United States Patent 9,572,897 (MODIFIED POLYNUCLEOTIDES FOR THE PRODUCTION OF CYTOPLASMIC AND CYTOSKELETAL PROTEINS) - sequence listing, part 3

SEQ ID NO: 1469 - DNA, 9411 bp, Homo sapiens
gagcccaaggtggtgtttgccaaggagcagccagtgcacagggaggtgcaggcccaggcgggggccagcaccacactcagctgcgaggtggctcaggcccagacggaggtgatgtggtacaaggacgggaagaagctgagcttcagctcgaaagtgcgcatggaggctgtgggctgcacacggaggctggtggtgcagcaggcgggccaggcggtcgccggggagtacagctgcgaggcggggagccagcggctctccttccacctgcacgtggcagagcccaaggcggtgtttgctaaggagcagccagcacacagggaggtgcaggctgaagcaggggctagcgccacactgagctgtgaggtggcccaggcccagacagaggtgacttggtacaaggacgggaagaagctgagctccagcttgaaagtgcatgtggaggctgcaggctgtacacggaggctggtggtgcagcaggcaggccaggcagacaccggagagtatagctgtgaggctgggggccagcagctctccttccgcctgcaagtggcagagcccaaggcggtgtttgccaaggagcagccagcgagcagggaggtgcaggctgaggcggggaccagtgccacgctgagctgcgaggtggcccaggcccagacagaggtgacgtggtacaaggacgggaagaaactgagctccagctcgaaagtgcgaatggaggccgtgggctgcacacggaggctggtggtgcaggaggcaggccaggcggacgccggggagtacagctgcaaggccggggatcagcggctgtccttccacctgcacgtggcagagcccaaggtggtgtttgccaaggagcagccagcacacagggaggtgcaggctgaggcgggggccagtgccacgctgagctgcgaggtggcccaggcccagacagaggtgacgtggtacaaggatgggaagaagctgagttccagctcgaaagtgcgcgtggaggccgtgggctgcacacggaggctggtggtgcagcaggcgggccaggcagaggccggggagtacagctgcgaggcagggggtcagcagctctccttccgcctgcaggtggcagagcccaaggcggtgtttgccaaggagcaggtggtgtttgccaaggatcagccggtgcacagggaggtgcaggctgaggcagggaccagcaccatgctgagctgcgaggtggcccaagcccagacggaggttatgtggtacaaggacgggaagaagctgagctccagctcgaaaatgcgtgtggaggccgtgggctgcacacggaggctggtggtgcaggaggcaggccaggcggacgccggggagtacagctgcgaggctgggggccagcggctctccttccatctgcatgtggctgagcccaaggtggtgtttgccaaggagcagccggcatgcagggaggtgcaggcggaggcgggggccagtgccacgctgagctgtgaggtggcccagggccagatggaggtgacatggtacaaggacgggaagaagctgagctccagctcaaaagtgcacatggaggccagcggctacacacggaggctggtagtgcagcaggcgggccaggcggatgctggggagtacagctgtgaggcggggggccaacggctgtccttccgcctgcacgtggcagagctggagccccaaatttcagagagaccctgccgcagggagcctctggtggtcaaggagcatgaagacatcatcctgaccgccacactggccacaccctctgcggccacggtgacctggctcaaggatggtgtggagattcgccgcagcaagcggcatgagacagccagccagggggacacccacaccctgaccgtgcatggcgcccaggttctggacagcgccatctacagctgccgtgtgggcgcagaggggcaggacttcccagtgcaggtggaagaggtggccgccaagttctgccggctgctggagcctgtgtgcggcgagctgggtggcacggtgacactggcctgcgagctaagcccagcgtgtgcagaggtggtgtggcgctgcggcaacacgcagcttcgggtgggcaagcgcttccagatggtggccgaggggcccgtgcgctcactcactgtgttggggctgcgcgcagaggacgcaggggagtacgtgtgtgagagccgtgatgaccacaccagtgcgcagctcaccgtcagtgtgccccgagtggtgaagtttatgtctgggctgagcaccgtggtcgcagaggagggcggcgaggccaccttccagtgcgtggtgtcccccagtgatgtggcagtcgtgtggttccgggacggtgccctgcttcagcccagcgagaagtttgccatatcacagagtggcgccagccacagcctgaccatctcagacctggtgctggaggacgcgggccagatcaccgtggaggctgagggcgcctcatcctctgctgccctgagggtccgagaggcgcctgtgctgttcaaaaagaagctggagccgcagacggtggaggagcggagctcggtgaccctggaggtggagctgacgcggccgtggccggagctgaggtggacacggaacgcgacggccctggcgccgggaaagaacgtggagatccacgccgagggcgcccgccaccgcctggttctgcacaacgtaggttttgccgaccgtggcttctttggctgcgagacgccggatgacaagacacaggccaaactcaccgtggagatgcgccaggtacggctcgtacggggcctgcaggcagtggaggcacgggagcagggcacggctaccatggaggtgcagctgtcgcatgcggacgtggatggcagctggactcgtgacggtctgcggttccagcaggggcccacgtgccacctggctgtgcggggccccatgcacaccctcacactctcggggctgcggccagaggatagtggccttatggtcttcaaggccgaaggagtgcacacgtcggcgcggctcgtggtcaccgagcttcccgtgagcttcagccgcccgctgcaggacgtggtgaccactgagaaggagaaggttaccctggagtgcgagctgtcgcgtcctaatgtggatgtgcgctggctgaaggacggtgtggagctgcgggcaggcaagacgatggccatcgcagcccagggcgcctgcaggagcctcaccatttaccggtgcgagttcgcggatcagggagtgtatgtgtgtgatgcccatgatgcccagagctctgcctccgtgaaggtacaaggaaggacatacactctcatctaccggagagtcctggcggaagatgcaggagagatccaatttgtagccgaaaatgcagaatcgcgagcccagctccgagtgaaggagctgccagtgaccctcgtgcgcccgctgcgggacaagattgccatggagaagcaccgcggtgtgctggagtgtcaggtgtcccgggccagcgcccaggtgcggtggttcaagggcagtcaggagctgcagcccgggcccaagtacgagctggtcagtgatggcctctaccgcaagctgatcatcagtgatgtccacgcagaggacgaggacacctacacctgtgacgccggtgatgtcaagaccagtgcacagttcttcgtggaagagcaatccatcaccattgtgcggggtctgcaggacgtgacagtgatggagcccgctcctgcctggtttgagtgtgagacctccatcccctcagtgcggccacctaagtggctcctggggaagacggtgttgcaggctggggggaacgtgggcctggagcaggagggcacggtgcaccggctgatgctgcggcggacctgctccaccatgaccgggcccgtgcacttcaccgttggcaagtcgcgctcctctgcccgcctggtggtctcagacatccccgtagtcctcacacggccgttggagcccaagacagggcgtgagctgcagtcagtggtcctgtcctgcgacttccggccagcccccaaggctgtgcagtggtacaaggatgacacgcccctgtctccctctgagaagtttaagatgagcctggagggtcagatggctgagctgcgcatcctccggctcatgcctgctgatgctggtgtctaccggtgccaggcgggcagtgcccacagcagcactgaggtcactgtggaagcgcgggaggtgacagtgacagggccgctacaggatgcagaggccacggaggagggctgggccagcttctcctgtgagctgtcccacgaggatgaggaggtcgagtggtcgctcaacgggatgcccctgtacaacgacagcttccatgagatctcacacaagggccggcgccacacgctggtactgaagagcatccagcgggctgatgcgggcatagtacgcgcctcctccctgaaggtgtcgacctctgcccgcctggaggtccgagtgaagccggtggtgttcctgaaggcgctggatgacctgtccgcagaggagcgcggcaccctggccctgcagtgtgaagtctctgaccccgaggcccatgtggtgtggcgcaaagatggcgtgcagctgggccccagtgacaagtatgacttcctgcacacggcgggcacgcgggggctcgtggtgcatgacgtgagccctgaagacgccggcctgtacacctgccacgtgggctccgaggagacccgggcccgggtccgcgtgcacgatctgcacgtgggcatcaccaagaggctgaagacaatggaggtgctggaaggggaaagctgcagctttgagtgcgtcctgtcccacgagagtgccagcgacccggccatgtggacagtcggtgggaagacagtgggcagctccagccgcttccaggccacacgtcagggccgaaaatacatcctggtggtccgggaggctgcaccaagtgatgccggggaggtggtcttctctgtgcggggcctcacctccaaggcctcactcattgtcagagagaggccggccgccatcatcaagcccctggaagaccagtgggtggcgccaggggaggacgtggagctgcgctgtgagctgtcacgggcgggaacgcccgtgcactggctgaaggacaggaaggccatccgcaagagccagaagtatgatgtggtctgcgagggcacgatggccatgctggtcatccgcggggcctcgctcaaggacgcgggcgagtacacgtgtgaggtggaggcttccaagagcacagccagcctccatgtggaagaaaaagcaaactgcttcacagaggagctgaccaatctgcaggtggaggagaaaggcacagctgtgttcacgtgcaagacggagcaccccgcggccacagtgacctggcgcaagggcctcttggagctacgggcctcagggaagcaccagcccagccaggagggcctgaccctgcggctcaccatcagtgccctggagaaggcagacagcgacacctatacctgcgacattggccaggcccagtcccgggcccagctcctagtgcaaggccggagagtgcacatcatcgaggacctggaggatgtggatgtgcaggagggctcctcggccaccttccgttgccggatctccccggccaactacgagcctgtgcactggttcctggacaagacacccctgcatgccaacgagctcaatgagatcgatgcccagcccgggggctaccacgtgctgaccctgcggcagctggcgctcaaggactcgggcaccatctactttgaggcgggtgaccagcgggcctcggccgccctgcgggtcactgagaagccaagcgtcttctcccgggagctcacagatgccaccatcacagagggtgaggacttgaccctggtgtgcgagaccagcacctgcgacattcctgtgtgctggaccaaggatgggaagaccctgcgggggtctgcccggtgccagctgagccatgagggccaccgggcccagctgctcatcactggggccaccctgcaggacagtggacgctacaagtgtgaggctgggggcgcctgcagcagctccattgtcagggtgcatgcgcggccagtgcggttccaggaggccctgaaggacctggaggtgctggagggtggtgctgccacactgcgctgtgtgctgtcatctgtggctgcgcccgtgaagtggtgctatggaaacaacgtcctgaggccaggtgacaaatacagcctacgccaggagggtgccatgctggagctggtggtccggaacctccggccgcaggacagcgggcggtactcatgctccttcggggaccagactacttctgccaccctcacagtgactgccctgcctgcccagttcatcgggaaactgagaaacaaggaggccacagaaggggccacggccacgctgcggtgtgagctgagcaaggcagcccctgtggagtggagaaaggggtccgagaccctcagagatggggacagatactgtctgaggcaggacggggccatgtgtgagctgcagatccgtggcctggccatggtggatgccgcggagtactcgtgtgtgtgtggagaggagaggacctcagcctcactcaccatcaggcccatgcctgcccacttcataggaagactgagacaccaagagagcatagaaggggccacagccacgctgcggtgtgagctgagcaaggcggcccccgtggagtggaggaaggggcgtgagagcctcagagatggggacagacatagcctgaggcaggacggggctgtgtgcgagctgcagatctgtggcctggctgtggcagatgctggggagtactcctgtgtgtgtggggaggagaggacctctgccactctcaccgtgaaggccctgccagccaagttcacagagggtctgaggaatgaagaggccgtggaaggggccacagccatgttgtggtgtgaactgagcaaggtggcccctgtggagtggaggaaggggcccgagaacctcagagatggggacagatacatcctgaggcaggaggggaccaggtgtgagctgcagatctgtggcctggccatggcggacgccggggagtacttgtgtgtgtgcgggcaggagaggacctcagccacgctcaccatcagggctctgcctgccaggttcatagaagatgtgaaaaaccaggaggccagagaaggggccacagctgtgctgcagtgtgagctgaacagtgcagcccctgtggagtggagaaaggggtctgagacccttagagatggggacagatacagcctgaggcaggacgggactaaatgtgagctgcagattcgtggcctggccatggcagacactggggagtactcgtgcgtgtgcgggcaggagaggacctcggctatgctcaccgtcagggctctacccatcaagttcacagagggtctgaggaacgaagaggccacagaaggggcaacagccgtgctgcggtgtgagctgagcaagatggcccccgtggagtggtggaaggggcatgagaccctcagagatggagacagacacagcctgaggcaggacggggccaggtgtgagctgcagatccgcggcctcgtggcagaggacgctggggagtacctgtgcatgtgcgggaaggagaggacctcagccatgctcaccgtcagggccatgccttccaagttcatagagggtctgaggaatgaagaggccacagaaggggacacggccacgctgtggtgtgagctgagcaaggcggcaccggtggagtggaggaaggggcatgagaccctcagagatggggacagacacagcctgaggcaggacgggtccaggtgtgagctgcagatccgtggcctggctgtggtggatgccggggagtactcgtgtgtgtgcgggcaggagaggacctcagccacactcactgtcagggccctgcctgccagattcatagaagatgtgaaaaaccaggaggccagagaaggggccacggccgtgctgcaatgtgagctgagcaaggcggcccccgtggagtggaggaaggggtctgagaccctcagaggtggggacagatacagcctgaggcaggatgggaccagatgtgagctgcagattcatggcctgtctgtggcagacactggggagtactcgtgtgtgtgcgggcaggagaggacctcggccacactcaccgtcagggccctgcctgcacgacactcaagatctgaagaccaaggaggcctcagaaggggccacagctacactgcagtgtgagctgagcaaggtggcccctgtggaatggaagaagggtcctgagaccctcagagatgggggcagatacagcctgaagcaggatgggacgaggtgtgagctgcagatccatgacctgtctgtggcggatgctggggaatactcatgcatgtgtggacaagagaggacctcggccacgctcactgtcagggccctgcctgccaggttcacagagggtctgaggaatgaagaggccatggaaggggccacagccacactgcaatgtgagctgagcaaggcagcccctgtggagtggaggaaaggccttgaggctctcagagatggggacaaatacagcctgagacaagacggggctgtgtgtgagctgcagattcatggcctggctatggcagataacggggtgtactcatgtgtgtgtgggcaggagaggacctcagctacactcactgtcagggccctgcctgccagattcatagaggatatgagaaaccagaaggccacagaaggggctacagtcacattgcaatgtaagctgagaaaggcggcccccgtggagtggagaaaggggcccaacaccctcaaagatggggacaggtacagcctgaagcaggatgggaccagttgtgagctgcagattcgtggcctggtcatagcagatgctggagaatactcgtgcatatgtgagcaggagaggacctcggccacgctcactgtcagggccctgccggccagattcatagaagatgtgagaaatcacgaggccacagaaggggccacagctgtgctgcagtgtgagctgagcaaggcggcccccgtggagtggcggaaggggtctgagaccctcagagatggggacagatatagcctgaggcaggacgggacgaggtgtgagctgcagattcgtggcctggctgtggaggacactggagagtatttgtgtgtgtgcgggcaggagagaacctcagctacactcactgtcagggccctgccagccagattcatagacaacatgacaaaccaggaggccagagaaggggccacggccacactgcactgtgaactgagcaaggtggcccctgtggagtggaggaagggacctgaaaccctccgagatggggacagacacagcctgaggcagga

SEQ ID NO: 1470 - DNA, 4883 bp, Homo sapiens
taaagcccacgtcatgttcttcctttactgcagggcctcttaatggggcttaaaacctaggatgggttaagtaaacaatgtaggtgagtttagtgtgcaaacagctgaaatcaccggctgcattttaagctcgtctacagcagcaacctgcagacacctattcagagagattactaaattccctccttcccattaataaaaaggaccagaatatcagtctacaaaagacactgcgttgctgcgaaccagctctcgcttgcgcgatcaggaagaagggcggcaaggctggagcctcgggaccggagaaaggcagcctgcttgtgacgtcaaatcagcggactcttatcttggctttaggccggttccggttccccggctttccgggcgcgagcgtgtgcgagcgcggcagcgtactgcgcgtgctccgcagagggacacgggaaggttgggtccggctctggaggagatgcgtgattggctgacgctgtgctcgggggttccctggccctttcggcaggggtaaaacaataagagggggcggtggcaaagggggcgggacgtccgtggtccttgtcgcacgtcgcagcgcctggcgcccgggaagaggtggttgtgaggcagacgaactcgcggctctccggcttccgaggcttccgagttgtcggaggaagggggcggcgagcaataagaacccgccgcacccggtcctcagcgactcttctgacctccgcgcgacgtacccgccgccgccgttggctggagcatttgacattgtgcagcaaagaaatggttatggagaagcccagtccgctgcttgtagggcgggagtttgtgaggcaatattatactttgctgaataaagctccggaatatttacacaggttttatggcaggaattcttcctatgttcatggtggagtagatgctagtggaaagccccaggaagctgtttatggccaaaatgatatacaccacaaagtattatctctgaacttcagtgaatgtcatactaaaattcgtcatgtggatgctcatgcaaccttgagtgatggagtagttgtccaggtcatgggtttgctgtctaacagtggacaaccagaaagaaagtttatgcaaacctttgttctggctcctgaaggatctgttccaaataaattttatgttcacaatgatatgtttcgttatgaagatgaagtgtttggtgattctgagcctgaacttgatgaagaatcagaagatgaagtagaagaggaacaagaagaaagacaaccatctcctgaacctgtgcaagaaaatgctaacagtggttactatgaagctcaccctgtgactaatggcatagaggagcctttggaagaatcctctcatgaacctgaacctgagccagaatctgaaacaaagactgaagagctgaaaccacaagtggaggagaagaacttagaagaactagaggagaaatctactactcctcctccggcagaacctgtttctctgccacaagaaccaccaaaggctttctcctgggcttcagtgaccagtaaaaacctgcctcctagtggtactgtttcttcctctggaattccaccccatgttaaagcaccagtctcacagccaagagtcgaagctaaaccagaagttcaatctcagccacctcgtgtgcgtgaacaacgacctagagaacgacctggttttcctcctagaggaccaagaccaggcagaggagatatggaacagaatgactctgacaaccgtagaataattcgctatccagatagtcatcaactttttgttggtaacttgccacatgatattgatgaaaatgagctaaaggaattcttcatgagttttggaaacgttgtggaacttcgcatcaataccaagggtgttgggggaaagcttccaaattttggttttgtggtttttgatgactctgaaccagttcagagaatcttaattgcaaaaccgattatgtttcgaggggaagtacgtttaaatgtggaagagaaaaaaacaagagctgcaagagagcgagaaaccagaggtggtggtgatgatcgcagggatattaggcgcaatgatcgaggtcccggtggtccacgtggaattgtgggtggtggaatgatgcgtgatcgtgatggaagaggacctcctccaaggggtggcatggcacagaaacttggctctggaagaggaaccgggcaaatggagggccgcttcacaggacagcgtcgctgaagctccactgttggcaaagtcttggcagtggtacattattcatcgtgtttgcattcttgttaattttttttttggctttggaatgtgacacagcctttttgatcatttctttgatgtgaaaagcatctttggttatcagttaaattgaggtggacattatttccccaatttcacaacaggattcacattgttaatttataaatctagacttggagaattaaggactgagaaatgaccatatcttaaactatctacgacaaagtgaacttaaaaggacatgcccactgaattcaggtcctttgagtaaaaaaaaaatcttctgctgcacattttgtttaagtgttactgtttctgcctgttaatgctgggaacacaaatagtgcaatttgtgcaattggagaatcttgccttttttcttggctccccccaaaaatacaaaccaacagaaacttgttatgcactcatcaaaatgtactaatgggtactctgaactcattaacattgacatctgcaacaggaggcaacagggaaaaaatctcatcttcttttccagtagaaaatagtttgtgaaatgatgagggcattttatctgcttgctgtgaccagcgtgtgtacacataaaccttaacaagactacaagtatattccagaaggaaatcattttagttatgaactaaataataaaaattagaacttcaaatgcgatggtcttgactattagaccagatttagtagctccatatctaagatttttctacctgcccctcttcagtacagggatggctggctgctcaacacactcctcctccccttttttcctttctttaagctgtgtacagtgaaaattgtctttactgtatttttgttctctggtaatgtaataagcatgatggtgccttctattaatacatcattccagtcttgctggtaattttgtacagtatagtgtatgaattgctgtgctgcaaagccaaacagctgcaaaatgttgaaaaatcatcgaaatgtataaaaattgcagtatctttaaaatcagtaaaatggactagcatattatttatcttgttcttcagttaacaactttgtgttctctgtgggagggagggagtcctgtgtgtttgtggggagagggaaggaggaagtcagttatttgagtaagcctctagttgacttttctcttagcctgaatgtggacgttgaaacatatcacttcagggcttggaaaagtcagtcaacttgacgtacatttttagtgacattttaaaagcagtcagattctataaatggcaagtaagcctgaagtgaggatactgcaattttcggagaaaagaacagcagctctttaagtgtttgcattttctatttggggggcagggaactgtcattcattttgcacaattcttgaactgatgtcagcacccgagtggctcctgaatttaagtctgggacgacatcttttatttttacatgaatctttaaacaattctgtgagcaaagtttgtagctgctggattattgtctgtctttatagcaagttccagtaaaccacaagtatggcaaagcttatccaattttatgcttggagcagtcagtacataccagtttctgatgtttcaggcaggagtggggtaaataagtgtgaccacttaaagctgctcgttagcatggaagacttctccattctatctttgtaaaacagacaagatatgcacttgacatagtagcaaattggttctgaattatgcaactgtttgctatttagtaaactagcaaatgatgcatgtattttgtttttcatgtactgggcaatatgagtaaaatctgtccctttttccccctttgaatgaggtcttccatgtttgagggaaagtcttgcactattgcatatattttggggacacagattttcatagtttccatttttggggggcttaaggattttttttttttctgtttgaaacagttttatactttctgatatagtacttgaaattcttaccagaaaattactttggagttttgaagcctttattaatactacttttaaagaagcagttgttttattgtcaatgttttttttcccccaagcatattttcttgtatttctgtttccatatatatatatatatatataatttccaattcaggatattgccctgccatccatgaaaactgttctggcaccaaaagtaatgacaaatgttaagtgtaataatagaaaagtagagcaaagagccattcagcttcagtctttacataccatgaataaaacattaaaacatcatatggagaagtttacatggtgattgttcacctgcagtactgtggagttttaacattttgtcctcttttcagtgaaacagagtaaaaatattcatctaccattactgttatttgctgattttgttttattttttgatggtaatattctatccttatgacactattgcaaccaaattggctttaccatcttggctttagtaggtatagaagacaatggattaccatctttattgctgtaatgtgttaagcattatatgctagtagaatctagtttaattgtttcaggtggaaagtattctttgagtttccatattgaatgtgtttggactaaacaaacaataaactactgatgtctgcagcattta

SEQ ID NO: 1471 - DNA, 818 bp, Homo sapiens
gcggcggcggcaccatgagcggccggaagcgcagcttcaccttcggggcctacggcggggtggacaagtccttcacttctcgccggagtgtgtggaggagcgatgggcagaaccagcacttccctcaggcactagacctgtcacgagtgaacttagttccctcctatactccttcactctaccctaagaacacagatctatttgagatgattgagaagatgcagggaagcaggatggatgaacaacgctgctccttcccgccgcccctcaaaacagaggaggactacattccatacccgagcgtgcacgaggtcttggggcgagaaggacccttccccctcatcctgctgccccagtttgggggctactggattgagggcaccaaccacgaaatcaccagcatccccgagacagagccactgcagtcgcccacaaccaaggtgaagctcgagtgcaaccccacagcccgcatctaccggaagcactttctcggcaaggagcatttcaattactactcactggacgctgccctcggccaccttgtcttctcactcaagtacgatgtcatcggggaccaagagcacctgcggctgctgctcaggaccaagtgccggacataccatgatgtcatccccatctcctgcctcaccgagttccctaatgttgtccagatggcaaagttggtgtgtgaagacgtcaatgtggatcggttctatcctgtgctctaccccaaggcttcccggctcatcgtcacctttgacgagcatgtcatcagcaataacttcaagtttggcgtcatttatcagaagcttgggcag

SEQ ID NO: 1472 - DNA, 2965 bp, Homo sapiens
gcactccaggagcagccgcgccgctgctcacccgccctgtagtccgctccccccagggccgtccccgttttaagaaatggggtgatggggcgtccctacccggcgcctgcaggggctcctggggagcgcgccggtggctcgctgctcccgggtggggcgcggggctggcgctcgagggtgccgtggcccaggcggggctgcagcgagtgtgttccccgttccgcgcgcgtgaagcgtgggagcgaagcctcgggggagggcgggagcgcggctgagctcactgtgaacacccggctgggtagtcccgcgagcaggggaggggccggaaccgatgtgtatgcggagaggtcgcagtcattgctgtgagcaggacacagtggcggctgacctgggagaagttacagagggacggggtgggagagggacgaggagtcgggaatggcccccaggctctcgtcctgagcggtcggctggacgtggggcgccactgaccaccgtggagaagcccgggggaggggaggtgctttctggctgcacactgacctatgttggggtgcccagggcaggatgtacacgctgctgtcgggcttgtacaagtacatgtttcagaaggacgagtactgcatcctgatcctgggcctggacaatgctgggaagacgaccttcctggagcagtcgaaaacccgatttaacaagaactacaaggggatgagtctatccaaaatcaccaccaccgtgggcctaaacatcggcactgtggatgtgggaaaggctcggctcatgttctgggacttaggagggcaggaagagctgcagtctttgtgggacaagtattatgcggagtgtcacggcgtcatctacgtcattgactccaccgacgaggagaggctggctgagtccaagcaggcgtttgagaaggtggtgaccagcgaggcgctgtgcggtgtccccgtcttggtgctggccaacaagcaggatgtggagacgtgcctctcaatccctgacatcaagacggccttcagcgactgcaccagcaagatcggcaggcgagattgcctgacccaggcctgctcggccctcacaggcaaaggggtgcgcgagggcatcgagtggatggtgaagtgtgtcgtgcggaatgtgcaccggccgccgcggcagagggacatcacgtaggcgcagccgcgctgccgtcgggacggctggtcccctggtgctggaggagtggcctcctgttggctcccatgctgctgatctggggggtgggtttgctttgctttggggttcttctatttactttgttttctcgaagacaaactttcctctatgtctggaaaagcgtaggcatccggaggctttggaggggagtctggcagcccggctggcccaggccctgcagcggcagcctttccacagggcgcagcggcggcctttcgaggccctttctggggggtctgagggagacctggttgggaattggggctccagtgctcaggctggcttgggctgcatgaggacagccctgtgggaccctcgggagaccccgtggctgtctccgccccatcgaggaggaggcccgtcagccatggctgccatctggcttctgccctgtgaccccgtgaccccgtgaccccgaagtggtctggggctgatcttgccttgaggaagacccaggccatgttcccaaaggccagcgggggccctggattgtgatgcagcctcgggacagggctgaggcctgcgggggaagacctataccccacgcctgggcctggcttcacctcaccctaatcccccgggagggagctgactgatgcaaaaagctgagggggcctgctgggagtggctgtttttatgccccagccccgcaagttggggagtgtttgtgggggtccagagccctcccccagccaggagagaacctcccggaggggttctctgtggggccctgtgtcccctgctcgggagtaaggctggtcctggggtcctccctgcacggaccccactgggcctgccgagtgctgtgttcttcctcagtctggctgtgggcaggagcggcctgcccagtgtcacccagggtgagtgcaaaataaagacggcgagtgtggctctgtccatcccttccctcctggagggtggaggctcctggctgttggacacggtgatggtgttactgggctgctcaggggctggtgggcaggtgaggggctccccaggtgggcctggagagtccaggcactcccttcctgcggatgtgggaaggacatggggtcctgggaggagctgctgggaaggggcatgagtcagggtgggggtggcgcagcagctgcggggctgtgactcacaggagtcgggccctggaagtccccgcgtcctctccaggggaccctgtgtgtgttctgcaggttggttcccaggacctgggggggacctccagccccgggaacctggccgtgctggggaggcgagtggctggtgcagccccccggttgctctgggtgcatcgggaggcttcagagcctgccccagagagggagaagcttcacttcccggaaagcatgggaggcctggaggaggtctttggcaggtcccctctcgggaaatcccctgtgagttgggagtgggaggaattcataagtggggggttagtgtgggccccggcgactagggctggcctgagccccatcctgttcttccagcaatgataccctcccaggccctgaccctcgctgagcttcaggggcccctgccacgtgccacagccactgggggcagaggtggcactccccactgatcctcccagggagggtctgtctgaggtaggggaagccccgggcagcagttctgatggcaggcagcctgagggatctgggcacagcgggcggctcaggtgtccccggctgccctcccagtagctgtgcaactacaaccagttttatgaaaaagctttataaaaataagctttaag

SEQ ID NO: 1473 - DNA, 2209 bp, Homo sapiens
agcagacaagatggcttccgggatttggcggcgcctttgtctctcgctgcagccggagctccaggtctcgctttcattgctctgtgtcctctgctcctagaggtccagcctctgtgggcctgtgacctgcagaaattgagagatccacagctaagactccaggaccccctggaagcctagaaatgggactgttgacatttagggatgtggccatagaattctctctggaagaatggcaatgcctggacactgcacagcggaatttatataaaaatgtgattttagagaactacagaaacctggtcttcctgggtattgctgtctctaagcaagacctgatcacctgtctggagcaagaaaaagagcctttgactgtgaagagacatgagatggtgaatgaacccccagtaatgtgttctcattttgcccaagagttttggccagagcagaacataaaagattcttttgaaaaagtgacactgagaagatatgaaaaatgtggaaatgataattttcagttaaaaggctgtaaaagtgtggatgaatgtaagttgcacaagggaggttataatggacttaaccaatgtttaccaactatgcagagcaaaatgtttcaatgtgataaatatgtgaaagtctttaataaattttcacattcagatagacataagataaaacatatggaaaataaacctttcaaatgtaaagaatgtggcagatcattttgcatgctttcacacctaactcgacatgaaagaaattataccaaggtgaatttctgcaaatgtgaagaatgtgaaaaagctgttaaccaatcttcaaagcttactaaacataaaagaatttatacttgtgagaaactctacaaatgtcaagaatgtgacagaacttttaaccaattctcaaaccttactgaatataaaaaagattatgctcgagagaaaccatacaaatgtgaagaatgtggcaaagcctttaaccagtcctcacaccttactacacataagataattcatacaggagagaaaccctacaaatgtgaagaatgtggcaaagcctttaaccagttctcaaatcttactacacataaaaaaattcatactggagagcaaccctacatatgtgaagaatgtggcaaggcttttacccaatcctcaacccttactacacataagagaattcatactggagaaaaaccctacaaatgtgaagaatgtggaaaagcttttaaccgatcctcaaaacttactgaacataaaaacattcatactggagagcaaccctacaaatgtgaggaatgcggcaaagcttttaaccgatcctcaaatcttacggaacataggaaaattcataccgaagagaaaccctacaaatgtaaagaatgtggcaaagcttttaaacactcctcagcccttactacacataagagaattcacactggagagaaaccctacaaatgtgaagaatgtggcaaagcttttaaccgatcctcaaaacttactgaacataagaaacttcatactggaaagaaaccctacaaatgtgaagaatgtggcaaagcttttatccaatcctcaaaacttactgaacataagaaaattcattctggagagataccctacaagtgtgaagaatgtggcaaagcttttaaacactcctcatcccttactacacataaaagaattcatactggggagaaaccctacaaatgtgaagaatgtggcaaagcttttagccgatcctcaaaacttactgaacataagataattcatactggagagaaaccctataaatgtgagagatgtgacaaagcttttaaccaatctgcaaaccttactaaacataaaaaaatacatactggagagaaactacagaactggaatgtgtgataatgattttgacaacacctcaaatttttctaaatataaaggaaatcatactggtgaaaaattctagaaatgtaaagaatgtgtcaaagactttaaatggttttcacacttcattgtatgtaagataattcatactggagaaaactacaagtgtgaagaatttggcaatactgttaattaaggctcaaaccttattgcacaggaaagcgtttatacttaagaaaaattgtacaaatataaagagtgtaaaatagccattaatatctgttgacatcttaatatcagaatgttggtacttaataaaagcattataaatgcaa

SEQ ID NO: 1474 - DNA, 2515 bp, Homo sapiens
aaaatggatcctcacttcttcacttggatataataatatagactgccgacattctgggaactgatcagtcttccagcttccagtgtggtgccctccctcaattgtgctgagtgtcccccaatccagagatattctgtaatttcttcctcagaaagaaacaaaacaaaattctgatcttcccagatgaagataatggattctgaattaatgcatagtatagtaggaagctatcataaacctccagaaagagtatttgttccctcattcacccagaatgaaccatctcagaattgccatcctgcaaacttagaagttacctctcctaagatacttcatagcccaaatagccaagctcttattttagccttaaaaactcttcaggaaaaaattcatcgtttagagctggagagaacacaagctgaagataacctgaacattctttccagagaagcagcacagtataagaaggccttagagaatgaaacaaatgagagaaatctggcacaccaggagctgataaagcagaaaaaagatataagtatacagttaagctcagcccagtctcgttgtactcttctagagaagcaactagaatatacaaagagaatggttctcaacgtagagcgagaaaagaacatgatcctagaacaacaggcccagcttcagagggaaaaagaacaagatcagatgaagctgtatgcaaaacttgaaaagcttgatgtcttagaaaaagagtgtttcagacttacaacaactcagaaaactgctgaggacaagattaaacatttagaagaaaaacttaaggaagaagaacatcagcgtaagctatttcaagacaaagcttctgagcttcaaactggacttgaaatcagtaaaattataatgtcttcagtttcaaatctaaagcactccaaggaaaagaagaaatcttcaaagaaaactaaatgtataaagagacgaccaccttggcaaatttgttcaaagtttggagcactgccttttgtggctgaaaagatgaggcaacatcgtgacccacatatccttcagaaaccttttaacgtgactgagactagatgtctccccaagccttctagaacaacttcctggtgtaaagctattcctcctgactcagaaaagtccatttccatttgtgacaatttatctgaacttttgatggcaatgcaagatgagctggaccaaatgagcatggagcaccaagaactactgaaacaaatgaaggaaactgaaagtcattcagtctgtgacgacatagaatgtgaactagagtgtttactcaagaaaatggaaattaaaggagaacaaatctccaaactgaagaagcatcaagacagtgtctgtaaactgcagcaaaaagttcaaaactcaaagatgagtgaagcttcaggtattcagcaagaagacagctaccctaaaggatcaaagaacataaaaaatagccccagaaaatgtttgactgacactaacctttttcagaaaaacagcagctttcatccaatacgagttcataatcttcaaatgaaattgagaagagatgatatcatgtgggaacagtaacaaaacagcaaaactgtcaccttaatgaactttgtcagtgagaccttgaattgtctaaagtggttttaatttaatataactttgtgacattttgaatcatgtttctagtttctataaaacatgaagttgcagtatttaaaaattaatgcctaatgacctggtgggttccaaataataaattaattgcttttttatttttcttattgattgaagcccgtaacctcatcttgtcttagaaacattgttggctttgcagatatcttaagctaaatttaagaaattgtactagattgacaatattcaaaattgagttaaatccaagctacaagtaccattcattccacttttcatttagtaggtttggaaccttaaaaaccaatgttcaatgaacagagttcagaaagatcatttagctttcctggtgccttctttctattttgttttagagctgtgaaatgtttttctcttttggaaaaggaaaaacttaatagttacacagttttgtgaagaagcctttaatccaagttttatgagacagtaggaacctatagctacttaatttttaggagacagtaattcagttgcagaagctttcctctgctattcccattctcttttacaaaactagttttttttaaaaaatcaatgatcaattttatcttactactttataacttttgctgacttttattctttgcattgtatgtaatgtccatcagtataaattgagactgtgaatttctaggacccacaaaagtggtattttttttttgtacaagaaagtatagaggaagaggaagctgggcattaaattacctcatccagcagaaattcacggtagtatggtatatttttattttttatattttaaaatcaataatgtcaaatgtcattgtgtatgcatgctttataataaatttacacttgatcatttttctgg

SEQ ID NO: 1475 - DNA, 2475 bp, Homo sapiens
agcaagggaagtgacaggaaatggagctggggagacaaaaatgtggataacaacaaaagaatttcaacaggtaaaaaaatgagtcaaacatctctcaaacagaaaaagaatgagcctggaatgaggtcctcaaaagagagtctagaagcagaaaaaagaaaggaatctgacaaaacaggagttcgtctgagcaatcagatgaggcgtgcagtcaatccgaatcactcgctgagatgttgccccttccagggtcactcgtcgtgtagacgctgcctttgtgcagctgagggaacagcccttggcccctgccacacaatacgtatttatattcacatgtgcctgttgtgggagcagggccagcagatcaccatgatgaggggatcacaagaatcatcactgcggaagacagactctcgagggtaccttgtgcgcagtcaatggtctagaatatcccggagcccatccaccaaggctccatccatagatgagcctagaagcaggaacaccagtgctaagctccccagcagctccacgagctcccggactccatccacctccccaagcctgcatgactcctcaccgccgccgctgtccgggcagccctcgctccagccacccgcgtcgccccagctgccccggtcgctggactcgcggcctcccacgcccccagagcccgatcctggctcccggcgcagcaccaaaatgcaagagaatccggaggcctgggcccaaggcatcgtgcgggaaatccgccagacccgggactcgcagccgctggaatattcgcgcacgtcccccaccgagtggaagtcctccagccagcgcagggggatctaccccgcctccacccagctggaccgcaactctctgtccgagcagcagcagcagcagcgggaggacgaggacgactacgaggctgcctactgggcatccatgaggtcgttctacgagaagaacccgagctgctcgcgcccctggccgcccaaacccaagaacgccatcaccattgctctctcatcctgcgcgctcttcaacatggtggacggcaggaaaatctacgagcaagagggtctggaaaagtacatggagtatcagctcaccaatgagaacgtcatcctgaccccgggcccggcgttccgcttcgtcaaggcactacagtatgtcaatgctagactccgtgatctatatcctgatgaacaggacttatttgatattgtactgatgactaataaccatgcccaagtgggagtgcggcttataaacagcgtcaatcactacggcttactgattgaccgcttctgtctgaccgggggaaaagaccccattggctatttgaaggcatatcttaccaacttgtatattgctgcagattctgaaaaagtgcaagaggcaatacaagaaggtattgcctctgcgacaatgtttgatggagccaaagacatggcttactgtgacactcagctccgtgtagcctttgatggggatgctgtcctcttctctgatgagtctgaacattttaccaaggagcatgggctcgacaaattcttccagtatgatacattatgtgaaagtaagcctcttgctcagggtcccctaaaaggctttctggaagatttaggcagactgcaaaagaagttctatgccaaaaatgaacggttactttgtcctatcaggacctacctggttacagctaggagtgcagccagttcaggcgcccgtgtgctgaagacccttcgacgctggggtctagagatagacgaagctcttttccttgctggagcccccaaaagtcccatcttggtgaagatccggccccacatcttctttgatgaccacatgttccacattgaaggggcacagaggttaggttccatcgcagcttatggctttaataaaaaattcagtagttaggggcagggaggagaaataaagtggtgatagtctggtgttacagaagccacttcttttggctctctaggataattagataggtatttcagaaaattggaccttaaaactttgcttctttggaaaggttttctcctgattttttggaaaaccttttgaaccctcaagttaccatcaaactacttctctttgaactaccaatactgttgaatgccattacacctatctctgtgtaagtcataatgatgactctttaggataagtttagaacttgaatatttgcatgcttaaggcactgttttagaagcttacttagttttataaacactgctcatttttggatgtttgtagataacaatgaattgttacccatcagcattgtagaatagtgtcttcaaaggtagaaggagtatggttaagcacactcttgaaaactggagctttgtattctgtgactgctatggctagctttgtaaccaaagcaaaatgagaatttcactctacctgcatgagtataacaattttgatactgctcatttagaaataaatcatctggttgttcctcca

SEQ ID NO: 1476 - DNA, 1838 bp, Homo sapiens
gctgggctgggcttgctgaggtagaggcagcgccaagaagaggcctttgccgctggtcgggattgggatgtcgaagaacacagtgtcgtcggcccgcttccggaaggtggacgtggatgaatatgacgagaacaagttcgtggacgaagaagatgggggcgacggccaggccgggcccgacgagggcgaggtggactcctgcctgcggcaaggaaacatgacagctgccctacaggcagctctgaagaacccccctatcaacaccaagagtcaggcagtgaaggaccgggcaggcagcattgtcttgaaggtgctcatctcttttaaagctaatgatatagaaaaggcagttcaatctctggacaagaatggtgtggatctcctaatgaagtatatttataaaggatttgagagcccgtctgacaatagcagtgctatgttactgcaatggcatgaaaaggcacttgctgctggaggagtagggtccattgttcgtgtcttgactgcaagaaaaactgtgtagtctggcaggaagtggattatctgcctcgggagtgggaattgctggtacaaagaccaaaacaaccaaatgccaccgctgccctgtgggtagcatctgtttctctcagctttgccttcttgctttttcatatctgtaaagaaaaaaattacatatcagttgtcctttaatgaaaattgggataatatagaagaaattgtgttaaaatagaagtgtttcatcctttcaaaaccatttcagtgatgtttataccaatctgtatatagtataatttacattcaagtttaattgtgcaacttttaacccctgttggctggttttttgttctgttttgttttgtattatttttaactaatactgagagatttggtcagaatttgaggccagtttcctagctcattgctagtcaggaaatgatatttataaaaaatatgagagactggcagctattaacattgcaaaactggaccatatttcccttatttaataagcaaaatatgtttttggaataagtggtgggtgaataccactgctaagttatagctttgtttttgcttgcctcctgattatctgtactgtgggtttaagtatgctactttctctcagcatccaataatcatggcccctcaatttatttgtggtcacccagggttcagagcaagaagtcttgctttatacaaatgtatccataaaatatcagagcttgttgggcatgaacatcaaacttttgttccactaatatggctctgtttggaaaaaactgcaaatcagaaagaatgatttgcagaaagaaagaaaaactatggtgtaatttaaactctgggcagcctctgaatgaaatgctactttctttagaaatataatagctgccttagacattatgaggtatacaactagtatttaagataccatttaatatgccccgtaaatgtcttcagtgttcttcagggtagttgggatctcaaaagatttggttcagatccaaacaaatacacattctgtgttttagctcagtgttttctaaaaaaagaaactgccacacagcaaaaaattgtttactttgttggacaaaccaaatcagttctcaaaaaatgaccggtgcttataaaaagttataaatatcgagtagctctaaaacaaaccacctgaccaagagggaagtgagcttgtgcttagtatttacattggatgccagttttgtaatcactgacttatgtgcaaactggtgcagaaattctataaactctttgctgtttttgatacctgctttttgtttcattttgttttgttttgtaaaaatgataaaacttcagaaaat

SEQ ID NO: 1477 - DNA, 5740 bp, Homo sapiens
aaacaccatgccctgccatctctgggtcttagagtcaccctaacatctgatctagattaattatcatcatgtgcgaggttttggcatgaagcacgccaggctcaccgtttcatgatcttagactatttacagcaaactcaaacagctcacttgctttttacaccctgcaaagaccaagggagagcctggaggggttgttttttttttctgttttattctatcaaagcagcaaatactgcaatttccacagtaaatggtcacagtggggaccaatatcctgccctccagacccgctgcttcagccaatacagcaagggaagacgcagctctgttttctagaaggatcccaccgaggcataaaaacggcgcagcccagcctggcgccgcgccgggtcccggagccccgggcgcgaacatggggaatgcgcactccaaaagcggggacaggcacagcgcgctccccggccgccccgagctgtctttttacggctctttccccaggaaatggagcgagaacgtcttcttggataacgagctgctgacctccaagatcctgtctgtgctgcggccgcagtcggagcggggcttccgcgccggggacctccgctacccgacccactttctcagcaccaactctgtccttgcctctgtcacagcctcgctcaaggagcacccccggggcaccctcctgtccgatggcagcccggccctgtccaggaatgtcggtatgacggtctctcagaaagggggtccccagccaacaccgagcccggctggccctgggacgcaactcggaccaatcacaggagagatggatgaagccgattctgcgtttttaaaatttaagcagacagctgatgactctctgtcccttacatctccaaacaccgagtccatttttgtagaagatccctacaccgcctcgctgaggagtgagattgagtcagacggccacgagtttgaagctgagtcctggagcctcgccgtggatgcagcctacgccaagaagcaaaagagggaggtggtgaaaagacaagatgtcctttatgagctgatgcagacagaggtgcaccacgtgcggacgctcaagatcatgctgaaggtgtactccagggccctgcaggaggagctgcagttcagcagcaaggccattggccgcctcttcccatgcgctgacgacctgctggagacgcacagccacttcctcgctcggctcaaggagcgccgccaggagtccctggaggagggcagtgaccggaattatgtcatccagaaaatcggcgacctcctggttcagcagttttcaggtgaaaatggggagagaatgaaagaaaagtacggtgtgttttgtagtggccacaatgaagctgttagtcattacaagttgctgcttcagcaaaacaagaaatttcaaaacttgatcaagaaaattggcaacttctccatcgtgcggcggcttggcgtgcaggagtgcattctcctggttacacaacgcataaccaaatacccagtgctggtggagcgcatcatccagaacacggaagctggcactgaggactatgaagacctgacccaggccttgaacctcatcaaagatatcatctcacaagtggacgccaaggtcagtgagtgtgagaagggccagcgcctcagggagatcgcagggaagatggacctgaagtcttccagcaaactcaagaacgggctcaccttccgcaaggaagacatgcttcagcggcagctccacctggagggcatgctatgctggaagaccacatcagggcgcttgaaagatatcctggctatcctgctgaccgacgtacttttgctgctacaagaaaaagatcagaaatacgtctttgcttctgtggactcaaagccacccgtcatctcgttacaaaagctcatcgtgagggaagtggccaacgaggagaaagcgatgtttctgatcagcgcctccttgcaagggccggagatgtatgaaatctacacgagctccaaagaggacaggaacgcctggatggcccacatccaaagggctgtggagagctgccctgacgaggaggaggggcccttcagcctgcccgaagaggaaaggaaggtggtcgaggcccgcgccacgagactccgggactttcaagagcggttgagcatgaaagaccagctgatcgcacagagcctcctagagaaacagcagatctacctggagatggccgagatgggcggcctcgaagacctgccccagccccgaggcctattccgtggaggggacccatccgagaccctgcagggggagctaattctcaagtcggccatgagcgagatcgagggcatccagagcctgatctgcaggcagctgggcagcgccaacggccaggcggaagacggaggcagctccacaggcccgcccaggagggctgagaccttcgcgggctacgactgcacaaacagccccaccaagaatggcagtttcaagaagaaagtcagcagcactgaccccaggccccgagactggcgaggccccccaaacagcccggacttgaagctcagtgacagtgacattcctgggagctctgaggaatcgccgcaggtggtggaggcgccaggcacggaatccgatccccgtctgcccaccgtcctggagtcggagcttgtccagcggatccagacactgtcccagctgctcctgaaccttcaggcggtaatcgcccaccaggacagctatgtggagacgcagcgggctgccatccaggagcgggagaagcagttccggctgcagtcgacgcgtgggaacctgctgctggagcaggagcggcaacgcaacttcgagaagcagcgggaggagcgcgcggccctggagaagctgcagagccagctgcggcacgagcagcagcgctgggagcgcgagcgccagtggcagcaccaggagctggagcgtgcgggcgcgcggctgcaggagcgcgagggcgaggcgcggcagctacgcgagcggctggagcaggagcgggccgagctggagcgccagcgccaggcctaccagcacgacctggagcggctgcgcgaggcccagcgtgccgtggagcgcgagcgggagcgcctggagctgctgcgccgcctcaagaagcagaacaccgcgccaggcgcgctgccgcccgacacactggccgaggcccagcccccaagccaccctcccagcttcaacggggaagggctggagggccctcgtgtgagcatgctgccatccggcgtggggccagagtacgcagagcgccccgaggtggctcgccgggacagcgcccccaccgagaaccggctggccaagagcgatgtgcccatccagctgctcagcgccaccaaccagttccagaggcaggcggccgtgcagcagcagatccccaccaagctggcggcctccaccaagggtggcaaggacaagggcggcaagagcaggggctctcagcgctgggagagctcagcgtccttcgacctgaagcagcagctgctgctcaacaagctcatggggaaagatgagagcacctcacggaaccgccgctcgctgagccctatcctgcccggcagacacagtcctgcgcccccaccagaccctggcttccccgccccgagcccaccgccagctgacagcccctccgagggcttctctctcaaggccgggggcacagccctcctgcccgggcccccagctccctcgccactgccggccacaccactcagcgccaaggaggacgccagcaaagaagacgtcatcttcttctaaaagggccgtgactcaaggaaagtttttaatggaaagttgagccagaactaaaccagggagctgtctgaaatcatagcaccccatccgggtggcggggagatcaactccgagctgtttttccgaggcagtgaggaacggtgccggctctgcacggagctgaggacaggacagaccttgctttgagaaggagctgccggccggggccacgctccacagccgccgcgcgacagtggagccaagggttagggcaccaggaggggccaggtggcgtcggcagcatctgtccccagaatcaggcagaatccacttcccaaacagagccccacgcaggttcaccatgaacctcagggtcagggaatgagccaggcacgggggcatgggcagagagggccacggggcagggcccactgagggaacatcagtggccctccagtcaggttctgtgggtttggaagcccatcgtgaaaggggctgacctttgcccctttttacttggcattggttttgaaaccagctgtttcccaaactctgcttcccaagggcaaccgttgctgttcacacgctcagcctgtctgggggagcgggcctctagcttcagccagggcgggtacacaccctgggcacagggtcctcagcccccgggaaatgagctcccagggctggcgtcccaccttccaggtgggggctggcacatcacagactgtcgagagcgccatgtcccagggcatgcagaggatgcacctagagacgttgcagcaagtggacaagtggccgctgtgcgggcccctcgcttgtagtgagctgttgcagcttacggtccgttccctggaggggtggaggaaggaggtgttgggcagcatcaaaggtgctgggacatcccagggtggtgagatccatccacgatccagctccggtggagaaagggcccatgtcaagccttgttctgcaccccaagcattggtggtaggactgggtcctggctgatcgtccttgttcccagtggggtacatgtgagcccctgccagggccaagtccttctcccgaacccagggtcctgggaactgcagatcccggggggattcagcccttctcccactgtgctggcagaggcactcctgtgacgctgaatacagtgaacagggacattcccgccactcggggacagatgggcacaagggaggggaaactccatcaggaagtgctcccctgggcagaggcgcccactgggtgctgtgggctcaggagggggcggggcaggagctggtgccaaccgggaaccagagccccacagccatacagcccattggtgacaaggtcctgagaacacagtggccaggtgtccccaggctcctggcccctccgacgacctcaactctgcccagcccggtccctggccatcagcgacgctgtccgccccccgtcagatcccatgtgtgccatgtttatcatcagtgttttgtatttttgtactgagtatcggagcactttacagaagctgactgtacattcctgttctgttgtgaagagaacattcccagaccctggcaccctcctgagccggcgtgtgccggtccagccctccgagatgccacaattccttggatgggggagaagttcaaggaatttctgctcggccacgcggtgggaaccccgcgtccccgccatgtggcagaggggtctcagtcgtgctaggcatcgggcggcagcgccgacagcccttccctcgccagtgcccctcggccactcctgggttggagcccgattttatttgtaaagttgacagtcgagcaaatgttcctattttcgtgggatctgcacacgtctttgtcagttgtggtcatgatcttagtcacctgctaattatttttacaatgattacaacatttcctcactgcgggatatttctgacccgctttagaacttaagacctgattctagcaataaacgtgtccgagatgagcggtg

SEQ ID NO: 1478 - DNA, 2034 bp, Homo sapiens
gttgagaggccccaagacccagttcctttacagaatcaaccctggggtggctttaggactgggctctttggagctcatccttggacccacagtggagtgctggtccgtgctgatgtcttcagataccaatcaatgggcatttggctccttgcttccactgacctcttgagtactttcaacgatcggtgtcaggagtgccccagctgctgtttctagagcatctctgcaacccacggtggcctctcctctctctgcgggccatggacagcacagtcccttcagccctggagctgccccagcggctggcactgaacccaagggagagcccgaggagtccagaagaggaggagccccacctgctgagcagcttggctgcagtccagaccctggccagtgtcatccggccttgctatggcccccacggccggcagaagttcctggtgaccatgaaaggagaaacagtgtgcacggggtgtgccactgccatcctcagggccctggagctggagcacccagcagcatggctcctccgggaagcaggacaaacccaggcagagaatagtggggacggcacagccttcgtggttctgctgacggaagccttgctggaacaggcagagcagctgctgaaggctggcctgcctcgcccgcagctccgggaggcctacgccacggccactgcagaggtcctggccacactgccctccctggccatccaatctctggggcctttggaagatccatcctgggccctccattctgtgatgaatacccacaccctgtcccccatggaccacttgaccaagctggtggcccacgcctgctgggctatcaaggaactagacggcagcttcaagcctgagcgtgttggggtgtgcgcgctgcccggggggacactggaggattcctgcctcctcccggggttagcaatatctgggaagctctgtgggcaaatggccacagtgttaagtggtgccagggtggctctctttgcttgcccctttggtcctgcccatccaaatgcaccagcaacggcccgtctttctagtcctgctgatctagctcaatttagtaaaggaagcgatcaattactagaaaagcaagtaggccagctagcagctgcaggaattaatgtggcagtggtgttgggggaggtcgacgaggagaccctcacactggcggacaagtatggcatcgtggtgattcaagctaggtcttggatggagatcatttacctgagtgaggtgttggacacacctctgctgcctcgtctgctccctccccagaggccaggcaagtgccagagggtttacaggcaggagctgggagatggtttggctgtggtatttgaatgggaatgtacaggcacacctgccctcactgtggttctcaggggagccaccacccaggggctgcggagtgcagagcaggccgtctaccacggcattgatgcctatttccagctatgtcaagatcccagactgattccaggagctggggccacagaaatggctttggcaaaaatgctttctgataaaggaagcagattggaagggcccagtgggcctgcattcctagcatttgcctgggccctgaagtatcttcctaaaactttggcagagaatgcaggcttagctgtctcagacgtgatggcagaaatgagtggagtgcaccaaggtgggaacctcctaatgggtgtgggaactgaagggataataaatgtggcccaggaaggggtgtgggacaccctaatagtcaaagcccaaggatttcgagcagtggctgaggtggtgctacagctcgtgactgtagatgaaatcgtagtggccaagaaaagtcccacacatcaggagatctggaatcctgactctaagaagacaaagaaacacccacctcctgtggaaacaaaaaaaatccttggattgaataactagtgataccctcaataaaacagggattgccaagaagggaacaatcaccccaaaaatgaatgtttgcctttattccgtgtttggtacttgattcactttcttt

SEQ ID NO: 1479 - DNA, 2900 bp, Homo sapiens
ggcagtcaggcctccccgctctgtgctacctgcggcccggctctcctccgcgcccccactcgcgctgcgatgacgcgctcactgttcaagggaaacttttggagtgcagacatcctcagcaccatcggctatgacaacattatccaacatctgaacaatggccgcaagaactgcaaagagtttgaagactttctaaaagaaagggcagcaattgaagagaggtatggcaaagatctgctcaacctctctaggaagaagccgtgtggacagtctgaaatcaacaccctgaagcgggcccttgaagtcttcaagcagcaagtagacaatgtggcacaatgtcacattcagcttgcacagagtttaagagaagaggccaggaagatggaagaattcagggaaaagcaaaaactacaacgaaaaaagacagagctcataatggatgctatccataaacaaaagagcttacaattcaagaaaaccatggatgcaaagaagaactatgagcagaaatgccgggacaaagatgaggcagaacaggccgtcagccggagtgccaacctggtgaacccgaagcaacaagaaaagctttttgtgaaactggcaacttcaaagaccgcagtagaggactcagacaaagcatacatgctgcacatcggcaccctggataaggtccgagaagagtggcagagtgagcacatcaaggcctgcgaggcatttgaggctcaagaatgtgaacgaataaacttcttccggaatgcattgtggttacatgtgaatcagctgtcacaacaatgtgtcaccagtgatgaacacccatcatgtatgagaatttctactcctcccagaagaatgcagtcccagcaggaaaggctacagggcctaacttggcaaggagaggacccctcccaattcctaaaagctcaccagatgatcccaattactctttggttgatgactacagtttgctctatcagtaaaatcaatgaaaccagagctttttccggctagtgcttctgtgatatggaaagggcacccagagcagcaggacctatagccacgttatgtcagcaatgaagactttgaagtgaacccttgctataattttttagagatttaaaatttatggtagacatttaggacaacataagcaagtagagttctgcagttttttgaagtttacaaattgccccattctgaagaattattctttcccagttactcaggttatgaatgaattaggttttcaacatgggaagcatgaaatccacttctggatttggagcatccacttgaggagcagaggtggcagcagaggattctgagccaccaactgcagtagtggctcctttggctttgggcagcctggctgtggagtttccacggcgacacacagcctcagtggtgcaagatttaaaattaccttcctttttggctggaagacttagaagccgcctgatcatactttctcattttacagatgaggaaataaagcctacaagtgtgaaattaatttccttacagttttcctagctgatgagggacagaaccagaactagagcctgagcccaacccacatcactattcttctaacccttcctgaagttgtgatgctcatgctgaaatttaagatgccaaatatttttgccagcactttttcagttgggagaatcaccagggtttaaatgtcagatttatttttatgtggatccctgtgtatgctgaactacagagcatgatgtttaatctaatttaaggagccactgattgtaaaacatgccattattttatgttgcactaagaaggtggggtcgaggagttgccaataaacttgggacagactattgatggccaagcccatctgaatttaagatgctaaagtatgaaaaaaatacatcttagaatcaatgaaataccatattttgattccattcctcaagataattttagagttataaaaccagtcctcaattttgggtcttcacagagaatctttcccttgctagaccccagaattttaaatgcatccgtcttacactttcacaaatatttgggttttcctttttcactcacaaacagcagggaggtcatgtactttttgtacaacacctgtgcactatgagaaaatggtaccttttagttattgacaagttaaaatagcactctcagtttttcagtattacagagagcaaatagtttcctctcctgctctgtgcagtagcttttccagaactatggacaaattgatcagaagaagattgattatttcctcatctttttttcttttttttgagacagagtctctctctgtcccccaggctgaagtgcagcggcatgatctcagctcactgcaacctctgcctcccgggttcaagtgattctcctgcctcagcctcctgagtagctgggattacaggcacccaccaccacacctggctaattttttgtatttttagtaaagacagggttttaccatgttggtcaggctggtctcaaactcctgacctcaggtgatccacctgcctcggcctcccaaagtgctgggattacaggcgtgagccactgcgcccggcctatttccccacctttcgtgtaaggtgctactgaacatgacagcttcttgtcatgacaggaaacttgcatcagttggatatccttttgagaaactgaattttgcaaagggccaaatttccccaaactgaacgggctcaggaaatgttcctttacactcagaacattctattttaagtatattatttattgttggcagttcctcagggatttcccttttctctgtattggtcagtgtagttgatgtaaaaccgttttgtggatggaaaatatttttattttattgctcttttagtttggtaggttaaataaaggttcttggtaatttggga

SEQ ID NO: 1480 - DNA, 4948 bp, Homo sapiens
taggcgccattttcgagtgaaggacccggagccgaaacaccggtaggagcggggaggtgggtactacacaaccgtctccagccttggtctgagtggactgtcctgcagcgaccatgccccgtaaaggcacccagccctccactgcccggcgcagagaggaagggccgccgccgccgtcccctgacggcgccagcagcgacgcggagcctgagccgccgtccggccgcacggagagcccagccaccgccgcagagactgcaagtgaggaacttgataatagaagtttagaagagattttgaacagcattcctcctcccccgcctccagcaatgaccaatgaagctggagctcctcggcttatgataactcatattgtaaaccagaacttcaaatcctatgctggggagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataaggaaggggatgattatgaagtcattcctaacagtaatttctatgtatccagaacggcctgcagagataatacttctgtctatcacataagtggaaagaaaaagacatttaaggatgttggaaatcttcttcgaagccatggaattgacttggaccataatagatttttaattttacagggtgaagttgaacaaattgctatgatgaaaccaaaaggccagactgaacacgatgagggtatgcttgaatatttagaagatataattggttgtggacggctaaatgaacctattaaagtcttgtgtcggagagttgaaatattaaatgaacacagaggagagaagttaaacagggtaaagatggtggaaaaggaaaaggatgccttagaaggagagaaaaacatagctatcgaatttcttaccttggaaaatgaaatatttagaaaaaagaatcatgtttgtcaatattatatttatgagttgcagaaacgaattgctgaaatggaaactcaaaaggaaaaaattcatgaagataccaaagaaattaatgagaagagcaatatactatcaaatgaaatgaaagctaagaataaagatgtaaaagatacagaaaagaaactgaataaaattacaaaatttattgaggagaataaagaaaaatttacacagctagatttggaagatgttcaagttagagaaaagttaaaacatgccacgagtaaagccaaaaaactggagaaacaacttcaaaaagataaagaaaaggttgaagaatttaaaagtatacctgccaagagtaacaatatcattaatgaaacaacaaccagaaacaatgccctcgagaaggaaaaagagaaagaagaaaaaaaattaaaggaagttatggatagccttaaacaggaaacacaagggcttcagaaagaaaaagaaagtcgagagaaagaacttatgggtttcagcaaatcggtaaatgaagcacgttcaaagatggatgtagcccagtcagaacttgatatctatctcagtcgtcataatactgcagtgtctcaattaactaaggctaaggaagctctaattgcagcttctgagactctcaaagaaaggaaagctgcaatcagagatatagaaggaaaactccctcaaactgaacaagaattaaaggagaaagaaaaagaacttcaaaaacttacacaagaagaaacaaactttaaaagtttggttcatgatctctttcaaaaagttgaagaagcaaagagctcattagcaatgaatcgaagtagggggaaagtccttgatgcaataattcaagaaaaaaaatctggcaggattccaggaatatatggaagattgggggacttaggagccattgatgaaaaatacgacgtggctatatcatcctgttgtcatgcactggactacattgttgttgattctattgatatagcccaagaatgtgtaaacttccttaaaagacaaaatattggagttgcaacctttataggtttagataagatggctgtatgggcgaaaaagatgaccgaaattcaaactcctgaaaatactcctcgtttatttgatttagtaaaagtaaaagatgagaaaattcgccaagctttttattttgctttacgagataccttagtagctgacaacttggatcaagccacaagagtagcatatcaaaaagatagaagatggagagtggtaactttacagggacaaatcatagaacagtcaggtacaatgactggtggtggaagcaaagtaatgaaaggaagaatgggttcctcacttgttattgaaatctctgaagaagaggtaaacaaaatggaatcacagttgcaaaacgactctaaaaaagcaatgcaaatccaagaacagaaagtacaacttgaagaaagagtagttaagttacggcatagtgaacgagaaatgaggaacacactagaaaaatttactgcaagcatccagcgtttaatagagcaagaagaatatttgaatgtccaagttaaggaacttgaagctaatgtacttgctacagcccctgacaaaaaaaagcagaaattgctagaagaaaacgttagtgctttcaaaacagaatatgatgctgtggctgagaaagctggtaaagtagaagctgaggttaaacgcttacacaataccatcgtagaaatcaataatcataaactcaaggcccaacaagacaaacttgataaaataaataagcaattagatgaatgtgcttctgctattactaaagcccaagtagcaatcaagactgctgacagaaaccttcaaaaggcacaagactctgtcttgcgtacagagaaagaaataaaagatactgagaaagaggtggatgacctaacagcagagctgaaaagtcttgaggacaaagcagcagaggtcgtaaagaatacaaatgctgcagagatttcaaaaatatcactgcatcctatagaagataatcctattgaagagatttcggttctaagcccagaggatcttgaagcgatcaagaatccagattctataacaaatcaaattgcacttttggaagcccggtgtcatgaaatgaaaccaaacctcggtgccatcgcagagtataaaaagaaggaagaattgtatttgcaacgggtagcagaattggacaaaattacttatgaaagagacagttttagacaggcatatgaagatcttcggaaacaaaggcttaatgaatttatggcaggtttttatataataacaaataaattaaaggaaaattaccaaatgcttactttgggaggggacgccgaactcgagcttgtagacagcttggatcctttctctgaaggaatcatgttcagtgttcgaccacctaagaaaagttggaaaaagatcttcaacctttcgggaggagagaaaacacttagttcattggctttagtatttgctcttcaccactacaagcccactcccctttacttcatggatgagattgatgcagcccttgattttaaaaatgtgtccattgttgcattttatatatatgaacaaacaaaaaatgcacagttcataataatttctcttcgaaataatatgtttgagatttcggatagacttattggaatttacaagacatacaacataacaaaaagtgttgctgtaaatccaaaagaaattgcatctaagggactttgttgaactttatgctgaagattcttcaagttgattcagtgtattactgatttttttctatttgtaaaggattatgagttgtataaaatacatactccctaaactagatcatgaaactggtttctgttttatgcagttgtcatttgtaaagtctaataaaatattctctataattgcttctagattacaaaaatatgacaatcttgtaagtagcagactatggagaaaaatgagttacctggagggtcaggtaacttgccaaactaaaaagtatgttagttgaggcaaagtcctaagcaaggttgtgctatcaaggctcagcataccttcgtgggcctttgatttaccaacactggaaatgcctgccaactaatcttggatagattctttaaggcattccacttagcttgccagttgagacaatcaccacagttattacccaaatactatgaacatatttttgtaaaccagtcattctgaattatagtgatgagaatttaaatatatgcttttctagaatttgatgtttgaccatttatgacttaattaccagagagccagtaaattaggacagtgtttcaacaagcctaggctatctcgtaagttgaaaaatatcccactatagttgcttcatgagtatgaagtaagatggcctctgatttacactggttcaatttacaaattttcaactttatgataggtttatccgggtactaaatgcatttcaacttgatagtttcaacttatgataggtttaccaggatgtagtcccactgttgaggagcatctatttaggggttaattactttagtaataagtggaaagtaagataccttgagtaatgtttgcctataaaattgtcagcgtatttttacactattggctcaagaatgttataatgctaagggacataagttggcaaccacttggtttttggaaggactttcggtattgtattagaagtctgccctagctgttaaatttctgggtatttatcctaaggaattaattaaagagttaattgttcctttcttcagtgggccattgttttagatatttaaaaaatccaacagtttctatcataatgtaactgtaaaaatgtaaacacattattagcatggacttttaaataaagatttaaagaaagc

SEQ ID NO: 1481 - DNA, 3177 bp, Homo sapiens
ggcaccgcggcgctcgggtgtttttgggggcccgggtggagggcccgggtgccggggcccaaggtgcggcctcgctagcgggagagggagcgggatcaccggcccggagagagctctcagggccagagcggggcaggaggatgctttcccagccccaccatggagctgcgctgtgggggattgctgttcagttctcgctttgattcagggaatctagcccacgtggagaaggtggaatctttgtccagtgatggggaaggggtaggaggtggggcgtcagccctgaccagtggcattgcctcttcccctgactatgaattcaacgtgtggacccgaccagactgtgctgaaacggaatttgagaatgggaacaggtcatggttctacttcagcgtccggggaggaatgccaggaaaactcatcaagatcaacattatgaacatgaacaagcagagcaagctgtattcccagggcatggccccctttgtgcgcacactgcccacccggccacgctgggaacgcattcgagaccggcccacctttgagatgacagagacgcagtttgtgttatcctttgttcatcgtttcgtggagggccgtggggccaccaccttcttcgccttctgctaccccttctcctacagtgactgccaggaactgctaaaccagctagaccagcgctttccggagaaccaccctacccatagcagccccctggataccatctattaccatcgggagctcctttgctattctctggatggacttcgtgtagatctgctgacgatcacttcctgccatgggcttcgagaagatcgagagccccgtctagagcagctatttcctgataccagcacccctcgaccattccgtttcgcaggcaagaggatattcttcttaagcagtagagtacacccaggggagactccatctagctttgtcttcaatggctttctggacttcatcctccgacctgatgatccccgggcccaaaccctccgtcgcctcttcgtctttaagctgattcccatgttgaaccccgatggtgtggtccggggacactaccgcacagactcacgtggagtgaatctgaaccgtcagtacctgaagcctgatgccgtcctgcacccggccatctatggggccaaagctgtgcttctctaccaccatgtgcactctcgtctgaactcccagagttcctctgagcaccagcccagttcctgtctccctcctgatgctcctgtttctgacctggagaaagccaacaatctccaaaatgaagctcagtgtgggcactcagctgacaggcataacgctgaagcctggaaacaaacagagccagcagaacagaagctcaacagtgtgtggattatgccacaacagtctgcggggcttgaagagtcagcccctgataccatcccccccaaagagagtggcgttgcttactatgtggacctgcatggacatgcttccaaaaggggctgcttcatgtacggaaacagctttagtgatgagagcacccaggtggaaaacatgctatatccaaagctcatctccttgaattcagcccacttcgacttccagggctgcaatttctcagagaagaatatgtatgcccgagaccgtagagatggccagtctaaagagggaagcggccgtgttgcaatctacaaagcctcagggataatccacagctacacacttgaatgcaactacaacactggacgctcagtaaacagcatccctgctgcctgccatgacaatgggcgtgccagcccccctcccccgccggctttcccctccagatacactgtggaactatttgagcaggtgggacgagctatggccattgcagccctggacatggcggaatgtaatccgtggccccgaattgtactgtcagagcacagcagccttactaatctacgggcctggatgctgaaacatgtacgcaacagccgaggcctaagcagcactctgaatgtgggtgtcaacaagaagaggggccttcgaactccacccaaaagtcacaatgggttgcctgtctcctgctccgaaaacaccttgagtcgggcacgaagttttagcaccggcacaagtgccggtggtagcagcagcagccaacaaaattctccacagatgaagaattcccccagctttccttttcatggcagtcggcctgcagggctgccaggcctgggctctagtacccaaaaggtcacccaccgggtgctgggccccgtcagagagccccgaagccaggacaggagacggcagcagcagcccctgaaccatcgtcctgcaggcagcctcgctccatccccagctcctactagttctggcccagcctcctcacacaagctgggctcctgtctactgcctgattcattcaacataccagggagcagttgctcactcttgtcctctggagacaaaccagaggctgtcatggtaatcgggaaaggtctgctagggactggagctcggatgccctgcatcaagactcgattgcaggctaggcccaggttgggccggggctcaccgccgactcgcagagggatgaaaggctcttcaggccccacatcccctaccccccggaccagggagagcagtgagctggagctgggatcctgctctgctacaccagggctgcctcaggccaggcccccacggccccgctctgcccctgccttttctcctatatcctgtagtctatctgactccccatcctggaattgttacagcaggggtcccttgggccaacctgaggtttgttttgtccctaaatctcccccactgactgtttctccccgggtctgataatgcctttatgttcaagcccaggatatagccccaagatggggtaacagtgggaaatatgctagttcccctccaggccgctgattccatgtgacagccgttaagtccttggaatgccagccacgctgtccaaggcattacagagtatcaccttgagacagaacaaaacagggacctgccaccccttccctccctccgcagcacaagattttgggaccacaaaaaaaagtctatatttttatattggggggagggagtagaaaagcaagcccctatactgggccctattcagtggcagcttcttgttccataggattaaggaagactctgaggaaataaaagttgtttggaaaaatc

SEQ ID NO: 1482 - DNA, 5559 bp, Homo sapiens
gcgggactcaagagtagccttcctcgaggacctgcctttcccatttgctgcctgaagttaatgtttcttgctggccaaatcagggacatgccggcattagcgggatgagtgggtgttccggcagggatgtggtcattgacggccagtgagggcgagagtaccacggcccacttcttccttggagctggagatgaggggctgggcacccgtggaataggcatgaggccagaagagagtgacagcgagctccttgaggatgaggaggatgaagtgcctcctgaacctcagatcattgttggcatctgtgccatgaccaagaaatccaagtccaagccaatgactcaaatcctagagcgactctgcagatttgactacctgactgttgtcattctgggagaagatgtaatccttaatgaacctgtggaaaactggccatcctgccactgcctcatctctttccactccaaaggctttcctctggacaaagctgttgcttactccaagcttcgaaacccctttcttatcaatgatctggccatgcagtattacatccaagataggagggaggtgtaccggatcctgcaggaagagggtattgatctgcctcgatatgctgtgctcaaccgtgatcctgcccggcctgaggaatgcaacctgatagaaggtgaagaccaagtagaggtcaatggagctgtctttcccaagccctttgtggagaagccagtgagtgcagaagaccacaatgtttacatctactaccccagctcagctggaggaggaagccagcgtctctttcgtaagattggcagccgaagcagtgtttactctcctgagagcagcgtccgaaagacggggtcgtacatctatgaggagtttatgccaacagatggcacagatgtcaaggtgtatacagtggggccagattatgcccatgctgaagctagaaaatctccagctttggatgggaaggttgaacgagacagtgaggggaaagagattcgatatccagtcatgctgactgccatggaaaagctggtggccaggaaagtctgcgtagctttcaagcaaacagtttgtggatttgaccttcttcgtgccaatggtcattcctttgtgtgtgatgtcaatggctttagttttgtcaagaactcgatgaaatactacgatgactgtgccaagattctggggaacaccataatgcgggagcttgccccacagttccagattccatggtccatccccacggaggctgaggacattcccattgttcccaccacatctggcactatgatggaacttcgttgtgtcattgcaattattcgtcatggggatcgtactcccaagcagaagatgaagatggaagtgaaacacccaaggttttttgctctgtttgaaaaacatggtggctacaagacagggaaattaaaactcaagcgacctgagcagctccaggaggtgctggatatcacaaggctgttgttggctgaactggagaaagaaccaggtggtgagatcgaggagaagactggaaaactagagcagctgaagtctgtactggagatgtatggtcacttctcaggtataaaccggaaggtacaattgacttactaccctcatggagtaaaagcttctaatgaggggcaagatccacagagggaaactctggccccatctctgttgctggtactgaagtggggtggagaactgactcctgctggccgtgttcaggctgaggagctggggcgagcttttcgctgcatgtaccctggaggacagggtgactatgctggcttccctggttgtgggctgcttcgtctccatagcactttccgccacgatctcaagatctatgcctctgatgagggtcgtgttcagatgactgctgctgccttcgccaagggccttctggctctagaaggggagctgacacccattttggtgcaaatggtgaagagtgccaacatgaatgggctactggacagcgatggggattccttgagcagctgccagcaccgggtgaaggctcggctgcaccatattctacagcaggatgcgccctttggccctgaggactacgatcagctggctcccaccagaagtacttccctgctcaactccatgactatcatccagaatcctgtgaaggtctgtgatcaggtatttgccctgatcgaaaacctcacccaccagatccgggaacgaatgcaggaccccaggtctgtagacctgcagctctaccacagtgagacactagagctaatgctacagcgttggagcaagctggagcgtgactttcgacagaagagtgggcgctatgatatcagtaagatccctgacatctatgactgtgtcaagtatgatgtgcagcacaatgggagtctgggacttcaaggcacagcagagttgctccgtctctctaaggcactggctgatgtggtcattccccaggagtacgggatcagtcgggaggagaaactggaaattgctgtgggcttctgtcttccactgttgcggaagatactacttgacctgcagagaacccacgaggatgagtctgtcaacaagctgcatcccctgtactcccgaggcgtgctctccccaggtcgccacgttcgaacgcgtctctatttcaccagtgagagccatgtccactccctgctcagtgtcttccgttatggaggacttcttgatgagacccaggatgcacaatggcagcgagctttggattatcttagtgccatctcagagcttaactacatgacccagattgtcatcatgctttatgaggacaacacacaggatcccttatcagaggaacggttccatgtggagctacacttcagccccggagtgaaaggtgttgaggaagaaggcagtgccccggctggctgtggattccgtccagcctcttctgagaatgaggagatgaaaaccaaccaaggcagtatggagaacctgtgtccaggaaaggcatcagatgaaccagaccgggcattgcagacttcaccccagcctcctgagggccctggccttccgaggagatcacccctcattcgtaaccgaaaagctggttccatggaggtactttctgagacttcatcctcgaggcctggtggctaccggctcttttcatcttcacggccacccacagaaatgaagcagagtggcctagggtttgaagggtgttccatggtgcctaccatctaccctctggaaacactgcataatgccctttccctacgtcaagtgagtgaattcttgagtagagtctgccagcgccacactgatgcccaggcacaggcatctgcagccctctttgattccatgcacagcagccaggcctcagataacccattttctccaccacgtactcttcattcacctcccctgcaactccagcagcgctctgagaagcccccttggttagagacaaggttttgccatgttggccaggctggtttagagctcctgacctcaagtgatctgcctgcctcggcctcccaaagtgctgggattacaggcgtgagccaccgcacccagccagacagcagtggcccttctagcactgtgtccagtgctggtccttcttcccctactacagtagatggtaactcccaatttggcttcagtgatcaaccctccctaaattcacacgtggctgaagaacatcaaggccttgggctgctccaggagacccctgggagtggagcacaagagctctccatagaaggggagcaagagctttttgaaccaaatcagtccccacaggtgccacctatggaaaccagccagccatacgaggaggtcagccagccatgtcaggaggtccctgacatcagccagccatgccaggacatttctgaggcgctcagccagccatgtcagaaggtccctgacatcagccagcaatgccaggagaaccatgacaatggtaaccacacatgccaggaggtccctcacatcagccagccatgccagaagtccagccaactgtgccagaaagtctctgaggaagtttgccagctatgtctggagaactccgaggaggtcagccagccatgccagggggtctctgtggaggttggcaagctggtccataagttccatgtaggggttggtagcttggtccaggaaacccttgtagaagttggcagcccagctgaagagatccctgaggaggtcatccagccataccaggagttctctgtggaggttggcaggctggcccaggagacttctgcgatcaatctgttatctcagggcatccctgagattgataaaccatcccaagagttccctgaggagattgatctgcaggcccaggaggtccctgaggagataaattagaagtcctgggtggtccctgaagtgattgatcagctgcctggagagggtattcctcaagcccagcatccatctggtgatccaaaccctcagagccagtctctagcccatgaccagcactcaccccttccaccagcaacatgtgattaattttctcattagtggtatcacactataccagccatttgagccagcaaccttttctgttggctaactcactggccagctctcaccagcggtgtctggggaagtagttctctttgtatgaagcatacctgtgccagagctgtggttgaggaggagccagttttaggttcgaagaagccattggctcctcacttagccattagacttgaataggatttccttggggtgggttggtctgtcattacccagccttctctgagcatcctaggaaatcacagattgttaaaggaaatgccgcttcactgctgaagacaccatctggcgacagcaaatgcaaaagaggggactctagggtcttcacttttctggggaaatgttcacgacttctcaaggtacgcttagaccatatgtgcattcaggggactcttgtctttgccagcactcctcaggtgagcccgggatggctatctgaaatgtctggaaaatagagtcccttccccaaacatctgacatggccactaaatctttagacttgccttatagatccttccatatcatccccaagtgccccttctgcctcagtcctgttcctctgggcaatagctctagggaaaagtaggtattagactgctgtgcaaaattcagagcaactacttaaaatgctctagaggattcttagccagtctgtgaaagtgggcctcctctgtggtggggctgtttggcttaggagatgctgtagtagtagagataatcaggttctattttaagcaatcagcagagatcaatattgtacagatacaagcaaaggtttaataaatatatatatatatatttatttctgtagttgtgccagggacagactggccaaagaccaaacactgcagggtccccaagaaatttgtccttatatcattgtgtctgagggccagatatgattatgaagctttttccaaagatccagggatgggaatgggagtgggtaggaggggtaatgcggtcattggagtcgggggctggaacattatgagtgctcaataaatataaactaatgagaatggtggtgatgga

SEQ ID NO: 1483 - DNA, 1757 bp, Homo sapiens
aacccgtttccatggctgcgagaactgacgctccccaaccgtcccgcaactgtcctgtcccagactttggcaccgtcggggtccgtcgtccccgaatgtgacagcatccccaccccggctgctgcccaggatccgccggaccccggcctcgatatgggagacctggaactgctgctgcccggggaagctgaagtgctggtgcggggtctgcgcagcttcccgctacgcgagatgggctccgaagggtggaaccagcagcatgagaacctggagaagctgaacatgcaagccatcctcgatgccacagtcagccagggcgagcccattcaggagctgctggtcacccatgggaaggtcccaacactggtggaggagctgatcgcagtggagatgtggaagcagaaggtgttccctgtgttctgcagggtggaggacttcaagccccagaacaccttccccatctacatggtggtgcaccacgaggcctccatcatcaacctcttggagacagtgttcttccacaaggaggtgtgtgagtcagcagaagacactgtcttggacttggtagactattgccaccgcaaactgaccctgctggtggcccagagtggctgtggtggcccccctgagggggagggatcccaggacagcaaccccatgcaggagctgcagaagcaggcagagctgatggaatttgagattgcactgaaggccctctcagtactacgctacatcacagactgtgtggacaggcagtggtcagtctcccagcccccacagctggctcacttgaagagaattcaacgtctgcacccagtgtgctggttcctctccccaggcaagctgcagcagttcgagggcagccgttggcatactgtggccccctcagagcagcaaaagctgagcaagttggacgggcaagtgtggatcgccctgtacaacctgctgctaagccctgaggctcaggcgcgctactgcctcacaagttttgccaagggacggctactcaagcttcgggccttcctcacagacacactgctggaccagctgcccaacctggcccacttgcagagtttcctggcccatctgaccctaactgaaacccagcctcctaagaaggacctggtgttggaacagatcccagaaatctgggagcggctggagcgagaaaacagaggcaagtggcaggcaattgccaagcaccagctccagcatgtgttcagcccctcagagcaggacctgcggctgcaggcgcgaaggtgggctgagacctacaggctggatgtgctagaggcagtggctccagagcggccccgctgtgcttactgcagtgcagaggcttctaagcgctgctcacgatgccagaatgagtggtattgctgcagggagtgccaagtcaagcactgggaaaagcatggaaagacttgtgtcctggcagcccagggtgacagagccaaatgagggctgcagttgctgagggccgaccacccatgccaagggaatccacccagaatgcacccctgaacctcaagatcacggtccagcctctgccggagccccagtctccgcagtggagagcagagcgggcggtaaagctgctgaccgatctccctcctcctcaccccaagtgaaggctcgagacttcctgccccacccagtgggtaggccaagtgtgttgcttcagcaaaccggaccaggagggccagggccggatgtggggaccctcttcctctagcacagtaaagctggcctccaga

SEQ ID NO: 1484 - DNA, 1377 bp, Homo sapiens
atgaatgaagctatggctacagattccccaagaagacccagtcgttgtactggtggagttgtggttcgcccccaggctgtcacagagcagtcctacatggaaagtgttgtgacttttctgcaggatgttgtgccacaggtatattgttgtggagacaacattcagtcttatactgccacagtcattagtgctgctaaaacattgaaaagtggcctgacaatggtagggaaagtggtgactcagctgacaggcacactgccttcaggtgtgacagaagatgatgttgccatccacagtaattcacggcggagtcctttggtcccaggcatcatcacagttattgacaccgaaaccgttggagagggccaggtgcttgtgagtgaggattctgacagtgatggcattgtggcccacttccctgcccatgagaagccagtgtgctgcatggcttttaatacaagtggaatgcttctagtcacaacagacacccttggccatgactttcatgtcttccaaattctgactcatccttggtcctcatcacaatgtgctgtccaccatctgtatactcttcacaggggagaaactgaagccaaagtacaggacatctgcttcagccatgactgtcgctgggttgtggtcagtactctccggggtacttcccacgttttccccatcaacccttatggtggccagccttgtgttcgtacacatatgtcaccacgagtagtgaatcgcatgagccgtttccagaaaagtgctggactggaagagattgaacaagaactgacgtctaagcaaggaggtcgctgtagccctgttccaggtctatcaagcagcccttctgggtcacccttgcatgggaaactgaacagccaagactcctataacaattttaccaacaacaaccctggcaaccctcggctctctcctcttcccagcttgatggtagtgatgcctcttgcacaaatcaagcagccaatgacattggggaccatcaccaaacgaaccggcaaagttaaacctcctccacaaatttcacccagcaaatcgatgggcggagaattttgtgtggctgctatcttcggaacatccaggtcatggtttgcaaataatgcaggtctgaaaagagaaaaagatcagtccaaacaagttgtagttgagtccctgtacattatcagttgctatggcaccttagtggaacacatgatggagccgcaacccctcaatggaatgaattgcagccaccgtttaatgcaaaccaccctctgctcctcgctgcagatgcagtacagtattatcagttcctgcttgctggcctggttccccctggaagtcctgggcccattactcgacatgggtcttacgacagtttag

SEQ ID NO: 1485 - DNA, 1116 bp, Homo sapiens
gagagactacaactcccagtatgcaccgcgatgcgcgcctcaccctgcatctcccagcccgcagccagctggcatcctagaccctctgccctgcgaccaacagccgggagcggaccagacaccagaactcccggaacggttgaagacggttccgctccctgtcccgcctttcgcagcccagcagtttcgccctgcggagaggagccttgctgtttccaaatctctcctgctgaagagacattggagctagggcggctagtttcacctggctgtcacaaatcctctgcaccccaggagcgccgcttggacccccgggctcgctgcgtggtccatatctaggtcgggcctctcacggagactttcccaccagtgtaataaagaggagaaaacgtcacagcggaagggcctgaccctgctgcatccactaaggaaacagctacggggatgggaccctgggagctgctgtggagcctcatccaccgcttctctgaccccacccaggctgcttcccaggcctcagggtcttagtgtggacctccgggccgtgattaatgcaggtcagcaggaccagagcgccccttggtccctcccaacacatgagggtagtttgtgtggtgaggtcagggatagtgtctgcgcttctaccctgaatagggctcccttggaaaatactttaatatctctttttaaatacccccttggaccacttttaatagttttctgatagaactaaacagtgatcattctcttaattcatgtttccattaagtttttcaggttaagtactgcacgactactcgcttctgaaactgatagacactgcctcagctccgtgcagggcagacgcacaagagcagaatctccgtgggacatctctctggagcatcaatattactgcagtatttggaagaaacaaatttaaataagttctaaggtgaagaatggaacatttaagacaagtctggaaagtcatctgcctttaataactgtcgtttgtccttaacgtcagactttctccaagaccaaaactctaagaacttatttccattcttacaaatagtaaaaatgataaatcatatcaagtcaattgaaagtcctgcctgctgctttcctaaa

SEQ ID NO: 1486 - DNA, 5565 bp, Homo sapiens
gcgggactcaagagtagccttcctcgaggacctgcctttcccatttgctgcctgaagttaatgtttcttgctggccaaatcagggacatgccggcattagcgggatgagtgggtgttccggcagggatgtggtcattgacggccagtgagggcgagagtaccacggcccacttcttccttggagctggagatgaggggctgggcacccgtggaataggcatgaggccagaagagagtgacagcgagctccttgaggatgaggaggatgaagtgcctcctgaacctcagatcattgttggcatctgtgccatgaccaagaaatccaagtccaagccaatgactcaaatcctagagcgactctgcagatttgactacctgactgttgtcattctgggagaagatgtaatccttaatgaacctgtggaaaactggccatcctgccactgcctcatctctttccactccaaaggctttcctctggacaaagctgttgcttactccaagcttcgaaacccctttcttatcaatgatctggccatgcagtattacatccaagataggagggaggtgtaccggatcctgcaggaagagggtattgatctgcctcgatatgctgtgctcaaccgtgatcctgcccggcctgaggaatgcaacctgatagaaggtgaagaccaagtagaggtcaatggagctgtctttcccaagccctttgtggagaagccagtgagtgcagaagaccacaatgtttacatctactaccccagctcagctggaggaggaagccagcgtctctttcgtaagattggcagccgaagcagtgtttactctcctgagagcagcgtccgaaagacggggtcgtacatctatgaggagtttatgccaacagatggcacagatgtcaaggtgtatacagtggggccagattatgcccatgctgaagctagaaaatctccagctttggatgggaaggttgaacgagacagtgaggggaaagagattcgatatccagtcatgctgactgccatggaaaagctggtggccaggaaagtctgcgtagctttcaagcaaacagtttgtggatttgaccttcttcgtgccaatggtcattcctttgtgtgtgatgtcaatggctttagttttgtcaagaactcgatgaaatactacgatgactgtgccaagattctggggaacaccataatgcgggagcttgccccacagttccagattccatggtccatccccacggaggctgaggacattcccattgttcccaccacatctggcactatgatggaacttcgttgtgtcattgcaattattcgtcatggggatcgtactcccaagcagaagatgaagatggaagtgaaacacccaaggttttttgctctgtttgaaaaacatggtggctacaagacagggaaattaaaactcaagcgacctgagcagctccaggaggtgctggatatcacaaggctgttgttggctgaactggagaaagaaccaggtggtgagatcgaggagaagactggaaaactagagcagctgaagtctgtactggagatgtatggtcacttctcaggtataaaccggaaggtacaattgacttactaccctcatggagtaaaagcttctaatgaggggcaagatccacagagggaaactctggccccatctctgttgctggtactgaagtggggtggagaactgactcctgctggccgtgttcaggctgaggagctggggcgagcttttcgctgcatgtaccctggaggacagggtgactatgctggcttccctggttgtgggctgcttcgtctccatagcactttccgccacgatctcaagatctatgcctctgatgagggtcgtgttcagatgactgctgctgccttcgccaagggccttctggctctagaaggggagctgacacccattttggtgcaaatggtgaagagtgccaacatgaatgggctactggacagcgatggggattccttgagcagctgccagcaccgggtgaaggctcggctgcaccatattctacagcaggatgcgccctttggccctgaggactacgatcagctggctcccaccagaagtacttccctgctcaactccatgactatcatccagaatcctgtgaaggtctgtgatcaggtatttgccctgatcgaaaacctcacccaccagatccgggaacgaatgcaggaccccaggtctgtagacctgcagctctaccacagtgagacactagagctaatgctacagcgttggagcaagctggagcgtgactttcgacagaagagtgggcgctatgatatcagtaagatccctgacatctatgactgtgtcaagtatgatgtgcagcacaatgggagtctgggacttcaaggcacagcagagttgctccgtctctctaaggcactggctgatgtggtcattccccaggagtacgggatcagtcgggaggagaaactggaaattgctgtgggcttctgtcttccactgttgcggaagatactacttgacctgcagagaacccacgaggatgagtctgtcaacaagctgcatcccctgtactcccgaggcgtgctctccccaggtcgccacgttcgaacgcgtctctatttcaccagtgagagccatgtccactccctgctcagtgtcttccgttatggaggacttcttgatgagacccaggatgcacaatggcagcgagctttggattatcttagtgccatctcagagcttaactacatgacccagattgtcatcatgctttatgaggacaacacacaggatcccttatcagaggaacggttccatgtggagctacacttcagccccggagtgaaaggtgttgaggaagaaggcagtgccccggctggctgtggattccgtccagcctcttctgagaatgaggagatgaaaaccaaccaaggcagtatggagaacctgtgtccaggaaaggcatcagatgaaccagaccgggcattgcagacttcaccccagcctcctgagggccctggccttccgaggagatcacccctcattcgtaaccgaaaagctggttccatggaggtactttctgagacttcatcctcgaggcctggtggctaccggctcttttcatcttcacggccacccacagaaatgaagcagagtggcctaggctcacagtgcacagggctgttcagcaccacagtgctgggtggctcctccagtgccccgaatcttcaggactacgcccgcagccatggcaaaaagctaccacctgccagtctgaagcaccgagatgggtttgaagggtgttccatggtgcctaccatctaccctctggaaacactgcataatgccctttccctacgtcaagtgagtgaattcttgagtagagtctgccagcgccacactgatgcccaggcacaggcatctgcagccctctttgattccatgcacagcagccaggcctcagataacccattttctccaccacgtactcttcattcacctcccctgcaactccagcagcgctctgagaagcccccttggtacagcagtggcccttctagcactgtgtccagtgctggtccttcttcccctactacagtagatggtaactcccaatttggcttcagtgatcaaccctccctaaattcacacgtggctgaagaacatcaaggccttgggctgctccaggagacccctgggagtggagcacaagagctctccatagaaggggagcaagagctttttgaaccaaatcagtccccacaggtgccacctatggaaaccagccagccatacgaggaggtcagccagccatgtcaggaggtccctgacatcagccagccatgccaggacatttctgaggcgctcagccagccatgtcagaaggtccctgacatcagccagcaatgccaggagaaccatgacaatggtaaccacacatgccaggaggtccctcacatcagccagccatgccagaagtccagccaactgtgccagaaagtctctgaggaagtttgccagctatgtctggagaactccgaggaggtcagccagccatgccagggggtctctgtggaggttggcaagctggtccataagttccatgtaggggttggtagcttggtccaggaaacccttgtagaagttggcagcccagctgaagagatccctgaggaggtcatccagccataccaggagttctctgtggaggttggcaggctggcccaggagacttctgcgatcaatctgttatctcagggcatccctgagattgataaaccatcccaagagttccctgaggagattgatctgcaggcccaggaggtccctgaggagataaattagaagtcctgggtggtccctgaagtgattgatcagctgcctggagagggtattcctcaagcccagcatccatctggtgatccaaaccctcagagccagtctctagcccatgaccagcactcaccccttccaccagcaacatgtgattaattttctcattagtggtatcacactataccagccatttgagccagcaaccttttctgttggctaactcactggccagctctcaccagcggtgtctggggaagtagttctctttgtatgaagcatacctgtgccagagctgtggttgaggaggagccagttttaggttcgaagaagccattggctcctcacttagccattagacttgaataggatttccttggggtgggttggtctgtcattacccagccttctctgagcatcctaggaaatcacagattgttaaaggaaatgccgcttcactgctgaagacaccatctggcgacagcaaatgcaaaagaggggactctagggtcttcacttttctggggaaatgttcacgacttctcaaggtacgcttagaccatatgtgcattcaggggactcttgtctttgccagcactcctcaggtgagcccgggatggctatctgaaatgtctggaaaatagagtcccttccccaaacatctgacatggccactaaatctttagacttgccttatagatccttccatatcatccccaagtgccccttctgcctcagtcctgttcctctgggcaatagctctagggaaaagtaggtattagactgctgtgcaaaattcagagcaactacttaaaatgctctagaggattcttagccagtctgtgaaagtgggcctcctctgtggtggggctgtttggcttaggagatgctgtagtagtagagataatcaggttctattttaagcaatcagcagagatcaatattgtacagatacaagcaaaggtttaataaatatatatatatatatttatttctgtagttgtgccagggacagactggccaaagaccaaacactgcagggtccccaagaaatttgtccttatatcattgtgtctgagggccagatatgattatgaagctttttccaaagatccagggatgggaatgggagtgggtaggaggggtaatgcggtcattggagtcgggggctggaacattatgagtgctcaataaatataaactaatgagaatggtggtgatgga

SEQ ID NO: 1487 - DNA, 6773 bp, Homo sapiens
cggccgccgccggccgggccccaagcccccgagggcgccagggcgggatcgcgaccggtgcaacttctagccttgttgtcctcctggtgcgaagagctcggccgcctgctgctgctccgacatcagaagagccgccagagcgatccccctgggaaactccccatgcagccccctctcagctccatgagctccatgaaacccactctgtcgcacagtgatgggtcgttcccctatgactctgtcccttggcagcagaacaccaaccagcctcccggctccctttccgtggtcaccacggtttggggagtaaccaacacatcccagagccaggtccttgggaaccctatggccaatgccaacaaccccatgaatccaggcggcaaccccatggcgtcgggcatgaccaccagcaacccaggcctcaactccccacagtttgcggggcagcagcagcagttctcagccaaggctggccccgctcagccctacatccagcagagcatgtatggccggcccaactaccccggcagcgggggctttggggccagttaccctgggggtcctaacgcccccgcaggcatgggcatccctccgcacaccaggccgcctgctgacttcactcagcccgcggcagccgctgcagcagcggcagtggcagcagcagcagccacagctacagccacagccacggccactgtggcagccctgcaggagacacagaacaaggatataaaccagtatggaccgatgggtcccacccaggcgtataacagccaattcatgaaccagcccgggccgcgggggcctgcctccatggggggcagcatgaaccccgcgagcatggcggctggcatgacgccctcggggatgagcggccctcccatgggcatgaaccagccccggccgcccggcatcagcccctttggcacacacgggcagcggatgccccagcagacctacccgggcccccggccccagtcccttcctattcagaacataaagaggccataccctggagagcccaactatggaaaccagcaatatggaccaaacagccagttccccacccagccaggccagtacccagcccccaaccccccgaggccactcacctcccccaactacccaggacagaggatgcccagccagccgagctccgggcagtacccgccccccacggtcaacatggggcagtattacaagccagaacagtttaatggacaaaataacacgttctcgggaagcagctacagtaactacagccaagggaatgtcaacaggcctcccaggccggttcctgtggcaaattacccccactcacctgttccagggaaccccacaccccccatgacccctgggagcagcatccctccatacctgtcccccagccaagacgtcaaaccacccttcccgcctgacatcaagccaaatatgagcgctctgccaccacccccagccaaccacaatgacgagctgcggctcacattccctgtgcgggatggcgtggtgctggagcccttccgcctggagcacaacctggcggtcagcaaccatgtgttccacctgcggcccacggtccaccagacgctgatgtggaggtctgacctggagctgcagttcaagtgctaccaccacgaggaccggcagatgaacaccaactggcccgcctcggtgcaggtcagcgtgaacgccacgcccctcaccattgagcgcggcgacaacaagacctcccacaagcccctgcacctgaagcacgtgtgccagccgggccgcaacaccatccagatcaccgtcacggcctgctgctgctcccacctcttcgtgctgcagctggtacaccggccctccgtccgctctgtgctgcaaggactcctcaagaagcgcctcctgcccgcagagcactgtatcacgaaaatcaagcggaatttcagcagcgtggctgcctcctcgggcaacacgaccctcaacggggaggatggggtggagcagacggccatcaaggtgtctctgaagtgccccatcacattccggcgcatccagctgcctgctcgaggacacgattgcaagcatgtgcagtgctttgatctggagtcatacctgcagctgaattgcgagagagggacctggaggtgtcctgtgtgcaataaaaccgctctgctggagggcctggaggtggatcagtacatgtggggaatcctgaatgccatccaacactccgagtttgaagaggtcaccatcgatcccacgtgcagctggcggccggtgcccatcaagtcggacttacacatcaaggacgaccctgatggcatcccctccaagcggttcaagaccatgagtcccagccagatgatcatgcccaatgtcatggagatgatcgcagccctgggccccggcccgtccccctatcccctcccgcctcccccagggggcaccaactccaacgactacagcagccaaggcaacaactaccaaggccatggcaactttgacttcccccacgggaaccctggagggacatccatgaatgacttcatgcacgggcccccccagctctcccaccccccggacatgcccaacaacatggccgccctcgagaaacccctcagccaccccatgcaggaaactatgccacacgctggcagctctgaccagccccacccctccatacaacaaggtttgcacgtaccacaccccagcagccagtcagggcctccattacatcacagtggggctcctcctcctcctccttcccagcctccccggcagccgccacaggccgctcccagcagccatccacacagcgacctgacctttaacccctcctcagccttagagggtcaggccggagcgcagggagcgtccgacatgccggagccttcgctggatctccttcccgaactcacaaatcctgacgagctcctgtcttatctggacccccccgacctgccgagcaatagtaacgatgacctcctgtctctatttgagaacaactgagggccacccggtcggggccatccctccacactctgcatcctaccccacctacccaacacacttttccacctgggagcctgtgccctcagaccgccccgcaccagagccacgggctgtggggcggggagccctcccccgctgcagccctctcagaacagaggggtagggagggtgcaccagtgcaccaggaaggctgtgtgggtctggagcccacgtcccacctccacacccttggcttgggcccatgcccagcgcaggcctgaagaccaccctcccgagaggaaccagcccggtaagagggcacacgctgatgcggcttcccggtccctccgcgtgtgccgattccagatgaccttccagtgtccccaaggttcttccatcttctagactgtaaccctgcctccctgcttcctggtccagagcctccctccagtgactgtggagcctgagaaggcccccgggccccagcatgggccccgagccttggaggagcactggcagttggtggcagtgagaccagcccacccaccaccacccaccacagaaaagcacaaacctctgggaaagacaacgtctctcgggggccaggggtcatcggtttgacccctgacctataagccaagataccccataaacacactcagaaagcagagaaaaaggacaagagtctgtgtttgagagggggtctgccattcctgcttggggactggtggggaagagggccaggacatcttctgagccaggacgtccctgaggctccacctccaagctcagacagggcccaggcttggggaacagagagagcaggtgtacacccaaccaaagtgattgtgcccttggttggggggcgcgggcatataacctgtcagaagcaaacaggagcggcaacttctaactttgctccaagccactctctttttaaacagcaacaatttaaagctatgaagtcacctggagaaaaggaacgttgctcttggacagcaagcaaaccatttctctccgtctgttctgtttttctcctagtccctctcctgccacctctccaagacttccgtgggacacccacttccctctgtcctagttctctttgtccaatcagatggcaagggcagtgcgtggaaaggccggggaggtgcagaaaccagagcccagggcaatggtgtctgtccagcccctccctctgtccctgtgctccaagctgcccccggctgcagcccaggccatggacatgtgcaccagtatgtacctgcaggcatgggggggaggggggcgtgtttctgggcctgccccagacactgcccttggctgccagcctaccctgcctgcactcctccaccatcacaatctcacccaaactcctgctcactcaagcaaaagcagcctctggccttccctccaccgctttgctccatctggcttaccactctccagggcctcctggggagcctgtcctgtgttcactttgtttcaggctggtctgtgccccgtgagccacatggcctagggtgatgccaggttgtcccgtcactggggtcccatctgtaaattctttgcgcccttcccggctgctgcctggggccctttcctgctctcccgtccgctgtgggtggtccccagctctcctctgtgggttttaccggaaaggtggccccagctgttgacttccagtcactgtcccagacggcacaaggttttctgtaggaaagctgccattgccccggccccttttcttcctttgtcccgttgtcgaggttttttcaaatagcgtgttgttcagtatgcaaatcaattattttaagaatcgcttttgtaaatatctttgtgaatattttagtatcgtctttgataatattcaacattttcatgacctggttatagcctttgctggtgtttttaaaatacctggactcaatgacaaagaccgagtcttctttttttttaaacaaaaacaaaaaaagcaaccagggctatttgtacagttgaaggggtgaacagaatgggcggctgtgctgggagttggaagaccgggcagcccgctatttagagccatccctcagtcagctggcagggacaagccaacgccaggtagcatgtggccacccttgcccagtgtctgtggcctggcaagtggccacgccctgtgtcagaccatctgggaattaagctccagacagacttacagatgccttccttaggagttcttgcttcttgcgttgatactttgccccagaaaggcctgggattcattctggttcttatcagggtgtgtccacactctgctcacaggtggatccacggctttccagtgcggagagtcgagatgctccctgcagcccaggccccgggcacctcctgcaaccatctctgggctcagcacctgaggcgggtttcctgggtcccctctccagcaagcctccaccagcaagctcggcccagagcttcccttccggctggctctgaaccgtgcgtggtgcctacagcctgcagtctggagacaagctcttccggagtgctctgggagccaggccagggtgtgagggaggtgcagaggcatccggggcgggagcaagccccaggttgtgacaggtgcaggtagacaacgcccataaacagagatggtcctgaactctggagagatccttccctgatcctttcggacgactacttggagccataagtaacctcagcaaaaacgaggcctctgcaagccacttttccatgccaagcatccacccggcccacaggcatgtttctgccgccactccgcaagatggacagggagccagcaggcaggcgggaagggccaagtacaggcaatcacccccatcttcttggtttgaagctttatccatgtatcatgttccgtgtagccattttattttttaagaaactgctaatactttctccctaatggaagccctgatcccccagagagctacaggtctgctcccgacgggcctcgggcctgacccgtccacacagggccgtgtcaacagcagcgactcaagggacgtgtgtacatatgtaaatgagaaatagagacgtgtcaacagatgcattcatttctcttggaatgtgtattgtttttattttgcgaaacaaaacaaaacaaaaaaaaaagcttggaactccatcacgtggaaaaactagatcctgttggttatagcatttgtgagttctccacgtctgtctctctcgctcatgtaatatactctgaccctgagtggaaaggggtttttgttctgtttttattttacctacatgtactatttagcttcagtgtactagtcctgccacctgtgtatttttagggtgctatggaaataatgaaaagaaacggggatttcagaagaaaattgtaaccaaattcatactttgtataatttttgatatcatgatcacaggtgattcacacgtacacacataaacacacccaccagtgcagcctgaagtaactcccacagaaaccatcatcgtctttgtacatcgtatgtacaatgcaatcatttcatactttaaactggtcaaaaaactaattgtgatttctagtcttgcaaagctgtatgtagttagatgatgtgacaacctctaatatttatctaataaatatgtattcagatgaaacctgtatattaggtgttcatgtggttattttgtatttaaagatcaaattatttgactattgctagacatttctatactctgttgtaacactgaggtatctcatttgcccatgttaatttttttctaaataaattgacaaaaacaaaggtttggcg

SEQ ID NO: 1488 - DNA, 6336 bp, Homo sapiens
tcgtggggaaaaggcagggagggggtggtgtccccagccggtttggggggtgcgttgcccggagacggaaagtttgggagcccgagcaggctcggctgcagcctcggggagggggtccagcgggtggcggccctggggatggggaaggagcaggagctgctggaggcggcccgcaccgggcacctcccggcggtggagaagctgctgtccgggaagcggctctcctcaggctttgggggcggcggcggcggtggctctgggggcggcggcggcggcagcggcggcggcggcggcggcctcggctcttccagccaccccctctccagtctgctcagcatgtggagagggccaaatgtgaactgtgttgacagcactggctacacacccctgcaccatgctgctttgaatggccataaggatgtggtcgaggttcttctgaggaacgatgcgctgaccaacgtggctgactcaaaaggctgctaccctctgcatttggcagcctggaaaggagatgcccagatagtgcggttgctcatccatcaagggccttcacacaccagagtcaatgaacagaacaatgacaacgagacagccctgcattgtgcagcgcagtatggccacacagaggtggtgaaggtgctcttagaggagctgacggaccccaccatgcgcaacaacaaattcgagacccctttggacctggcagcactgtacgggcgactggaggtggtgaaaatgctccttaatgcacaccccaacctcctgagctgcaacactaagaagcacacccctctgcacttggcagcaaggaatggccacaaagccgtggtccaggtcctcctcgatgctggcatggacagcaactaccagacggagatgggcagtgctttgcatgaggctgctttgtttggcaagaccgatgtggtgcaaatcctgctggctgcaggaactgacgtcaacataaaagataaccatggactgactgccctagacactgttcgggaactgccttctcaaaagagccagcaaatagcagcattaattgaagatcacatgactggaaaaagaagtacaaaagaagtagataaaacccccccaccccagccacctctcatctccagtatggactccatatcacagaagtctcagggtgacgtggagaaagcagtgactgaactgattatagattttgatgcaaatgctgaagaagagggtccctacgaagctctgtataatgccatctcctgccattcgttggacagcatggccagcgggcgatcatctgaccaagactccacgaacaaggaggctgaggcagcaggagtgaaacctgctggagtgaggcctagggaacgtccaccacctccagcaaagccaccgcccgatgaagaggaagaagaccacatagataagaagtattttcccttgacagcttctgaggttctgtccatgagacctaggattcatgggagtgcagcccgggaagaagacgaacacccttatgaactgttgttaacagcagagacaaagaaagtggtgttggtggatggaaaaacaaaagaccacaggcggagcagcagcagccggagccaggactctgcggaggggcaggacgggcaggtcccagagcagttctcaggcctcctccacggctcctccccggtgtgcgaggtggggcaggaccctttccagctgctctgtaccgctggccagagccatccagacgggtccccccagcagggcgcctgccacaaggccagcatgcagctggaggagacgggtgtgcatgctcctggagcctcccagcccagtgccctggaccagagcaagagagtgggctacctcacaggcctgcccaccaccaacagccgctcgcaccctgaaactttgactcacacagcatctccgcaccctggtggtgctgaggaaggagaccggagtggggccaggagccgagcgcctcccactagcaaacccaaagctgaactcaaactcagccgcagcttgtccaagtctgactctgatctcctgacctgctcacccacagaggacgctaccatggggagtcggagtgagtccttatccaactgcagcattgggaagaaaaggctagagaagtcaccctccttcgcctcggagtgggatgagattgagaaaatcatgagttctattggagaagggattgacttttctcaggaacggcagaagatctcaggtttacggacgctggagcagagtgtcggggagtggctggagtcgattgggctgcagcagtatgagagcaagttgcttctgaatggctttgacgatgtccacttcctggggtctaatgtgatggaagagcaggacctgcgggacatcggcatcagcgacccacagcaccggcggaagctgctccaggcggcacgctccctacccaaggtgaaggctctgggttatgacgggaacagcccccctagcgtgccctcctggctggactccctggggctgcaggactacgtccattccttcttgtcaagtggttacagctccattgacaccgtgaagaacctctgggagctagagctcgtcaatgtcctgaaggtccagctgctcggccatcgcaagcgcatcatcgcctccctcgcagacagaccgtacgaggagccgccccagaagccccccagattctcccagctgaggtgccaagatttgctctcccagacgtcatccccactgagtcagaatgattcctgcactgggcggtcggcagatctgctgctgcctccaggggacacaggcaggaggcgccatgacagtctccatgaccctgcggcaccctcccgagcggagcgcttcaggatccaggaggagcaccgtgaggccaagctgaccctgcggcccccgagcctggcagccccctacgccccagtgcagagttggcaacaccagccagagaaactcatcttcgagtcctgtggttatgaagccaattatctgggctccatgctgatcaaagatctgcgagggacagaatccacgcaagacgcctgtgccaagatgcggaaatctacggagcacatgaagaagatccccaccatcatcctgtccatcacatacaaaggtgtcaagttcatcgatgcctccaacaagaacgtcattgcagagcacgagatccggaacatttcctgtgcggcccaggacccggaggacctctgtacctttgcctacatcaccaaggacctgcagaccagccaccactattgccatgtgttcagcaccgtggatgtgaacctgacctacgagatcatcctgacgctggggcaggccttcgaagtggcctatcagttggccctgcaggcccagaagtccagggcgacgggcgcctctgcagctgagatgattgaaacaaaatcttccaaaccggtgcctaagcctcgggtcggcgtgaggaaatccgcactggaaccacctgatatggaccaagatgcccaatcccatgccagtgtctcctgggttgtggaccccaaaccagactctaagcggagcctcagcaccaactgagccactgaggaaccacactgtgctgcggaaacatagacgtgggggcataggctcccactgccaccaccgccatcgcctcacctgcagctctgaagacccaggcctcacctccgcctgcaggacctcctcttggccacttggcctgggcctgccaccaccacgtcctgcagaacgagccctgccttggctgtggagaagcactccaggccgctagcagatgggactggcattccagagggtcaagaagtgacttgttcagaacacattgtttttaacagaaaaaaaatctttttataaaatgaacttttaacacttggctcaaacctctaggtcatactgccaatctttagacaaatggccatggggcagaggacaggggagctgaggttggttcagaggccagcctgcatagcctctgtcctcaggacggaacttgggtgcagctcagtgggtcggaagagaaggcggtggcctgtgggtgaggggaacggagcaggctcaggcagaattgagtacggtgcgtctgcttttcaaacccaaccatatcagctgctgctctttatgaactgcccaacttcctgtccctttcaggggctagacacaggcttctcgtaagaacacagccttagaggcacctgagcaactcaaaggtttccggtccatttctggggttcccgatgggaaggttcagtggccaaatgaagataagtgtgcagtttctagtgctgggaagtcttagccagcaccagagcgccaggcctctccctggcctcttacctgtcagtgatcggagcactgccctgggctggccggcgccgtactgcctgcgttgtgtcagagaataggaaaagcagctttgtttggggcattaatgcttggagtggggtcagctaaggttgctacttgccaatttgtgatttgtctaatcagcctgtgtgattggggctcattttgattctctgaattatcggtttgacggttacacttggctgctgggcccatccctggcccccggtgtggaaaaggctaaataaggtgacagtgcatcgatgctcccccgcgtggcctttggggcaggctggcatcccggtgcgcctctgcttcttaagctttcctgctgctcgctttgtttttaaaagtaacttgggttgcattcttccctctggactagagtagaaatgcaggggaaactgctgtggatttgagaggcaaagttggctcagctgtgtgcccagttcctcctgtgggcactttagcaggctccgagctttcctggcataggtcaatcaggtcccaggatgaataatccaggcttcagcaacactcctctttcccagccagcaaaggctgtgaatttgaattctttgttggtatgtatgtgcagggagtactgttaggcacattcttaacccatgtggttggccagaaatcagaagtggggctgtgtctctgactggctagaggccaggccttgtgggtttctatctgctaagcacccagcaggttggggcctgggactcagctctctctgcggtagaggcaggccctcctccacttcttggtactaaacgaagatctcgacaccttgcagttttacttcatttcctgcccctttcagggcctgtgaggatgcccatgagctaccgctgtacagttctcggccccggctttcttccaagagttgaccaggaaccctaaagcatccagagtagactgcgctgccactgcgcacatgctggtgcccgtcttcctcctaaggggccaggccacatccaagtgggcctctgtcgggggcggggcggtaggtccgaaagaaaccgcagacactacgatgcactcctcaagctgtcttttgtgcttagatcatccataggtgtttcttctgcttgaagctgctatatcatctttatttattcagggtattttcatattggaagccttggctagtctgctctagctctgggttctgtttagagattggtttatttctgaatattcaagaaaggaaaatgactgggcctttctttcttttcttctcctctgggatgggtagtctccctttcctagaaaggttattataactttaaggacaggcttcaagtgggaaggcccctacttttgcacttctccaagtgcaggtcacaccaggggcagaccctgtcgctgcgtttctgaactgtgaaggagcccattcgggtgggagacttcagatgggctcagtacctgtcccagccacaggcttcttgtccacctcttctcccctgcccaccagctgctcagcgcataagaccttcccgacaggctctgcgtgtgcagctctctgcgtccctcctgggccctccagcgtcagacactaatgggagttcccgagatgctcgggtttgagcagggagcaggcagagctgcagtcagagacattagaaaaccagtctgaattgggtctgtctttgagatgcccaggccagcagaaagcagctcagaagtattgttgctcatggtgtggcaatggactgaactgtaatgaaaatgttatttaatctttgtctctgtattttgatacttgaatgactttcccttttgttttactgtatataaaattgttaatctgtctgattttgtctgaattataaacactttgaggtaccaaacataaccaatctgtgcaacaacatagactgacctcagtacccaagagagtgtaaatatttctgggcttccagctttggttttgttattttcataactgtacacaacttagaacagactgaattaataaatgagaagcgacatgaa

SEQ ID NO: 1489 - DNA, 3813 bp, Homo sapiens
gggaaagttcccggctgtcggttggagggtgggtcctcgccccgccccgccccctcgggccgcccttccgcgcttccgggaggcttgtcccaagctcacggacccctcgctgggtgccggttaagaccccgctccccgtcgccagtgctatggaggcggcggcggcggtggtggcggcagaggcggaagtggaaaacgaagacggcgacagcagctgcggggatgtatgcttcatggacaaaggcttgcagagcatatcagaattatctttagattcaactcttcatgccgtcaatcttcattgcaataacatctccaagatcgaagccattgatcatatttggaatttacaacatctagatctgtcatctaatcaaataagtagaattgaaggactaaacacactgacaaaactgtgcacattaaatttgtcctgcaatttgattacaaaagtagaaggacttgaagaactaattaatctgactagactaaatgtatcttataaccacatagatgatcttagtggattgattccccttcatggaattaagcataaacttagatatattgatctacatagtaatcgtatagatagtatccatcacttacttcagtgtatggtaggattgcacttcctgaccaatcttattttggagaaagatggagacgataatcctgtctgtcgactgccagggtacagagcagttattctccagactttgccacagcttagaatcctagattgcaagaacatatttggtgaaccagtaaatttgacagaaataaattcatcacagctgcagtgcctagaaggtcttttggataatttagtttcttctgattctcccctaaatataagtgaagatgagatcattgatagaatgccagtgataacagcacctatcgatgagttagttcccttggaacagtttgcaagtacaccaagtgatgctgtgttgacgtcttttatgtctgtgtgtcaatcttctgagccagagaaaaataatcatgaaaacgatttgcagaatgagataaaacttcagaaattagatgaccaaattctacaacttctaaatgaaacttctaattcaatagataacgttcttgagaaagaccccagaccaaaaagagacacagatataacttctgaaagtgactatggaaacagaaaagaatgcaatagaaaagttcctcgaagatcaaaaatcccttatgatgccaaaaccattcaaactattaagcaccacaataaaaactacaactcttttgtaagttgtaatcgtaaaatgaaaccaccttaccttaaagaattatatgtaagctcatctttagcaaactgtcctatgttacaagaatcagaaaagccaaagactgaaataattaaagtagaccaaagtcactcagaagacaacacttaccagtcccttgttgaacagctagaccaagagagagagaagagatggagagctgagcaagccgaaaataaactcatggattatattgatgagctgcataaacatgcaaatgaaaaagaggatattcatagtctggctctacttaccacagataggctaaaggaaattatttttagagagagaaattccaaaggacaactcgaagttatggttcacaaacttcaaaatgaaattaaaaaactgactgttgaactaatgaaagcaaaagatcaacaagaggatcaccttaaacacttaagaaccctcgaaaaaacattagaaaaaatggagagacaaaaaaggcagcagcaggcagcacagataagactgatccaagaggtggaactcaaagcttcagctgccgatagagaaatatacttacttagaacttcccttcatcgagaaagagaacaagcgcaacaacttcatcaacttcttgcattgaaagaacaggaacacaggaaggaacttgaaacaagggagttttttactgatgctgacttccaggatgccttagctaaagaaatagccaaagaagagaaaaagcatgagcaaatgataaaagaataccaagagaaaattgacgtgttaagccagcagtatatggatttagaaaatgaattccgtattgctttaactgttgaagccagaagatttcaagatgttaaagatggttttgaaaatgttgcaactgagttagcaaagagcaaacatgctcttatttgggctcaacgaaaagaaaatgagtcttcctctttaattaaagatctgacctgtatggtaaaggaacaaaaaacaaaactggcagaagtttctaaattgaaacaagaaacagcagcaaatttacagaatcaaatcaacacccttgaaattttaattgaagatgacaagcagaagagtattcaaatagaacttctcaagcacgaaaaagtccagcttatttctgagctagcagccaaggaatcactaatatttggtttaaggacagaaagaaaagtatggggacatgagctggcacaacaaggatcttctctagcccaaaatcgtggaaaattggaggctcaaattgagagtttatctagagagaatgaatgtctgcgaaagacaaatgaaagtgatagtgatgcattaagaataaagtgcaaaatcatagacgaccaaactgaaactattagaaaattaaaagattgtttacaagaaaaagatgaacacatcaaaagattacaagaaaagatcacagaaatagaaaaatgcactcaagaacaacttgatgaaaaatcttcacaactggatgaggtacttgagaagttggaaaggcacaatgaaagaaaagaaaaactaaaacaacagttgaaaggaaaggaagtagaacttgaagaaatcagaaaagcttacagtacactgaatcggaagtggcatgataaaggagaacttctatgtcatcttgaaacacaagtaaaagaagtgaaagaaaaatttgaaaacaaggaaaagaaacttaaagcggaaagagacaaaagtattgaactacaaaagaatgcaatggaaaaacttcatagtatggatgatgcctttaaaagacaagttgatgcaattgttgaagctcatcaagctgaaatagcacagctggccaatgaaaagcagaagtgtattgattctgcaaatttaaaggtccatcaaattgaaaaagaaatgcgtgaacttttggaagaaacatgcaagaacaaaaaaacaatggaagcaaaaattaagcaacttgcttttgctttaaatgaaattcagcaagatatgtgatggttctgagaatgaatttaattgaaatagaccagcagacctattgtaaaaatgattaaatattgtaatagtagtaactgctatgactttgaaatgtctctttctatacatttcattatgaatatatttttaaagacttttgatcaagtatttattaattgtataggttttttataataaattgttgacaattttgtctattagaaaaaactatcataactagacttacaatatttttcttgtttctgtactatacattgtttggtaattacacatttgcctacaaatttgtgaatgaaaagattagtattttcaccatatgaggtaaaacattttaatcattgttatcttattgtgatgatgaagaactaattatatttgttatttaattgatgtagctcaattcttttaaagtacttatgtagccaaaaagcatttgaaatctgtatgataaaagatgtggcattcttaagaaagtatatgtagccatctccacatcactcattatgaccccttcttttataatgcttatatcttttcattaaagattacatttaaggtttta

SEQ ID NO: 1490 - DNA, 682 bp, Homo sapiens
aactcctggtactctagcaccgatctgctttggagaacctgatcctgagactccagcaggatgtcttatcaacagcagcagtgcaagcagccctgccagccacctcctgtgtgccccacgccaaagtgcccagagccatgtccacccccgaagtgccctgagccctgcccatcaccaaagtgtccacagccctgcccacctcagcagtgccagcagaaatatcctcctgtgacaccttccccaccctgccagccaaagtgtccacccaagagcaagtaacagcttcaggattcatcaggagcatgagaggataaggataattggctcacctcgttccacagctccacttgcatcttctcaccaaagccttccatggatgcacagggagcttctttctccttaacctgtggcctgcctgtgatgatctgtgacagcaaaagattccctttctgaggctgccatactgccactgtccaggtggagctaagaaaaggaagtcctcagctgtgccagctcccagagcttcggaagaaagagcagcagctctctccctgggaaccatcagacaattctgttgatgtgttctgtgtctgtctgtcacctggtcatgagcttctaccacctttgcaattgtcatttatctttcactccctgaataaagtatctatgcatatatatttgt

SEQ ID NO: 1491 - DNA, 1390 bp, Homo sapiens
accctcagggcagagagcagccctacactccctacaccacacccatactcagcccctgcaggcaaggagagaacaggtcaggttcccgagagctcaggaacatggagctgatccaggacacctcccgcccgccactggagtacgtgaagggggtcccgctcatcaagtactttgcagaggcactggggcccctgcagagcttccaagcccgacctgatgacctgctcatcaacacctaccccaagtctggcaccacctgggtgagccagatactggacatgatctaccagggcggcgacctagagaagtgtaaccgggctcccatctacgtacgggtgcccttccttgaggtcaatgatccaggggaaccctcagggctggagactctgaaagacacaccgcccccacggctcatcaagtcacacctgcccctggctctgctccctcagactctgttggatcagaaggtcaaggtggtctatgttgcccgaaacccaaaggacgtggcggtctcctactaccatttccaccgtatggaaaaggcgcaccctgagcctgggacctgggacagcttcctggaaaagttcatggctggagaagtgtcctacgggtcctggtaccagcacgtgcaggagtggtgggagctgagccgcacccaccctgttctctacctcttctatgaagacatgaaggagaaccccaaaagggagattcaaaagatcctggagtttgtggggcgctccctgccagaggagaccatggacttcatggttcagcacacgtcgttcaaggagatgaagaagaaccctatgaccaactacaccaccgtcccccaggagctcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatctaccctgaccaatgggctcaagaataaagtatgatttttgagtcaggcacagtggctcatgtctgcaatcccagcgatttgggaggttgagctggtaggatcacaataggccacgaatttgagaccagcctggtaaaatagtgagacctcatctctacaaagatgtaaaaaaattagccacatgtgctggcacttacctgtagtcccagctacttgggaagcagaggctggaggatcatttcagcccaggaggttgtggatacagtgagttatgacatgcccattcactacagcctggatgacaagcaagaccctccctccaaagaaaataaagctcaaaataaaatatgatttgtgttca

SEQ ID NO: 1492 - DNA, 3211 bp, Homo sapiens
acttcctgccgggctgcgggcgcctgagcggctcttcagcgtttgcgccggcggctgccgcgtctctctcggctcccgcttcctttgaccgcctcccccccccggcccggcggcgcccgcctcctccacggccactccgcctcttccctcccttcgtcccttcttcctctcccttttttccttcttccttcccctcctcgccgccaccgcccaggaccgccggccgggggacgagctcggagcagcagccagagtttattaaccacttaacctctcagaactgaacaaagacaacattgttcctggaacgccctctttttaaaaaagaaagcataacccctactgtagaactaaatgcactgtgcatgaaacttggaaaaaaaccaatgtataagcctgttgacccttactctcggatgcagtccacctataactacaacatgagaggaggtgcttatcccccgaggtacttttacccatttccagttccacctttactttatcaagtggaactttctgtgggaggacagcaatttaatggcaaaggaaagacaagacaggctgcgaaacacgatgctgctgccaaagcgttgaggatcctgcagaatgagcccctgccagagaggctggaggtgaatggaagagaatccgaagaagaaaatctcaataaatctgaaataagtcaagtgtttgagattgcacttaaacggaacttgcctgtgaatttcgaggtggcccgggagagtggcccaccccacatgaagaactttgtgaccaaggtttcggttggggagtttgtgggggaaggtgaagggaaaagcaagaagatttcaaagaaaaatgccgccatagctgttcttgaggagctgaagaagttaccgcccctgcctgcagttgaacgagtaaagcctagaatcaaaaagaaaacaaaacccatagtcaagccacagacaagcccagaatatggccaggggatcaatccgattagccgactggcccagatccagcaggcaaaaaaggagaaggagccagagtacacgctcctcacagagcgaggcctcccgcgccgcagggagtttgtgatgcaggtgaaggttggaaaccacactgcagaaggaacgggcaccaacaagaaggtggccaagcgcaatgcagccgagaacatgctggagatccttggtttcaaagtcccgcaggcgcagcccaccaaacccgcactcaagtcagaggagaagacacccataaagaaaccaggggatggaagaaaagtaaccttttttgaacctggctctggggatgaaaatgggactagtaataaagaggatgagttcaggatgccttatctaagtcatcagcagctgcctgctggaattcttcccatggtgcccgaggtcgcccaggctgtaggagttagtcaaggacatcacaccaaagattttaccagggcagctccgaatcctgccaaggccacggtaactgccatgatagcccgagagttgttgtatgggggcacctcgcccacagccgagaccattttaaagaataacatctcttcaggccacgtaccccatggacctctcacgagaccctctgagcaactggactatctttccagagtccagggattccaggttgaatacaaagacttccccaaaaacaacaagaacgaatttgtatctcttatcaattgctcctctcagccacctctgatcagccatggtatcggcaaggatgtggagtcctgccatgatatggctgcgctgaacatcttaaagttgctgtctgagttggaccaacaaagtacagagatgccaagaacaggaaacggaccaatgtctgtgtgtgggaggtgctgaaccttttctggccatgaaccattataaaatcccaacatatatactgaaaatactgaaactgctttgaaaatttggaatttctgatacctccagtgggccgagagacacggtgggtaaaggatgtgggcagcagcagggaagacaacagaaacacaaggaggcggctgtggccgggctggactgtgctggggtttgttgtgatggccactcggtgacctggcggtccctacgcaatagcagctgcctgtggggaagaagggctgcccagccagctggttctcccgggacaccagcagatccacaccctgggcacctccgtgtttggtcttttttttcccctgtgtgaaagaagaaacggcacgaccccttctcaagctggctcactcagacacattgggacaaaccctggacagccatgccagagagaggcctttgaccggccccagagctaaaagcaccagagaaaatcaaatgcttcctactcagcgtgacccaacttttctagtgtgccacggccccaccacctcctgcagtacccacaccatcaccactgctttctcttccaacagtgatctgtattcttagtttcattattttcttttgattgatatgacactatataaaattttcatttgagaatttctcaattgtatctagttaaatagcacagtttggaaacttgtctgagactgactttatcaataatctaaccgacaaagatcatatccatgtgtatgtggttagacatttttatttcattgactaacccaggacagtttcagtgatgcaaattgtgtgccctctggttcagctgaaacagtcctggactttcaaaaaccttgaataagtctcccacagttgtataaattggacaatttaggaattttaaactttagatgatcatttggttccatttttatttcatttttatttttgttaatgcaaacaggacttaaatgaactttgatctctgttttaaagattattaaaaaacattgtgtatctatacatatggctcttgaggacttagctttcactacactacaggatatgatctccatgtagtccatataaacctgcagagtgattttccagagtgctcgatactgttaattacatctccattagggctgaaaagaatgacctacgtttctgtatacagctgtgttgcttttgatgttgtgttactgtacacagaagtgtgtgcactgaggctctgcgtgtggtccgtatggaaagcctggtagccctgcgagttaagtactgcttccattcattgtttacgctggaatttttctccccatggaatgtaagtaaaacttaagtgtttgtcatcaataaatggtaatactaaa

SEQ ID NO: 1493 - DNA, 1960 bp, Homo sapiens
aagctgagccgagccgagccgagctgggggcgcagagcgcgggaggcggcggcggcgcggagcccaggtggctccgctgccggatgggagtgccccagtgtgctggatgaagctggcgcatgcaccatgtcatcatgtgtctctagccagcccagcagcaaccgggccgccccccaggatgagctggggggcaggggcagcagcagcatccacctgggcatggagtccttcattgtggtcaccgagtgtgagccgggctgtgctgtggacctcggcttggcgcgggaccggcccctggaggccgatggccaagaggtcccccttgacacctccgggtcccaggcccggccccacctctccggtcgcaagctgtctctgcaagagcggtcccagggtgggctggcagccggtggcagcctggacatgaacggacgctgcatctgcccgtccctgccctactcacccgtcagctccccgcagtcctcgcctcggctgccccggcggccgacagtggagtctcaccacgtctccatcacgggtatgcaggactgtgtgcagctgaatcagtataccctgaaggatgaaattggaaagggctcctatggtgtcgtcaagttggcctacaatgaaaatgacaatacctactatgcaatgaaggtgctgtccaaaaagaagctgatccggcaggccggctttccacgtcgccctccaccccgaggcacccggccagctcctggaggctgcatccagcccaggggccccattgagcaggtgtaccaggaaattgccatcctcaagaagctggaccaccccaatgtggtgaagctggtggaggtcctggatgaccccaatgaggaccatctgtacatggtgttcgaactggtcaaccaagggcccgtgatggaagtgcccaccctcaaaccactctctgaagaccaggcccgtttctacttccaggatctgatcaaaggcatcgagtacttacactaccagaagatcatccaccgtgacatcaaaccttccaacctcctggtcggagaagatgggcacatcaagatcgctgactttggtgtgagcaatgaattcaagggcagtgacgcgctcctctccaacaccgtgggcacgcccgccttcatggcacccgagtcgctctctgagacccgcaagatcttctctgggaaggccttggatgtttgggccatgggtgtgacactatactgctttgtctttggccagtgcccattcatggacgagcggatcatgtgtttacacagtaagatcaagagtcaggccctggaatttccagaccagcccgacatagctgaggacttgaaggacctgatcacccgtatgctggacaagaaccccgagtcgaggatcgtggtgccggaaatcaagctgcacccctgggtcacgaggcatggggcggagccgttgccgtcggaggatgagaactgcacgctggtcgaagtgactgaagaggaggtcgagaactcagtcaaacacattcccagcttggcaaccgtgatcctggtgaagaccatgatacgtaaacgctcctttgggaacccattcgagggcagccggcgggaggaacgctcactgtcagcgcctggaaacttgctcacgaagcaaggcagcgaagacaacctccagggcaccgacccgccccccgtgggggaggaggaagtgctcttgtgagaggcagtccctgcgtggaaagttgctgggcccccgcccccggctcccccgcacgcatgcatccactgcggccggaggaggccatggagcccgagtagctgcctggatcgctcgacctcgcatgcgcgccgcgtcgcctctggggggctgctgcaccgcgtttccatagcagcatgtcctacggaaacccagcacgtgtgtagagcctcgatcgtcatctctggttatttgttttttcctttgttgttttaaaggggac

SEQ ID NO: 1494 - DNA, 2154 bp, Homo sapiens
aacagatgattccctgattctccagagagattacacacttcgtttgtggctaaggtgacccaatgaaagaagaaaatgaaagccataaagaaaagtcttacagaagaagaatacctgtacctggacttttctcaccaaacagaaggatgcatctttcctcttcatacatctgtaactttatttctgttatcttactgtgactgtaaaatctttaaaatttgcttagttgtcaccaaagaggtgagtagagatagttcactactaagagatgacctgatccaggatgttgaaatacagattatttcaaggcaggagctcccaccaatagtccaaaattgctgtttgcctgcagtagtagaacgatcagacaatttttgtagagcaggacttgctgttgtattgagacacataatccagaaatcctatgaagcagaccccttaaagaaggaacttttggaacttctgggctttaaaaagacttgcttgaaagcctgtgctgaagttagtcagtggaccaggctatgtgaactcaccatccctttggctattgagaattttctcagagaatcttctgaccagcccccaactatacctgtagaaatactacagctagagaaaaagcttagtgagcctgttagagtgcataatgatgataaactccgcaggcagaagctcaagcaacagaaggctgatggagttgggcctccccttactaagggaaaggcaaagagcaaggtccacacacaggaaacatctgaagggttggattcttcatccaagagtctggaactgaaagtggcattctcaaagctcacagtacaggaagaaccagctactaccaacagagagccttctcacatcagaaaagcaaaagcctccgaccttccacctctggagcatgtgtttgcagaagggctttacttcactctggcagatattgtgctcttgccctgtatccatcatttcttggtaattatcagcaggaaattttctgagaagctggtagaatttccattgctagcctcttggtaccagaggattcaggaagtgccaggagtaaaaacagcagcttctaagtgtgggatccaatttctccatttaccaaagttgttgacaacctcaactgaacagcatccaaacttatgtgaagtcccaggtgtagaagagcaaagcgatcctttatttataggaggaccaagaccaaccatggccaagttaatggaaaagggcattgaagtgatgttttctccccacccttgccctacttggactcttgattggaatgttctccctgcagcagtcagcccaaaggaaggtaaaatgtccagtgatcgagctttgaggaagcagcaacagttgaacaaccttgtctatgtggtaacaaatcaggccaaacctggtgacagaattgtggatttctgcagcggtgggggccatgttggaattgtccttgctcacatgctgccatcatgtcaggttacattaatagaaaacaaggaattatcattaattcgtgctaagaagagaagtgatgaactgggtttaagcaacatttggttcattcaagcaaatatggaatattttactgggatgtttaatattggagtagcattgcatgcttgtggagtggcaacagacatggtgattgagcactgtatcaaaacacgggcttccttcgtcacatgcccttgctgttatggtttcattcagaacacctcaaagttcaattttccaaaaagtgaacaattcaagaaaactttatcatacaaggaacacatgattctgtgcagatttgcagaccagacagctgtccagctcccaccccaacgaaggctcataggaaaacagtgcatgtgcttggtggatctggatcgagcaagagctgcagaagaatgtggatactccgttcaagtgatatccatggagccagagagctgctctcccaaaaataacatgattgtgggagtccccatttaaaatgagatattcacatttgatattttgccatccgtcttcacgttggatgcccagtggcattcaggaggttcttggcataactaggaaacagcattagccatcttgaacctattgtgctcaggaaggaaagcaacagggaaatcttggaagtaaaggctccctgcaaagcatcacaaa

SEQ ID NO: 1495 - DNA, 632 bp, Homo sapiens
gcgggcgctgcggcccctgctctacctcctagcgccggtgcgcggccgaggccgcactacctgtctgcgggaaagcgggatccaccccaggacgtcgggtcgctgccgacataatgtcaagtggaaactatcagcagtcagaggctcttagcaaacccactttcagtgaggaacaagcctctgcgttagtggagtcagtgtttgggttgaaagtttccaaggtccggccacttcctagctatgatgaccaaaactttcatgtctacgtttcaaaaaccaaagatggcccaactgaatatgtcctcaaaataagcaacaccaaggctagcaaaaatccagacctgattgaagtgcagaatcacatcatcatgtttctgaaagccgctggatttccaacagcctctgtgtgtcacactaaaggagacaacacagcttctctcgtgtctgtagatagtggctctgaaatcaaaagctacttggtgaggctgctgacttacctcccaggaagacccatcgctgagcttcccgtcagcccccagctattgtatgaaattggaaaactagctgccaaattggataagacactgcaggagggtaagccccgcgttacacccctattggccaaaaactga

SEQ ID NO: 1496 - DNA, 3233 bp, Homo sapiens
acttccggtgcttgccctgcccatccccgtggcgggggcgtggccatggcgggggcgctccggcgggggcgggccctgggctcccgcccttcgggtcccacagtttccagccgccgctctcctcagtgcccggtggcccaggagggcctgggagcccgaagccgtccccgagtcgctcctaggtcactggcgcgatgcgggccgtcctctcggctgatgggttggaagcccagcgaggctagaggccagtcccaaagtttccaggcatcagggctgcagcccaggagcctcaaggcggcccggcgggcgactggacggccggacaggtcccgagcagcccggcccaccatggacccctctgcccacaggtcccgagcagccccgcccaacatggacccagacccccaggcgggcgtgcaggtgggcatgcgggtggtgcgcggcgtggactggaagtggggccagcaggacggcggcgagggcggcgtgggcacggtggtggagcttggccgccacggcagcccctcgacacccgaccgcacagtggtcgtgcagtgggaccagggcacgcgcaccaactaccgcgccggctaccagggcgcgcacgacctgctgctgtacgacaacgcccagatcggcgtccggcaccccaacatcatctgtgactgctgcaagaagcacgggctgcgggggatgcgctggaagtgccgtgtgtgcctggactacgacctctgcacgcagtgctacatgcacaacaagcatgagctcgcccacgccttcgaccgctacgagaccgctcactcgcgccctgtcacactgagtccccgccagggcctcccgaggatcccactaaggggcatcttccagggagcgaaggtggtgcgaggccccgactgggagtggggctcacaggatggaggggaagggaaaccgggccgtgtggtggacatccgtggctgggatgtggagacaggccggagtgtggccagcgtgacgtgggctgatggtaccaccaatgtgtaccgtgtgggccacaagggcaaggtggacctcaagtgtgtgggcgaggcagcgggcggcttctactacaaggaccacctcccaaggctcggcaagccggcggagctgcagcgcagggtgagtgctgacagccagcccttccagcacggggacaaggtcaagtgtctgctggacactgatgtcctgcgggagatgcaggaaggccacggcggctggaaccccaggatggcggagtttatcggacagacgggcaccgtgcatcgtatcacggaccgcggggacgtgcgcgtgcagttcaaccacgagacgcgctggaccttccaccccggggcgctcaccaaggccctgggccgcgtcgggaaggtggtgaaagtgtttggagacgggaacctgcgtgtagcagtcgctggtcagcggtggaccttcagcccctcctgcctggtggcctaccggcccgaggaggatgccaacctggacgtggccgagcgcgcccgggagaacaaaagctcactgagcgtggccctggacaagcttcgggcccagaagagtgacccagagcacccgggaaggctggtggtggaggtggcgctgggtaacgcagcccgggctctggacctgctgcggaggcgcccagagcaggtggacaccaagaaccaaggcaggaccgctctgcaagtggctgcctacctgggccaggtggagttgatacggctgctgctacaagccagggcgggcgtggacctgccggacgacgagggcaacacggcactgcactacgcggccctggggaaccagcccgaggccaccagggtgctcctgagtgctgggtgccgggcggacgccatcaacagcacccagagcacagcactgcacgtggccgtgcagaggggcttcctggaggtggtgcgggccctgtgtgagcgcggctgtgacgtcaacctgcccgacgcccactcggacacgcccctgcactccgccatctcggcgggcactggagccagcggcattgtcgaggtcctcacggaggtgccaaacatcgatgttaccgccaccaacagccagggtttcaccctgctgcaccatgcctccctcaagggtcacgcgctagctgtgagaaagattctggctcgggcgcggcagctggtggacgccaagaaggaggacggcttcacggcgctgcatctggctgccctcaacaaccaccgcgaggtggcccagatcctcatccgggagggccgctgtgacgtgaacgtgcgcaaccggaagctgcagtccccgctgcatctcgccgtgcaacaggcccacgtggggctggtgccgctactggtggacgctgggtgcagtgtcaacgccgaggacgaggagggggacacagccctgcacgtggcgctgcagcgtcatcagctgctgcccctggtggctgatggggccgggggggacccagggcccttgcagctgctgtccaggctacaggcctcgggcctccccggcagcgcggagctgacggtgggcgcggcggtcgcctgcttcctggcgctggagggcgccgacgtgagctacaccaaccaccgcggtcggagcccgctggacctggccgccgagggtcgcgtgctcaaggcccttcagggctgcgcccagcgcttccgggagcggcaggcgggcgggggcgcggccccgggccccaggcaaacgctcgggacccccaacaccgtgacgaacctgcacgtgggcgccgcgccggggcccgaggccgctgagtgcctggtgtgctccgagctggcgctgctggtgctgttctcgccgtgccagcaccgcaccgtgtgtgaggagtgcgcgcgcaggatgaagaagtgcatcaggtgccaggtggtcgtcagcaagaaactgcgcccagacggctctgaggtggcgagcgccgcccccgcccccggcccgccgcgccagctggtggaggagctgcagagccgctaccggcagatggaggaacgcatcacctgccccatctgcatcgacagccacatccgcctcgtgttccagtgcggccacggcgcatgcgccccctgcggctccgcgctcagcgcctgccccatctgccgccagcccatccgcgaccgcatccagatcttcgtgtgagccgcgccgtccgccgcgcccgagctgccttcgcgtgcccccgccctgtgttttataaaaagaaagattctcggacgttg

SEQ ID NO: 1497 - DNA, 4252 bp, Homo sapiens
ggcggctccggagtccgggaggctctggctgctccagtcgcgggtccgggccccgcctctccactcggcggtggcgtccgtgttgttattgtggtggtagcggcgtctggctgctgcggaccccgccgagtcctagcgcctggcctgcgcgccgctgcccgcgccacagccccatcactgagaagaattttttcactgtatagttgcctctgcacttaaagcaggcttggtccatgaatcccatgacaagagctttgaggacatgaggagcattctttgttcaaacatactgtgttttcctttggatcactggattaatttatttttggaaatcaagtgcaatattggaagccatttctactaattttatttcacttttaaatttatgatttgatttgaatactatcatgggaggagctgtgagtgctggggaagataatgatgacttaattgataatttaaaagaagctcagtatattcgtactgaaagagtggagcaagccttcagagcgattgatcgtggagattactatttggaaggctacagagacaatgcttacaaagacttagcctggaagcatggaaacatccacttgtcagcaccttgcatttattctgaagttatggaagcattgaaacttcaaccaggattgtcttttcttaacctgggaagtggaaccggatatttaagtacaatggtgggcttaattttaggtccttttggaataaatcatgggattgagcttcattcagatgtggtggaatatgccaaggaaaaactggagagcttcatcaaaaatagtgatagctttgataaatttgagttctgtgaacctgcatttgttgttggtaattgcctccagatagcttctgacagtcatcagtatgatcgaatttattgtggagctggagtgcagaaagaccatgaaaactacatgaaaatattactaaaagttggaggcatattagtcatgcctatagaggatcagttaacacagattatgcgaactggacagaacacttgggaaagtaaaaatatccttgctgtttcatttgctccacttgtgcaaccaagtaagaatgataatggcaaaccagattctgtgggactccctccctgtgctgtcaggaatctacaggacttggctcgtatttacattcgacgcacacttagaaatttcataaatgatgagatgcaggccaaggggattcctcaaagggctccacccaaaaggaaaagaaagagagttaaacagagaattaacacttacgtatttgtgggtaatcagcttattcctcagcctctagacagtgaagaggatgaaaaaatggaagaggataacaaagaagaggaggaaaaagatcacaatgaagcaatgaagccagaggagccacctcaaaatttactgagagaaaaaatcatgaagctgcccctccctgaatctttaaaagcttacttgacatattttagagacaaataacttagatcaagaagaaaaatgcctactgataattcctttagtcttgaaaatgtagcatttgttaggagttaaaagagagaattatttctttcatcagagcaaattatagtggaaaaaaaatcacttgtttctgtcagtaacacaaatgatgtattcagtgaataaaagaatcccttttataaaatctatttttctttaaatcttggaaaaatgttgttttagctcagagtgatttcaaagtggaatgcaacagtagtcaagacttgtgtactataaatccttttctgattccttacagatttgtagtgatgaggtttagatttaattttatatatggtttaaataattgttaagcttatataacctgatctgaattgcagttgtttgcatttcctctatgaaaacttcatttatctaataaggaagtcaaatgctttgtagactatttaccttacttttgttgcaatcactgttgttgggttgctgtatatatattccgggcaatatatgagtgcaataacaatacaagatattgaataatttagctttaaaaaatcccacaaattttatgaaattttacagccctgctacttttgcttttgaatctcttgccaaaagacatgggtaaaatatctgcctctctcatagagattttaagagcacagcaagtgaattattaaaacaaagtctatacttaatacaactctttatatggaccctttacattttcagtatttaaaaaaatgaggttatcttaactctatagaattttaaaagtatatttagaattgttttttctgtagttcactgtataaagtatttggttttttaaaaaaagcaaaaccattgttatgtgtgactcttgataggacacagaacgagtgaatgagcatgagtgaggccactttcttggatggctgtaagtagcagggccagggtagacctggtcagcggatgcactttagcagatggaacttctagtttatctgaatatttatctttgacaaggtagggctgagcctacatttgcttttgatctatctagtataagaaatattcacagaaattgtatgtagataccctttgttttgaaaatgctgttcagaatcatagtgtaatctttgggacctatgccatgttcatttcactccttcccatattttttgtgtttcttttggtaaaactataatggttttcattttttacttaatatcacacagttaaactgtccatatttgagctttattttagcttatcagtgataaaaaacaggtagtaactgccattgtttgtttgttttcctaataaggcctgaaaacagccattccttgttaagaaagtgtacaatgtaacatatttgctagagttacatggattatatatttcttaaagggaaaaatttgagagtatcatggactaccaccagcattattattacagtagttactcagatttggttaaggaagcccaagcaatgtatagtgaaaggattattatctctctgctaagattcagatattgtttcagaaatctcagctccagtaattccacaacatctaaaaacaaatgtttgtgatcatgtgtaagcatgaaattgttccaagtaagtgaggatattttagttatgtgaaagacagtttcatggaaggtatttgttttataccagtggctgggatggtggaattggggttatttctacaattattcttagacgattactaaactgttaagaaatgccccatatcatttttgtatctaggaaagaaaaaaatcagtttcatactgttgtcatctgtcagaaatgctcattttattttgaattaaatgtggcttttgaagtacctagttaccttgaattcctggtgaccacatgtttttatctggaaaacctggagaaagttatctgtcccatctcccctgcttgtttttttttttttttttggttggagctgctgtttagatgatgcttttactatgcaggagagagtttttgttaaggatatatttgaagattggcttttccatattgtccttcattctttgaccatggcaaagtgtacagtagattttcatgatcattgcatatttcttgtcattgaaatgtatcttttatgtttttaaatgcattcattttacacttgtgagtttatcattgactttaagaggtagaaatgaaaaatgaaaattaaagctaaagcctttttatctattaatgcagatatattagaataagaatattttgggtttgtgtttattttttaatgaatttatgtttacttgatatggaaaattacgctttataggtggaaaagtagcaaataaagattaagtaaaagtaagtgaaaatgatggggaatatagtattggaattttatagctagttaaaacagtaagtatcatctaatttgggtgtttattttgcagatgagaaaacagacctagaaccgtggcatgttttgcctgaaacatacagtgagttagagacagggcctaagatagcttctagcatcagatcaatcccaagaatccatcagcaacctcagaccaacccaagaagataatttaaatctatactgcttattggtcaatatatttggttctagtattaataaagaaaaatgttattaaaatagcatacatagtagtaaaataaaatacaaaaagtgtgttgatttatagctgtttgagatgataaaagtgaagcaaagcctgttaaatcattggaagacttggaaaattattttaaataaacaattacatgtaattaagca

SEQ ID NO: 1498 - DNA, 1156 bp, Homo sapiens
gtcgcattggtttatagatagacgtaatcaatggatggcattgcaaggagcatccagttttatggagggtggaagcctcacttccttggctataataaagagttctgatgcatcttcatacaacaagaggaagagtctgcacgcagaagcaccaccttctagggataaataaagggtcaagctaaggaagggcagaacaaacttcagacactcacttctttgcctcaacttcagcctgctctcacaacctcactatgtcttgccccaactactgctcgggaaactccaactcaggatctctcagaacctcccgccatattcctctcacctccatcgacctctgccctaccagcgtgagctgtggagatgtcctctacttacccactagctctcaagaccatacctgggtcacagacaactgccaagagacctgcggtgaaccaaccagctgccagccggtccactgtgagaccggcaatcttgaaacctcttgcggttcttccactgcttactacgtgcccaggccttgccaaggaagcagttttcttcctgcttctttcttctccagttcctgccttccagtatcctgtagaccacagaggtatgtgtccagcggctgtcgtccactgaggccgctgctcaatagttaccagcccataggagactgtgtgcccaatgcctatcgcccccaattctgcttgtccaagagttgccagccccaaaacctcctcacttctggatgccaaccctcgagttgcttggcctatcgtcctcaaagtcttcacgttgtgtccagcagcctcagacctctggggcctctgttcagtggttgccaacctctgacccatgtgttcagcacgtgtcgtccatcttgctctggactgtgaaaccagcagcttctttgttccagtgaataatcactctgagcatccacaacaaaaattcaaactccatggacttttgcttctttgctagtagcaactgatgtttcttagttttactgtgcctgatctaatgcaagctgcttctctcgcatgttttatcttgttttcatctttccttgacatcaaaaaaattagtttacaatgctattcaatgttgctctggtctgggaagaatgtatttgttttgcactataataaatgcgattaagtcc

SEQ ID NO: 1499 - DNA, 1157 bp, Homo sapiens
tgggtccgtggcggcgggaggggtggcctcctgcgctggtcgccccaggggacctgagaggcgcgacaaacagtcggcgcgtttggtactcgcgcctgcagagctttcaacctccgcgccggctgcgcctgtttctcggccaggggagcaaggccacgcggcctacgcagccgagtcggaaccaaccggttgtttggtgaaacctaccccagagcctcccgcggcccacagagcacagactgtttttgccaaccatggcatctggagatgacagtcctatctttgaagatgatgaaagccctccttacagcctagaaaaaatgacagatctcgtagctgtttgggatgttgctttaagtgacggagtccacaagatcgaatttgaacatgggactacatcaggcaaacgagtagtatatgtagatggaaaggaagagataagaaaagagtggatgttcaaattagtgggcaaagaaacattctatgttggagctgcaaagacaaaagcgaccataaatatagacgctatcagtggttttgcttatgaatatactctggaaattaatgggaaaagtctcaagaagtatatggaggacagatcaaaaaccaccaatacttgggtattacacatggatggtgagaactttagaattgttttggaaaaagatgctatggacgtatggtgcaatggtaaaaaattggagacagcgggtgagtttgtagatgatgggactgaaactcacttcagtatcgggaaccatgactgttacataaaggctgtcagtagtgggaagcggaaagaagggattattcatactctcattgtggataatagagaaatcccagagattgcaagttaatgaattttcatcttaagaagtaaagatcaggactttttaattactgtggtaattaaatgtgttcagtatgtacttatcagtacatttagtctgcaatgttttaattttttaaaaagttacatgaaactaacattccaagggtcaggaaaaaaaccaattatgtatagtcataaaaattacaatttatgatgcaaataatgtaaaatgttttaaagacaaatggcaaataagatatggaccaaagtcactaatgttttacaacagtaacctttactataataaatacttttaaaaaaa

SEQ ID NO: 1500 - DNA, 5996 bp, Homo sapiens
gcgggaagcagctcttgtggatcctcagtggcggaggctcggtcacccggataggtaaaggaaaacatgcctgccacacggaagccaatgagatatgggcatacagagggacacacggaggtctgttttgatgattctgggagttttattgtgacttgtggaagtgatggtgatgtgaggatttgggaagacttggatgatgatgatcctaagttcattaatgttggagaaaaggcatattcatgtgctttgaagagtggaaaactggtcactgcagtttctaataatactattcaagtccacacatttcctgaaggagttccagatggtatattgactcgcttcactacaaatgcaaaccatgtggtctttaatggggatggtactaaaattgctgctggatctagtgattttctagtcaaaattgtggatgtgatggatagcagccaacagaaaacatttcgaggacatgatgcccctgttttaagtctttcctttgatcctaaggacatctttctggcatcagctagttgtgatggatctgtcagagtgtggcaaatttcagatcagacatgtgctattagttggccactgctacaaaaatgcaacgatgtgataaatgcaaaatcaatctgcagacttgcttggcagccaaaaagtgggaagttactggcaattcctgtggaaaaatctgttaagctatatagaagagaatcttggagtcatcaatttgatctttcagataatttcatctctcagaccctcaatatagtaacctggtctccctgtgggcaatatttagctgcaggtagtattaatggtctaatcatagtttggaatgtggaaaccaaagactgcatggaaagggtgaaacatgagaaaggttatgcaatttgtggtctggcatggcatcctacttgtggtcgaatatcgtatactgatgcggaaggaaatctagggcttctagagaatgtttgtgaccccagtggaaagacatcaagcagtaaggtatctagcagagtggaaaaggattataatgatctttttgatggagatgatatgagtaatgctggtgattttctaaatgacaatgcagttgagatcccttctttttcaaaagggattataaatgatgatgaggatgatgaagacctcatgatggcttcaggtcgtcctagacagcgaagtcacatcctagaagatgatgaaaactcagttgatatttcaatgctaaaaactggttctagtcttctcaaagaggaggaggaagatggtcaagaaggcagcattcacaatctaccacttgtaacatcccaaaggccattttatgatggacccatgccaactccccggcaaaagccatttcagtcaggttctacaccgttgcatctcactcacagattcatggtgtggaactctattggaattattcgctgctataatgatgagcaagacaatgccatagatgtggagttccatgatacctccatacaccatgcaacacacttatcaaacactttgaattatacaatagcagatctttcccacgaagctattttgttggcatgtgaaagcactgatgaactagcaagcaagcttcactgcctgcactttagttcttgggattcaagcaaagagtggataatagacttgcctcagaatgaggatattgaagccatatgtctcggtcaaggatgggctgctgccgctactagtgccctgcttcttcgattgtttactattggaggggttcaaaaagaggtattcagccttgctggacctgtggtgtcaatggcaggacatggagaacagcttttcattgtttatcacagaggtacaggatttgatggggatcagtgccttggagttcaactgctagagctggggaaaaagaaaaaacaaattttgcatggtgaccctcttcctcttacaaggaaatcctaccttgcatggattgggttttcagctgaaggtaccccttgttacgtggattcagaaggaattgttcgaatgcttaacagaggacttggtaatacgtggactcctatatgtaatacaagagagcactgcaaaggaaaatctgatcactactgggtggttggtatccatgaaaatccccagcaactaaggtgcattccttgtaaaggttctcggtttcccccaacccttccacgccctgctgttgctatattatcctttaagcttccttactgtcagattgcaacagagaaaggacaaatggaggagcaattttggcgttcagttatatttcacaaccaccttgattatttagctaaaaatggttatgaatatgaagagagcactaaaaatcaagcaacaaaagagcaacaggaacttttaatgaaaatgcttgcgctttcttgtaaactggagcgagaattccgttgtgtggaacttgctgatctaatgactcaaaatgctgtgaatttagccattaaatatgcttctcgctctcggaaattaatactggctcaaaaactaagtgaactggctgtagagaaggcagccgaattgacagcaacccaggtggaagaggaagaagaagaagaagatttcagaaaaaagctgaatgctggttacagcaatactgctacagagtggagccaaccaaggttcagaaatcaagttgaagaagatgctgaggacagtggagaagctgatgatgaagaaaaaccagaaatacataagcctggacagaactcgttttccaaaagtacaaattcctctgatgtttcagctaagtcaggtgcagttacctttagcagccaaggacgagtaaatccctttaaggtatcagccagttccaaagaaccagccatgtcaatgaattcagcacgttcaactaatattttagacaatatgggcaaatcatccaagaaatccactgcacttagtcgaactacaaataatgaaaagtctcccattataaagcctctgattccaaagccgaagcctaagcaggcatctgcagcatcctatttccagaaaagaaattctcaaactaataaaactgaggaagtgaaagaagaaaatcttaaaaatgtattatctgaaaccccagctatatgtcctcctcaaaacactgaaaaccaaaggccaaagaccgggttccagatgtggttagaagaaaatagaagtaatattttgtctgacaatcctgacttttcagatgaagcagacataataaaagaaggaatgattcgatttagagtattgtcaactgaagaaagaaaggtgtgggctaacaaagccaaaggagaaacggcaagtgaaggaactgaagcaaagaagcgaaaacgtgtggttgatgaaagtgatgaaacagaaaaccaggaagaaaaagcaaaagagaacctgaatttgtctaaaaagcagaaacctttagatttttctacaaatcagaaactatcagcttttgcatttaagcaggagtaaaggaagaaagtgaccctagggaagtaatggatttttttttactcatctttgaatatagactcgagtctttgggaaactcattatatatatattttttaaagagtttgaagcaactgtttgtctttataagataatgtagtaattatattggtgtaggtaacaggacatatgtaaaaactatcatctttgcagattactctgcctccaaatgcagggcctttcagagatgcattgtgattgtaattactgagttgaagctccaaccaatttgaatttgtttcttaaccttgaaaaatcattaaagccaaggtattaaaacctttgtgcattaataccttctaggggtttggttcatttggtttttgtcatgtgcaaggaaggacaatagtcctctttccaagtgtgttagcatagacttctctatatgtttctactagacctaggggatgacgtcttttaataatactggccctaaacatgtaaataatcttgtaggtgagactttttcttttgtgtttcggaaatttcctatgtggctttcagttgtctgtttgtatagcctggatttttttgaggtaaatgaaactttctcatttgtatatttggcttgatatggtcttaatattatctttccacgaaatggatatatttctagaaaatatatatttactaccataatttctaccaccacccccattttgctctgcattatacacagtagagaagaactgaagacactgctgtgacagtattgcagtccaaggcatcatgtgctcttggtgggatactctgattatcagcatcaacagtactttactgagcaagactttgaaggcctgagaagagagcaaagttatggaaagtatttaactcttattttatattgaacaaacaaggtttaatcatgtcatacatttttggttttctaagcagagactaatacaaatgcagccacataaaggcagtgtactgggggtgggagggaaggaaacaatcacataaaatcagctgactcaaaattgaggatagttaataggttgaaagggaaaaagtatgttgaaaatttagacataaatgaaccaagaatattccttatctggtgatgattaaagttaggaaaacatacattttttattttttaattagtagctgctatcagagacattatagcacagtggttatgagcacagattccaaagccagattacctaggttcggagacccgcttctctacctactactaatagttgggtcatgttgggccggtgacccaaattctagccttcattcactcatctgtaaaatggatataatgatagtacctactttataggttgttatgagaattgaatgaaatgaaagcccttagtttctgacacatagtaatcttttatataaatgttagttactattctgataatgatgatgctgttggttatttcatcttgctttgtcattaggtttgattctgaatactatacaaactaattttgatttcaagatcttaagtaaaggtttatttatagtacattggaaagcatgtttgtagacatgtattttgtgtttggttcctcaacttgctttgtatatattttataatactaggttgatataaaagtaaatgcagtttcgccatttcagtggcaaaaaccgcgatttcttttgtgccaacctaatgcttaaggatataatctgtgtatattgtatttcagattcatagcaacctaataacaaggatttacaaaagggtttttacttccctacttttttttggctgaaggaaggtttttgtattgacttggtttaacttacaaatcagaactttgaaaccaagaaacattatccttatttctctgctatataatagtaaacctgtttttttccagtgttcttttttttttttccagagaattgggactgaatagtatgaaagtgaaaatggaaataaattaattattaatcatcatcatatcaataatattgcctacttgagcttattgtatactatagaaaattgacatatacttaattttattctccaaaagcaaaaactcctcacaggaggttactttacagatttattttggagaacaagtgaataggcactggggttatgtgcagctctggggactgtgctatgatctaaagcctctcatatctgtgcagcaacctggggtgagtcactgtcactaacatggaacagatgccaggtagtccctttggacaaaaggatgaggcccatccatgtagaaagcatcttaatcagtgactgtcttatgggccctctttgtttcccatctgttttattatcagaatatataattttcccccaagttttcatcttgaatctctcaaacctacagaaaatttgaaatttgacagtaagcacctgtatatccttcctctagtttgtcttattgttgacattttatcatgtatgctttatagacaggatttttcctgaaccatttggaatatgcatatacttcatccctcagttcccagcatgtaccctaagaataaagattttcttctgcata

SEQ ID NO: 1501 - DNA, 1576 bp, Homo sapiens
agtgggtcttctcactcttttccaggctccttggaggtcactgccctgatgacaacatggtcttcccttcaaggaagccacgtttctaagagggctctggcatatgcattggtggtcactaactgccaagagagaatccagcattggaagaaggtagataatgactataatgcccttcgagaaagactcagcaccttgcctgataaattgtcttataatataatggtaccatttggcccttttgccttcatgccaggaaaacttgtccatactaatgaagtcactgttttactgggggacaactggtttgcaaagtgctcagcaaagcaggctgtaggtttagttgagcaccggaaagaacatgtaagaaaaacaatagatgacttaaaaaaagtgatgaaaaattttgaatccagagttgaattcacagaagatttgcagaaaatgagcgatgctgcaggtgatattgttgacatacgagaagaaattaaatgtgacttcgaatttaaagcaaaacaccgaattgctcataaaccgcattccaaaccaaaaacttcagatatttttgaagcagatattgcaaatgatgtgaaatccaaggatttgctagctgataaagaactgtgggctcgacttgaagaactagagagacaggaagaattgctgggtgaacttgatagtaagcctgatactgtgattgcaaatggagaagatacgacatcttctgaagaggaaaaggaagatcgtaacacaaatgtgaatgcgatgcatcaagtaacagactctcatactccttgtcataaggatgttgcaagttcagaaccattcagtggtcaagtgaatagtcagttgaactgttcagtgaatggttccagttcttaccacagtgatgatgatgatgatgatgatgatgacgacgacgacgacaacattgacgacgatgatggtgataacgaccatgaggctttaggggttggagataattctataccaacaatatatttttcacatactgttgagcctaagagggtccgaataaatactggaaagaataccactttaaaattcagtgaaaagaaagaagaagccaaacgtaaacgaaagaacagcactggcagtggccactctgcccaggagctgccgaccatcaggacgcctgcagacatttacagagcctttgttgatgttgtgaatggagaatatgtccctcgcaaatccatcctgaagtctcgaagtagagagaatagtgtgtgtagcgacactagtgaaagcagtgctgctgaatttgatgataggcggggagttttgaggagtatcagctgcgaagaagccacttgcagtgacaccagtgagagcattttggaagaggaaccacaagaaaatcaaaagaaacttttgcccttatcagtaacacctgaggttttgcggctagttggctattcaagaaacctcgcccctctgaatgtcatactgtaatctttaaggaagaaagctacatgaattaattgtactctatgggaaaatttctttggaaagatattttgtaaaacttttttttccaagtaaaaactttatg

SEQ ID NO: 1502 - DNA, 2369 bp, Homo sapiens
agcggaccgacgcgacacgccgtgcgcctccgcggctgcgctacgaaaacgagtcccggagcggccccgcgcccgccgcacccggccctcgcccgcccgaagacaggcgccaagctgccccgccgtctccccagctagcgcccggccgccgccgcctcgcgggccccgggcggaagggggcggggtcccgattcgccccgcccccgcggagggatacgcggcgccgcggcccaaaacccccgggcgaggcggccggggcgggtgaggcgctccgcctgctgcgcgtctacgcggtccccgcgggccttccgggcccactgcgccgcgcggaccgcctcgggctcggacggccggtgtccccggcgcgccgctcgcccggatcggccgcggcttcggcgcctggggctcggggctccggggaggccgtcgcccgcgatgctgctctccaagttcggctccctggcgcacctctgcgggcccggcggcgtggaccacctcccggtgaagatcctgcagccagccaaggcggacaaggagagcttcgagaaggcgtaccaggtgggcgccgtgctgggtagcggcggcttcggcacggtctacgcgggtagccgcatcgccgacgggctcccggtggctgtgaagcacgtggtgaaggagcgggtgaccgagtggggcagcctgggcggcgcgaccgtgcccctggaggtggtgctgctgcgcaaggtgggcgcggcgggcggcgcgcgcggcgtcatccgcctgctggactggttcgagcggcccgacggcttcctgctggtgctggagcggcccgagccggcgcaggacctcttcgactttatcacggagcgcggcgccctggacgagccgctggcgcgccgcttcttcgcgcaggtgctggccgccgtgcgccactgccacagctgcggggtcgtgcaccgcgacattaaggacgaaaatctgcttgtggacctgcgctccggagagctcaagctcatcgacttcggttcgggtgcgctgctcaaggacacggtctacaccgacttcgacggcacccgagtgtacagccccccggagtggatccgctaccaccgctaccacgggcgctcggccaccgtgtggtcgctgggcgtgcttctctacgatatggtgtgtggggacatccccttcgagcaggacgaggagatcctccgaggccgcctgctcttccggaggagggtctctccagagtgccagcagctgatccggtggtgcctgtccctgcggccctcagagcggccgtcgctggatcagattgcggcccatccctggatgctgggggctgacgggggcgtcccggagagctgtgacctgcggctgtgcaccctcgaccctgatgacgtggccagcaccacgtccagcagcgagagcttgtgaggagctgcacctgactgggagctaggggaccacctgccttggccagacctgggacgcccccagaccctgactttctcctgcgtgggccgtctcctcctgcggaagcagtgacctctgacccctggtgaccttcgctttgagtgccttttgaacgctggtcccgcgggacttggttttctcaagctctgtctgtccaaagacgctccggtcgaggtcccgcctgccctgggtggatacttgaaccccagacgcccctctgtgctgctgtgtccggaggcggccttcccatctgcctgcccacccggagctctttccgccggcgcagggtcccaagcccacctcccgccctcagtcctgcggtgtgcgtctgggcacgtcctgcacacacaatgcaagtcctggcctccgcgcccgcccgcccacgcgagccgtacccgccgccaactctgttatttatggtgtgaccccctggaggtgccctcggcccaccggggctatttattgtttaatttatttgttgaggttatttcctctgagcagtctgcctctcccaagccccaggggacagtggggaggcaggggagggggtggctgtggtccagggaccccaggccctgattcctgtgcctggcgtctgtcccggccccgcctgtcagaagatgaacatgtatagtggctaacttaaggggagtgggtgaccctgacacttccaggcactgtgcccagggtttgggttttaaattattgactttgtacagtctgcttgtgggctctgaaagctggggtggggccagagcctgagcgtttaatttattcagtacctgtgtttgtgtgaatgcggtgtgtgcaggcatcgcagatgggggttctttcagttcaaaagtgagatgtctggagatcatatttttttatacaggtatttcaattaaaatgtttttgtacatagtggataa

SEQ ID NO: 1503 - DNA, 3111 bp, Homo sapiens
gcgagttgtgtgagccgccagtatggccgggctatggcggcgagcactggctacgtgcgactgtggggagcggcgcggtgctgggtgctgcggcggccgatgctggccgccgccggggggcgggttcccactgcagcaggagcgtggttgctccgaggccagcggacctgcgacgcctctcctccttgggcactgtggggccgaggcccggcaattgggggccaatggcgggggttttgggaagcgagcagccgcggcggaggcgcattctcggggggcgaggacgcctccgagggcggcgcggaggaaggagccggcggcgcggggggcagcgcgggcgccggggaaggcccggtcataacggcgctcacgcccatgacgatccccgatgtgtttccgcacctgccgctcatcgccatcacccgcaacccggtgttcccgcgctttatcaagattatcgaggttaaaaataagaagttggttgagctgctgagaaggaaagttcgtctcgcccagccttatgtcggcgtctttctaaagagagatgacagcaatgagtcggatgtggtcgagagcctggatgaaatctaccacacggggacgtttgcccagatccatgagatgcaggaccttggggacaagctgcgcatgatcgtcatgggacacagaagagtccatatcagcagacagctggaggtggagcccgaggagccggaggcggagaacaagcacaagccccgcaggaagtcaaagcggggcaagaaggaggcggaggacgagctgagcgccaggcacccggcggagctggcgatggagcccacccctgagctcccggctgaggtgctcatggtggaggtagagaacgttgtccacgaggacttccaggtcacggaggaggtgaaagccctgactgcagagatcgtgaagaccatccgggacatcattgccttgaaccctctctacagggagtcagtgctgcagatgatgcaggctggccagcgggtggtggacaaccccatctacctgagcgacatgggcgccgcgctcaccggggccgagtcccatgagctgcaggacgtcctggaagagaccaatattcctaagcggctgtacaaggccctctccctgctgaagaaggaatttgaactgagcaagctgcagcagcgcctggggcgggaggtggaggagaagatcaagcagacccaccgtaagtacctgctgcaggagcagctaaagatcatcaagaaggagctgggcctggagaaggacgacaaggatgccatcgaggagaagttccgggagcgcctgaaggagctcgtggtccccaagcacgtcatggatgttgtggacgaggagctgagcaagctgggcctgctggacaaccactcctcggagttcaatgtcacccgcaactacctagactggctcacgtccatcccttggggcaagtacagcaacgagaacctggacctggcgcgggcacaggcagtgctggaggaagaccactacggcatggaggacgtcaagaaacgcatcctggagttcattgccgttagccagctccgcggctccacccagggcaagatcctctgcttctatggcccccctggcgtgggtaagaccagcattgctcgctccatcgcccgcgccctgaaccgagagtacttccgcttcagcgtcgggggcatgactgacgtggctgagatcaagggccacaggcggacctacgtgggcgccatgcccgggaagatcatccagtgtttgaagaagaccaagacggagaaccccctgatcctcatcgacgaggtggacaagatcggccgaggctaccagggggacccgtcgtcggcactgctggagctgctggacccagagcagaatgccaacttcctggaccactacctggacgtgcccgtggacttgtccaaggtgctgttcatctgcacggccaacgtcacggacaccatccccgagccgctgcgagaccgtatggagatgatcaacgtgtcgggctacgtggcccaggagaagctggccattgcggagcgctacctggtgccccaggctcgcgccctgtgtggcttggatgagagcaaggccaagctgtcatcggacgtgctgacgctgctcatcaagcagtactgccgcgagagcggtgtccgcaacctgcagaagcaagtggagaaggtgttacggaaatcggcctacaagattgtcagcggcgaggccgagtccgtggaggtgacgcccgagaacctgcaggacttcgtggggaagcccgtgttcaccgtggagcgcatgtatgacgtgacaccgcccggcgtggtcatggggctggcctggaccgcaatgggaggctccacgctgtttgtggagacatccctgagacggccacaggacaaggatgccaagggtgacaaggatggcagcctggaggtgacaggccagctgggggaggtgatgaaggagagcgcccgcatagcctacaccttcgccagagccttcctcatgcagcacgcccccgccaatgactacctggtgacctcacacatccacctgcatgtgcccgagggcgccacccccaaggacggcccaagcgcaggctgcaccatcgtcacggccctgctgtccctggccatgggcaggcctgtccggcagaatctggccatgactggcgaagtctccctcacgggcaagatcctgcctgttggtggcatcaaggagaagaccattgcggccaagcgcgcaggggtgacgtgcatcgtcctgccagccgagaacaagaaggacttctacgacctggcagccttcatcaccgagggcctggaggtgcacttcgtggaacactaccgggagatcttcgacatcgccttcccggacgagcaggcagaggcgctggccgtggaacggtgacggccaccccgggactgcaggcggcggatgtcaggccctgtctgggccagaactgagcgctgtggggagcgcgcccggacctggcagtggagccaccgagcgagcagctcggtccagtgacccagatcccagggacctcagtcggcttaatcagagtgtggcatagaagctatttaatgattaaagtcatttgcagta

SEQ ID NO: 1504 - DNA, 2103 bp, Homo sapiens
ataattcaacagctcaactttcgggcccgcctctttcctgggggtgggagtttgctccaaactttgtttatgggacagtccgggagctgctgcggccgcgctgtctgcttctcctgcgcctccttttcgcccagcactagcgccttaggccagctcgggggatgtgagagccgaagcccttagactgccaggcacagagtcgggtcgggatttgtcagccaagcctcggctccagctccgcaatctcgggactcacccgagcgacccaggcccgacggcaagttcgggcgggacggcggccgccgcgcgctcaggctcagcttcgctgcccgcccagaagatgaatccggcctcggcgccccctccgctcccgccgcctgggcagcaagtgatccacgtcacgcaggacctagacacagacctcgaagccctcttcaactctgtcatgaatccgaagcctagctcgtggcggaagaagatcctgccggagtctttctttaaggagcctgattcgggctcgcactcgcgccagtccagcaccgactcgtcgggcggccacccggggcctcgactggctgggggtgcccagcatgtccgctcgcactcgtcgcccgcgtccctgcagctgggcaccggcgcgggtgctgcgggtagccccgcgcagcagcacgcgcacctccgccagcagtcctacgacgtgaccgacgagctgccactgcccccgggctgggagatgaccttcacggccactggccagaggtacttcctcaatcacatagaaaaaatcaccacatggcaagaccctaggaaggcgatgaatcagcctctgaatcatatgaacctccaccctgccgtcagttccacaccagtgcctcagaggtccatggcagtatcccagccaaatctcgtgatgaatcaccaacaccagcagcagatggcccccagtaccctgagccagcagaaccaccccactcagaacccacccgcagggctcatgagtatgcccaatgcgctgaccactcagcagcagcagcagcagaaactgcggcttcagagaatccagatggagagagaaaggattcgaatgcgccaagaggagctcatgaggcaggaagctgccctctgtcgacagctccccatggaagctgagactcttgccccagttcaggctgctgtcaacccacccacgatgaccccagacatgagatccatcactaataatagctcagatcctttcctcaatggagggccatatcattcgagggagcagagcactgacagtggcctggggttagggtgctacagtgtccccacaactccggaggacttcctcagcaatgtggatgagatggatacaggagaaaacgcaggacaaacacccatgaacatcaatccccaacagacccgtttccctgatttccttgactgtcttccaggaacaaacgttgacttaggaactttggaatctgaagacctgatccccctcttcaatgatgtagagtctgctctgaacaaaagtgagccctttctaacctggctgtaatcactaccattgtaacttggatgtagccatgaccttacatttcctgggcctcttggaaaaagtgatggagcagagcaagtctgcaggtgcaccacttcccgcctccatgactcgtgctccctcctttttatgttgccagtttaatcattgcctggttttgattgagagtaacttaagttaaacataaataaatattctattttcattttctgcaagcctgcgttcttgtgacagattatacagaattgtgtctgcaggattgattatgcagaatacttttctctttcttctctgctgccccatggctaagctttatgggtgttaattgaaatttatacaccaattgattttaaaccataaaaagctgaccacaggcagttacttctgagggcatcttggtccaggaaatgtgcacaaaattcgacctgatttacagtttcaaaaactgtattgatgacagtagtaccaaatgctttaaaaactatttaacttgagctttaaaaatcattgtatggatagtaaaattctactgtatggaatacaatgtaattttgaatcca

SEQ ID NO: 1505 - DNA, 3031 bp, Homo sapiens
atggagatggctaacagctagagcaggctgtcctcggagggaaccgggtcacatcgcagggccacctctagctgcaagagaatctgggaagctgagcaattcaaaccaggcacactgctgccccccacacaactggggttctgccgtatagaagaggagactggatctttggagacattccatctccagacacccagagacgctccagaatggaggtcctgagggagaaggtggaggaggaggaggaggccgagcgggaggaggcggccgagtgggctgaatgggcgaggatggagaaaatgatgaggccagttgaggtgcggaaggaggaaatcaccttaaagcaggagacgctcagagacctggagaagaagctgtcagagatccagatcactgtctcagcggagctcccggcctttaccaaggacactattgacatctccaagctgcccatttcctacaaaaccaacacacccaaggaggaacacctgctgcaggtggcagacaacttctcccgccagtacagccatctgtgcccggaccgcgtgcccctcttcctgcaccccctgaacgagtgtgaagtgcccaagttcgtgagcacaaccctccggcccacactgatgccctaccccgagctctacaactgggacagctgtgcccagtttgtctccgacttcctcaccatggtgcccctgcctgaccctctcaagccgccctcgcacctgtactcctcgaccactgtgctcaagtaccagaaggggaactgctttgacttcagtacgctgctctgctccatgcttatcggctctggctatgatgcttactgcgtcaacggctacggctcgctggacctgtgccacatggacctgacgcgggaggtgtgcccactcactgtgaagcccaaggagaccatcaagaaggaggaaaaggtgctgcctaagaagtataccatcaaaccccccagggacctgtgcagcaggtttgagcaggagcaagaggtgaagaagcagcaggagatcagagcccaggagaagaagcggctgagggaggaggaggagcgcctcatggaagcggagaaggcaaagccggatgccctgcacggcctgcgggtgcactcctgggtccttgtgctatcggggaagcgcgaggtgcctgagaacttcttcatcgacccattcacaggacatagctacagcacccaggatgagcacttcctgggcatcgaaagcctgtggaaccacaagaactactggatcaacatgcaggattgctggaactgctgcaaggacttgatctttgacctgggtgaccctgtgagatgggagtacatgctcctggggactgataagtctcagctgtccttgactgaagaagacgacagtgggataaacgatgaggatgatgtggaaaatctgggcaaggaggatgaggataagagcttcgacatgccccactcgtgggtggagcagattgagatctccccggaagcatttgagacccgctgcccgaacgggaagaaggtgattcagtacaagagggcaaagctggagaagtgggccccgtacctcaatagcaatggccttgtgagccgcctcaccacctatgaggacttgcagtgtaccaatattttggagataaaggagtggtaccagaaccgggaagacatgctggagctgaaacacataaacaagaccacagacctgaagacagactacttcaagcctggccacccccaggctctgcgcgtgcactcgtacaagtccatgcaacctgagatggaccgtgtcattgagttttatgaaacggcccgtgtggatggcctgatgaagcgggaggagacacccaggacaatgacagagtactatcaaggacgcccagacttcctctcctaccgccatgccagcttcggaccccgagtcaagaagctcactctgagcagtgcagagtcaaacccccggcccattgtgaaaatcacagagcggttcttccgcaacccagcgaagcccgcggaggaggacgtggcagagcgcgtgtttctggtcgcggaggagcgcatccagctgcgctaccactgccgtgaggaccacatcacggcctccaagcgcgagttcctgcggcgcaccgaggtggacagcaaaggcaacaagatcatcatgacgcccgacatgtgcatcagcttcgaggtggagcccatggagcacaccaagaagctgctctaccagtacgaggccatgatgcacctgaagagggaggagaagctgtccagacatcaggtctgggagtcagagctggaggtgctggagattctgaagcttcgagaggaagaggaggcggcgcacacactgaccatctccatctatgacaccaagcggaatgagaagagcaaggaatatcgggaggccatggagcgcatgatgcacgaagagcacctgcggcaggtggagacccagctggactacctggccccattcctggcccagctcccgccaggagagaaactaacatgctggcaggcggtgcgcctcaaggatgagtgcctcagcgacttcaagcagcggctcatcaacaaggccaacctcatccaggcccgctttgagaaggagacccaggagctgcaaaagaagcagcagtggtaccaggagaaccaggtgacgctgacacccgaggatgaagacctgtacctgagttactgctctcaggccatgttccgcatccgcatcctggagcagcgcctcaatcgacacaaggaactggccccactgaagtacctggctctggaggaaaagctctacaaggacccacgcctgggggagctccagaaaatattcgcttgatgtccctcctggggcctcagccagagctgccagagaaaggaaacctcttcccgcagcctggctcctgtgttccctctatccagccaatgcctgtttacacagacacctggcctcactgccagcccacctcccctacagccctgtttgttcctgcttctcatgattttcctgtaaataaacacactcttaatttgcca

SEQ ID NO: 1506 - DNA, 2686 bp, Homo sapiens
gtctttagctctcatggattgggagctgggaaaggaatgagaagacagaagtcagagacaagaagaggctaacatgactgataccactataatttagtggatcagtgtctttcaatgatgtgactgtggacttcactcaggaggagtggcagcacctggatcatgctcagaagactctatatatggatgtgatgttggaaaactattgccacctcatctctgtggggtgtcacatgaccaaacctgatgtgatcctcaagttggaacgaggagaagagccatggacatcatttgcaggtcatacctgcttggaagaaaactggaaagctgaagactttttagtgaaattcaaggaacaccaagagaagtattctagatcagttgtaagcatcaaccacaaaaaactggtgaaggagaagagtaaaatatatgaaaagacatttactctaggcaaaaaccctgtgaattcaaaaaatctacctcctgaatatgatactcatggaaggattttgaaaaatgtttcagaattaatcatcagtaatctaaatcctgcaagaaagagacttagtgagtataatggatatgggaaatcactcctgagtactaaacaagagactactcatcctgaagtcaaatcccataatcaaagtgccagagctttcagtcataatgaagttcttatgcagtatcagaaaacggaaactccagcacagtcatttggatataatgactgtgagaaatcattccttcaaaggggaggcctgattacacatagtagaccttacaaaggagaaaacccatctgtatataataaaaaaagaagagcaaccaatattgaaaaaaaacatacatgcaatgaatgtgggaaatctttctgcaggaaatcagtattgattctgcatcagggaattcactcagaagaaaaaccctatcaatgtcatcaatgtggaaatgcatttagaaggaaatcatatctcattgatcatcagagaactcacacaggagagaaaccctttgtttgcaatgaatgtggtaagtccttccgcctcaagacagccctcactgatcatcagagaacacacacaggggagaaatcgtatgaatgtctgcaatgtaggaatgccttcagattgaagtcacacctcattcgtcatcagagaactcacacgggagagaaaccatatgagtgtaatgactgtgggaagtccttccgccagaagacaacactctctctacatcagagaatccatacaggtgagaaaccctacatttgtaaagaatgtgggaagtcctttcaccagaaggcaaatcttactgtacatcagagaactcatacaggggaaaagccctatatttgtaatgaatgtgggaaatccttctcccagaagacaacccttgctcttcatgagaaaactcataatgaggagaaaccctatatttgtagtgaatgtggaaagtccttccgccagaagacaacccttgtagcacatcagagaacacatacaggggagaaatcttatgaatgtcctcactgtgggaaggcctttagaatgaagtcatacctcattgatcatcaccgaactcacacaggagagaaaccatatgaatgtaatgaatgtggtaaatcattcagtcaaaagacaaatctcaatctacatcagagaattcatacaggggagaaaccctatgtttgtaatgaatgtgggaagtcctttcgccagaaagcaaccctcactgtacatcagaaaatacataccggccagaaatcctatgaatgtcctcagtgtgggaaagcctttagcaggaagtcatatctcattcatcatcaaagaactcatacgggagagaaaccatataaatgtagtgaatgtggaaagtgcttccgccagaagacaaatcttattgtacatcagagaactcacacaggtgagaaaccctatgtttgtaatgagtgtggtaagtctttcagttataagagaaacctcattgtccatcaaagaactcacaagggagaaaacattgaaatgcaataaatgatgtggtttcttatatgaattctttacaagctgttgtaaacatttagttttaaaaagaaaagcatgctgaaacatgttaatgtaattttaaatcacaagtctaataattattaaagtaccatacggaataactgtctactgtttactagcatataaaataagtatgatcattattattgaactctatcagctatgaagctaaattttaaagtcaactgctcttcctactgactcaaatagtttattttttaaaaatacttatataatacatgcagagacaagatacacaatgattataagtattaatctccataagagaaaatatttatgaactatatttctcattgcactctgtaataaaaagcagttagttgttacttacctaagagttaccacttccgtagcctataacatcaaaacgtagtttttgcatgttttcaattttataaatatatattttatcagacatcatgaattattttgtgtcttgcttatttcactcaattttttaagatctgtacattattgcatgtggcagtagtgtattttcattttgcatactattccattttaagaatatattgctgtttatcctattgatggatatttgtattttttatacttttgtgtaataataaaaatactgctgt

SEQ ID NO: 1507 - DNA, 739 bp, Homo sapiens
tcactgccctctgcctcgaccttatccagccacacgccaccatgtgtcataccagctgctcctcgggctgccagccagcctgctgcgcgcccagcccctgccagccagcctgttgtgtgcccagctcctgccaggcatcctgctgtgtgcctgtgggctgccagtcctccgtgtgtgtgcccgtgagcttcaagccagccgtgtgcctgcccgtgagctgccagtcttctgtgtgtgtgcccatgagcttcaagtcagctgtgtgcgtgcccgtgagctgccagtcttctgtgtgtgtgcctgtgagctgcaggcccattgtgtgtgcagccccctcctgccagtcctccctgtgcgtgcctgtgagctgcaggcctgtcgtgtatgcggctccgtcctgccagtcctctgggtgctgccagccctcctgcaccagcgtcctctgcagacccatctcctacagtatctcttcctgctgctgagcatgaatctccagacccgctgctcccagtgcagatgaggccacacctgtacactccctggatgagtcctcagttggtcttctgcacatggtgcaggtgaaaagcatgctcagttgaaccctctgaattctggattgagaatgtgacagaatgatctggagcccttgctgaccttgcccatccccccagggaagtctggggtcccagagtcattctctgaccccatgagagccaaataaaccagctttccccatgca

SEQ ID NO: 1508 - DNA, 1305 bp, Homo sapiens
gttgaggtcaagtagtagcgttgggctgcggcagcggaggagctcaacatgcgtgagtgtatctctatccacgtggggcaggcaggagtccagatcggcaatgcctgctgggaactgtactgcctggaacatggaattcagcccgatggtcagatgccaagtgataaaaccattggtggtggggacgactccttcaacacgttcttcagtgagactggagctggcaagcacgtgcccagagcagtgtttgtggacctggagcccactgtggtcgatgaagtgcgcacaggaacctataggcagctcttccacccagagcagctgatcaccgggaaggaagatgcggccaataattacgccagaggccattacaccatcggcaaggagatcgtcgacctggtcctggaccggatccgcaaactggcggatctgtgcacgggactgcagggcttcctcatcttccacagttttgggggtggcactggctctgggttcgcatctctgctcatggagcggctctcagtggattacggcaagaagtccaagctagaatttgccatttacccagccccccaggtctccacggccgtggtggagccctacaactccatcctgaccacccacacgaccctggaacattctgactgtgccttcatggtcgacaatgaagccatctatgacatatgtcggcgcaacctggacatcgagcgtcccacgtacaccaacctcaatcgcctgattgggcagatcgtgtcctccatcacggcctccctgcgatttgacggggccctgaatgtggacttgacggaattccagaccaacctagtgccgtacccccgcatccacttccccctggccacctacgccccggtcatctcagccgagaaggcctaccacgagcagctgtccgtggctgagatcaccaatgcctgcttcgagccagccaatcagatggtcaagtgtgaccctcgccacggcaagtacatggcctgctgcatgttgtacaggggggatgtggtcccgaaagatgtcaacgcggccatcgccaccatcaagaccaagcgcaccatccagtttgtagattggtgcccaactggatttaaggtgggcattaactaccagccccccacggtggtccctgggggagacctggccaaggtgcagcgggctgtgtgcatgctgagcaacaccacggccatcgcggaggcctgggctcgcctggacctggcagctctggagaaggattatgaagaggtgggcgtggattccgtggaagccgaggctgaagaaggtgaagaatactga

SEQ ID NO: 1509 - DNA, 5740 bp, Homo sapiens
gattggacagctggggaccttcttctgattaaccttaaaccaacttgtagccatagagacacctcacaaggttcccatttttgttgttgttgttgttgattttctgctcacacctttcctgaccttgcaaccatgtatggaagtgcccgctctgttgggaaggtggagccgagcagccagagccctgggcgttcacccaggcttccacgttcccctcgcttgggtcaccgtcgaaccaacagtacgggagggagttcgggaagcagtgttggaggtggcagtgggaaaaccctttcaatggaaaatatacaatctttaaatgctgcctatgccacctctggccctatgtatctaagtgaccatgaaaatgtgggttcagaaacacctaaaagcaccatgacacttggccgttctgggggacgtctgccttacggtgttcggatgactgctatgggtagtagccccaatatagctagcagtggggttgctagtgacaccatagcatttggagagcatcacctccctcctgtgagtatggcatccactgtacctcactcccttcgtcaggcgagagataacacaatcatggatctgcagacacagctgaaggaagtattaagagaaaatgatctcttgcggaaggatgtggaagtaaaggagagcaaattgagttcttcaatgaatagcatcaagaccttctggagcccagagctgaagaaggaacgagccctgagaaaagatgaagcttccaaaatcaccatttggaaggaacagtacagagttgtacaggaggaaaaccagcacatgcagatgacaatccaggctctccaggatgaattgcggatccagagggacctgaatcagctgtttcagcaggatagtagcagcaggactggcgaaccttgtgtagcagagctgacagaggagaactttcagaggcttcatgctgagcatgagcggcaggccaaagagctgtttcttcttcgaaagacattggaggaaatggagctgcgtattgagactcaaaagcagaccctaaatgctcgggatgaatccattaagaagcttctggaaatgttgcagagcaaaggactttctgccaaggctaccgaggaagaccatgagagaacaagacgactggcagaggcagagatgcacgttcatcacctagaaagccttttggagcagaaggaaaaagagaacagtatgttgagagaggagatgcatcgaaggtttgagaatgctcctgattctgccaaaacaaaagctctgcaaactgttattgagatgaaggattcaaaaatttcctctatggagcgtgggcttcgagacctggaagaggaaattcagatgctgaaatcgaatggtgctttgagtactgaggaaagggaagaagaaatgaagcaaatggaagtgtatcggagccattctaaatttatgaaaaataaggtagaacaactgaaggaggaactaagttcgaaagaggctcaatgggaggagctgaaaaagaaagcggctggtcttcaggctgagattggccaggtgaaacaggagctgtccagaaaggacacagaactactcgccctgcagacaaagctagaaacactcacaaaccagttctcagatagtaaacagcacattgaagtgttgaaggagtccttgactgctaaggagcagagggctgccatcctgcagactgaggtggatgctctccgattgcgtttggaagagaaggaaaccatgttgaataaaaagacaaaacaaattcaggatatggctgaagagaaggggacacaagctggagagatacatgacctcaaggacatgttggatgtgaaggagcggaaggttaatgttcttcagaagaagattgaaaatcttcaagagcagcttagagacaaggaaaagcagatgagcagcttgaaagaacgggtcaaatccttgcaggctgacaccaccaacactgacactgccttgacaactttggaggaggcccttgcagagaaagagcggacaattgaacgcttaaaggagcagagggacagagatgagcgagagaagcaagaggaaattgataactacaaaaaagatcttaaagacttgaaggaaaaagtcagcctgttgcaaggcgacctttcagagaaagaggcttcacttttggatctgaaagagcatgcttcttctctggcatcctcaggactgaaaaaggactcacggcttaagacactagagattgctttggagcagaagaaggaggagtgtctgaaaatggaatcacaattgaaaaaggcacatgaggcagcattggaagccagagccagtccagagatgagtgaccgaatacagcacttggagagagagatcaccaggtacaaagatgaatctagcaaggcccaggcagaagttgatcgactcttagaaatcttgaaggaggtggaaaatgagaagaatgacaaagataagaagatagctgagttggaaaggcaagtgaaagaccagaataagaaggtagcaaatctgaagcacaaggaacaggtggaaaaaaagaagagtgcacaaatgttagaggaggcgcgacgacgggaggacaatctcaacgacagctctcagcagctacaggacagtctccgtaagaaggatgacaggattgaagagctggaagaagcactaagagaaagtgtacagataactgcagagcgggaaatggtgctagcacaagaggaatcagccaggaccaatgctgaaaaacaggtggaggagttactgatggccatggagaaggtaaagcaggaactagaatccatgaaagcaaagctgtcctccacccagcagtctctggcagaaaaggaaactcacttgactaatcttcgggcagagagaaggaaacacttagaggaagttctggagatgaagcaagaagctcttctggctgccattagtgaaaaagacgccaatatagctctcttggagctttcgtcctctaagaagaagacccaagaggaagtggctgccctgaagcgggagaaggatcgtctggtacagcagcttaagcagcagacgcaaaatcgaatgaagctaatggccgacaactacgaggatgaccacttcaaatcctcccattccaatcaaacaaatcacaagccctccccagaccagatcatccagcccctcttagaacttgaccaaaatagaagtaaattaaagttgtacattggacacctgacaaccctctgccatgaccgagaccccctgatcctccgtggactcactccaccagcttcctataacttggacgatgaccaggcggcttgggagaatgagctgcagaagatgacccgggggcagcttcaggatgagttagagaaaggtgaacgggacaatgcagaactgcaggagtttgccaacgccattcttcagcagatagcagaccattgtcccgacatcctagagcaagtggtcaacgccctggaagagtcctcttgaccctgctttatggggaagcctgaggtagtcaacccaggagccaagaaaagagaactacgaggaacaggtgcccggaaccttcttggcaccaaacactacaaacttcatcccaacttgctcacttgaagaagtgtgattccagcaccgtttctacatctgccatcttactctgcctttctgctttggatgtggtctctacactaaccttcttgatgtccagggtagataaagggtcgaatctctctgaagaactgccacctggtcatcagcagtggagaactgtgggagctggtggctctgccctgacagagagccatggagcagaggagcctctcacctcctgtcctctgacatgagaatgaaaccaggaatggacttggagttcaacaggctgagaggatgcctccaatggaccagagagctgagtgttctaatatcacaataggtgctttctcctaaaagggcaaaaaacaatctcaaaaagattagaaaaagagaaggggggaagggaagagaaaatcgactcttctttttactgtctcttctgcttactttccacatgagatgctttgtaccggggagctgtgagcaggcctcacgatggcttgggagcactcgttctcccaaggtctgagtcttcatccagccctgcctgtctgtcgcagccttcctcactctgttcctcggccagttaacaagaagatggtgtgaggtgttctccaccagtctctcctgtttgagactgttgacgttatcatactgaggtgttagatcaaatatctctaattgaagaacatgtgaggttgaaagagcaccagccagggcaacatagcgtgaccctgtctctacaaaaaattaaaaagagaacatacaaagttgacatatgagaccctgttgtccccgcctgcagctttgccccagtaacagatgcccgttgctcttgggctggtttcccctgaacacctccaagaggctgcctgccttgccagcacccgtgtcctgagctcctgcagcccagtggctgctgaagttgtgatccctcactcaccctgctagctttgcccttgactcgtcttctctgaacctcagcctcgtgcattgcctggaaccttcttctagcataaatgaaggtttttcctcctacacacattccttcctcggttatttcattcagagaatatttatgaaatgcctactgtgtgcaagtcatccatccttgaaaaggccacttctcagtgagggagagatgtagtggattctgtgagacatacctgctggagttgaagcagtaaatagcatgtccttcccctccccgatcttaaggtgtgttttctagaaaagttccctaatggaattcatgagtttgggggtctcagtcacccgcttgcctgtaggattccatttgatgattctggatttttgctgtttgttattgcccttagaggggctctgagtatctacttgtgggtggccatttcctgacatctgcatgtacctcgtggaattcagccagcttcatgttgcaaatcagaaagctgaccccaagactgcaaatcaatgaaggtattggcattgttaaggacgtagcgtagacaacagcagtcataaataattaggcaggaacttaacccaaatctagttctttgaccacctctaccaccagaacccagcagacactcacatctcctgataagagttgctggactcgatgtttttgttttgcattttctcctctccttccccacttactcagagaatttaaagtctgtagagtcagcacagccccatcagtccaggaacttcccaccaccagcccttgactgtcccattaactgacatggtcagatttccagctccccctactccctgctgtgaaacaatccctctccctgtgagaggaaactgtggagcgtttcttatcgaaggttaaatggactctgctcataaacctcttactgagatgcttcctgatagccaggctggccagagaggggtgcaggggttagatagtaagtggtggtcgtttgtggtcagttacctcaattctgttcattgcagtgcccgtaaaccatgtagaaagctcccagcactgaaaggcaggagtgttagcatctcgctttatccaccataacgtaaagaactgcggtgtgataacagccttcacggggccacggtggaaccaagacagcaggcgaggccatgcctaaacaagtggtctggcacgggcactggccagctgctctctccaagcaggtgg

SEQ ID NO: 1510 - DNA, 3359 bp, Homo sapiens
tgtttatactccggagggtgtccccgtgcgtcatcggtggagtggaccaaaactggtgatctgtttgccctgtgtgaccttgcccagaaccctgctgactgagagaacacatctgctggaagtcctctgggattcaaggtacagggaatgaagagtagttttacagaaaaaagaggacaatattgggatcacctttgacctttccatttggaaataatattttctattgtgttatagaaaggtgggaagctttcatccagaacaatgaatttcataaaggacaatagccgagcccttattcaaagaatgggaatgactgttataaagcaaatcacagatgacctatttgtatggaatgttctgaatcgcgaagaagtaaacatcatttgctgcgagaaggtggagcaggatgctgctagagggatcattcacatgattttgaaaaagggttcagagtcctgtaacctctttcttaaatcccttaaggagtggaactatcctctatttcaggacttgaatggacaaagtctttttcatcagacatcagaaggagacttggacgatttggctcaggatttaaaggacttgtaccataccccatcttttctgaacttttatccccttggtgaagatattgacattatttttaacttgaaaagcaccttcacagaacctgtcctgtggaggaaggaccaacaccatcaccgcgtggagcagctgaccctgaatggcctcctgcaggctcttcagagcccctgcatcattgaaggggaatctggcaaaggcaagtccactctgctgcagcgaattgccatgctctggggctccggaaagtgcaaggctctgaccaagttcaaattcgtcttcttcctccgtctcagcagggcccagggtggactttttgaaaccctctgtgatcaactcctggatatacctggcacaatcaggaagcagacattcatggccatgctgctgaagctgcggcagagggttcttttccttcttgatggctacaatgaattcaagccccagaactgcccagaaatcgaagccctgataaaggaaaaccaccgcttcaagaacatggtcatcgtcaccactaccactgagtgcctgaggcacatacggcagtttggtgccctgactgctgaggtgggggatatgacagaagacagcgcccaggctctcatccgagaagtgctgatcaaggagcttgctgaaggcttgttgctccaaattcagaaatccaggtgcttgaggaatctcatgaagacccctctctttgtggtcatcacttgtgcaatccagatgggtgaaagtgagttccactctcacacacaaacaacgctgttccataccttctatgatctgttgatacagaaaaacaaacacaaacataaaggtgtggctgcaagtgacttcattcggagcctggaccactgtggagacctagctctggagggtgtgttctcccacaagtttgatttcgaactgcaggatgtgtccagcgtgaatgaggatgtcctgctgacaactgggctcctctgtaaatatacagctcaaaggttcaagccaaagtataaattctttcacaagtcattccaggagtacacagcaggacgaagactcagcagtttattgacgtctcatgagccagaggaggtgaccaaggggaatggttacttgcagaaaatggtttccatttcggacattacatccacttatagcagcctgctccggtacacctgtgggtcatctgtggaagccaccagggctgttatgaagcacctcgcagcagtgtatcaacacggctgccttctcggactttccatcgccaagaggcctctctggagacaggaatctttgcaaagtgtgaaaaacaccactgagcaagaaattctgaaagccataaacatcaattcctttgtagagtgtggcatccatttatatcaagagagtacatccaaatcagccctgagccaagaatttgaagctttctttcaaggtaaaagcttatatatcaactcagggaacatccccgattacttatttgacttctttgaacatttgcccaattgtgcaagtgccctggacttcattaaactggacttttatgggggagctatggcttcatgggaaaaggctgcagaagacacaggtggaatccacatggaagaggccccagaaacctacattcccagcagggctgtatctttgttcttcaactggaagcaggaattcaggactctggaggtcacactccgggatttcagcaagttgaataagcaagatatcagatatctggggaaaatattcagctctgccacaagcctcaggctgcaaataaagagatgtgctggtgtggctggaagcctcagtttggtcctcagcacctgtaagaacatttattctctcatggtggaagccagtcccctcaccatagaagatgagaggcacatcacatctgtaacaaacctgaaaaccttgagtattcatgacctacagaatcaacggctgccgggtggtctgactgacagcttgggtaacttgaagaaccttacaaagctcataatggataacataaagatgaatgaagaagatgctataaaactagctgaaggcctgaaaaacctgaagaagatgtgtttatttcatttgacccacttgtctgacattggagagggaatggattacatagtcaagtctctgtcaagtgaaccctgtgaccttgaagaaattcaattagtctcctgctgcttgtctgcaaatgcagtgaaaatcctagctcagaatcttcacaatttggtcaaactgagcattcttgatttatcagaaaattacctggaaaaagatggaaatgaagctcttcatgaactgatcgacaggatgaacgtgctagaacagctcaccgcactgatgctgccctggggctgtgacgtgcaaggcagcctgagcagcctgttgaaacatttggaggaggtcccacaactcgtcaagcttgggttgaaaaactggagactcacagatacagagattagaattttaggtgcattttttggaaagaaccctctgaaaaacttccagcagttgaatttggcgggaaatcgtgtgagcagtgatggatggcttgccttcatgggtgtatttgagaatcttaagcaattagtgttttttgactttagtactaaagaatttctacctgatccagcattagtcagaaaacttagccaagtgttatccaagttaacttttctgcaagaagctaggcttgttgggtggcaatttgatgatgatgatctcagtgttattacaggtgcttttaaactagtaactgcttaaataaagtgtactcgaagcca

SEQ ID NO: 1511 - DNA, 3122 bp, Homo sapiens
agcaccgtctgggctgtggaagcggagggggtggggacactctggcccggttctcggtggtgcgggagcgggcgggagcagcggccgctctggtcggcggacgtgctgccgagtagtcccggaagcgaagcagcgatggcggagagtccgactgaggaggcggcaacggcgggcgccggggcggcgggccccggggcgagcagcgttgctggtgttgttggcgttagcggcagcggcggcgggttcgggccgcctttcctgccggatgtgtgggcggcggcggcggcagcgggcggggccgggggcccggggagcggcctggctccgctgcccgggctcccgccctcagccgctgcccacggggccgcgctgcttagccactgggaccccacgctcagctccgactgggacggcgagcgcaccgcgccgcagtgtctactccggatcaagcgggatatcatgtccatttataaggagcctcctccaggaatgttcgttgtacctgatactgttgacatgactaagattcatgcattgatcacaggcccatttgacactccttatgaagggggtttcttcctgttcgtgtttcggtgtccgcccgactatcccatccacccacctcgggtcaaactgatgacaacgggcaataacacagtgaggtttaaccccaacttctaccgcaatgggaaagtctgcttgagtattctaggtacatggactggacctgcctggagcccagcccagagcatctcctcagtgctcatctctatccagtccctgatgactgagaacccctatcacaatgagcccggctttgaacaggagagacatccaggagacagcaaaaactataatgaatgtatccggcacgagaccatcagagttgcagtctgtgacatgatggaaggaaagtgtccctgtcctgaacccctacgaggggtgatggagaagtcctttctggagtattacgacttctacgaggtggcctgcaaagatcgcctgcaccttcaaggccaaactatgcaggacccttttggagagaagcggggccactttgactaccagtccctcttgatgcgcctgggactgatacgtcagaaagtgctggagaggctccataatgagaatgcagaaatggactctgatagcagttcatctgggacagagacagaccttcatgggagcctgagggtttagaccctgctcccatctccccttcccccactcaagagtcccagcagaatcccttccccccaccccagggatggagaggcactgtgtatctccctccagactcgaagtcatcctgcaagatggcaagaaccaagcaagctccgatcccagggtgtgggagtgggggcctgttcccggtctgacctccttggcactggagcatctggggcttcgttcatccattcatcccgtatcaggggccaaggtacctttacaggagcacctagagcgagggcctttggcaaaaacaaaacaaccaacacacctctccacagggccagctccttagggataagtggaagatggaaattgcaattccaagagggagtgtgcccaaatgatttatggggatacctggaagggagcttggggtgggggctgtctgtgacacttaagcagtctgggtggttgtctatttgtctgtcttcagtcttgaagcagggcttcccaatgcccttttcctccctgccttccttcccccattatttcccacaggccagcataattttgtttttcctaatttatagtcactgttctagacagaccaaagagaaggaacagtggtggagtctaggctgctgatcagtaagctttacctagcacctgagcacctttctcccctcccctctttcctcacccttttctagatgtaagacagaaagtaaatgtgactgggacttaaccaaggtcttggtaaagcctgcatggcaccgtaagaagctgaaaatactgtttgttcccgcaatcactgatttgaaaagttcccaacacaggcagctgctgtgtatatgggattagagccactacatagaatagtctcttacagattttcataaatactagtcacaataagggtatttttcttgggggtggagtaagggggagactgatgctagtccttgttgtattttgttgggctgtccttgtgtattttcaccccagcctgtagtcctcctcacttcaaccccagggatttttggggagcaagggtagccaatggcagagggggttggggctgggactctggaggctcctccccttctttctcttccttccgcctcccccgtgcccccagctgctcttgtcactgtctctgatgggtatttgcctggctttgttgcttctctatctgtatttagctgcagtgatcctttagctggttggctcagaaaaaaaaaaatgtgctttaggtgccctgtaatcctgggcatcaagggaatccatccttcccctttttgatatgttctccccgtacttccagatttattgttatggctcccagtgggtattggcgattcttgtgatgcagggcctcagtcagtgtccagccatgcataagggagaggatagtgtgtacctgccctgccctctgctatgaaggtctctgccttgtggatcatgggactccccttggaggatctgtgcaaaggggggctgggcacaaaggagaatgtcctatttgggagggcaggaagcaaaggaactggacagggattggtgggcttggggaacggaagtttatcttggatacccttgaagaggctgggtctcttcacatgaagatcgaaaagggaccctgcttccaatttccctcttccattcctcgagctactccagggcttagaagaatgctcttggtctgtgggtccagtgttgtctgtcatccatttaagtgttcccactttcaagtgacaatcctctccttggccctgccatagggcagagcatgtctggcatagcagcctgacttttatgccctaatcttgagttgaggaaatatatgcacaggagtcaaagagatgtctttatatctgactgtatataaatgaagtttttttgttttttttgttttcctttttggtgcaataaagtttgttttggcagaa

SEQ ID NO: 1512 - DNA, 3120 bp, Homo sapiens
ccaagccggagcccgagctggaggaagcccccaggtgccaggatctgcccggatccgcgcccgctccggccggcaccatggacagcgaggcattccagagcgcgcgggactttctggacatgaacttccagtcgctggccatgaaacacatggatctgaagcagatggagctggacacggcggcggccaaggtggatgaactgaccaagcagctggagtcgctgtggtcagactctcccgcgcctcctggcccgcaggccggacccccttctaggccgccccggtacagctccagctcgatccctgagcccttcggcagccgagggtccccccggaaggcggccaccgacggcgcagacaccccgttcggacgatcagagagtgccccaaccctacacccctacagcccgctgtcccccaagggacggccgtcgtcgccgcgcaccccgctctacctgcagccggacgcctacggcagcctggaccgcgcgacctcgccccggccccgcgccttcgatggcgcaggcagctccctcggccgtgcgccctccccgcggcccgggccaggcccgctccgccagcagggtccccccacgcctttcgacttcctgggccgcgcaggctccccccgcggcagccccctggcggaggggccccaggccttcttccccgagcgtgggccgtcaccgcgcccccctgccacagcctacgacgcgccagcgtccgccttcgggagctccctgctaggctccggcggcagcgcattcgccccgcctctgcgcgcgcaagacgacctgacgctgcgccggcggcctccgaaagcctggaacgagtctgacctggacgtggcgtacgagaagaagccttcgcagacagcgagctatgaacgcctggacgtcttcgcaaggcctgcctcgccgagcctgcagctgttgccttggagggagagcagcctggatggactggggggcaccggcaaggacaacctcactagcgccaccctgccgcgcaattacaaggtctctcctctggccagcgaccggcgttcagacgcgggcagctaccggcgctcgctgggctccgcggggccgtcgggcactttgcctcgcagctggcagcccgtcagccgcatccccatgcccccctccagcccccagccccgcggggccccgcgccagcgtcccatccccctcagcatgatcttcaagctgcagaacgccttctgggagcacggggccagccgcgccatgctccctgggtcccccctcttcacccgagcacccccgcctaagctgcagccccaaccacaaccacagccccagccacaatcacaaccacagccccagctgcccccacagccccagacccaaccccaaacccctaccccagccccccagcatccccaacagacatggccccctgtgaacgaaggaccccccaaaccccccaccgagctggagcctgagccggagatagaggggctgctgacaccagtgctggaggctggcgatgtggatgaaggccctgtagcaaggcctctcagccccacgaggctgcagccagcactgccaccggaggcacagtcggtgcccgagctggaggaggtggcacgggtgttggcggaaattccccggcccctcaaacgcaggggctccatggagcaggcccctgctgtggccctgccccctacccacaagaaacagtaccagcagatcatcagccgcctcttccatcgtcatggggggccagggcccggggggccggagccagagctgtcccccatcactgagggatctgaggccagggcagggccccctgctcctgccccaccagctcccattccacccccggccccgtcccagagcagcccaccagagcagccgcagagcatggagatgcgctctgtgctgcggaaggcgggctccccgcgcaaggcccgccgcgcgcgcctcaaccctctggtgctcctcctggacgcggcgctgaccggggagctggaggtggtgcagcaggcggtgaaggagatgaacgacccgagccagcccaacgaggagggcatcactgccttgcacaacgccatctgcggcgccaactactctatcgtggatttcctcatcaccgcgggtgccaatgtcaactcccccgacagccacggctggacacccttgcactgcgcggcgtcgtgcaacgacacagtcatctgcatggcgctggtgcagcacggcgctgcaatcttcgccaccacgctcagcgacggcgccaccgccttcgagaagtgcgacccttaccgcgagggttatgctgactgcgccacctacctggcagacgtcgagcagagtatggggctgatgaacagcggggcagtgtacgctctctgggactacagcgccgagttcggggacgagctgtccttccgcgagggcgagtcggtcaccgtgctgcggagggacgggccggaggagaccgactggtggtgggccgcgctgcacggccaggagggctacgtgccgcggaactacttcgggctgttccccagggtgaagcctcaaaggagtaaagtctagcaggatagaaggaggtttctgaggctgacagaaacaagcattcctgccttccctccagacctctccctctgttttttgctgcctttatctgcacccctcaccctgctggtggtggtccttgccaccggttctctgttctcctggaagtccagggaagaaggagggccccagccttaaatttagtaatctgccttagccttgggaggtctgggaagggctggaaatcactggggacaggaaaccacttccttttgccaaatcagatcccgtccaaagtgcctcccatgcctaccaccatcatcacatcccccagcaagccagccacctgcccagccgggcctgggatgggccaccacaccactggatattcctgggagtcactgctgacaccatctctcccagcagtcttggggtctgggtgggaaacattggtctctaccaggatccctgccccacctctccccaattaagtgccttcacacagcactggtttaatgtttataaacaaaatagagaaactttccttataaataaaagtagtttgcacagaaattga

SEQ ID NO: 1513 - DNA, 2072 bp, Homo sapiens
ggtagacgcgatctgttggctactactggcttctcctggctgttaaaagcagatggtggttgaggttgattccatgccggctgcctcttctgtgaagaagccatttggtctcaggagcaagatgggcaagtggtgctgccgttgcttcccctgctgcagggagagcggcaagagcaacgtgggcacttctggagaccacgacgactctgctatgaagacactcaggagcaagatgggcaagtggtgccgccactgcttcccctgctgcagggggagtggcaagagcaacgtgggcgcttctggagaccacgacgactctgctatgaagacactcaggaacaagatgggcaagtggtgctgccactgcttcccctgctgcagggggagcagcaagagcaaggtgggcgcttggggagactacgatgacagtgccttcatggagcccaggtaccacgtccgtggagaagatctggacaagctccacagagctgcctggtggggtaaagtccccagaaaggatctcatcgtcatgctcagggacactgacgtgaacaagcaggacaagcaaaagaggactgctctacatctggcctctgccaatgggaattcagaagtagtaaaactcctgctggacagacgatgtcaacttaatgtccttgacaacaaaaagaggacagctctgataaaggccgtacaatgccaggaagatgaatgtgcgttaatgttgctggaacatggcactgatccaaatattccagatgagtatggaaataccactctgcactacgctatctataatgaagataaattaatggccaaagcactgctcttatatggtgctgatatcgaatcaaaaaacaagcatggcctcacaccactgttacttggtgtacatgagcaaaaacagcaagtcgtgaaatttttaattaagaaaaaagcgaatttaaatgcactggatagatatggaagaactgctctcatacttgctgtatgttgtggatcagcaagtatagtcagccttctacttgagcaaaatattgatgtatcttctcaagatctatctggacagacggccagagagtatgctgtttctagtcatcatcatgtaatttgccagttactttctgactacaaagaaaaacagatgctaaaaatctcttctgaaaacagcaatccaggttgaagaagaaatgaagaagcatgaaagtaataatgtgggattactagaaaacctgactaatggtgtcactgctggcaatggtgataatggattaattcctcaaaggaagagcagaacacctgaaaatcagcaatttcctgacaacgaaagtgaagagtatcacagaatttgtgaattactttctgactacaaagaaaagcagatgccaaaatactcttctgaaaacagcaacccagaacaagacttaaagctgacatcagaggaagagtcacaaaggcttaaaggcagtgaaaatggccagccagagaaaagatctcaagaaccagaaataaataaggatggtgatagagagctagaaaattttatggctatcgaagaaatgaagaagcacagaagtactcatgtcggattcccagaaaacctgactaatggtgccactgctggcaatggtgatgatggattaattcctccaaggaagagcagaacacctgaaagccagcaatttcctgacactgagaatgaagagtatcacagtgacgaacaaaatgatactcagaagcaattttgtgaagaacagaacactggaatattacacgatgagattctgattcatgaagaaaagcagatagaagtggttgaaaaaatgaattctgagctttctcttagttgtaagaaagaaaaagacatcttgcatgaaaatagtacgttgcgggaagaaattgccatgctaagactggagctagacacaatgaaacatcagagccagctaagagaaaagaaatatttggaggatattgaaagtgtgaaaaaaaggaatgataatcttttaaaggctctacaattgaatgagctcaccatggatgatgataccgctgtgctcgtcattgacaac

SEQ ID NO: 1514 - DNA, 1698 bp, Homo sapiens
atgcctgcatccttcccgatgctgcgctgtgcgcgttcaccttgctggacagtgtgctggtcaccctggtgcagggccctgcccgatggaagatgcagctgtttgagcagccctccctccccactcggccccacccgagaccctgtggccacttttctggaaacttgtcgggagcctggcagccagccagcaggacccgcctccctgcgggccgagtacctgcccccatctgtggcttccatcaaggtgtcggcggagctgctcagagctgccttgaaggacggccactcaggcgtgcccctgtgctgtgccaccctgcagtggctccttgctgagaatgctgctgtggacgtcgtgagggcccgagcactatcttccatccagggagtggcccctgatggcgccaacgttcacctcatcgtccgagaggtggccatgactgacctgtgcccagcagggcccatccaggccgtggagattcaagtggaaagctcctctctggccgacatttgcagggcgcaccatgccgttgtcgggcgcatgcagacgatggtgacagagcaggccacccagggctccagcgctcctgatctccgtgtgcagtacctccgccagatccacgccaaccacgagacactgctgcgggaggtgcagaccctgcgcgaccggctctgcacggaggatgaggccagctcctgtgccaccgcccagaggctgctacaggtgtaccggcagctgcgccaccccagcctcatcctgctgtgaccaggcgggcctgcccctgggctctggccacgcttccagcctctgtcacagcccccccaggcctcatgggttagagggaaaccgagctggcctggccagagccgtcagggaaggtaggacctggccacgtaggagcagaacgctcatgaaagtgcttggaggccgtggagcacaaagcagattctgattgggagcaaccgaggcgggctctgaacctggccggtccagcttcgcgtcctctgctggtgtctctccttctctgaccgcggccgcagcccctgcactcgccttcctcactgctgggcagccttcccaccaccgcagcagcccctgaggccaggaggcagtgcagggcattctggacccggagggccagagaaacaggatttctggggtttggacttggggtgagtttgtaactgttgctgccacaccaccaggagcaccggctgcccctctgggtggcactaccaggtgccccacggtacccttgtcacactgttcacacctgcccggctgcccactctgggaccccgaggtaggagggtgctccctgagaccaaagcacaaaacagcatgcagggagctcctgcaagtgcccgtggtctcgtgccacaccaaggaagggccagcgggtggcctgtggccggaatgctcaacaactaggtgcctccagccggggcagtacccagcactgtgcactattttcagggccactcagggtggcgctgtggcccgggggggggccctgagccccagcccccagcctcctccctcagcctgggctacggcccacctcctggtgctggtgttttcatctggggagggtgctcgcgccgctcccgctgcaggcactgtccgcgatgagtgcgggtaggagccgtgaggtgcttctctgctgtgacaaacgaccctgtctgtccgtgaaccttc

SEQ ID NO: 1515 - DNA, 3141 bp, Homo sapiens
tggcggagcccgggaggcggagaaggctgtcgttgccttggccgtcgcatccccgagggagtcgtgtcggcgccaccccggcccccgagcccgcagattgcccaccgaagctcgtgtgtgcacccccgatcccgccagccactcgcccctggcctcgcgggccgtgtctccggcatcatgtgtggtatatttgcttacttaaactaccatgttcctcgaacgagacgagaaatcctggagaccctaatcaaaggccttcagagactggagtacagaggatatgattctgctggtgtgggatttgatggaggcaatgataaagattgggaagccaatgcctgcaaaatccagcttattaagaagaaaggaaaagttaaggcactggatgaagaagttcacaagcaacaagatatggatttggatatagaatttgatgtacaccttggaatagctcatacccgttgggcaacacatggagaacccagtcctgtcaatagccacccccagcgctctgataaaaataatgaatttatcgttattcacaatggaatcatcaccaactacaaagacttgaaaaagtttttggaaagcaaaggctatgacttcgaatctgaaacagacacagagacaattgccaagctcgttaagtatatgtatgacaatcgggaaagtcaagataccagctttactaccttggtggagagagttatccaacaattggaaggtgcttttgcacttgtgtttaaaagtgttcattttcccgggcaagcagttggcacaaggcgaggtagccctctgttgattggtgtacggagtgaacataaactttctactgatcacattcctatactctacagaacaggcaaagacaagaaaggaagctgcaatctctctcgtgtggacagcacaacctgccttttcccggtggaagaaaaagcagtggagtattactttgcttctgatgcaagtgctgtcatagaacacaccaatcgcgtcatctttctggaagatgatgatgttgcagcagtagtggatggacgtctttctatccatcgaattaaacgaactgcaggagatcaccccggacgagctgtgcaaacactccagatggaactccagcagatcatgaagggcaacttcagttcatttatgcagaaggaaatatttgagcagccagagtctgtcgtgaacacaatgagaggaagagtcaactttgatgactatactgtgaatttgggtggtttgaaggatcacataaaggagatccagagatgccggcgtttgattcttattgcttgtggaacaagttaccatgctggtgtagcaacacgtcaagttcttgaggagctgactgagttgcctgtgatggtggaactagcaagtgacttcctggacagaaacacaccagtctttcgagatgatgtttgctttttccttagtcaatcaggtgagacagcagatactttgatgggtcttcgttactgtaaggagagaggagctttaactgtggggatcacaaacacagttggcagttccatatcacgggagacagattgtggagttcatattaatgctggtcctgagattggtgtggccagtacaaaggcttataccagccagtttgtatcccttgtgatgtttgcccttatgatgtgtgatgatcggatctccatgcaagaaagacgcaaagagatcatgcttggattgaaacggctgcctgatttgattaaggaagtactgagcatggatgacgaaattcagaaactagcaacagaactttatcatcagaagtcagttctgataatgggacgaggctatcattatgctacttgtcttgaaggggcactgaaaatcaaagaaattacttatatgcactctgaaggcatccttgctggtgaattgaaacatggccctctggctttggtggataaattgatgcctgtgatcatgatcatcatgagagatcacacttatgccaagtgtcagaatgctcttcagcaagtggttgctcggcaggggcggcctgtggtaatttgtgataaggaggatactgagaccattaagaacacaaaaagaacgatcaaggtgccccactcagtggactgcttgcagggcattctcagcgtgatccctttacagttgctggctttccaccttgctgtgctgagaggctatgatgttgatttcccacggaatcttgccaaatctgtgactgtagagtgaggaatatctatacaaaatgtacgaaactgtatgattaagcaacacaagacaccttttgtatttaaaaccttgatttaaaatatcaccccttgaagcctttttttagtaaatccttatttatatatcagttataattattccactcaatatgtgatttttgtgaagttacctcttacattttcccagtaatttgtggaggactttgaataatggaatctatattggaatctgtatcagaaagattctagctattattttctttaaagaatgctgggtgttgcatttctggaccctccacttcaatctgagaagacaatatgtttctaaaaattggtacttgtttcaccatacttcattcagaccagtgaaagagtagtgcatttaattggagtatctaaagccagtggcagtgtatgctcatacttggacagttagggaagggtttgccaagttttaagagaagatgtgatttattttgaaatttgtttctgttttgtttttaaatcaaactgtaaaacttaaaactgaaaaattttattggtaggatttatatctaagtttggttagccttagtttctcagacttgttgtctattatctgtaggtggaagaaatttaggaagcgaaatattacagtagtgcattggtgggtctcaatccttaacatatttgcacaattttatagcacaaactttaaattcaagctgctttggacaactgacaatatgattttaaatttgaagatgggatgtgtacatgttgggtatcctactactttgtgttttcatctcctaaaagtggtttttatttccttgtatctgtagtcttttattttttaaatgactgctgaatgacatattttatcttgttctttaaaatcacaacacagagctgctattaaattaatattgatatattc

SEQ ID NO: 1516 - DNA, 2701 bp, Homo sapiens
gctttggcggcggttggtggccgtgcgggcggggagggagggggaggagagaagaggaggtggagaaggcttgggctcgcgccgctgaagtcggcttacccgctggccgcctcctgacaagcgggagggatccgcggtggacccagggaagcggaggagcctggcggccaccccctcttcctcacttccctgtactctcatcgctctcggcctccgacacgaaaaggaagcaaatgagctgatggaagatctgtttgaaactttccaagatgagatgggattctccaacatggaagatgatggcccagaagaggaggagcgtgtggctgagcctcaagctaactttaacacccctcaagctctacggtttgaggaactactggccaacctactaaatgaacaacatcagatagcgaaggaactatttgaacagctgaagatgaagaaaccttcagccaaacagcagaaggaggtagagaaggttaaaccccagtgtaaggaagttcatcagaccctgattctggacccagcacaaaggaagagactccagcagcagatgcagcagcatgttcagctcttgacacaaatccaccttcttgccacctgcaaccccaatctcaatccggaggccagtagcaccaggatatgtcttagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgccaatgaatttccctgtttgccaaagcaagtggcttggatcctggccacaagcaaggttttcatgtatccagagttacttccagtgtgttccctgaaggcaaagaatccccaggataagatcctcttcaccaaggctgaggacaatttgttagctttaggactgaagcattttgaagggactgagtttcttaaccctctaatcagcaagtaccttctaacctgcaagactgcccgccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcaaggcctagaaaaagacaactcagagttggggagtgaaactcggtacccactgctattgcctaagggtgtagtcctgaaactgaagccagttgccgaccgtttccccaagaaggcttggagacagaagcgttcatcagtcctgaaacccctccttatccaacccagcccctctctccagcccagcttcaaccctgggaaaacaccagcccaatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctatgccccctgaggccaggacaagcttccctctgtctgagtcccagactttgctctcttctgcccctgtgcccaaggtaatgatgccctcccctgcctcttccatgtttcgaaagccatatgtgagacggagaccctcaaaaagaaggggagccagggcctttcgctgtatcaaacctgcccctgttatccaccctgcatctgttatcttcactgttcctgctaccactgtgaagattgtgagccttggcggtggctgtaacatgatccagcctgtcaatgcggctgtggcccagagtccccagactattcccatcgccaccctcttggttaaccctacttccttcccctgtccattgaaccagccccttgtggcctcctctgtctcacccttaattgtttctggcaattctgtgaatcttcctataccatccacccctgaagataaggcccacatgaatgtggacattgcttgtgctgtggctgatggggaaaatgcctttcagggcctagaacccaaattagagccccaggaactatctcctctctctgctactgttttccccaaagtggaacatagcccagggcctccaccagtcgataaacagtgccaagaaggattgtcagagaacagtgcctatcgctggaccgttgtgaaaacagaggagggaaggcaagctctggagccgctccctcagggcatccaggagtctctaaacaactcttcccctggggatttagaggaagttgtcaagatggaacctgaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccactctgtggaatatacttttgcttcaataaatctgtgcttttattgcttcattgtttca

SEQ ID NO: 1517 - DNA, 1636 bp, Homo sapiens
gctggatggggcccggcctcttcccagcgttcctcctccggccccaggtcaccgccagcacgcgcctgcttcccgtctgcgcgagtccacgcagctccccaggcccttcaccagcacagcagcagcaggcatggcagcaagcgtggagcagcgcgagggcaccatccaggtgcagggccaggccctcttcttccgagaggccctgcccggcagtgggcaggctcgcttctctgtactgctgctgcatggtattcgcttctcctccgagacctggcagaacctgggtacactgcacaggctggcccaggctggctaccgggctgtggccattgacctgccaggtctggggcactccaaggaagcagcagcccctgcccctattggggagctggcccctggcagcttcctggcggctgtggtggatgccttggagctgggccccccggttgtgatcagtccatcactgagtggcatgtactccctgcccttcctcacggcccctggctcccagctcccgggctttgtgccagtggcccccatctgcactgacaaaatcaatgctgccaactatgccagtgtgaagactccagctctgattgtatatggagaccaggaccccatgggtcagaccagctttgagcacctgaagcagctgcccaaccaccgggtgctgatcatgaagggggcggggcacccctgttacctggacaaaccagaggagtggcatacagggctgctggacttcctgcaggggctccagtgaagcccagcactgctgcagggggtgggctgcctgcctgctctgagctctctcttgcacgctctctcttctctcccaggctctggctcatgcacatgcaacaggtgcgtctgtctatatgtctgggttcttgtcttttgtggtctgtttgtcttttctacctctttctcttgcagtgatagactgagggggtaaaatcaagagaaaaaactctcaggaatcaaggaacataatcctgtggagggtaatccattacatgagcttctcctgttcttccactttcctgcctggctttcactccttcccctgctctgcccagcctttccctcccacccactcctccttctgcaaatgccctgaaggccagcccttaccccaacacccacttccccacctccttaggccccagatacatacatgcccacatgcacgcttacatgtttagagccatccttgtttccaaatatgacccttcgcttgagggcaactgcataggtacatctaactctggactggcatgcacattgtcatgtgcagctttgcatatacacacatgcatacatgagcctccacacaagcacttgcacacatgtggactcctaaccatgctaacctcactggctgggaaggtggggaccccatgggccagcccttgcaggaggcccttttgcaaggcttagggtgtggccagccctgaaagctacttggacacaggtttcagctggccccagcccagaagtgacccccagaaagggagggccaccgctttgccccctgcttttacccttccttctgggtgctctacacctcaggttaccaggcctgaggcatctcagccaagcttgtttcctgctctgaggcttgtggggtgggagc

SEQ ID NO: 1518 - DNA, 3838 bp, Homo sapiens
agccgttcccacgtgagaggctccgcggccgaattcctcgcgtgcagcaggcgcggaccgcccggcgtccggccggactgagagccctggtccggcgcgcgccgccggccgggcgggaggcgggggcgggctcggctgcgccccgatgcggcggcgacctccgggtctgtgagcccggcgcgcgccgtcggagcccctcgcgcagccgctggtagcgtccccccgggcacccggcatgcgggcggccgactcgggctcgtgggagcgcgtccgccagctcgcggcgcagggcgagccggcgccttcctgcggggcgggggccgggcccgcgcggcccccgggacccgcagcctgcgagcagtgcgtggacgcggcggggcccggcgatcggccccgcgccggggttccccgggtccgagcggatggcgactgcagccagcccgtgctcctgcgggaagaagtgtcgcggctccaggaggaagttcaccttctccggcagatgaaggagatgttggcgaaggacctggaggagtcgcagggcggcaagtcctctgaggtcctctcggccaccgagctcagggtccagctggcccagaaggagcaggagctagccagagccaaagaagccttgcaggccatgaaagctgatcggaagcgcttaaagggcgagaagacagacctggtgagccagatgcagcagctgtatgccacactggagagccgcgaggagcagctccgagacttcatccgcaactatgagcagcaccgcaaggagagcgaggatgcggtcaaagcgctggccaaggagaaggacctgctggagcgtgagaagtgggagctgcggcgccaagccaaggaggccacagaccacgccacggcactgcgctcccagctggacctcaaggacaaccggatgaaggagctggaggccgagctggccatggccaaacagtccttagctacgctgaccaaggacgtccccaagcggcattccctcgccatgccgggcgagacggtgctcaatggcaaccaggagtgggtggtgcaggcggacctcccgctgaccgcagccatccggcagagtcaacagactctctaccactcacacccccctcaccctgcggaccggcaagcggtcagggtgagcccctgccactcccggcagccctctgtcatctccgacgcatctgccgccgaaggcgaccggtcgtccacaccgagcgacatcaactcccctcgacaccggacacactccctctgcaacggcgacagtcccggcccagttcagaagaacctgcacaaccctattgtacagtcactagaggatcttgaagaccaaaaacggaaaaagaagaaagagaagatgggattcggctccatctcccgcgtcttcgccagagggaagcagcggaagtccctcgaccccggcctctttgatggtaccgcccctgattattacatagaggaggacgcggactggtgatacgcgctcccctgcgcctgctgcccgcaggcgtgtctgtgcgtgtgggcgtgtgtgcaagcgagcgtgggtgcgcgtgtggccgtgcgtggggtgcgtgtgcacgtgtgcgctggcacacatgggtgctgggtgtggccgagcgcctctaacaagtgaaaacacgagtgtgaacctctctcccctgcgtcgccacctctgtaattgatgtacataccgcaaaccgtgtgtgaacctgtcaactctctgtcgtctttggagcgatacagttgtgttgttaatctggtttattatttttcttcagtgtttggtttttctttttctttttgtttggttcgtcggtttgtttttgtttttgtttttttccccctttctcctcccctcctcctttttatgaaacttgaaaacttgaaggactgctgtgtatttgtaaataacaaaactattgtgcactctgtgcttgtaaatgtccctcgtccaaaccgctactcctggagcccgtctggcagaggatgtggtctgtttttgatgtcccccctcccgcccccctggtgtgaacgtgtgggaccagaccctgtcctgggggtgcgcccaagtcactttaaccacaaaacgccatcgtcgtcagggtaagctctgctctctacaaagactcgcgagccgggccaaggggccttgtcttggctgggtttgtcagaggtcaaaccggctcttttaaacggcctaccagtttttaaattgcattgccgtttctttctttatgaaaaaaaagaaaaaaagaaaattgtttcatttaatttatttgcacaaatgctgaaaacttattctatctaaattattacataaatattggaatgtctatttttccatggggtgggcgggaggtgggtgtctctgttgacttgtctgttctgttaccatgctgctacccaactgtgcaaagtagtttagggtggccagaacccagggaccattggatttcaaagcttgctttttctgttggttcttctctctccttctctctctgtctctcccattctcctgcccatgcatgaaaggatcctccaccttcttcccacccagagctccctccaggcctttctctatatatttatttatctgacatacagaacacgactttagtgagcagagtgctgacagtcatggtccccttctttgggtctgtcttttgagagaggttgagttcagggcaagacagcctgccacacatccaagggtacgaccagtgggaccctggcctgagtctgttctccgaggggcctccagcagcttctgttcctccctgcagctgtgtctttcttgtcctgggtttaggatgcaggtgggccaggcaggtgttgttaggggaggcacccacttcaaaaggagggccacagtggggacacagagtccagcacctgagccctccaccctccccattctggttggttccatcagccacacttagaatctcccaggatcccttggactccgtcccccaacttgtcacagcagcctgagcctacccaccccaggagacaagagctggcaggaacatctgcctatatggggggtggcgttggccccaaagaggcttcaccagcaaaggaactgtgtgtattttaatgccaggggacggaggatgtgtgagctgttcagcaaggtctgcccaaggcctaaaactcaatttccttattcttttgcttctgctcgtccttaacaactaacagctcaacccacacctctagacaacagtagtcgtgctttctgctaacggtgacattttcagctcttaaaaagaagcaaggagattttcaaatgctagagtatctctatcagaaggcataggacattgtgtccaaagtctcaagaacaaacaacactttccttctgacctggtccaaaagtcagcaaacagcaagcaggcagaggccctcataaggacttttctgtcctcctttgaccaaactgtttaaccgagcctaggggtgacggggagcgacccaagctggcatctttctctacggagacagattttagaaaatacttttcttgcccatgaatttcttttctggttgatttttatcattttccctttacttacaagaaaataagattgcaaccactcctgctaatgatttagtagttccttttcatttcagtttttgtaaattaggagataattctaagagttactaaaggatgatttatttaagagaactacgtcaaatagcgaatgagttatgggtaacattagacgaaaataacctttcccgtgggaaaggtttctcgaaggcatggatgcaaatataaaatattaaaaaaaatctaaataaagcttattttaaaatatga

SEQ ID NO: 1519 - DNA, 807 bp, Homo sapiens
ggaaggcagctgaactcggcgcctggaaagatggaggcagcggagacagaggcggaagctgcagccctagaggtcctggctgaggtggcaggcatcttggaacctgtaggcctgcaggaggaggcagaactgccagccaagatcctggttgagtttgtggtggactctcagaagaaagacaagctgctctgcagccagcttcaggtagcggatttcctgcagaacatcctggctcaggaggacactgctaagggtctcgaccccttggcttctgaagacacgagccgacagaaggcaattgcagctaaggaacaatggaaagagctgaaggccacctacagggagcacgtagaggccatcaaaattggcctcaccaaggccctgactcagatggaggaagcccagaggaaacggacacaactccgggaagcctttgagcagctccaggccaagaaacaaatggccatggagaaacgcagagcagtccagaaccagtggcagctacaacaggagaagcatctgcagcatctggcggaggtttctgcagagggtaagctgttgttccctgaggctgaggctgaggcagagaatcttccagatgataaaccccagcagccgactcgaccccaggagcagagtacaggagacaccatggggagagaccctggtgtgtccttcaaggctgttggtctacaacctgctggagatgtaaatttgccatgacttcctggaggacagcagcatggagaaagatcctagaaaaggcctctgacttccctcacctcccaaccatcattacaggaaaga

SEQ ID NO: 1520 - DNA, 7011 bp, Homo sapiens
tgttaggaaagaaaaaaaaattcctgatgtctggtccaagcaggaattccccggtggattggggaatgtctggcttttcctcagcttattgatctctgtggtaaccactggaggcccccagaagacccatagaaatgagaggcctgaggtctacaagtcgctgctagaaatattttagcctctccaaagcccagaatgcagccccgacccaagtttgtaagggttctgggtgcacgctgaccctgcgcgggcagacgcgccctttgctccaggtccggacctgggcgctgctatagcaacgtcctggacgcccagaccttaggccgccgccgccgcggaagcgaggaacccggccttctcccgctcctgagggctgtggcggcggcggcccgggaggcggcccaggctgggtaaagaccgcccggctcctcctatgcaagctgaggcagcggattggttttcaagcatgcccttccagaagcatgtctactacccgctcgccagcggcccagaggggcccgacgtcgctgtggccgccgccgccgcgggtgcggcctccatggcctgtgcgccccccagcgcggcttcggggcccctgcccttcttccagttcaggccgcggctggagagtgtggactggcggcggctgagcgccatcgacgtggacaaggtggcgggggctgtggacgtgctgacgctgcaggagaacatcatgaacatcaccttctgcaagctggaagacgagaagtgcccacactgccagtcgggggtggacccggtgctgctgaagctcatccgtctggcgcagttcaccatcgagtacttgctgcactcacaagagttcctcacctcgcagctgcacaccctggaggagcggctgcgcctgagccactgcgacggcgagcagagcaagaagctgctcaccaagcaggcgggggagatcaagacgctcaaggaagagtgcaaacgccggaagaagatgatctccacccagcagctgatgatcgaggccaaagccaactattaccagtgccatttttgtgacaaggcctttatgaaccaagcttttctacaaagtcacattcaacgccgccacactgaagaaaattctcattttgagtatcagaaaaatgcacagattgagaagctccggagtgagatcgtcgtattgaaggaagagctgcagctcaccaggtctgagctagaggctgcacaccatgccagtgcagtcagattctccaaggaatatgaaatgcagaaaacaaaagaggaagactttttgaagttatttgacaggtggaaagaagaagaaaaggagaaactagttgatgaaatggaaaaagtcaaggagatgtttatgaaggaatttaaagaattaacttcgaagaattcagcattagaatatcaactgtcagaaatccagaagtccaatatgcagatcaagtccaacataggcacattaaaagatgcacacgagtttaaagaagaccgttctccatatccccaggatttccataatgtcatgcagcttcttgatagtcaggaaagcaaatggacagctcgagttcaagctattcatcaagaacacaagaaagagaagggtcggctcctgtcacatatagagaaacttcgaacctcaatgatagatgatctaaatgcaagcaatgttttctataagaaaaggatagaagagctagggcagagactccaggagcagaatgagctgattataactcagagacagcagattaaagactttacctgtaatccattaaacagtatcagtgaacccaaagtgaatgccccagccctgcacactttggaaactaaatcaagtctgccaatggtgcatgaacaggcattctcgtcgcacatactggaaccaatagaagaactttcagaggaagaaaaaggaagggaaaatgaacagaaattaaataacaacaaaatgcatttaaggaaagctttgaagagtaactcctccctcactaagggactaagaacaatggtggagcagaacttgatggagaaactggaaaccttggggattaatgcagatatacgtggcatttcaagtgatcagttgcatagagtactaaaaagtgtggaatcagaaagacataagcaagaaagagaaatacctaactttcatcaaattcgagaattccttgaacatcaagtcagctgtaaaattgaggagaaagcactactctcttcagatcagtgcagtgtttctcaaatggataccctttcaactggagaagtacccaaaatgatacaacttccttccaaaaacagacaactgattagacaaaaagctgtttctactgataggacatctgttccaaaaattaagaaaaatgtcatggaagatccttttcccagaaagtcttcaactattacgacccctccttttagttcagaggaggagcaggaggacgacgacctcatccgggcatacgcatccccaggcccacttcctgtgccgccaccacaaaacaagggcagcttcgggaagaacacagtgaaaagtgacgcggacgggaccgagggaagcgaaatcgaggacactgatgattctcccaagcccgcaggagtcgccgttaaaacacctactgaaaaagttgaaaagatgtttccacatcgcaaaaatgtgaacaaaccagtcggtggaactaatgtccctgagatgtttatcaaaaaagaagaattacaagaactaaagtgtgcggatgtggaggatgaagactgggacatatcatccctagaggaagagatatctttgggaaaaaaatctgggaaagaacagaaggaacctccacctgcgaaaaatgaaccacattttgctcatgtgctaaatgcctggggcgcatttaatcctaaggggccaaagggagaaggacttcaagaaaatgaatcaagcacattaaaaagcagcttagtaactgtgactgattggagcgacacttcagatgtctaattccacatgtcagaagattattccagaagccagcagtatttcagtatcacagtgtttcagtaatttgcctccatgattctagtgcttctgccttaccgtgtttcccacagcaacacagagactgattcaaagaacaatggtctctttaatggcacccaatacagtattgaaaatcagatcatcaacagtatttcgaagcatgtaaaggtgtttaagacttccgctgctgcttaaaaataacatgtcattgaagtcataaaaagttttttcttcagaaaggtactctagtgttaagtgtatttttttcaactaattttttagtgaattttttttaaacttacagcatgttttggtttgaattactaaaactttaaaaaatatttttcttatgtatgctgtcgtatcgtaggcgtttatattataaaattctgttagtagtcttaaaattgaattggtggaaccactaatccttaaaagttagtctggttatttttcatatagaagtaagtttaatccgagtgtggtggtgttcacctttaatcccagctacttgggaggctgaggtgggaggataacttgagcacaggagttcaagaccagcgtgggcaatatagcaagactccacccctccacaccccaaaaaagtaagtttaggattagaatatagctaggtccaatgttaaatacattttcctggagtacatttgtcacattcagctttgagccactgtaagcatgttactattaaatggttggttattttatatagcatattctttatcttggatattttatgaataaagtatagttattttaagtgccaattaatttatcagactaaatagaaaatatttgagccattactgaattcacatatgtatgtttttttttactatttaaaatacccaacatgtattatgaaatacctcaaaagtaatttagttacattcttaaacaatgacattgtcgaaagaaagttcttataagctgttttttgcatttttataacttggttatactatattctgtttccaagtaaccttttaactaaaagatttgttgggttttagatctcttttcatttgtcaaccttttcagtaaagccctctgttacatcactgtgactgtggctgtgttattagagatgaattctgagttaaatttgtacttattaggggtcttacagagggagaatctggccttgattgctatgccatatgacattctgtcctaatggttagaacaaatctttatctgtttccacccaccctgggatcctttttacttgtagcccattcctgccctctaaaagaatccttccaacttcctataggggccatttcatgcagatatactcactttatatgtatgtttctaaaagctttagtgaaggctgaatccaagtttcatgtagtaggacagagaacagaaggccgaatccaagtttcatgtggtaggacagagaacggcaatctacaaaactacaccaagcctaagatggcccatgtgccactttgttcattcatttatttattcagcagatatttattgaaccacttggtctggtttggttttgaacacgcactaattcatttaattacaacaactttgcgatgtagttattgttataatcctcatcctaaaggtgtgagaaacagagttattaagtaagttgccagaagccatacaagtacaaagtgtcaaggggagactttaagccaggtctctattccatgttttgtgtctgccatgttttcattcctgagcagaagagcttggggaaatgaacttttgctaagtaaacccagtatttaaattaagtcactatatctgtgtcttttaagagcccctcctttagcttacatggttagttgtatctttttttttttttttttttgagacagagtctcactatgttgcccaggcttgagcgcagtggcaccatctcggctcactacaacctccgcctcccagattcaagcgattttcctgcctcagcctcccaagtagctgggattacaggtgcccaccaccatgcctggcttaattttttgtatttttagtagagatgaggtttcaccatgttggccagactggtctcgaactcctgacctcaaatgatccgctgtcttgtcctcccaaagtgctgggattataggcgtgagccatcgcgccctgctgcatttcatttttttgtataaaatttggtttgttcgtttttgaggggaaccattcctttatgttgccccttactgatgcccaactaatgtgtttctggttactaacagaccttcatcccccaccctccctaaattcttcggtgtaatctaagcgttatctgcaccacttctgaataataaatgtgtttgaaatgcacacctacacaaccctgtcccacactggcctgtaggacctaatctaccttcatgtctttcagttgatttgtatttctgcaaaagatatttcaaggattatcaaggtatggaattttttttattttttatcttttaacaaacttgttcatttccttttctttccattgagcacctctgaacaatgtgattcttttttttaagtctttcacacttcaggaaaatactacattcacccacgttgtgattcatatcggacagtttcttactcaaagataacacaaataccaattcttattcatactttgaaactatattttaccctagactgccttggttcaaaggcctagtttcgacattactgtggcaaattatttaagctctctgttttcatttctttttctgtaaatgcaggatgaaaacaatatgtatctcctaggatggctgtgaggagtgagtgagacaggacatgaaaggtgtgtatgaactgtgataactgttgcccttgtgggcatgttatatagggctggctctaggaagaagcctgtgtcttttttcagaaatccctggagcaacttaaatgtctttagaaatgacaagtctctcagttatccagttagccgtaaacaggttctggaagacacacctagatagaactcggcccgtcagttctgagtgaggcacgtaccacttgggcttgggatgtccttaacccatttatgcctgaggttgcaattttttgaatttttccaatcacaccttggcgatgaccttgagcagtaggatataaataactcccacatgcttagtgttccaataatggaacactaggcataaacaggttttaattggctcctcagtcaaccatgaccaatatctctatctcagcttctgctgatgccctagctcagggctctgcattccgtgccagggacgcctcagccccttaacatggatgtgccacatgacaggcaataatatattggccccattagcccttcctggagcagtcataatgaattacagtcatgacaggcacatgtaagaaaccaaaatttgctaaatatgtacatgagtcttcatcacagcatcgtttatgaaaacaactaaatattcactaatggtgccagtggaataaatcagagaacatcccctgctacgtaactctctgcatacatcaaagagaatggtgtggctttgctttttcaacaatctactgagtggccatgggcatgtggatatggccatgaatgagcaagatcctctctgatcctgtagaagttaagttctaccagataacttgctgcttcaacaaaaagatttacctttttaaataaatgttgtagaatacttaaaaaaaacaaactagaatttgcctgtgtgcagccagtaacatgtctatttaacctggacaccttttgaggaatattctcagattgcccccatgctgtttataagacattgttccttatacacctgtttatgaatgaaaagaaacataaggagtgggtacaaagacttctatctatgaatgattaaaaaggctagagtacgaatacttcttgaacctttggtactaaatgcttttcatgttctatataaatgtagaaaacattttacaaatcctgtaaataaactgtttattttttatagaaagcc

SEQ ID NO: 1521 - DNA, 2147 bp, Homo sapiens
ggtagacgcgatctgttggctactactggcttctcctggctgttaaaagcagatggtggttgaggttgattccatgccggctgcctcttctgtgaagaagccatttggtctcaggagcaagatgggcaagtggtgctgccgttgcttcccctgctgcagggagagcggcaagagcaacgtgggcacttctggagaccacgacgactctgctatgaagacactcaggagcaagatgggcaagtggtgccgccactgcttcccctgctgcagggggagtggcaagagcaacgtgggcgcttctggagaccacgacgactctgctatgaagacactcaggaacaagatgggcaagtggtgctgccactgcttcccctgctgcagggggagcagcaagagcaaggtgggcgcttggggagactacgatgacagtgccttcatggagcccaggtaccacgtccgtggagaagatctggacaagctccacagagctgcctggtggggtaaagtccccagaaaggatctcatcgtcatgctcagggacactgacgtgaacaagcaggacaagcaaaagaggactgctctacatctggcctctgccaatgggaattcagaagtagtaaaactcctgctggacagacgatgtcaacttaatgtccttgacaacaaaaagaggacagctctgataaaggtatgcagtagccaactatatcagcatgaggccgtacaatgccaggaagatgaatgtgcgttaatgttgctggaacatggcactgatccaaatattccagatgagtatggaaataccactctgcactacgctatctataatgaagataaattaatggccaaagcactgctcttatatggtgctgatatcgaatcaaaaaacaagcatggcctcacaccactgttacttggtgtacatgagcaaaaacagcaagtcgtgaaatttttaattaagaaaaaagcgaatttaaatgcactggatagatatggaagaactgctctcatacttgctgtatgttgtggatcagcaagtatagtcagccttctacttgagcaaaatattgatgtatcttctcaagatctatctggacagacggccagagagtatgctgtttctagtcatcatcatgtaatttgccagttactttctgactacaaagaaaaacagatgctaaaaatctcttctgaaaacagcaatccagaaaatgtctcaagaaccagaaataaataaggatggtgatagagaggttgaagaagaaatgaagaagcatgaaagtaataatgtgggattactagaaaacctgactaatggtgtcactgctggcaatggtgataatggattaattcctcaaaggaagagcagaacacctgaaaatcagcaatttcctgacaacgaaagtgaagagtatcacagaatttgtgaattactttctgactacaaagaaaagcagatgccaaaatactcttctgaaaacagcaacccagaacaagacttaaagctgacatcagaggaagagtcacaaaggcttaaaggcagtgaaaatggccagccagagaaaagatctcaagaaccagaaataaataaggatggtgatagagagctagaaaattttatggctatcgaagaaatgaagaagcacagaagtactcatgtcggattcccagaaaacctgactaatggtgccactgctggcaatggtgatgatggattaattcctccaaggaagagcagaacacctgaaagccagcaatttcctgacactgagaatgaagagtatcacagtgacgaacaaaatgatactcagaagcaattttgtgaagaacagaacactggaatattacacgatgagattctgattcatgaagaaaagcagatagaagtggttgaaaaaatgaattctgagctttctcttagttgtaagaaagaaaaagacatcttgcatgaaaatagtacgttgcgggaagaaattgccatgctaagactggagctagacacaatgaaacatcagagccagctaagagaaaagaaatatttggaggatattgaaagtgtgaaaaaaaggaatgataatcttttaaaggctctacaattgaatgagctcaccatggatgatgataccgctgtgctcgtcattgacaac

SEQ ID NO: 1522 - DNA, 1826 bp, Homo sapiens
gcttgtggggttggcagttctttaagtctgcaaataactacagaacacaatagagtcctcctcccttcctctctctctctttcttttttttttttcttttcctgcttccaaacgccttcttcgaggctgaagctgggcaggtctccagaggtgcagcagccacaacaatcccgcagttcaaagttaagcagcagttgcacaacttccagcaactttctcagccggctactaatgagctgaaagccaggaacatccgaggagaagagaaagcttccagccctcctcccttcaccctggaaatccagacacccccacccccaccctcagatcactttaagataatttctttattcgtttgcccgacagaccatggctccctttggaagaaacttgctaaagactcggcataaaaacagatctccaactaaagacatggattcagaagagaaggaaattgtggtttgggtttgccaagaagagaagcttgtctgtgggctgactaaacgcaccacctctgctgatgtcatccaggctttgcttgaggaacatgaggctacgtttggagagaaacgatttcttctggggaagcccagtgattactgcatcatagagaagtggagaggctccgaaagggttcttcctccactaactagaatcctgaagctttggaaagcgtggggagatgagcagcccaatatgcaatttgttttggttaaagcagatgcttttcttccagttcctttgtggcggacagctgaagccaaattagtgcaaaacacagaaaaattgtgggagctcagcccagcaaactacatgaagactttaccaccagataaacaaaaaagaatagtcaggaaaactttccggaaactggctaaaattaagcaggacacagtttctcatgatcgagataatatggagacattagttcatctgatcatttcccaggaccatactattcatcagcaagtcaagagaatgaaagagctggatctggaaattgaaaagtgtgaagctaagttccatcttgatcgagtagaaaatgatggagaaaactatgttcaggatgcatatttaatgcccagtttcagtgaagttgagcaaaatctagacttgcagtatgaggaaaaccagactctggaggacctgagcgaaagtgatggaattgaacagctggaagaacgactgaaatattaccgaatactcattgataagctctctgctgaaatagaaaaagaggtaaaaagtgtttgcattgatataaatgaagatgcggaaggggaagctgcaagtgaactggaaagctctaatttagagagtgttaagtgtgatttggagaaaagcatgaaagctggtttgaaaattcactctcatttgagtggcatccagaaagagattaaatacagtgactcattgcttcagatgaaagcaaaagaatatgaactcctggccaaggaattcaattcacttcacattagcaacaaagatgggtgccagttaaaggaaaacagagcgaaggaatctgaggttcccagtagcaatggggagattcctccctttactcaaagagtatttagcaattacacaaatgacacagactcggacactggtatcagttctaaccacagtcaggactccgaaacaacagtaggagatgtggtgctgttgtcaacatagttccaatggctcctttctgacctgctttcatgttttaatgtttgtttaatttaataggaaacctcattttaaatataacactcaaaaaaatgtaaatcatattgtagtattcaatagttaataaaaactcgagaaatgtgttgtttctg

SEQ ID NO: 1523 - DNA, 3974 bp, Homo sapiens
gagaggagtgttttcttgcatccagaaaagacctgagaggcggacgacacctgtgctccgcagagcagaacgtgggaggaacggcgggatgttaaggagctcaagaagcagagagtctacctgcccgacgcgttcgtggagaggagcagcggttgctgttggaggaggtgggtgcaaggacggcagatggcatccctgagaggtggtgactgagactagatgcgggtgcaggtccatctccactggtggctgtggtggctttggattgttggaagaccatcaccttcagcaggtctgcacttgggaacaatcattctcccccagcccgagcgtgcctctgccctctgtatcattgacagaggctgtatgtttggaaagagaactttgtgactgcagaactgacagttgactctaattcttgctaccaagtttttccccgacccagtgaaagagtgttaagacttcgacctaggacacattgagaaccaaggccaagactggacagggccatataactgggcttcaaccatggctgggactaagaataagacaagagcccaggccaaaactgaaaaaaaggctgctatacaagctaaagctggagcagagagggaggctactggtgttgttaggcctgtagccaagaccagggccaaagcaaaagccaagacagggtctaagacagatgcagtagcagagatgaaggcagtgtctaagaacaaggttgttgctgagacgaaggaaggagctctgtcagagcctaagactctgggcaaagccatgggagatttcactcccaaggctgggaatgagtccaccagctccacatgtaaaaatgaggctggtactgatgcctggttctgggctggggaagaggccactatcaattcctggttctggaatggagaagaggctggtaatagtttcagcactaagaatgataaacctgaaattggtgcccaggtctgtgctgaggagttggaacctgcggctggggccgattgcaaacctaggtcaggggctgaggaggaggaggaagagaatgttattgggaactggttttgggaaggagatgatactagttttgaccctaatcctaaacctgtgagcaggatagttaagcctcagcctgtgtatgaaattaatgaaaaaaataggcccaaggactggtctgaggtaactatctggcccaatgcccctgctgtaactccagctgtgttaggatttagatcccaggcaccatctgaggcaagccctccttcatatattgttctggcctccgctgaagaaaatgcctgttctttgcctgtggcaacagcttgccgcccttctaggaacactcgctcatgctcacagcctatccctgagtgtcgttttgattctgacccctgcatccagaccatagatgagattagacgtcaaatcaggatcagggaggtaaatgggattaagccatttgcttgtccttgcaaaatggaatgctatatggattctgaggaatttgaaaaacttgttagcttacttaagtcaactactgatcctcttattcataaaatagcacggattgcaatgggtgtccataatgttcacccatttgcccaagagtttattaacgaagtaggtgtagtgacacttattgaaagcttgctcagttttccttcccctgaaatgagaaaaaagactgtaattactctgaatcctccttctggggatgaaagacaacgcaaaattgaattacatgttaagcatatgtgtaaagaaaccatgtcatttcctttgaactcaccgggacagcaatctggattaaagatactaggacaactgactactgattttgtccatcactacattgttgccaattacttttcagagcttttccatttgctgtcctcaggaaattgcaaaaccagaaatcttgttttgaaactacttttaaatatgtctgaaaatccaactgcagccagagacatgatcaatatgaaggcattggcagcattaaaactcatctttaaccagaaagaggcaaaagccaatcttgttagtggtgtggccatatttattaacataaaggagcatatcagaaaaggctcaattgtagttgttgatcacttgagttataatacactcatggccattttcagggaagttaaagagattattgaaacaatgtaaaatgagccagagatagaacattttaagccatcttcaaactctagcaggctgtacattacagtgtacacattatacactgcatctttaacacagagtcacctgtgacaggctctaggtttgagctagactattttgggggtatcaaatgaatattataccttgggctgaaaatgtttgatttttatcttgtctagattggcatatttttaacattttacttaagatagcaaaccagttcgttttaagtaagctaacttgttcattagtatctgtggcttaaaatggcaaaaaagaaaatatccttgagtttgtaatctagttacagaagtaaggcatacacacacacaaagataacagtacctagagagagagtgtgtgtgagtgtgcgtgtctctgtgtgtgcacgtgcacgctcatggccaaatgtgcgcactctacataaaggaggcaggagttcctataggctatttaatgtaagagaaactatttttctcctgttccagctgtatcagatactcgttccgcaacacagaaatgactcagaatctcagacaaaatgtattatttgttcaattttaattttgctactacattcataactcttaaattgttaggctgtttcatttacatcaaagttatctcacaaaagagaaggcaggaaacgttttgtgagtgcctattctatgtcaaacactgtgttggcaccatattttacaagtttttttcctcttctcacagtgatcttgtgagttagttacttatatttttattagaactcattattctgggtaccctccaatgagaattagagaggttaaataccttttcctagattcccacagcaggaaggtggcatagctgttttgtctgacaccagaacccatctcaccacactgctttacagtcttcctgaaggacattttgaggtgggggggccttcaaagctcagagactggtttgaatggtttaattttgcaatggatcatgtccatgccaggtgttacaattcttaacttcctccaaattcgtgtgtccattagacatttggctacatctggctggaggtcaggagaaaattctgaggtaaatagatggattttatctggcagtgtcgaaaatagtaggagcctaaaactttgttcaatgagtaagatgtagatttggagtcatcagcaggggaaacttgttagatgtcctttgtatctttttctatccatttgtattttttctttcccaaagagctgaaatcattttataccctgaatttaaaaggtaattgcttttttcctccttgcgaaatcataccttaattttttttttttttttttttaccatttatgatttattctcctatgtgtcatatgaaaggccaaggggctttatcttttactagtaggcaagcctgggcatttctgcatttgtgccagctaacactacaaaatagacttaattagagaaatttagacccagaattgcagcttcaacaacacaaaacaggaaagctagaagaggttgctgtgtcaacctacaagatagtgattcttggaagttggtatggaccagaaagcattcccaggacatttaggctatggctgagttctctaagactcagggtgggaattataatccctggtctaagctgatatgaaagtttctatgtgtgaaaatatggagttatatgctttgagattttctgccagttaaactaaaacaagatcatactgtaaatgtttgtaacttgcttccccccactgtatactgtaaacatctttgcatgtcaataaatatgcctctacaacata

SEQ ID NO: 1524 - DNA, 3530 bp, Homo sapiens
tttccgtggcgacgctatccgaagtgcggctgcgcaagggtgacggcgcgcgagcaagggggagggggtgttttggttctagccgctcgccgtccttgcaggctctgccgtcggaaagccgctcattctcgcttccccttccctttcccggctcaagtccttcctctctctttcctttctttccgcctatcttttttctgctgccgctccgggtccgggccattttccgggccgggcgcactaaggtgcgcggccccggggcccagtatatgacccgccgtcctgctatccttcgcttcccccgccccatgtggctgcggggccgcggcggcgctgcccactatggcccggaaagtagttagcaggaagcggaaagcgcccgcctcgccgggagctgggagcgacgctcagggcccgcagtttggctgggatcactcgcttcacaaaaggaaaagacttcctcctgtgaagagatccttagtatactacttgaagaaccgggaagtcaggctacagaatgaaaccagctactctcgagtgttgcatggttatgcagcacagcaacttcccagtctcctgaaggagagagagtttcaccttgggacccttaataaagtgtttgcatctcagtggttgaatcataggcaagtggtgtgtggcacaaaatgcaacacgctatttgtcgtagatgtccagacaagccagatcaccaagatccccattctgaaagaccgggagcctggaggtgtgacccagcagggctgtggtatccatgccatcgagctgaatccttctagaacactgctagccactggaggagacaaccccaacagtcttgccatctatcgactacctacgctggatcctgtgtgtgtaggagatgatggacacaaggactggatcttttccatcgcatggatcagcgacactatggcagtgtctggctcacgtgatggttctatgggactctgggaggtgacagatgatgttttgaccaaaagtgatgcgagacacaatgtgtcacgggtccctgtgtatgcacacatcactcacaaggccttaaaggacatccccaaagaagacacaaaccctgacaactgcaaggttcgggctctggccttcaacaacaagaacaaggaactgggagcagtgtctctggatggctactttcatctctggaaggctgaaaatacactatctaagctcctctccaccaaactgccatattgccgtgagaatgtgtgtctggcttatggtagtgaatggtcagtttatgcagtgggctcccaagctcatgtctccttcttggatccacggcagccatcatacaacgtcaagtctgtctgttccagggagcgaggcagtggaatccggtcagtgagtttctacgagcacatcatcactgtgggaacagggcagggctccctgctgttctatgacatccgagctcagagatttctggaagagaggctctcagcttgttatgggtccaagcccagactagcaggggagaatctgaaactaaccactggcaaaggctggctgaatcatgatgaaacctggaggaattacttttcagacattgacttcttccccaatgctgtttacacccactgctacgactcgtctggaacgaaactctttgtggcaggaggtcccctcccttcagggctccatggaaactatgctgggctctggagttaatgacaactccccaaatgcagagatttacactaacttccattctcagtttccttgtttcttttgattttttttttcctaattgtgtgaggctcttgtgttttagtgggaacaccaaagtttgcctatagtttaggcacttaataggaagaagctctgtacagaaatctgaaagttgttttgctttttgttttcccctttggtaatcaaaattttactatcttttattatttctggcttttcaaccaaacattgttgctaatccctatttttctttaagtgacacacattctcctgtctctggcttcttcaggctgaaatgacatagctcacccttacttcactcttgagaggtagggctcctttataattacatggttgctctcagactttctgtgaaagtttgggagctgtgtgtgtctgtgtgtgtgtgagagagagatcttgtctgcgtgtgtgtgtgtgatcttgtgtgcctgtaggtactgtgtgtcactgaaattacctggagtgaggattacttgtaattaaaatatttataaaagaaacaactttattcacagagtccagctttgggactagtctgtatcttgttttttaagtctaacaacactgataataggaagtaaaaacagaaaggaaaagaaattaccactgggaaaatctttttagttagattgtaggcttcctggggcctcccatgccaggactgcaaagtgatccagccctacctgtcttcccacctgtgtgtcccccgtgtgggaagttggtgtcacttccccttcccaccctcacatctgcttagccagtagccacacccctaaaacatcagactcaccatccaggtgcagctccagaggctacaaaaggcttcatgggacttgaatccccatcctagcttctctctccttcccctcaagacctgatctggttttaaggggcctggagctgggagtctcaagtctgctaagattcacatccatagcccccatggctttgaggagaatcctctctgccattcttccaatctccccagtgggttttgctattattttctaaattgggttaagtctaagaaggtgggggtgagcagggggtttatctgtgtgtagtgagtgcttcatgtgtggaatattcattttcttactgcagtgggacttggggttgaagccacccctcctactctgttggcttagccctgagatggtgacaggctggcctgcagtcagcatcattgtgcatgtgacagcatcaatgtgattagtaatttgtctgttcctcccttgaactgtctgtttagtctgaggtttttaaacttgcaggcagctgactgtgatgtccacttgttccctgatttttacacatcatgtcaaagataacagctgttcccacccaccagttcctctaagcacatactctgcttttctgtcaacatcccattttggggaaaggaaaagtcatatttattcctgcaccccagttttttaacttgttctcccagttgtccccctcttctctgggtgtaagaagggaaattggaaaaaaaattatatatatattctccttttaatggtggggggctactggagaggagagacagcaagtccaccctaacttgttacacagcacataccacaggttctggaattctcatcttcgaacctagagaaataggtgctataaacagggaattaagcaaaatgctggatgctatagatcttttaattgtcttaattttttttctattattaaactacaggctgtagatttcttagttctcacagaacttctatcattttaaactgacttgtatatttaaaaaaaaaatc

SEQ ID NO: 1525 - DNA, 3788 bp, Homo sapiens
atcccggctcctgcatccagtcgccattcgggaggccgctgcgctgcagggcctcgcggagccgcccgcgaccgcgagccgggccctccgcgcggtccatcgcccactggacgccgcccgcggccggaccggttcaacttctcatctttgttcttcttcatatactataggctgtttgctgtggtttagtcaaaaagccatgtagaatgcctgccttttgaagaccacttttaaggtgtctagtaagacagcagcagtattgaaagtttttaaagaatataaccgtgtgtgttggtaacagacagaagaatggaagcattccaggaacttcgtaaaccatcagcacgtttggagtgtgaccattgcagtttcagaggcacagactatgaaaatgtacaaatccatatgggtaccatccatccagaattttgtgatgaaatggatgctggtgggctaggcaaaatgatattttaccagaaaagtgcaaagttatttcactgccataaatgcttcttcaccagcaagatgtactctaatgtatactatcacatcacatccaaacatgcatccccagacaaatggaatgataaaccaaaaaatcagttgaacaaagaaacagatcctgtgaaaagccctcctcttcctgaacaccagaaaataccctgcaattcagcagaaccaaaatccatacctgccctttcaatggaaacacagaaacttggttcagttttgtctccagaatcgccaaaacctactcctcttactcccctggagcctcagaaacctggctctgttgtttctcctgagctacagacacctcttccttctcctgagccttcaaaacctgcctctgtttcttctcctgaacctccaaaatcagtccctgtttgtgagtctcagaaacttgcccctgttccttctccagaaccacagaaacctgcccctgtatctcctgagtcagtaaaggctactcttagtaatcccaaaccccagaagcagtctcatttcccggaaacattggggccaccttcagcctcatctccagagtcaccagttctagctgcttccccagaaccttggggaccatccccagctgcatctccagaatctcggaagtcagcccggactacctcccctgagccaaggaagccatccccttcagagtctcctgaaccttggaagccgttccctgctgtctccccagagcctaggagaccagcccccgctgtgtcaccaggctcttggaaaccagggccacctgggtcccctaggccttggaaatccaatccttcagcatcatcaggaccttggaagccagctaaacctgctccatctgtgtctcctggaccttggaaaccaattccttctgtatctcctggaccttggaaaccaactccatctgtgtcttctgcatcctggaaatcttcatcagtctcacccagctcctggaagtctccccctgcatctcctgagtcatggaagtctggcccaccagaactccgaaagacagctcccacgttgtctcctgaacattggaaggcagttcccccagtgtctccagagcttcgcaaacccggcccaccactatccccagagatccgtagtccagcaggatctccagagctcagaaaaccctcagggtcaccagatctttggaagctttctcctgatcagcggaaaacttctcctgcttcacttgatttccctgagtcccagaaaagttcccgtggtggttctcctgatctctggaagtcttccttttttattgagcctcagaaacctgtcttccctgagacccgaaaaccaggtccttctgggccatctgagtcccccaaagcagcctcagatatctggaagcctgttctctctatcgatactgagcctagaaaacctgccctgtttcccgagcctgccaaaacagcccctcctgcttctccagaagcacgcaaacgtgccctttttccagagccccggaagcatgcccttttccctgaactccccaaatctgctctattctcagaatcacagaaggctgttgagcttggtgatgaactacaaatagatgccatagatgatcaaaaatgtgatattttggttcaggaagaacttctagcttcacctaagaaactcttagaagatactttatttccttcctcaaagaagctcaagaaagacaaccaagagagctcagacgctgagcttagtagtagtgagtacataaaaacagatttggatgcgatggatattaagggccaggaatcaagcagtgatcaagagcaggttgatgtggaatccattgattttagcaaagagaacaaaatggacatgactagtccagagcagtctagaaatgtgctacagtttactgaagaaaaagaagcttttatctctgaagaggagattgcaaaatacatgaagcgtggaaaaggaaagtattattgcaaaatttgttgctgtcgtgctatgaaaaaaggtgctgttttgcatcatttggttaataagcataatgttcatagcccttacaaatgcacaatctgtggaaaggcttttcttttggaatctctccttaaaaatcatgtagcagcccatgggcaaagtttacttaaatgtccacgttgtaattttgaatcaaatttcccaagaggttttaagaaacatttaactcattgtcaaagccggcataatgaagaggcaaataaaaagctaatggaagctcttgaaccgccactggaggagcagcaaatttgataacacagtgtgaatatttgttctacaaaggtgtttgttggaaccattctttgtaagtatagcttatcagatagcatagttggatcagtagatgacatgtatggtgtaccgtgtttcactgtctcagttgtgttactaagaatgagcatttgatcatttttttctggtctctgtctatgtgactatcttgtaagtcaataaatttctgtatagtccagatggattaaacttctcatttcttttaaatatgtatgaataataatacaaggaagtaggcattccatttaataatcaagagcaagttgtactcaaagcattcagttaaagtgtatctgtgtgtggaactaatttcagacaatagaaaatattagttgaaatgtttaagaattaggcatgaaaaataaatttgagaaattttgtttccttacatgtatttttaaatcataagagttattttctatctgatgtaaaattagtttataaatcttaatcagcttctagatgtttattagcttttatgtcatgaaatgttggagtctcagggttgctgattttctgctaatgggaaaaattgactaagtctttaaaatagtttgcagccttctcccacaggagacaagtgaaagataagtgtgattttagatctttcttgtccatagttgttttcagtggagtcttccattctgtatcttaccctaagatctggttcttccctccccatccccaccccccacccaccgcctgccagctcacactaatagatgattcttaattgccaaatgtgttagagtttgtatatcctactcctgggccttacatgtcgcctgttggggcttaagaccaggttgataagtaggaactgaaagtcttccagattcacagtagaaaattttatagacatttctgttaaagaaatatatcgattttatgtttttcaattatgttactgtaaataccttgtacctgttcatggattattttattctaaaatattttgtcaaatgtgtatcaaccaaattaaaaagaaaggttttcatgtc

SEQ ID NO: 1526 - DNA, 4823 bp, Homo sapiens
gagaacggtggccggacggagagactgcgggtctgagggactggcgggcgggcgggccgagcggcgccgccgaggccgggctgggccgagcccaggagcgcccgggatgtagcgggccaccctgccgatgccacagcgcccggccgcgggcggagccggagccggagcctggggaggcggcgggggcccagagcgcagcccgcgccccccgcgcggagccaggcccgctgccgtccccgccgcccgggcccccggcatgcagccccggctgcggaggtgacactcacggaccttagccaccgccgccgccatcgccaccatggacgaacaggaggcattgaactcaatcatgaacgatctggtggccctccagatgaaccgacgtcaccggatgcctggatatgagaccatgaagaacaaagacacaggtcactcaaataggcagaaaaaacacaacagcagcagctcagcccttctgaacagccccacagtaacaacaagctcatgtgcaggggccagtgagaaaaagaaatttttgagtgacgtcagaatcaagttcgagcacaacggggagaggcgaattatagcgttcagccggcctgtgaaatatgaagatgtggagcacaaggtgacaacagtatttggacaacctcttgatctacattacatgaacaatgagctctccatcctgctgaaaaaccaagatgatcttgataaagcaattgacattttagatagaagctcaagcatgaaaagccttaggatattgctgttgtcccaggacagaaaccataacagttcctctccccactctggggtgtccagacaggtgcggatcaaggcttcccagtccgcaggggatataaatactatctaccagccccccgagcccagaagcaggcacctctctgtcagctcccagaaccctggccgaagctcacctccccctggctatgttcctgagcggcagcagcacattgcccggcaggggtcctacaccagcatcaacagtgagggggagttcatcccagagaccagcgagcagtgcatgctggatcccctgagcagtgcagaaaattccttgtctggaagctgccaatccttggacaggtcagcagacagcccatccttccggaaatcacgaatgtcccgtgcccagagcttccctgacaacagacaggaatactcagatcgggaaactcagctttatgacaaaggggtcaaaggtggaacctacccccggcgctaccacgtgtctgtgcaccacaaggactacagtgatggcagaagaacatttccccgaatacggcgtcatcaaggcaacttgttcaccctggtgccctccagccgctccctgagcacaaatggcgagaacatgggtctggctgtgcaatacctggacccccgtgggcgcctgcggagtgcggacagcgagaatgccctctctgtgcaggagaggaatgtgccaaccaagtctcccagtgcccccatcaactggcgccggggaaagctcctgggccagggtgccttcggcagggtctatttgtgctatgacgtggacacgggacgtgaacttgcttccaagcaggtccaatttgatccagacagtcctgagacaagcaaggaggtgagtgctctggagtgcgagatccagttgctaaagaacttgcagcatgagcgcatcgtgcagtactatggctgtctgcgggaccgcgctgagaagaccctgaccatcttcatggagtacatgccagggggctcggtgaaagaccagttgaaggcttacggtgctctgacagagagcgtgacccgaaagtacacgcggcagatcctggagggcatgtcctacctgcacagcaacatgattgttcaccgggacattaagggagccaacatcctccgagactctgctgggaatgtaaagctgggggactttggggccagcaaacgcctgcagacgatctgtatgtcggggacgggcatgcgctccgtcactggcacaccctactggatgagccctgaggtgatcagcggcgagggctatggaaggaaagcagacgtgtggagcctgggctgcactgtggtggagatgctgacagagaaaccaccgtgggcagagtatgaagctatggccgccatcttcaagattgccacccagcccaccaatcctcagctgccctcccacatctctgaacatggccgggacttcctgaggcgcatttttgtggaggctcgccagagaccttcagctgaggagctgctcacacaccactttgcacagctcatgtactgagctctcacggccacacagctgccggtcgccctttgctgcatggcagggggctgctgctgggctcagtgaagttgctgcttctcccaggcaaggctgtggaccatggagtggcagcccagccagcgtcggtctgtgccccttccgccactggggctcagagccggggtggggtggctgcagcctcaggactgggagcccccagcctgtcagatccaggagctccagtgtcctgagctcagcgtggaggggtaggggctgggaacagtgtgcaaggcagccgtgggccccaccctcggggatgtgtcctgacactgcaattggcaccgaagcccagagggtctgggggcacaagactgacgccagggtatgaagagtgttattttcattcaaagtgttattttgtttttccttccaatgtctggagaccaccagggcatctctgggctggatgagctcccacaagcctgagggaaaggccagcactcgctagcagtggcaggcagaggcccaggctgccgtcccctagagtcccaggttggctctgccagtcctgtcctttaccaaagatgaatgaagcaaatgtcatgctgccttattcagggaaggaggagcctgtcctgcctgtggccatgaccctgcctctcccaggcaggggcccgcgatgtggaactgctgccactgaggggggatccagttttgtcaatgcagttgtctctgttttacaagttggagtcactcttatgctgtacccagtttctaaactggagactgtgtgtgccctctgggctctgagtacccctgctttgggcttgggcctaggctgcattgaaaagagctgaaggttgtggcctttgcgctcctggcccagcctttgttccccactggagcagaaggggagatggacgacacggtcggggcatctggcctggccagtgccctgatcccagagagcccgaggaggtgtctcaggctgcctgagtcgtgacctgctaggccagagcccactccatctggtagaagggaaagcccatatgctaccaccagctgtgtccaaaaccgccagctctgttcttcctcagccagcctcgcccatccccttgaggtctcagcccctttcccttgtagctcctcccctggagggggaatggcagcaggggttggggaaacagcatctccaagcagcttagagttggccatatttacctcagcctgggcgctggtcctttcttccggcccctcccctccaaaatgtgcctattgctagagctcctccctctcaacacccagtttccttgggagttgtcattaaaggaaaaaaaaaaaaaaaaaagccagtgcccagggatgggcatctccagggagctggggattagtgccaggcagccctgccagccatgcctacatccccatgggcacagaacaagccaaagccttcgttgtatgttgacgatgcacttttatgaatgtagtttctatcgctgtttttagccttttcacatcatgtaatgtgaggccttgtacttgttaatttatatctcagatcatatttgatggtttttatatatatcaattctagactgttacaggtgacggacgcctcaagagagagaagagaaaatgaaagcagctggttttgcagaagtgtgtgtcgcatgcgccagttgggcctggaccctcctgtgtccatccctgttcccccaggggctctatcagcccctgtaccccacactgccctctgaagacaacacaggctcctgcttccacctcggcccttgcccagggtggggcctggccctcatcttgaccaaagctgctgtgtggcagctcggcctctctacgaccccatcttggtggctgcacactcttcctggcccgcacccccatccccagtccctgttccccaagaggatacagagcacggtgctggctgactcaactgtgcgtcccaggttcagggtcttacagagctccaccccctggggtcttacctcactgggaatgtgttttgaaaatgaatttgaagacaagccaacaaaccctgcactccaaaaaagcaaaacagaccctaatttttttgtgccaaaaactgtggacatgctggctcagcatcctcaggaccaagttgttgcttaatttattgttttttaataactaatccagataaaaagttgtggggcttcagggtgacctgggcccaaaggttctgaagggcagttcctggcagccccaggcttgctgtgggaaggggccgtgccgtcactttctcatcattccatggggtgtgtctgcctgggccaactctgcatggagaggccagggctggggacagtccgcactctgccaccctcctgccccttccacccaccccagctctatgtctgtgtctgaattgtggatcgtgcagccatggttattgtggaactgtggaacctgcagccatagttatttgactatatcttgaccgagggcttgcagtgcaaagccaggccagtgttgcgcattacttacaataaaagggatcatttatatc

SEQ ID NO: 1527 - DNA, 4503 bp, Homo sapiens
cgagggaagaggccggagggagatcgcggaggggagggggcgggaggggggtggggtatcctgagtcgtccgtggtccggagtctggaaggccctagagcggcgccagtcgacccgcctcgccacaacttgcccagaccagacacgtttcatcctgcgccctgcaagaaggagccggcctgcctctctccgctttgctgctcctcggcctccgcgggcccggcccgcgtcagcagcgaccctggggtctgggtcccctgtgtcgcccccgcccgcctgcagcgcccggcacccgcccaggagcgcgcagctggggttctagggacgtatacttgagcaagagagaccacagctcttgttcccgctgatcctgcagcccagtggatggagtccagaatctacagacctgccaggaaagaaaaaaaaattcctgatgtctggtccaagcaggaattccccggtggattggggaatgtctggcttttcctcagcttattgatctctgtggtaaccactggaggcccccagaagacccatagaaatgagaggcctgaggtctacaagtcgctgctagaaatattttagcctctccaaagcccagaatgcagccccgacccaagtttgtaagggttctgggtgcacgctgaccctgcgcgggcagacgcgccctttgctccaggtccggacctgggcgctgctatagcaacgtcctggacgcccagaccttaggccgccgccgccgcggaagcgaggaacccggccttctcccgctcctgagggctgtggcggcggcggcccgggaggcggcccaggctgggtaaagaccgcccggctcctcctatgcaagctgaggcagcggattggttttcaagcatgcccttccagaagcatgtctactacccgctcgccagcggcccagaggggcccgacgtcgctgtggccgccgccgccgcgggtgcggcctccatggcctgtgcgccccccagcgcggcttcggggcccctgcccttcttccagttcaggccgcggctggagagtgtggactggcggcggctgagcgccatcgacgtggacaaggtggcgggggctgtggacgtgctgacgctgcaggagaacatcatgaacatcaccttctgcaagctggaagacgagaagtgcccacactgccagtcgggggtggacccggtgctgctgaagctcatccgtctggcgcagttcaccatcgagtacttgctgcactcacaagagttcctcacctcgcagctgcacaccctggaggagcggctgcgcctgagccactgcgacggcgagcagagcaagaagctgctcaccaagcaggcgggggagatcaagacgctcaaggaagagtgcaaacgccggaagaagatgatctccacccagcagctgatgatcgaggccaaagccaactattaccagtgccatttttgtgacaaggcctttatgaaccaagcttttctacaaagtcacattcaacgccgccacactgaagaaaattctcattttgagtatcagaaaaatgcacagattgagaagctccggagtgagatcgtcgtattgaaggaagagctgcagctcaccaggtctgagctagaggctgcacaccatgccagtgcagtcagattctccaaggaatatgaaatgcagaaaacaaaagaggaagactttttgaagttatttgacaggtggaaagaagaagaaaaggagaaactagttgatgaaatggaaaaagtcaaggagatgtttatgaaggaatttaaagaattaacttcgaagaattcagcattagaatatcaactgtcagaaatccagaagtccaatatgcagatcaagtccaacataggcacattaaaagatgcacacgagtttaaagaagaccgttctccatatccccaggatttccataatgtcatgcagcttcttgatagtcaggaaagcaaatggacagctcgagttcaagctattcatcaagaacacaagaaagagaagggtcggctcctgtcacatatagagaaacttcgaacctcaatgatagatgatctaaatgcaagcaatgttttctataagaaaaggatagaagagctagggcagagactccaggagcagaatgagctgattataactcagagacagcagattaaagactttacctgtaatccattaaacagtatcagtgaacccaaagtgaatgccccagccctgcacactttggaaactaaatcaagtctgccaatggtgcatgaacaggcattctcgtcgcacatactggaaccaatagaagaactttcagaggaagaaaaaggaagggaaaatgaacagaaattaaataacaacaaaatgcatttaaggaaagctttgaagagtaactcctccctcactaagggactaagaacaatggtggagcagaacttgatggagaaactggaaaccttggggattaatgcagatatacgtggcatttcaagtgatcagttgcatagagtactaaaaagtgtggaatcagaaagacataagcaagaaagagaaatacctaactttcatcaaattcgagaattccttgaacatcaagtcagctgtaaaattgaggagaaagcactactctcttcagatcagtgcagtgtttctcaaatggataccctttcaactggagaagtacccaaaatgatacaacttccttccaaaaacagacaactgattagacaaaaagctgtttctactgataggacatctgttccaaaaattaagaaaaatgtcatggaagatccttttcccagaaagtcttcaactattacgacccctccttttagttcagaggaggagcaggaggacgacgacctcatccgggcatacgcatccccaggcccacttcctgtgccgccaccacaaaacaagggcagcttcgggaagaacacagtgaaaagtgacgcggacgggaccgagggaagcgaaatcgaggacactgatgattctcccaagcccgcaggagtcgccgttaaaacacctactgaaaaagttgaaaagatgtttccacatcgcaaaaatgtgaacaaaccagtcggtggaactaatgtccctgagatgtttatcaaaaaagaagaattacaagaactaaagtgtgcggatgtggaggatgaagactgggacatatcatccctagaggaagagatatctttgggaaaaaaatctgggaaagaacagaaggaacctccacctgcgaaaaatgaaccacattttgctcatgtgctaaatgcctggggcgcatttaatcctaaggggccaaagggagaaggacttcaagaaaatgaatcaagcacattaaaaagcagcttagtaactgtgactgattggagcgacacttcagatgtctaattccacatgtcagaagattattccagaagccagcagtatttcagtatcacagtgtttcagtaatttgcctccatgattctagtgcttctgccttaccgtgtttcccacagcaacacagagactgattcaaagaacaatggtctctttaatggcacccaatacagtattgaaaatcagatcatcaacagtatttcgaagcatgtaaaggtgtttaagacttccgctgctgcttaaaaataacatgtcattgaagtcataaaaagttttttcttcagaaaggtactctagtgttaagtgtatttttttcaactaattttttagtgaattttttttaaacttacagcatgttttggtttgaattactaaaactttaaaaaatatttttcttatgtatgctgtcgtatcgtaggcgtttatattataaaattctgttagtagtcttaaaattgaattggtggaaccactaatccttaaaagttagtctggttatttttcatatagaagtaagtttaatccgagtgtggtggtgttcacctttaatcccagctacttgggaggctgaggtgggaggataacttgagcacaggagttcaagaccagcgtgggcaatatagcaagactccacccctccacaccccaaaaaagtaagtttaggattagaatatagctaggtccaatgttaaatacattttcctggagtacatttgtcacattcagctttgagccactgtaagcatgttactattaaatggttggttattttatatagcatattctttatcttggatattttatgaataaagtatagttattttaagtgccaattaatttatcagactaaatagaaaatatttgagccattactgaattcacatatgtatgtttttttttactatttaaaatacccaacatgtattatgaaatacctcaaaagtaatttagttacattcttaaacaatgacattgtcgaaagaaagttcttataagctgttttttgcatttttataacttggttatactatattctgtttccaagtaaccttttaactaaaagatttgttgggttttagatctcttttcatttgtcaaccttttcagtaaagccctctgttacatc

SEQ ID NO: 1528 - DNA, 6458 bp, Homo sapiens
cggcgtctctctcccccgcgccagctcccgtacacggagccgcattccttggcccccccacccccctccctcggggcccccccgcccccctcgggaaaaaaatccaccccgaatcactcgaacccgagggaggcttcctttcacccttggggagacgagctttcaacggttacctcttcttcgtctccccccaagcccccgtcccctccccctgctcccacccccttctggcgccgggtgtaaggtccctttaaggcgacggcgccttcctcgggtcagactaccggcggcgacgaccacaggagcatggcggacaccgacctgttcatggaatgtgaggaggaggagttggagccatggcagaaaatcagtgatgtcattgaggactctgtagttgaagattataattcagtggataaaactaccacagctggcaatcctttggtccagcaaggtggacagccactcatcctgacccagaatccagccccaggtctgggcacaatggttactcaaccagtattgaggcctgttcaggtcatgcagaatgccaatcatgtgactagttcccctgtggcctcacaaccaatatttatcactacgcagggatttcctgtaaggaatgtccggcctgtacaaaatgcaatgaatcaggttgggattgtgctgaacgtacagcaaggccaaacggttagaccaattacactagttccagccccaggtacccagtttgttaagccgacagttggagttccacaagtgttctcccagatgacccctgtgaggccaggctccacaatgcctgtgaggcccaccaccaacaccttcaccaccgtcatcccggccactcttaccattcgaagcaccgtcccacagtcccagtcccagcagaccaagtccactcccagcacttctaccactcccactgccacacagccaacctcactggggcaactagctgttcagtctccaggccagtcaaaccagaccacgaatcccaagctagctccctccttcccctctccacctgcagtgagcattgccagctttgtcactgtgaagcgacctggtgttacaggcgaaaatagcaatgaagtggccaaattggtgaatacccttaacaccatcccttccctgggccagagtcctgggccagtggtggtgtccaacaacagctctgctcatggctctcaaagaaccagcggacctgagtcttcaatgaaagtgacctcttccatcccagtatttgacctccaggatggtggacggaaaatatgtccacgatgtaatgctcaatttcgtgttactgaagctttgagaggtcacatgtgttactgttgcccagaaatggttgaataccagaagaaaggaaagtccctggattcagaacccagtgtcccatcagcagcaaagcccccatcccctgagaaaacagctcctgttgcttccacaccctcttctacacctattcctgctctgtcaccgcctaccaaagtaccagaaccaaatgagaacgtgggcgatgccgtccagaccaaactcattatgcttgtagatgacttctactatggacgggatggtggcaaagtagcccagctcacaaatttccctaaggtcgccacatctttccgatgcccacattgtaccaaaaggctaaaaaacaatattcgattcatgaaccatatgaaacaccacgtagaactcgatcagcagaacggtgaggtagatggtcacactatctgccagcactgttaccgccagttttccactcccttccagcttcagtgccacttggaaaatgttcatagtccctatgaatctactaccaagtgcaagatctgtgaatgggcgtttgaaagtgagccactatttctccagcatatgaaggatactcataagcctggagagatgccttatgtttgccaggtgtgtcaatatcgctcctcactctactctgaggtagatgtccattttcggatgatccatgaggatacccggcatctgctctgcccttattgcctgaaggtcttcaaaaatggcaatgcattccaacagcattacatgaggcaccagaagagaaatgtttatcactgcaacaaatgccggctgcagtttctctttgccaaggacaaaattgaacacaagcttcaacaccataaaaccttccgtaaacccaagcagctggagggcttgaaaccaggcaccaaggtgacaatccgggcttcccgagggcagccacgaactgttcctgtatcctctaatgatacacctcccagcgccttgcaggaggcagcaccgctgacctcctcaatggaccctctgcctgtcttcctttatccccctgtccagcgcagcatccagaagagagctgttaggaaaatgagtgtcatgggccggcagacatgcctggagtgcagcttcgagatcccagacttccctaatcatttccctacttacgtacactgctctctgtgtcgctatagcacctgctgttctcgagcttatgccaaccacatgatcaacaatcatgttccacggaagagccccaagtatttggctttgtttaaaaattctgtgagtggaatcaagctggcctgcacttcatgtacctttgttacctctgtgggcgatgctatggccaagcatttggtattcaacccctctcacagatccagcagcatcctgccacggggactcacttggatagctcactcaaggcatggccagactcgtgaccgagtgcatgaccggaacgtgaagaatatgtaccctcctccttccttccccactaacaaagctgccactgtgaaatctgcgggggccaccccagctgagcctgaagagctactaactcccttagccccagcactcccatcaccagcctcaactgcaaccccaccaccaacccccactcacccgcaggctttagcccttccaccgctggctacagagggagccgaatgtctgaatgttgatgatcaggatgaagggagcccagtcacccaagaacctgagctagcatcaggtggtggtggtagtggtggagttggcaaaaaggagcagctgtctgtgaagaagcttcgagtagtactgtttgctctatgctgcaatacagaacaggcagctgaacacttccgaaatccccagcgacgtattcgccgttggcttcgacgtttccaggcctcccagggggagaatctagagggcaaatatctgagctttgaggcagaagagaaactggctgagtgggtgctaacccagcgcgaacaacagctacctgtaaatgaggagaccttgttccagaaggccaccaaaataggacgttctttggaaggggggtttaagatctcctatgagtgggctgtgcgtttcatgctgcggcaccacctgactccccatgcccggcgagctgtggcccacaccctacctaaggatgtagcagagaatgcaggactcttcattgattttgtacaacggcagattcacaaccaggacttacccttgtctatgattgtggctattgatgagatctctttgttcctggatacagaggtgctgagcagtgatgatcgaaaggagaatgccctgcagacagtgggcacaggggaaccttggtgtgatgtagtcctagccattctggcagatggcactgtccttcccaccctggttttctacagagggcagatggatcagcctgctaacatgccagactccatattgctagaggcaaaggagagtggctacagtgatgacgagatcatggagctgtggtcaactcgagtgtggcagaagcacacagcttgccagcgcagcaaaggcatgcttgtgatggactgtcatcgcactcacttgtcagaagaggtactggctatgcttagtgcctctagcactttgcctgcagtggtcccagcaggctgtagctccaaaattcagccattagatgtatgcatcaaaagaactgtcaagaacttcctgcataaaaaatggaaggaacaggctcgggaaatggcagatactgcatgtgattctgatgtcctgcttcagctggtgcttgtctggctgggtgaagtgctaggtgtcattggggactgtccagagctagttcagcgctccttcctggtggctagtgttctgcctggccccgatggcaacattaactcacctacaagaaatgctgacatgcaggaggagctaattgcctccctagaggagcaactgaagctgagtggggaacattctgagtcttccactccacgacccagatcatctcctgaagagacaattgagcctgaaagtcttcaccagctctttgagggtgaaagtgagaccgagtctttctatggctttgaagaagctgacctagatctgatggagatttgagtgttggggtcatgagggggtgtggagtgagggtgggaacatgtgagggagggtaaaggggcttagggaaaagggggcataccaggtggggtatttggtttctattttttaattttataccaccactcccccctgaagttgacttacacttccctgtggatttgtggattaattaggaaaaccaatagtaatcacgtctgagccaaggagctggcccattggtcattcacttctgctaaaaacaggtttttgtgactttttttttttttaaatttaaatcactgtgtttggtatttttctgacaaaattaagaaaaagaaaaaaaattatttgtgggcaaatgttaaatttttttgtttccccttttacctcaattgtatcatagtactgggtttttttgtttgttttattgtgtggccaatgtctttgggcatgatgctatctaatcattgttaatgtgagaacatttctgaagatgggaaagacaaattatgtagctcacaaactggtttattatatatatggataaaaaacttttttcattgtggtcttaacacttttatataaaaatgaaaatggaaaaaaagtcccactgaactctctcttccttctccttttctttccttccctctccagagatgttggtttctacagcaaccctagatataaaattgtggctttaaaaatgcatgaaaccacctttaattatccagaatgaatagatttgtcttttcctcaccaccttccctccaaaacatgacataaacaatattttttgcacttgtgatccttggcccctttccccattctcaacaccatccatccctctggacaaaggatcatacaggtgttattagcaagcaagagatactgaagcgatcaaacagttttagggtggaagccattcccagtttgagtcttcatcctgtaagcccccaggggcagtccctgctttactgaacttcatcctgttagatggagagcatgcctgtttaagggattactggtcctacagccaggagctaattgttcaagaagtgttgaactttaaaaagacaagaccacttgttgaaatccagcgtgctctgtggctttcccctatttctcttaatacttagggaagaatctgacaggaagaagcgcacaggggtgtgcacaaagaaaatgacatgaatctttatttttcactgccagcttcaaggaaagaaaattttttctacaatttgcatgagggatttttttaattgtatgtactcatggttgtaaaccaaaacgtactgtaccgtacagagaaaaggagcaaaaaaccaagtcttctgtttatcctgaggctttccacaatgttcccctcctgtgagccaaggaggcaaactgcacaagcttgtaaatggttcgtctttaaaatgtacataagtggaacatttaataaaatgaggggaaatggatttataaacttgttttttttctaggtgaccctgtttaataggctttcacagactggggaatgctcaagatgtgatgggcctggtggtacaggtgtgacatttgttaccacccatttctcccaccccaccctgcttttttgtttgtttgttttttcatcccccagcacactataatatagtgaactggaaaagtcccttccagaaacagcttggccagctttgtgaacctttgacatctgaaaacaaccaaggatccatctgggcttctcttccccagctttttgcctgatgccattttattgacagacaatggactttgaagtcagcctttgcctttgagaaagttcaagaactatggttggtcacgtctatctacaacctaatcctactctttggtagtctctgcagcagccacagccttagcagagctggggttcctgtcttctgcacacgattgactttcttgatgggtaattttttttaagattataccaacagtggatcagctgggttttggccaggaagttgtctttgtggactctgcctgcatggcttagtagtagaaggaaatttttttttggttttgttttttataattcagtttaatcaataaacatgtatttattgactgtt

SEQ ID NO: 1529 - DNA, 4684 bp, Homo sapiens
aatccatccgcatggctttttgctctagttcctcagatctttctgcgctagctgcactcccaagcccaggcttagatctaccctaatctagtcccagccccgacctcatggacactggctgcaaaacttaccgccttgcaacacctggatccttaaatagttcagggcctcaaaggctcccaagccgccctgcgcctgttgctatggcgactgggcaggcggccggaagcgcggccttgttgggggcccccgttgcccgcctcccagtagccgcgcctcaccctaggccaggaatggttttagggaagactgttgccggatgacaaggctgtcactattgttctgtactacctgacattatgggaccaggccagccagcttcaacctgtgttcatctagcacctaggacccaacttgatgggaggagcgaccccaaagtacttcagacccagaaccagctgcagtttaataggaatgttcctacacattcaagcaacttggcgatccgatattcttgcccacatgccattagaattgaaaaactgaagcactcatacaatgaatcataccattgtaaagatgcagattgtagagttggtcctgacctgggcagttctgtttcattttccgtcatatcccaagagagacttagctatgctgtccacctagccagaagagatgtgaaacgaagacaatttgaaaaacatataaaagaacatcatctcagaagtcagcctcaaagctctcagaagtgtggacatactaagtataaaatacccgaccacagggtggaaaggaaggaatcaaagagtcaagcagcctgtcagtgtagccaccagccatccaaagtagaaatctccagctctggtgccaaagtatacctttactcatctcatccaggccagtcagatcttactgtgccaaattcgccacccacccatgatccgggacttcagcctcatcccaggataggtgaccacaaaaacataagtgaacagaaaagcctgctagaagtccagcgactccagaaagaactgagcagttgtatccacaaaattgaagaggtaactaaaaaagatagactagaagaagctttggatccagatgaagaacgtcgaatccgtatcaggagacaggagcaagctgctcgctctgcccgaatgctctacgtcctccagcagcaggtaaaagaaatccaggaagaattggataaattgagtccacataaaattaaacacactaagaagtcatgggcaatgtctaagctggcggctgcccatcgaggagccattcgggccttacagatgtttgtcactcagtttactgaccgaggggagcatccacttcctgctcggtgtaaggaactgggcagccttattcgccagctttcactttgttctgtcaagctggatgcagacccttctgttcctgatgtggttatagatattctgcaacaaattgaggctttggaatctctcctggaaaagaaactgtcaccaaaaaaggtgaaaaaatgtttcagtgaaattcggagcagatttcctatcggtagccaaaaggccttggagagatggccaagtacatcaccaaagggtgagaggaggcccctcacagcaaaggacacattcccacaggaaacaagtcgaccttctgtagcaaagcagcttcttgccgataagtatcagcccgatacggagcttccggagacccagaggttgcagagtgagcttgatgtattagatgcggatatagttctggaagaaggaccatttattctagaccaaagtgcaagcttcaaagacgaggtgttagccgtggcaaaaacaaaagcagggaaaaagaagcctgtgactgagaatgtgccgtttaggaagaaagatactctggcgccagcaagacagcaaggactccgcaaagctgaaagaggtagacaaagccaacctcacagtaaaagcagagtgcagcagacaacagtttcatccagattaaaaatgaaccggcagcctgtgaaagaccgcaaggcaccatggatacccccaaaccccacatccccaccagcgtctcctaaatgtgctgcatggctaaaggtgaaaactagccccagagatgccacaaaagagcctctccagcaagaagatcctcaagaggaaagtcacctgacaggtgctgttgagcatgaagcagccaggctcgcttggcttgatgctgaaacttccaaaagattgaaggaactagaagagttaaaagccaaggaaattgacagcatgcaaaaacagaggcttgattggcttgatgctgaaacttctagaagaacaaaggaactgaatgagctcaaagctgaagaaatgtatagactccaacaattgagtgtttctgccacccacttagcagacaaggtagaggaggcagttctggatcgtttgaagcctctcttggtcaaggcccagagagtcaattctactacagaagcaaatattcatttgaaagatggctcgtcagtaaacacagcgaaagcccagcctgcacaggaggttgcagctgttgattttgaatccaacaacattcgtcagcttgatgattttttggaagattgtgccagtgagctctgggctgtgactcatgctaagatcttggggtctgaaaccttagccaccgttgaggacagcaaggatagcccagatctggagatcatgatgcgccgaatggaagagatggaaaaataccaggagtctgttcgtcaaagatataataaaatcgcatatgctgatcctcgactttggatgcaggaagaaaacaatgaccaaaaaatctcagcaataagtgaaaagcctctatctcctcatccaatcagaatcacgaagacagtggatcgcaaggatccagccgtgaacatcatgttagaaaggccctgtaatggcaattccctggatgaaagtgtgggaacagaggaaggatcagagaaaagagaggcccctcttctctccctagccgaagattctcaacagaaagaaggccgagctcccctctttgtcccaccgggtatgcagcacagcatcggtgactactgtagtcgttttgagcagtaccttcggatcatatctcatgaggctgtaggctccttcaacccgtggctgatagctgaaagcttttcagaagagctggtagatgaagctctgggtgctgtggctgctgaacttcaggatatgtgcgaagattatgcagaagctgtgttcacctcagaattcttagaggctgctacataaaggctctctgaggcgaggccatttgtgtcacactggagaagggatggcaccaccctttgttttggcccacaggaaattttcatcctcagctgtccatccaggcccagaaggtgctgcccactgaaaggaaggcagtgccggggaggtcatcctcactttgcattttcttttgtcatggcaatggttctggaaatgtatgatgcaatgtatcacacttatcagtgcccaggcaacacaacttgattatggcaatattttcagaatgtgtacttttcctattgaaataccatgttcattcctctggctcagtttggtgatgaaaatgttttgaaagataatcgatacgtatatttcacacaaggattcaggttgctgttgaacccttgctggcattgataccaacacaagtgcggctactagctggtcccatcacggggcccctgttttgcatctttggcgatttcctgtcaggacctctggccctactaggctgtagactcagggagagcacagtctggctgtgctgccaaacctctcctctgctgcagtttattccaaacaggagccccctggctgtcagtgcacaataatagacacacatttcttcaacgttccattcctaggtgattttcacatttttagttcctcagcatattttattgctgtgtgttgacacaatctggtataaaaaactttctctggattcagaggaagtttgaggaatcaggagaggaccaggccttctcctgtgcctgggtgaaggtacagacctcgctgtgtctccgatgaggtcagaagtgtctctatttcataccacaaaggaacccaagtgggagtagggaacagatggatggcgcgaagacctctgtgtctccccagagaaaggaagaaacttaagaaccatcatagcctggtcctccaacatcttacagatcatgttttccaagagaaaagcctgtgttttcagaaactctgaattcagaaaaagaaacggaatgtgcgtaagaatcaggccactgcctggaaagactttctctcaattcgtagcctgaggctcagtgaaggaaacatgcagaaagaatgcctgagacgcccccagggaataagggaactctttataacctgtccagtgccgtcatctgggatttttctctgaagtacaagaatttcaggtgatttaagctgcttgatcacacttatttgtgcaaaattgattttcatttaatgttaatgttttcctgcttaattttatataacttcagaatgtaaagagcttcaaggtaaattacagggtgtttaacctggggagttaaatgtgtacacttgaattaataggagcaccggttgttgctagtataaagtaatttgtgtggcagtttgtactgtgctgagtttttaaaataaacccaatattttaaagt

SEQ ID NO: 1530 - DNA, 8006 bp, Homo sapiens
ctgcggcggcgcgctccgagcctgcgtctagggcgcccccgggtcagagctgtcgccgtggccgccgctgcaagaaccatgtaccgcagcagcgctcgctcctccgtctcttcccaccggcctaaagacgacggcgggggcggcccgcgcagcggccgcagctctggctcctcctcaggcccggctcgccgcagctcaccgccgcctccgccctccggctcctcgtcgcggaccccggctcgccgaccccgctcgccctcagggcaccgcggccgccgggcctcgccgtccccgccacggggtcgtcgcgtctccccgtccccgcctcgggcccgtcgcggctccccgtcgccaccgcggggccgacgactcttcccgccgggcccggccggcttcagaggcagcagccggggggagtcccgcgccgactatgcccgggacggccgcggagaccatccaggcgacagcggcagccggagacgctctcctggtctgtgttctgactctttggaaaagagcttaaggatcactgttggcaatgaccacttctgtgttagcacaccagaacggcgacggcttagtgatcggctggggtcaccagtggataatctggaagacatggacagggatgacctgactgatgattctgtcttcactcgaagctcccagtgctctcggggtcttgagcgatatatttcccaggaggaagggcctctcagtcccttcttgggacaacttgatgaggactaccgaacaaaagaaactttcctgcatcgatctgattatagtccccatatcagttgtcatgatgagctgttgcggggaacagaacggaatcgagaaaaactcaaaggctactccatacgatctgaagaaaggagccgggaggccaaaagaccccgttatgatgacacagtgaagataaacagcatgggaggggatcacccaagttttacatcaggaactcgcaactatcgacagcgtagaagaagcccaagtcctaggtttctcgaccctgagtttcgagaactggatcttgccagacgaaagcgagaggaagaggaggagcgaagtaggagcttgagtcaggagctggttggagttgatggtggtggtactggctgttccatccctggattgtcaggtgtcctaacagcatcggagccaggatattctttgcatcggcctgaggaagtatctgtgatgcccaagaaatccattttgaagaagcggattgaggtggacataatggagccctccatgcagcttgagagtttttccagcagtaccagctccagccaggatcaccctctctactctgggcacccatcccttccactaagtggtgctattgctgcttttgcctcagagattgaaaacaaggggactatggtagagactgccttgaaggaacctcagggcaacctctaccaatggggtccccttcctgggattcccaaagacaacagtcctctcagagaaaaatttggaagttttctatgccacaaggataatttggatttgaaggctgagggacctgagcgacacacagacttcctgctgccccatgagagagctagccaggatggcagtggtttttcccgcattctgagcatgttggctgattctaccagtacacaggaaaaaaggcgacgtagctttcccgacattgaagatgaggagaaatttctctatggggatgaagaagaggatttaaaggcagaatccgtaccaaagccccttgggagctctgagagtgaagttatgaggcagaaggcaagctccctgccgtcttcagctccagctgtaaagctagaatcactagaagagaccaatccagaatatgcgaagatccatgacttgctcaagacaatagggctggatattggagtagcagagattagtcaattggctgcacgcacccaggaacgacttcatggcaagaagccatcattacgctcctcagctgaccgccgttcctcagttgaccgatacttttcagctgaccactgttcctcagttgaccaccgcttctcagctgaccgctgttcctcagttgaccactgcttctcagctgatcgacgttcctcagatccccacagactagagagcagggaggcacatcatagcaatacccactctccagaggtgtcccatccacacccaccttctcctgtggatccttacctgctcacaaaaaacagccctccattcctaaagtctgaccatccagtgggtcatatttcaggaccagaggtggttggtagtgggtttcagtcatctgttgcagtcaggtgcatgttgccatcagccccatctgccccaattagacttccacacactgctgctttatctcagtttcacatgccaagggcctctcagtttgctgcagctcggatacctccgaactaccagggacctgccattccccctgcctcttttgatgcctataggcactacatggcatatgcagcctccagatggcccatgtatcccacctctcaaccgtcaaaccaccctgtacctgaaccacacaggataatgccaataaccaaacaagctactcgtagccgtcccaatcttcgtgtgatccccactgtgactcctgataagcctaagcagaaagagtctctgcgaggctcaattcctgcggcccaagtgcctgtccaggtgtccattccatcactcataagatataatccagagaagatctctgatgagaagaaccgtgcttcccagaagcaaaaggttattgaagagagggaaaaactaaagaatgaccgggaagcccgccagaagaagatgtactatcttaggaccgagttagagcggcttcataaacaacaaggagaaatgctgcgcaagaaacgaagggagaaggatggccacaaagatcctctcttggtggaggtgagtcggcttcaggataacattatgaaggacattgcagagctacggcaagaggcagaagaggcagaaaagaagcaatctgaactggacaaagtggctcagatcttgggaattaacatcttcgataaatcccagaagtctttaagtgacagtagagagcctacagagaagcctgggaaagcagaaaaatctaagagcccagaaaaagtgtcatcgttctcaaactcctcctccaacaaggaatcaaaagtaaacaatgagaagtttcgtactaagagccccaagcctgccgaaagcccccagtcagccactaagcagttggatcagcccactgctgcttatgagtattatgatgctggcaatcactggtgcaaagactgcaacaccatctgtgggaccatgtttgatttcttcactcatatgcacaataagaagcacacacagacactggatccctacaacagaccttgggcttcaaagacccagagtgaggccaagcaagatgccataaagcgcactgacaagataactgttcctgcaaaaggctctgagtttctggttcccatcagtggattttattgccagctctgtgaggaatttttgggggatccaatttctggggagcaacatgtgaagggtcaccaacacaatgagaaatacaagaaatatgtggatgaaaacccattatatgaggagcggcggaatctggaccgccaagctggcttggctgtggtcctagagacagaacggcgacggcagagtgagctaaagcgcaaacttagtgagaaaccaaaggaggagaagaaagaaaaaaaggcaaaggctgtgaaagaagtaaaggaggatgacaaggtctctgagaaattagaagaccaactctctgagggtaggaactcccctgaaaaagctgaaaataaaaggaacactggcatcaaactccagttaaaagaagaggtaaagaaggaatcaccaacatcatcttcttttgggaaattcagctggaagaagccagaaaaagaagaggagaaaagttcattggtgaccccaagtatctctaaagaagagattctagaaagtagtaaggacaaagaggatggcaaaactgaagctgggaaggcaaagcctatcaaaatcaagctctctgggaaaactgttgttgcacataccagcccttggatgcctgttgtgacaacttccacacagactaagatccgacccaacctgcctattccatccacagtactccgcaagtcatgttcagccacaatgagcaagccagctcctcttaacacctttctgtctattaagtcctctggaaccactgctaaacctctgccagtggttaaagagtcttcagctgatctcctcttacctccagacatcatctccaaagcatttggaggggaagaggtgattctaaaagggtctccagaggaaaaagtggtgttggctgaaaagagtgagccatctcatttacctgaacaaatactaccacctcctccaccacccccacctccaccacctccaccaccccccgttatacctcatccagctgccccgtctgctgctcaagcaaatgctatcttggctccagtaaaatcaaacccagttgtatctcagactctcagccctggcttcgtgggtcctaacattttgaacccagtgttgcctgtagccatcatggcctcagcacagccagctgccattccttctgatgagacagctcctggggtgagtgagagtgaccgagaccagaccctgttctctgtgttagtacgtcctccaccacccctctcaagtgtgttcagtgaacaagccaaaaaattagagaagcgaaattcatgcttagccacagccaatgctaaggacctgtatgacatattctatagtagtggtggaaagggggcccctgagactaagggggcccctgagactaagctaagtggtggtccattggccaatggggaaaatagcaacctctctagaaccaaaagttcagacacctcttctacttctcctttgaacagcagtgcatcccaagaggagttgcatcaagatgagggtttggtcgctgctcctatagttagcaactctgaaaagcccattgcaaaaactctggtggccctagggaaatggtcagttgtagaacatgtaggcccaaaaagcacaggcagcacctatggcttcctacagcctctgacaaggttgtgccaaagcaggccttatgaaacaattaccccaaagacagacactttggccatatggacctctagttccttccagagtgacactagtagggatatatctccagagaagagtgagcttgacctgggagagccaggaccacctggtgtagaaccacctcctcaactgttagatatacagtgcaaagaatctcagaagttggtagaaatccacctcagagaatctgttaaccaggataaggaaagccaagagctccgtaaatctgaggattgtagagaaagtgagatagagacaaacactgaactaaaagaaagggtaaaggagctgtctgaggggatagttgatgagggagtaagtaccagcattggaccccacagcatagatgattctaatttgaaccatggaaacagatacatgtgggagggagaagtaaaacagcccaacttgctaatgattgacaaagaggctgaacagtccaataaattgatgacaggaagtgaaactccaagtaaagtagtgatcaaattgagtccacaggcttgctctttcacaaaggcaaaattagactcatttttatcagaagctaggtctttactcaacccacaagatacacctgtgaaaatttctgccccagagttgctgcttcattccccagccagatcagctatgtgtttaacaggtagtccacaagagcaaggagtttcagttgttagtgaggaggggctagagaattcagctccagaatcagcttctagaacttctaggtacagaagtctcaaactcaagagagaaagatcaaaagactttcaagttaaaaagatctatgagttggctgtttgggatgaaaacaagaagaggccagagacctgggagagcccagagaaaccaaaaacagaagcactggagctacaagatgtccatccagagttaacagtgacaatagaaagcaaggccctagaagactttgaagctacagacttaaaggtagaggagcttactgccctggggaatctgggggatatgcctgttgatttctgcactactcgggtaagcccagcacatagatccccaactgtcttgtgtcagaaagtgtgtgaagaaaattctgtatcacctatagggtgtaattcctccgatcccgctgacttcgaaccaatcccatctttttctgggtttccgttagattctcccaaaaccttggtgcttgactttgagacagagggtgaacgaaactcacctaatcccaggagtgttaggatcccttctcctaacattttgaaaactggacttacagaaaatgttgaccgtggcttggggggcctagagggaacacaccaggcccttgacctgttagcaggaggaatgatgcctgaggaagtaaaagaatcttcccaattagacaaacaagagtcactcggattggaattaaaaacaattaattctgcaggccttgggccatctccttgccttccagaccttgttgactttgtcacacggacctctggagttcaaaaagataaactgtgttctccactctctgagccaggtgacccttctaaatgtagttccctggagttggggccattacagctagaaatatcgaatgcatccaccacagaggtggcaattctgcaagtagatgatgacagtggcgaccctctgaatttggttaaagctccagtgtcaaggtcccctccaagggagcaggtaattgaagacaatatggtccctcagggaatgcctgaacaggaaactacagttggtgccatccaggaccacacagaatccagtgttcacaactaagaataaatacctagagctacttgtgagtgaatcattggcttctagaaatcagatgcccagatgatccaagactagtttgttatctcatctggaacctacaccaagagatgcagtcagcatcttaaagtaaatgttcatggaagctaaaaaatttacctcctttccttttccctttccccttaaaacaccagacaaatcgataacaacttatatatatatatatatatctgtaaaaatgtattttgttaatttttttggccaatttattttctcccactttgtcattaaaatcacatgtctaactggctcaccacatagtgtgctttgattgtattttggctttgactctgccatttctgaaatgtgggggaggatggaggcagctgacctctccagttgctgtgttgtattcctacccaatttcctgggcagttgatgcatctctgggaaaaacaccagaaagcttgctgaaatggaaaacttggaagaattgttcatctcttaggcttccatttggatgggcctgccttaacattgtttgaaatgcagcgtgagtagctcttttgtttactgtttacaccccttattggcatgtcaactcctgtacttcccttactctgttgcctttcttgagatgcattgtcctgctaacccacaaacctgtttggaaataaacatggaagaatatctggcaggcttacttttagaagacgacaaatcggtaaggcttattcatggttcattgccaggagcagatatgcttttgagatcacttttatttttgaaatggcctttgttcattgtattgtgatccaataacactttgtattaaattgtttagcagccatttgtgttgtgaaggggtagaagatctctgaaacttgtcttgagattgaactcattccctgttccacaaacccatatgtatcctttcctctacctcctcctttcccaattaatttcaaccatagtacgatgtttggggttgtatattttgttaaaaagattaaagaatttatgagttggcttggacaagtttaactttatttttaatgtgttaattacttggaataaatgcattaatctca

SEQ ID NO: 1531 - DNA, 2755 bp, Homo sapiens
acaatcacttccgccgccgcagtcgccgcccgccccgctgctgtctggcgggggaggagctcgggaccgggagcagcggctctggcggtcgtggcggtcggagatccgagagctctgcttctctgaaaagcgtgtggctttctggacttggtctacacctgacagtcactggaatgctactccaggccttagaagaaagtgaaactaattttaaaggccccttattctttctgttacctgcctgctgaagtgaaaataaatctccctgctcctttattctaaactgattttactttcccatctcaaaaacgtgtgcagggagcaggagccctcctacccgagccccagctgtattggaaaccctcctaagtcagagtgatgggtcaggaatctagcaagcctgtatggcccaatccaacaggagggtatcagtccaatacaggtaggaggtatggaagaaggcatgcttatgtcagtttcaggccacccacgagccagcgggaaaggattgccagccagagaaagacgaactccgaagtcccaatgcacagatcagcccccagtcaaaccaccaagaggagccgatcgccattttccactactcgtcgtagttgggacgacagcgagagttcgggaaccaacctgaatattgataatgaggactattccaggtatccgccaagagagtacagagcttcgggtagcagaagaggaatggcctatggacatattgactcttatggggcagatgatagtgaggaggagggggctgggcctgttgagcgaccgccagtgagagggaaaactggcaagtttaaagatgataagctgtatgacccagagaaaggggcaaggtctttggctgggccacctccacatttctctagttttagccgtgatgtgagagaggagcgagacaagttagacccagtccctgcagcaagatgctcagctagcagagctgacttcctgccacaaagtagtgtggcctcacagtcgtcttctgaaggcaagctggctacaaaaggtgacagctcggagagggagagaagggagcaaaatttacctgcacgtcccagcagggctcctgtgagtatttgtggtggtggggaaaacacctcaaagagtgcagaggaacctgtggtcaggcccaaaatcagaaacctggcaagtccaaactgcgtgaaaccaaaaattttttttgatactgatgatgatgacgatatgccacacagtacttccaggtggagggataccgccaatgacaatgagggccactcggatggcctggcaagaagagggagaggcgagagttcaagtggctatcccgagccaaagtaccctgaagacaaacgggaagcgaggagtgaccaagtgaaaccagaaaaggtgccgagacgacgacgcaccatggccgaccctgacttctggacgcacagtgatgattactacaaatactgcgacgaagactctgacagtgacaaagagtggattgctgctctgcgtcggaaatatcgaagccgagagcaaaccctgtcctccagtggcgaaagctgggagactctgccggggaaagaagagcgggaacctccacaggctaaggtgagtgccagcactggcaccagccctggccccggtgctagtgccagtgccggggctggcgccggggccagtgctggcagcaatggcagcaattaccttgaagaagttcgagaaccatctcttcaggaagagcaggcatccctggaagaaggagaaattccttggctccagtaccatgagaatgacagtagcagtgagggggataatgattctggtcacgagttgatgcaacctggggtattcatgctggatggaaacaacaaccttgaagatgactccagtgtgagcgaagacctagaagtggattggagcctctttgatggatttgcagatgggttaggagtggctgaagccatttcctatgtggaccctcagttcctcacctacatggcacttgaagaacgcctggcccaggcaatggaaactgcccttgcgcacttggagtctctcgcagtggatgtagaggtggccaatccaccagcaagcaaggagagcattgacgctcttcccgagatcctggtcactgaagatcatggcgcagttggtcaggagatgtgctgccccatctgctgtagcgaatatgtgaagggggaggtggcaactgagctgccgtgccaccactatttccacaagccgtgtgtgtccatctggcttcagaagtcaggcacctgccccgtgtgccgctgcatgttccctcccccactctaaagaccaaggccgtttactcctggtctgattattttccccatctgaaatccacaatactgcaggagccctcttgaaattaacaatggaaataaaaccaatcagtcagttagcctaaacctattgattcctcgtgattatttccaatgtgaaaacagttgtgtatgattgcattaaaaatcatatcatcttttagaggttagaaaagggaaaactaaactttctaaatgctacttgagattgcagtaagaagatacgttttctaacctgaaagttaaatcgcatttgttttcttcagtagaatgggaatgtgttgctgttacttgtaatgtcaagtttatctgttaaatatgtccaaaaggcaaaatcatttttgttgcatgttatgggtcgatgttcctgtaattgcagtgccgtaaaagcttattaaagttgttcttttggtttt

SEQ ID NO: 1532 - DNA, 3438 bp, Homo sapiens
actcggtgcagaccgaaccatcgcggccgccgccagccgggcccttcgcggccgcgcgtcctgggcccgttccgccagccccgtctgctctctacccgcggccccgcggcggcgaccgtgaacactcggcggcccctacagcccgctctcggcccttcgtccctcgcgggccccgactctccctccttgcagtcccccggagcctggctcccggctcgggccgcaccgccagggactggggtgagcggcccagaaatctccaaattggacatccagagcagcattcttgttctgtctacgtcttgaattagaaactatcaagctctgtaagtcctgaaaaggaaataaaaggtgcgtccctacccaagaggagaggtggccagtaaatgtcagctgaggcaccgaaggctgcgatgcaccagcccggtgccctgtgaggacggccacatcaatagtggtaacactcacaatttcctgctgcagagagcattttaagaaaggacagcattcctgtgacctctgcctaccatccataaaatactcattcccctctcagctctgcctgcagttgaacacaaagacctggaggagactcccacctccttcagggagaagaaaggaggcagcgaagcagattaaaggaacttgtggcttgtggcctttttgtgcaagggccgcctggaaggggagaaaagtgtatgaaagccaccgtggcggttaatgagctgtgagatgaggcgctgctgcggccgctgctgctgacactcgctcccaggctgcacccgccgcccttggcgcttcatgtacatgtgtctattcaggccttgcggaggcgcccagaagagcatccaacacggctgccggggaaagaccgcccaccatgcccacggagaccctacagacaggtagcatggtgaagccggtcagccccgcgggcaccttcacctctgctgtgcccctgcgcatcctgaacaaggggccagactacttccgcaggcaggccgagcccaaccccaagaggctcagcgccgtggagaggctggaggccgacaaggccaagtacgtcaagagccaggaggtgatcaacgccaagcaggagcccgtgaagcccgccgtgctggccaagcccccggtgtgcccggctgccaagcgcgcactgggcagccccacgctcaaagtgttcggcaaccacgccaagaccgagagcggcgtgcagagggagaacctgaagctggagatcctgaagaacatcatcaatagctccgagggctctagctcgggctcggggcacaagcacagctcccgcaactggccgccccaccggtcggaagccactgacctgcaccgtcactccttcgcggagtccctgaaggtctaccccacgcagggccgcaggagcccgcaggagggcggctcccacgtgggcaggagactgctggagcagtcagccgagtccttcctccacgtgtcccacagctcttcggacatccgcaaggtgaccagcgtgaagcccctcaaggccatcccctgcagtagctctgcccctcccctgcctcccaagcccaaaatcgcagccatcgcctccatgaagtcccccgaggccgaccctgtggaaccagcttgtggagtcagccgaagaccctccctccagcggtctaagtcagacttgagtgacagatatttccgagtggacgcggacgtggagaggttcttcaactactgtggactggacccggaagagctggaaaacctgggaatggaaaactttgcaagggctaattctgacataatatccctcaacttccgcagcgcaagcatgatcagctcagactgtgaacagtctcaggacagtaacagtgaccttagaaatgatgacagtgccaatgaccgcgtgccgtatggcatttctgccatcgaaagaaatgctagaatcatcaagtggttatatagcatcaaacaagctagagagtcacagaaggtctcccatgtgtaagacagtgcgtggaaaggagggagcgtgggtctctgtgcttacgcagttgtgaaggttgtgaggtctccttgaagtgttgtgagcttctccactctttgtgttgcttgttgtgcaatgttttcaagttgcatgcttgtcaacatggggactgacctggcttccacgtcaccatcgctacagagcctggctgaacacgcgtcatctgccaaaagtttcaggccagaatctaattagggctttgctcgtaagcaaaactgtttacatgaaaatggtatacaacttcttcgatatttatgtggttcttgtgtttttatatcccgcgctattgtgtcttaattaaaagttttatcaactggcttttaagttgagagcagaatctttttgaaataaaaagccactttgcctacatgtgagactattccagtgggacagtaaatgggatctgctaccaaacagataatgactgaccgaacatagaaccaggctgggttttctgtggaataaagtggtgagcctgacgttaatcgtttacatgttgaaattctcttgccacttagtgaagcagtcattggggtaacaatgctacgttttgtgtccgattcagtgtgtaaacgttggtggttctatgtaatactgaccccaaggaaagacgatcagatacaaagaaagatggttaaatctaggaggttgggtgtttgggggttttgttgatgttgttctgattgggataattcagaaattcctaatattatctttcgacagaatgaccaccctaaaacaaatactgaatgcctttaaaaaaaaaaaaagttgtggttttttgttttttttttttttttttttggtcgagaactactaatttcatgctatttctttctctctccctttgttgttatttgatttgggggaagggagtgaggcttgtgcagatttgagctatctgaagacatgaacagaagtcaaataccagccatatcagtagagccttccattcaaaagtgaacacacttggtagctgaaccatatctgagcagcgtgattctgttgtcttgcatatgttattctctcaggctgtggatctttgttacagctctaggaaactgtagaaatacaatgctatgtagcttttccaccccatggtctctagtgctgcctatcaacttgtccccttttttcccaataacctgtcttccaggtggtacagttagctgtcactcagctgacaccatgatgtggcagcagagagggaaacctacaagtggtttgcctcattgcctttgccacatctgaagttctcagcagcactaccttagacttcatgagctaataggaaactttttatggtgtaaatgctgtaagactttgtacatacttcagttgttatgaaatctttaaagaaaaaaagaaaaagttacgctaataaattgctgtggtgcaggcactaa

SEQ ID NO: 1533 - DNA, 11435 bp, Homo sapiens
gccgcgcgcgggggccgtcattcggtggcgggtcccggccgcggggctggcgggctgaggggagaaaagatggcggcggcggcggcagctggtgcggcctccgggctgccgggtccagtggcacaaggattaaaggaagcgttagtggatacgctcaccgggatcctatccccagtacaggaggtgcgggcggctgctgaagaacagattaaggtgctggaggtgacggaggaatttggtgttcacttggcagaactgactgtagatccccagggggcactggcaatccgtcagctggcatcagtcatcttgaaacaatatgtggagactcactggtgtgcccaatcagagaaatttaggcctcctgaaactacagaaagggcaaaaattgttatccgggagctattgcctaatgggttgagagaatcgataagcaaagtgcgctccagtgtggcctatgcagtgtcagccattgcccactgggactggcctgaagcttggccccaactcttcaacctgctcatggagatgttggtgagcggagacttaaatgccgtccatggagccatgcgtgtgctgacagaattcactcgtgaagtaacagacacacagatgccacttgttgctcctgtcattctcccagagatgtataagatcttcaccatggctgaggtgtatggtattcgaacccgttcccgagccgtggagatttttaccacttgtgcccatatgatctgtaacatggaggagctggaaaagggtgcagccaaagtcctgatctttcccgtggtacagcagttcacagaggcctttgttcaggccctccagataccagatggccccacatctgacagtgggtttaagatggaggtcctaaaggcagtgacagccctagtgaaaaacttcccaaagcacatggtgtcctccatgcagcagattctgcctattgtttggaacaccctaaccgagagtgcagctttttatgtgaggacagaagtaaattacacagaagaagtagaagatcctgtggattctgatggtgaagtcctgggctttgaaaatctcgtctttagcatttttgaatttgtccatgctctactagaaaatagcaaattcaaaagcactgttaagaaagccttgcctgaattgatttattatattatcctgtacatgcaaatcactgaggagcagattaaagtatggacagccaacccccaacaatttgtagaagatgaagatgatgatacattctcctatactgttagaatagcagctcaagacttgttgctggctgtggccacagatttccagaatgaaagtgcagcagccctggctgctgcagccactcgacatttacaagaagctgagcaaaccaaaaacagtggcactgagcactggtggaagatccatgaggcatgcatgcttgccctaggctcagtgaaggccatcatcactgacagtgtgaaaaatggcaggattcattttgacatgcatgggttcctgaccaatgtcatccttgcagacctcaacctctcagtgtctcctttcctcttgggccgggcactttgggctgccagtcggttcactgttgctatgtcccctgaactgatccagcagttcctacaggcaacagttagtggtcttcacgagacacagcccccatcagttcgaatttctgcagtgagagccatctggggttattgtgaccaactgaaagtctcagagagtacccacgtgctccagcccttcctccccagcatccttgatggcttaattcacctagcagcccagttcagctcagaggtcctcaacctggtgatggagaccctgtgcatcgtttgtacagtagaccccgaattcacagcaagcatggaaagcaaaatctgccccttcaccatcgccattttcctaaagtacagtaatgatcccgtcgtcgcctcactggctcaggacatcttcaaggagctgtcccagattgaagcctgtcagggcccaatgcaaatgaggctgattcccactctggtcagcataatgcaggccccagcagacaagattcctgcagggctttgtgcgacagccattgatatcctgacaacagtagtacgaaatacaaagcctcccctttcccagcttctcatctgccaagctttccctgctgtggcacagtgtacccttcacacagatgacaatgccaccatgcagaatggcggagagtgcttgcgggcctatgtgtcagtgaccctggaacaagtagcccagtggcatgatgagcagggccacaatggactgtggtatgtgatgcaagtggtgagccagctcctggacccccgcacctcagagttcactgcggcctttgtgggccgccttgtttccaccctcatctccaaggcagggcgggaactcggggagaatctagaccagattcttcgtgccatcctcagtaagatgcagcaggcagagacgctcagtgtcatgcagtccctgatcatggtgttcgctcatctggtgcacactcagctagaacctctcttggagttcctgtgtagcctcccaggacctactggcaaacctgctctagagtttgtgatggctgagtggacaagccgacagcacctgttctatggacagtatgaaggcaaagtcagctctgtggcactctgtaagctgctccagcatggcatcaatgcagatgacaaacggctacaggatatccgtgtgaagggagaggagatctacagcatggatgagggcatccgcacccgctctaagtcagccaaaaacccagaacgctggacaaacattcctttgctggtcaagatcctaaagctgatcatcaacgagctctccaacgtcatggaggctaatgccgctcgccaggccactcctgcagagtggagtcaagatgactccaatgatatgtgggaggaccaggaggaggaagaggaggaggaggaggatggtttagctggccaacttttatctgacattcttgctacaagtaaatatgaggaggattactacgaggatgatgaggaagatgaccctgatgccctgaaggatcctctctatcagattgatctgcaggcatatctcacagatttcctctgccagtttgctcagcagccctgctacataatgttttcaggccaccttaatgacaatgagaggcgagttctacagaccatcggcatctaaaaaggggagcctttctacatttgctccttctgggccagccgcaaaccattttgcagccctcactggccttgagatgcactttcttctcaacctaaagtggcatcttgacccttggcccttggcctcggcagtgacactgatgacaattcagaccaggctcaccggtgccgtcacttaggaatgctggaacaaaggacatttctcaaagttcccctgaagacatgccatctctagaaccttttttctccccgactctacccccacctctgttcctagagccctctgctggcgagtccagaaacattattgcccagaaggattatgtgtttatggattattttgccccgcctcaggagcgcaggaagtcactaccatttatattctaaaacagacctatctatgttcataggacttctgatgtgttcagataggaatcctcatgagagatcattatgctttgtgccctggaccactgctgctctgggttctcaggaggaacaggcaagagcagcttcattctaagcctttccagtgacctcagccttgcttctcttctacaacactaaggctcctctgtcagaggaggtcgtcttgtttttgcttcattgcatgacataacccttcccctcaagctgttcctatatatacatgcacacacaaaataagccagacagatggcaatttgatcttccttttttagaaaaaaaaaaaaaaatggggaaaagggattttttttaaatccacctgacccaactatatttaatatgcctctcccacacattaccacagagtctgatattcaaaggttatcccctttccctcaggaagcctctaaagtgcttaagttgtagccctcaaatttgcaacatgtatttttctaggacagtaaagtaatctttacaaatgaatttagttgcatggtataaggtgtctcagcacctgtttgccttctattccctttagaaggtaagtaaaagtaatgggggaaaggattaggtggagcctgtctaaacattctagtgtgtcttggcaaacatagcctgaaatgattcttaaagaactggcattgtttaatcaaatatttttaagggagattccttaattgggaagtttagtctgtttggggttcaaagagtaaatgaggattagaaaatcatggagagaggctgggcgcggtggctaacgcctgtaatcctagcactttgggaggctgagatgggcggatcacttgagatcaggagtttgaggctagcctggccaacacagtgaaacctgcatttctactaaaaatacaaaaattagctgggcatggtggtgcatgcctgtaatcccagttaacttgagatgctgaggcaggagaatcgcttgaacttgggaagcagaggttgcagtgaaccgatatcacaccgttgcattccaaggcaagactcaatcacacacacacacacacacacacacaaatcatggggagaaagatgaaacctgtgttcccctttttttggtagtgcccacatctggtgccccatttttaataaccacaggatatttctttagattgatattctcacaaagaagaaatagaatataggctgggcgtggtgtgtcacacctgtaatcccagcacttacggaggccgaagccagcggatcaccagaggtcaggagttcgagaccagcctgaccaacatgatgaaaccctgtctctactaaaaatacaaaaattagccaggcatggtggcatgcacttgtaatcccagctactcgggaggctgagacaggagaatcgcttgaacctgggaggcagaggttgcagtaagccaagatcgcaccattgcactacagcctgggcaacaagaggagcgaaactctgtctcaaaaaaaaaaaagagaaagaatataaagtgaatctgaatctccactcaaggggatggccccaaggatattgtagctggtaatttcttcatgccactaggtgtccccagtgttcaacctccatgactgagattggaagaagtagagttaaaagtttttactacctttgagaagcctgcgggcatgttcacagtcgtcccatgccagccaggttctgaggctaactgcttgtgcccctgctgcttcacatggcattgtgggagttgctgatactggggaaatgatggcagatctgaccaagtggtgctgagaaaaccaccctcggccttgcagactccatagtttatctcaaggcagtgccagtcggatttggtgctaaaggcataaggccaagtcagcctctgatattggcacaaaagaatggtctcatgccagtagcattgaactgctgagcttgggaaggcttaaggctcccacacacagactgagaatgatgggggtccctctgcgtctgctaattagacaaacattctatatctagtgccaaaagtggtcctaaatcctttggcaagggtcctttctgctctcatgctgatttgggggaggactgggcatcctgcctcaggagaacttgagtcctgaggaaagggccctagtaacacttaagggctacccctggctaacagatactcggctgtgggtgagagcagaaggtcttggacccctcgatgtgcaggtacttaattgtgtttccagtgcattttcatatacattatcccatttaacctttataacaggttcacagagtggatattcccattctgttgatgagaaaaagagtggagagactgtgtccagtgtcagcaggaagaaaaaagatctgttggaggccagtacatgttgacagaaactctagaccatattttgtctcctgtctttggccaaagagaactagcttcagtctgaaaagggcagggctaagtggttacaaggaactaaaaagttcaaggtaagacaaatgaggtaaaaataaaaaagagcacttagctgctctgagacattttagtctcctgactggtaaacagcagctggggcaccaaggggctcccaggagtttgtcgagcttttattggagtgaactgaaaggaaaatggaaggaatgctataagactgaaaagaagttaaagccctaggaaggaagctgataacacaagttacagacgtatatgtgacattgatttgggagaatgaacctacaacaaatgacccaaaagcacctaaataagagtgacgagagtttaacagacattcattatggacttcagagaaaatgatgctaaactggtcttagaatcttctttaattttgttaactaggtaaataatctggacattttagtcaaagcattagacagacagagaagttggtaactgaccactaactaacaaactataaattcacccattgtgggttgacctggtaagttcccccagggctgtgtccttggcccctcctttgatattagtgacagatgactttttttatgccttacccattccacaaaagaatttgaagccatttacacaagagatagtactagtaaattaggagtgctgatcaaatttttagataataagaaacccttaggaaggatgacaatttagaatccaaatttaggatccaaacaaataccattacaaactataaaaatgagcagaatctaaatgtaacatttcaataaatgcagattgataataacatctgtgcagagttgaggactatagagtactgtgctgtcactaacagtattgtgtgctactaagagtttaatggctgggtgtggtggctcacacctgtaatcccaacactttgggaggcctaggtgggtaaatcagctgagatcaggagttcgagaccagcctggccaatgtggtgaaaccccgcctctactaaaaataaaaaaattagctgggcatggtggcacgtgcctgtaatcccagctactcgggaggctgaggcgggagaatcacttgaacctgggagacagaggttgcagtgagtcgagatcacaccattgcactccagcctgggcaacagagcaagattctgtctcaaaaaataaagtttattatgccaggagggccaggtgtggtgccacacccatgtaatcccagcactttaggaggctgaggagggcagatcacttaagcccaagagtttgagaccagtctgggcaatgtggcaataccttgtctcttaaaatttaaaataaaaaaaaagtttattatgccaggaactgttaatgtgtccaaaaaaactccagtgtggttctaggatgagataataaaaacaggttgtctagggtagtgtggaaggtcctttcagtcttcctgtgcctatcagtgatcctcattgccatgttcccttctggtgctcaaccggaggctccctgacagatgagtcctctgccagaggaaggctaagatgtagaggacaaatcgtgtcaaggaaaagaagcttgaaggagctaagaatgcttagcttagagaagacaagaggaaacaggacatggctttgggaagttcaaggatggtccagtgaaatacatactatacttttgcaccccagctaagctgacccatgatcagtaagtaggaaataaaaggccaatttctggctactcttgcccccaaccccatttcagtgaactatgaacctctattagatatgcaaggccggtgctaaatgctggagggctttggccctttccctcaaggagctagtctagtagggggtcagaaatacagatgggcctgaacataatgatggtttgacttccagtttttcaactttaggattgtgcaaaagctatacacattcggtagaaacagtacttcaagtatccatacaatcagtacagtattcaataaattacatgagacattcaacactttattataaaataggctttgtgttagatgagtttgcccaactgtaagctaatgtaagtgatctgagtaggtttaaggtagcctaggtgtattaaatgcatttttcacttaacggtattttcaacttttgttgggtttattgggatgtagccccattataagctgaaaagcatctgtagtataataaatgtggggagtgctgtgagagaaataagtgtactgggtttagttcccactgcccaaaaaaggaactggctaatggtaacctgggggaggaagtcgggtaagttgcatggagaaggcaacccttgaacacttgcaaggagctaacaatacctgcttctggagtatttaaacgccagtgggtatgctaaatacttttacctcagaccacctactaaccttacaaagtagtccactttgctcacccagttttacagattgatgaaactgaagcagacagatattgttaacctatcaaaggtcaccctgcaagtgtgtgattatagtccaagcagcttgtacttgttgcctatttgttttgcctttcctgtgcatttgccaggcagatgagagtggggtaagacattgcagagaaaaagtaagaaaaggccgtcatgaaacaatttcattttcagaccttataagcacgttacaagtactgatatttatgcttaagttcacgggagtcctggccagaaataaagctggaaggacaagtggggggcagattgtgaaggatccttcaagacctgcttcctctagagaatgggagactacccaagataactaaacagggaagtgatcaggttttgtgtcttagaaaagtgttgcagtgttgatgcaaatgtgactagaagggtgacttggaacctggattgaaggggtgggagatgggagaaaggaatgcagtctggcagcagctacagcagtccaggtgggaaaacccagagcctgaactaaggttgtaactagaggggatagggtggaagagctggattagagatgttgacaagataaagtcagtaggacttaaagactgacaagtaaggattttccaaaagtgagagctgtggaatgaattgtcttaaaatgttgcagtgagttcctcctcatcaatccaagtgctcgatcagaggctagacctttagttagcagtcacgggaaaattccccattctcacggggatttagactaggtcttaaccatactttaccaagattccagtagcaaagcacccaaaagtaatcgcaataaaattccaatttttgtaggccgggcatagtggctcacacctgtaatcccagcactttgggaggccgaggcaggcggaccacgacatcaagagttcaagagcagcctggccagcatggtgaaaccccgtctctactaaaaatacaaaaaaattagctgggcatggtggcgcatgcctataatcctagctactcaggcagctgaagcaggagaattgcttgaacccgggaggcagaggttgcagtgagccaagatcatgccactacactccagcctgggcgacagagcgacactctgcctcaaaaaaaaaaaaaaacaaaaaaaaaaacaagttttgtgaatttaagtttccctaatggatggtacaggtcaacatttgccatctaatgacacttacattccagttttttccttttttgagtaactgggaaaagggtggcattactgctggcttcctaaaattgaaaagtatactagggtttttaaacctgtgtagaatacatgatatggtagcaaatgtgctgtaggaagaaaagcaatgaggaactactggcctgactaggaggcctagaagtccctcccaggcttgagttgttctgacttggcatgattacatagctgcggcaagtgacgtttccttcaagccttggttccctcatctgtaaaatagggaactaatacctacctcacaggattgtagttagaattaaggatgacttcattaaagcacctctagtggtggaagatgtcccatcctatcccccacccatagctgggagctatgtttggctcattcttcctgactcactggattacactgtgactcagttcaatttcacacatgctgctgctaaattagggtcttggtgagcctttgggaggacagctctgaggaatgaattgtagcactgcagccctgcctgaggaacatgatagaaacaggtggtaggcccagctcttgccttccacctactaagcagtttttctgtggttagctgtgtgacataaactatcggtgtattaatttgctttcactagattcccccccccccaacaacttagtccaagaacatacctgaattctttgcatttccttgccttagttgcttttgtagggtggacagcaggactgcatgagaatagctgtgcttctggaccctatggtgaaagctctagtgaactgcaattaggcccagggtcccggaggaagaaggggagagaaaaaggggggtagttttccaaaagataagtaggggacaaaaaagtccacggggcctatgagcggtgagactcctgccctgattgtggcaaagcacctggagatgatagaacttcctagggaaaaggctgcatggagtccccagggatgctgggccctggtcaccaaggctccctgggaaggtctcttgtacctggggcacacagaccaacacttctgaatttgcaagcttaagagcatgtatgagcagaacctgtgcagaccaaggcttagagggctcacctcaatgttttgcactgtgtgagaccccaggaccttttcgtgattctggagaggggaacaaaccataataacaacaaaccaggtagcaggatagagactcattctcatctattttggttaaaagaaaataaatgtatttcttccacacctgattttgtgattgcaaattcataactaatatccctcgtcagctccgctgactcatccctgccacagggaggttcacagcaagagcacagaaactagggccagtgcccggttgtgtgaccttgagtaagttctttttcccttgaacagggagagagacacaatggatcagagtgtctctgccagttctaacttggggattctagtgggttgaaccgaacggtagtccgtttccaaaagaggaagccaagaccagagggggagtggttccttcaagtttgcagaaccagtaagtggcagagcaggactcatatctagttagtggttcagagcatgggctccggagctagactgcctggatttgaaccctggctttgccacttgcctgttgggtgactttggacaagctgcttaaattatgtctccatttcctaatccacagaacaagtgtaatactagttatctgtttcatggagtgattgtgaggattaaataaagttaatataacacaaagca

SEQ ID NO: 1534 - DNA, 401 bp, Homo sapiens
cttccgccagcttccctcctcttcctttctccgccatcgtggtgtgttcttgactccgctgctcgccatgtcttctcacaagactttcaggattaagcgattcctggccaagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttcttttt

SEQ ID NO: 1535 - DNA, 5350 bp, Homo sapiens
ttctcgggagaggaatcggttaggagaagggggattcctcactcagctgtgcgctctgatttcgtgcgcttcctcgtccttcatgttggatggccagtttttcgtttgtgcgtcatcctctacctgagaaatggtcgcttgcccctagtctagacacgcattaaagggcagtatttaaagtcagttggcaagcagtggaataagatttttgtaaagaaaccttgtgcagcatggattctctaccagatgaattttttgtgaggcatcctgctgtggaggatcagaggaaggaagaaactgagaataagctagaaaaatcatctggtcaactgaacaaacaggaaaatgacatacctactgatcttgtccctgttaacctactattagaagtgaagaagttattaaatgcaattaatactctaccaaaaggtgtggttcctcacattaagaagttcttacaagaagatttttccttccaaactatgcagagagaagttgcagctaacagccagaatggtgaggaaattgttcctgctttgactttacgtttcttgattacacagctagaagcagcacttaggaacattcaagctggcaattataccgcacaccagattaatattggttattatttgacattactgtttttatatggagtagcactcactgaaagaggaaagaaagaggattatacagaagctgagaataaatttctggtgatgaagatgatgatccaagaaaatgaaatttgtgaaaactttatgtctttagtttattttggacgtggtttactgcgatgtgctcaaaagagatataatggaggactgctagaatttcataaaagcttacaagaaattggagacaaaaatgaccattggtttgacatagatcctacagaagatgaagatttacctacaacttttaaagatcttcttaataattttatcaagacaactgaaagcaatataatgaagcagacgatttgtagttacctagattgtgaacgatcttgtgaagctgacattttgaagaacaccagttataagggattttttcagttaatgtgcagtaaaagttgctgtgtttatttccataaaatttgctggaaaaagttcaagaatttaaagtatccaggtgaaaatgatcagagttttagtgggaaaaaatgtttgaaggaaggatgtacaggtgacatggtaaggatgctgcaatgtgatgtacctggaattgttaaaattttgtttgaagttgtgagaaaggatgaatatatcaccattgaaaatttaggagcaagttatagaaagttgatatctctgaaaataactgatactgatataagaccgaagatcagtttaaaatttaatacaaaagatgaaatgcctatcttcaagcttgattataattatttctatcatctgcttcatataattattatttctggtactgacattgttcgacaaatatttgatgaggctatgccacctcctcttttgaaaaaagagcttcttatacacaagaatgtgctggaatcctactacaaccatctttggaccaatcatcctttgggtggatcatggcatctgctttatcctcctaacaaggagttaccgcaatccaaacagtttgacttatgcctcctgttagctcttataaaacatttaaatgtgttccctgcacccaaaaaaggatggaatatggaaccgccatcttctgacatctctaaatctgcagacatcctgagactgtgcaaatacagggatatcctccttagtgagattttgatgaatggtctcactgagtcacagttcaattcaatttggaaaaaagtttcagatattcttctgcgccttgggatgatgcaagaggatattgacaaagtgaaggagaatcccattgagaatatctcccttgattaccatcagctatctgtctacctaggcataccagtaccagaaatcatacagaggatgttatcctgctatcaacaaggaattgctctacagtcaataacaggcagtcagcgtattgaaatagaagagttacagaatgaggaagaagaactaagtccacctctcatggagtacaatataaatgtgaaatcacaccctgagatacagtttgcagaaattaataaagatgggacctcaatacccagtgaatcttcaacagaatctcttaaagatctccaggaagttaagagtaaacaaaggaaaaagaagaagactaagaataaaaagaataaagactcaaaagaagaccaagtcccatatgtggtagaaaaggaagagcagttgaggaaagaacaagcaaatccacactcagtcagtagacttataaaagatgatgcaagtgatgttcaagaggattctgcaatggaagacaagttctatagcctggatgaattgcatattctggacatgatagagcagggctcagctggcaaagtaactacagactatggagaaactgaaaaggaaaggcttgctcgtcaaaggcagctttataaattgcactatcagtgtgaagatttcaaaagacagttgagaacagtgacttttcggtggcaagaaaaccaaatgcagattaaaaagaaagacaaaattatcgcatctcttaatcaacaagttgcttttggaatcaataaggtttccaaattacagcgtcaaatccatgctaaagataatgaaatcaagaaccttaaagagcaactttctatgaaaagatctcagtgggaaatggaaaaacataatctggaaagcacaatgaaaacatacgtaagcaaactgaacgcagaaactagcagagctttaacagccgaggtgtatttcttacagtgtcgtagggattttggtttgcttcatctagagcagactgaaaaggaatgtctcaatcagcttgccagggtgactcacatggcagcaagcaacctagaatcacttcaattaaaggctgcggtagacagttggaatgccattgtggcagatgttagaaacaagattgcattcctcaggacacagtacaatgaacaaataaacaaagtcaagcaaggatttgccttgagtaccttgcctccagtccagcttcctcctccaccacccagtcctgagatactgatgcagcagttcttaggaagacctcttgtgaaagaatctttctttagacccatacttactgttcctcaaatgcctgcagtttgcccgggagtcgtctctgcaactggccaacctagagcccccctgatgactggcatagcctgggctctgccagcgcctgtgggagacgctgtgcctcccagtgcaggtctgcggagtgatccctccatcatgaattgggagagaattacagacaggctgaaaactgcctttccacagcaaaccagaaaggaacttacagatttcttacggaaattgaaggatgcttatggaaaatccttgtctgaactgacatttgatgaaattgtttgcaagatttcccagtttattgaccccaaaaagtctcagagtcaaggaaaatcagtgtcaaatgttaattgtgtttcacctagtcattctccatcacagcctgatgctgcccagcccccaaaaccagcctggaggccactcacttcacagggtcctgccacatgggaaggagccagtaatccagatgaggaagaggaagaagaagagccttgtgtgatctgtcatgagaatctgtctccagaaaatctttcagttttgccttgcgctcacaaattccatgctcagtgcattagaccatggttgatgcaacaggggacatgtccaacgtgcagactccacgttttgctaccagaagaattccctggtcaccccagccggcagttgcccaagatctgatacaaggtacccatgaagagattatgaactacttgaaggtggagactgtacggtggtgtgttggagctggcttgtaatgtcttatgagtgacaatcgttagtttgaggaattttgtgagacagttgtcaaattgttgctagcttgaaatctgcggcaattggagtatttacaccatagaaatgctataagtgaagacctacctttcccttaagagctagttgttaaacctttaccagcataccactggaccttgtctaaaatttctttgtgttcccagtgtcttgcccagtagatacaagataaatattgccagaatcagatatcaggaagtagtaagaaaaggagttaatatgcaaactaaatcactcgctcaattgaataattgagatcttctgttcatttgttccttggaccttaatcatttgcattttggagaaaattttttctgctttaaaagtctgtaatttcagtttttgtgtcggggagagggaaaaactatttgtctgtagttgctttttgtgacaaagtgaatacccactgggctaagtttcatatctaaagcttgtcactaagaattttcatttttaggggtcaaaaacctattttgaaaatagtgttgtgtgaatgctgtaagtgttgtacatgtctctggtttcagaattaaaagaattcagagttaccttgtgagataaatgttctttgcttcatattcacagtttcacctccatttaaatttatggggaagaataaatgtttcctgactcagaaacaattttgcctccatatttcagtgcaaatatattttgaagttacttttaaatatttatttaaaacctctgtttctgtaactgtatgttaaacgtattcttctgtaatgagaatagactggaacatgtgagggaaaaatatttaaaaaaagatggcagtcatctagacatgtaaaatgccaagaatgtcttagaattgcacaatttagaatttatagagcctttaatcaccttgtctagcaccttgtattagtccattttcatgctgctgataaagacatacctgagattgggcaatttacaaaagaaagaggtttaacggacttacagttccacatgactaaggaggcctcacaatcatggtggaaggcaaagaggagcaagtcacatcttacatggatggcagcagacaaggagagagagcttgtgcagggaaactcccatttttaaaaccatcagatctcatgaggcttactatcacgagaacagcatgggaaagacctgcccccgtgattaaattatttcccaccaggcccctcccacaacatggaataatgggagatacaagatatttgggtggagacacagagccaaaccatatcacaccttaaggtcatggtcatatagctagttatcttgtaaaaccaatgtttcttagttcatacttacaactgcaatttcactttcatttagaaaagaataaatgtttcttaattgaacaacta

SEQ ID NO: 1536 - DNA, 1710 bp, Homo sapiens
ttcttttctttcaacactttaaccatgtcactccatggggacgctgtcttgagcctttggtaagcctcattctccaggaccacacggcaggcgcgacagccctaggtccaccccaccccgtaagcgctccctccgggaggagacagaaacccaggacagctccggggcaaggccgaggaaggagggacgacggggcagggaggcccgaagagtccccgccttttgggatagtcgccacccttggaccccctcacccttggggacgttgaggagtgttaaaatctccaagacgcgagtcaccggtacgaagccacagccatttcgctgcttgctcggtgcaagtgcagaaggtcctagtagccgagcgtggagtcgagctcgtgggcggcgtcgggcaccttcggccgcgccctcagctgcacccgccggtgggcggggcccgagcccgtctctaaagccacgaggccgcccgctccgagcctggtgcttccgaccgctgcgcgcggctcctgggctgtcacagtctcccgttgccgccgtcatgtcccggcagctgtcgcgggcccggccagccacggtgctgggcgccatggagatggggcgccgcatggacgcgcccaccagcgccgcagtcacgcgcgccttcctggagcgcggccacaccgagatagacacggccttcgtgtacagcgagggccagtccgagaccatccttggcggcctggggctccggctgggcggcagcgactgcagagtgaaaattgataccaaggccattccactgtttgggaactccctgaagcctgacagtctccggttccagctggagacgtcactgaagcggctgcagtgtccccgagtggacctcttctacctgcatatgccagaccacagcaccccggtggaagagacactgcgtgcctgccaccagctgcaccaggagggcaagttcgtggagcttggcctctccaactatgcagcctgggaagtggccgagatctgtaccctctgcaagagcaacggctggatcctgcccactgtgtaccagggcatgtacaatgccatcacccggcaggtggaaacggagctcttcccctgcctcaggcactttggactgaggttctatgccttcaaccctctggctgggggcctgctgaccggcaagtacaagtatgaggacaagaatgggaaacagcccgtgggccgcttctttgggaatacctgggcagagatgtacaggaatcgctactggaaggagcaccactttgagggcattgccctggtggagaaggccctgcaggccgcgtatggcgccagcgcccccagcatgacctcggccaccctccggtggatgtaccaccactcacagctgcagggtgcccacggggacgcggtcatcctgggcatgtccagcctggagcagctggagcagaacttggcagcggcagaggaagggcccctggagccggctgtcgtggacgcctttaatcaagcctggcatttggttactcacgaatgtcccaactacttccgctaggcccatcgtttctcaggctgcccaaggctcttctgtaacatcttttgttactcacattttctttaatttagaactgcctcagtaaattcttagggatggaagtatttggacaaaaacctaatagaagagtcaccaccaaatgaagaataaaactcccagggtgctgtgtgtta

SEQ ID NO: 1537 - DNA, 1686 bp, Homo sapiens
ggtacctgtaccccacgtagtcgccggttaccgatcggactaagttccagtggtgatttacaagtcaagttaaaatgtccccagaagtggccttgaaccgaatatctccaatgctctcccctttcatatctagcgtggtccggaatggaaaagtgggactggatgctacaaactgtttgaggataactgacttaaaatctggctgcacatcattgactcctgggcccaactgtgaccgatttaaactgcacataccatatgctggagagacattaaagtgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaaaagagagagcaacagagatggggaggaatccagctctgcctgacatccaggcatcctctccaaattgcatagggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctgaaa

SEQ ID NO: 1538 - DNA, 4730 bp, Homo sapiens
gagaacggtggccggacggagagactgcgggtctgagggactggcgggcgggcgggccgagcggcgccgccgaggccgggctgggccgagcccaggagcgcccgggatgtagcgggccaccctgccgatgccacagcgcccggccgcgggcggagccggagccggagcctggggaggcggcgggggcccagagcgcagcccgcgccccccgcgcggagccaggcccgctgccgtccccgccgcccgggcccccggcatgcagccccggctgcggaggtgacactcacggaccttagccaccgccgccgccatcgccaccatggacgaacaggaggcattgaactcaatcatgaacgatctggtggccctccagatgaaccgacgtcaccggatgcctggatatgagaccatgaagaacaaagacacaggtcactcaaataggcagagtgacgtcagaatcaagttcgagcacaacggggagaggcgaattatagcgttcagccggcctgtgaaatatgaagatgtggagcacaaggtgacaacagtatttggacaacctcttgatctacattacatgaacaatgagctctccatcctgctgaaaaaccaagatgatcttgataaagcaattgacattttagatagaagctcaagcatgaaaagccttaggatattgctgttgtcccaggacagaaaccataacagttcctctccccactctggggtgtccagacaggtgcggatcaaggcttcccagtccgcaggggatataaatactatctaccagccccccgagcccagaagcaggcacctctctgtcagctcccagaaccctggccgaagctcacctccccctggctatgttcctgagcggcagcagcacattgcccggcaggggtcctacaccagcatcaacagtgagggggagttcatcccagagaccagcgagcagtgcatgctggatcccctgagcagtgcagaaaattccttgtctggaagctgccaatccttggacaggtcagcagacagcccatccttccggaaatcacgaatgtcccgtgcccagagcttccctgacaacagacaggaatactcagatcgggaaactcagctttatgacaaaggggtcaaaggtggaacctacccccggcgctaccacgtgtctgtgcaccacaaggactacagtgatggcagaagaacatttccccgaatacggcgtcatcaaggcaacttgttcaccctggtgccctccagccgctccctgagcacaaatggcgagaacatgggtctggctgtgcaatacctggacccccgtgggcgcctgcggagtgcggacagcgagaatgccctctctgtgcaggagaggaatgtgccaaccaagtctcccagtgcccccatcaactggcgccggggaaagctcctgggccagggtgccttcggcagggtctatttgtgctatgacgtggacacgggacgtgaacttgcttccaagcaggtccaatttgatccagacagtcctgagacaagcaaggaggtgagtgctctggagtgcgagatccagttgctaaagaacttgcagcatgagcgcatcgtgcagtactatggctgtctgcgggaccgcgctgagaagaccctgaccatcttcatggagtacatgccagggggctcggtgaaagaccagttgaaggcttacggtgctctgacagagagcgtgacccgaaagtacacgcggcagatcctggagggcatgtcctacctgcacagcaacatgattgttcaccgggacattaagggagccaacatcctccgagactctgctgggaatgtaaagctgggggactttggggccagcaaacgcctgcagacgatctgtatgtcggggacgggcatgcgctccgtcactggcacaccctactggatgagccctgaggtgatcagcggcgagggctatggaaggaaagcagacgtgtggagcctgggctgcactgtggtggagatgctgacagagaaaccaccgtgggcagagtatgaagctatggccgccatcttcaagattgccacccagcccaccaatcctcagctgccctcccacatctctgaacatggccgggacttcctgaggcgcatttttgtggaggctcgccagagaccttcagctgaggagctgctcacacaccactttgcacagctcatgtactgagctctcacggccacacagctgccggtcgccctttgctgcatggcagggggctgctgctgggctcagtgaagttgctgcttctcccaggcaaggctgtggaccatggagtggcagcccagccagcgtcggtctgtgccccttccgccactggggctcagagccggggtggggtggctgcagcctcaggactgggagcccccagcctgtcagatccaggagctccagtgtcctgagctcagcgtggaggggtaggggctgggaacagtgtgcaaggcagccgtgggccccaccctcggggatgtgtcctgacactgcaattggcaccgaagcccagagggtctgggggcacaagactgacgccagggtatgaagagtgttattttcattcaaagtgttattttgtttttccttccaatgtctggagaccaccagggcatctctgggctggatgagctcccacaagcctgagggaaaggccagcactcgctagcagtggcaggcagaggcccaggctgccgtcccctagagtcccaggttggctctgccagtcctgtcctttaccaaagatgaatgaagcaaatgtcatgctgccttattcagggaaggaggagcctgtcctgcctgtggccatgaccctgcctctcccaggcaggggcccgcgatgtggaactgctgccactgaggggggatccagttttgtcaatgcagttgtctctgttttacaagttggagtcactcttatgctgtacccagtttctaaactggagactgtgtgtgccctctgggctctgagtacccctgctttgggcttgggcctaggctgcattgaaaagagctgaaggttgtggcctttgcgctcctggcccagcctttgttccccactggagcagaaggggagatggacgacacggtcggggcatctggcctggccagtgccctgatcccagagagcccgaggaggtgtctcaggctgcctgagtcgtgacctgctaggccagagcccactccatctggtagaagggaaagcccatatgctaccaccagctgtgtccaaaaccgccagctctgttcttcctcagccagcctcgcccatccccttgaggtctcagcccctttcccttgtagctcctcccctggagggggaatggcagcaggggttggggaaacagcatctccaagcagcttagagttggccatatttacctcagcctgggcgctggtcctttcttccggcccctcccctccaaaatgtgcctattgctagagctcctccctctcaacacccagtttccttgggagttgtcattaaaggaaaaaaaaaaaaaaaaaagccagtgcccagggatgggcatctccagggagctggggattagtgccaggcagccctgccagccatgcctacatccccatgggcacagaacaagccaaagccttcgttgtatgttgacgatgcacttttatgaatgtagtttctatcgctgtttttagccttttcacatcatgtaatgtgaggccttgtacttgttaatttatatctcagatcatatttgatggtttttatatatatcaattctagactgttacaggtgacggacgcctcaagagagagaagagaaaatgaaagcagctggttttgcagaagtgtgtgtcgcatgcgccagttgggcctggaccctcctgtgtccatccctgttcccccaggggctctatcagcccctgtaccccacactgccctctgaagacaacacaggctcctgcttccacctcggcccttgcccagggtggggcctggccctcatcttgaccaaagctgctgtgtggcagctcggcctctctacgaccccatcttggtggctgcacactcttcctggcccgcacccccatccccagtccctgttccccaagaggatacagagcacggtgctggctgactcaactgtgcgtcccaggttcagggtcttacagagctccaccccctggggtcttacctcactgggaatgtgttttgaaaatgaatttgaagacaagccaacaaaccctgcactccaaaaaagcaaaacagaccctaatttttttgtgccaaaaactgtggacatgctggctcagcatcctcaggaccaagttgttgcttaatttattgttttttaataactaatccagataaaaagttgtggggcttcagggtgacctgggcccaaaggttctgaagggcagttcctggcagccccaggcttgctgtgggaaggggccgtgccgtcactttctcatcattccatggggtgtgtctgcctgggccaactctgcatggagaggccagggctggggacagtccgcactctgccaccctcctgccccttccacccaccccagctctatgtctgtgtctgaattgtggatcgtgcagccatggttattgtggaactgtggaacctgcagccatagttatttgactatatcttgaccgagggcttgcagtgcaaagccaggccagtgttgcgcattacttacaataaaagggatcatttatatc

SEQ ID NO: 1539 - DNA, 3009 bp, Homo sapiens
actgctccttctctcacgccaactgagtctcttgatctgtacatgcaatcccaggcagctcgcgaacacaaacccggggccagccgcctactgctgctgctgctgctgccgctgccgccgccgccgccgccgctgcctccgccggctctgcgaacccgggacttttcatgcaccacactctccgcctgcttccctccgtgtcctgaaaagtgcgaccgttctcccaaggaatttccacggcaagtcttaggagggaatgattccccagtaatattccctgccctgacccaaagtgctggttggcctccctcccagggaagactgcttcttgcgtaacgccggccacagaaagagactccgatggacttacaccgggcagccttcaagatggagaactcatcctaccttcccaaccctctggcatccccagcactgatggtcctggcatccacggctgaggccagccgtgatgcttccatcccttgtcagcagccacgaccctttggtgtacctgtctcagttgacaaggacgtgcatattcctttcaccaacggttcctatacctttgcctctatgtaccatcggcaaggtggggtgccaggcacttttgccaatcgtgatttccccccttctctactacacctccaccctcaatttgctcccccaaatctagattgcaccccaatcagtatgctgaatcatagtggtgtgggggctttccggccctttgcctccaccgaggaccgggagagctatcagtcagcctttacgccggccaagcgacttaagaactgccatgacacagagtctccccacttgcgcttctcagatgcagatggcaaggaatatgactttgggacacagctgccatctagctcccccggttcactaaaggttgatgacactgggaagaagatttttgctgtctctggcctcatttctgatcgggaagcctcatctagcccagaggatcggaatgacagatgtaagaagaaagcagcggcattgttcgacagccaggccccaatttgccccatctgccaggtcctgctgaggcccagtgagctgcaggagcatatggagcaggaactggagcagctagcccaactgccctcgagcaagaattcccttctgaaggatgccatggctccaggcaccccaaagtccctcctgttgtctgcttccatcaagagggaaggagagtctccaacggcatcaccccactcatctgccaccgatgacctccaccattcagacagataccagacctttctgcgagtacgagccaaccggcagacccgactgaatgctcggattgggaaaatgaaacggaggaagcaagatgaagggcagagggaaggctcctgcatggctgaggatgatgctgtggacatcgagcatgagaacaacaaccgctttgaggagtatgagtggtgtggacagaagcggatacgggccaccactctcctggaaggtggcttccgaggctctggcttcatcatgtgcagcggcaaagagaacccggacagtgatgctgacttggatgtggatggggatgacactctggagtatgggaagccacaatacacagaggctgatgtcatcccctgcacaggcgaggagcctggtgaagccaaggagagagaggcacttcggggcgcagtcctaaatggcggccctcccagcacgcgcatcacacctgagttctctaaatgggccagtgatgagatgccatccaccagcaatggtgaaagcagcaagcaggaggccatgcagaagacctgcaagaacagcgacatcgagaaaatcaccgaagattcagctgtgaccacgtttgaggctctgaaggctcgggtcagagaacttgaacggcagctatctcgtggggaccgttacaaatgcctcatctgcatggactcgtactcgatgcccctaacgtccatccagtgttggcacgtgcactgcgaggagtgctggctgcggaccctgggtgccaagaagctctgccctcagtgcaacacgatcacagcgcccggagacctgcggaggatctacttgtgagctatctgccccaggcaggcctcgcctccagcagccccacctgcccccagcctctgtgacagtgaccgtctccctttgtacatacttgcacacaggttccccatgtacatacatgcacatactcaaacatgcgtacacacacacacatttacacacgcaggactctggagccagagtagaggctgtggcccaggcactacctgctggctcccacctatggtttgggggccatacctgttccagctctgttcccagggtggggcagggaggtgggggttgggggagtagtggggcacggctcctaagatccagcccccatactgacagacggacagacagacatgcaaacaccagactgaagcacatgtaatatagaccgtgtatgtttacaatgttgtgtataaatgggacaactcctcgccctctacctgtcccctccccctttggttgtatgattttcttcttttttaagaacccctggaagcagcgcctccttcagggttggctgggagctcggcccatccacctcttggggtacctgcctctctctctcctgtggtgtcccttccctctcccatgtgctcggtgttcagtggtgtatatttcttctcccagacatggggcacacgccccaagggacatgatcctctccttagtcttagctcatggggctctttataaggagttggggggtagaggcaggaaatgggaaccgagctgaagcagaggctgagttagggggctagaggacagtgctcctggccacccagcctctgctgagaaccattcctgggattagagctgcctttcccagggaaaaagtgtcgtctccccgaccctcccgtgggccctgtggtgtgatgctgtgtctgtatattctatacaaaggtacttgtcctttccctttgtaaactacatttgacatggattaaaccagtataaacagtt

SEQ ID NO: 1540 - DNA, 768 bp, Homo sapiens
aagtagttgctgggacagcgaaatggaggggtgtgtgtctaacctaatggtctgcaacctggcctacagcgggaagctggaagagttgaaggagagtattctggccgataaatccctggctactagaactgaccaggacagcagaactgcattgcactgggcatgctcagctggacatacagaaattgttgaatttttgttgcaacttggagtgccagtgaatgataaagacgatgcaggttggtctcctcttcatattgcggcttctgctggccgggatgagattgtaaaagcccttctgggaaaaggtgctcaagtgaatgctgtcaatcaaaatggctgtactcccttacattatgcagcttcgaaaaacaggcatgagatcgctgtcatgttactggaaggcggggctaatccagatgctaaggaccattatgaggctacagcaatgcaccgggcagcagccaaggacacttagcctgtgatgaggagagagtggaagaagcaaaactgctggtgtcccaaggagcaagtatttacattgagaataaagaagaaaagacacccctgcaagtggccaaaggtggcctgggtttaatactcaagagaatggtggaaggttaaacagcttggatttattcttactttgtatgttgtgttgttgtccccagtgtcctacaaactaatgtatttgtgcacaagacatcatctatgaatgatgaagttttctcaccttcaaagtcttataaacatgttgactcttgttcc

SEQ ID NO: 1541 - DNA, 2743 bp, Homo sapiens
gaggagagaagaggaggtggagaaggcttgggctcgcgccgctgaagtcggcttacccgctggccgcctcctgacaagcgggagggatccgcggtggacccagggaagcggaggagcctggcggccaccccctcttcctcacttccctgtactctcatcgctctcggcctccgacacgaaaaggaagcaaatgagctgatggaagatctgtttgaaactagacagggtcttgccatgttctggaactcataggctcaagtaatcttcctgcctcaacctcccaaagtgctggaattacagttccaagatgagatgggattctccaacatggaagatgatggcccagaagaggaggagcgtgtggctgagcctcaagctaactttaacacccctcaagctctacggtttgaggaactactggccaacctactaaatgaacaacatcagatagcgaaggaactatttgaacagctgaagatgaagaaaccttcagccaaacagcagaaggaggtagagaaggttaaaccccagtgtaaggaagttcatcagaccctgattctggacccagcacaaaggaagagactccagcagcagatgcagcagcatgttcagctcttgacacaaatccaccttcttgccacctgcaaccccaatctcaatccggaggccagtagcaccaggatatgtcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgccaatgaatttccctgtttgccaaagcaagtggcttggatcctggccacaagcaaggttttcatgtatccagagttacttccagtgtgttccctgaaggcaaagaatccccaggataagatcctcttcaccaaggctgaggacaatttgttagctttaggactgaagcattttgaagggactgagtttcttaaccctctaatcagcaagtaccttctaacctgcaagactgcccgccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcaaggcctagaaaaagacaactcagagttggggagtgaaactcggtacccactgctattgcctaagggtgtagtcctgaaactgaagccagttgccgaccgtttccccaagaaggcttggagacagaagcgttcatcagtcctgaaacccctccttatccaacccagcccctctctccagcccagcttcaaccctgggaaaacaccagcccaatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctatgccccctgaggccaggacaagcttccctctgtctgagtcccagactttgctctcttctgcccctgtgcccaaggtaatgatgccctcccctgcctcttccatgtttcgaaagccatatgtgagacggagaccctcaaaaagaaggggagccagggcctttcgctgtatcaaacctgcccctgttatccaccctgcatctgttatcttcactgttcctgctaccactgtgaagattgtgagccttggcggtggctgtaacatgatccagcctgtcaatgcggctgtggcccagagtccccagactattcccatcgccaccctcttggttaaccctacttccttcccctgtccattgaaccagccccttgtggcctcctctgtctcacccttaattgtttctggcaattctgtgaatcttcctataccatccacccctgaagataaggcccacatgaatgtggacattgcttgtgctgtggctgatggggaaaatgcctttcagggcctagaacccaaattagagccccaggaactatctcctctctctgctactgttttccccaaagtggaacatagcccagggcctccaccagtcgataaacagtgccaagaaggattgtcagagaacagtgcctatcgctggaccgttgtgaaaacagaggagggaaggcaagctctggagccgctccctcagggcatccaggagtctctaaacaactcttcccctggggatttagaggaagttgtcaagatggaacctgaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccactctgtggaatatacttttgcttcaataaatctgtgcttttattgcttcattgtttca

SEQ ID NO: 1542 - DNA, 2130 bp, Homo sapiens
cactagcagagaagctgctgtccttccaccaccagcaccggaccacctgctccaagaccagcctcctggggggaccaggcacccggccttcactggcacccagggagccgtcctcagcagcgtcaacatgtcaaggcccagcagcagagccatttacttgcaccggaaggagtactcccagaacctcacctcagagcccaccctcctgcagcacagggtggagcacttgatgacatgcaagcaggggagtcagagagtccaggggcccgaggatgccttgcagaagctgttcgagatggatgcacagggccgggtgtggagccaagacttgatcctgcaggtcagggacggctggctgcagctgctggacattgagaccaaggaggagctggactcttaccgcctagacagcatccaggccatgaatgtggcgctcaacacatgttcctacaactccatcctgtccatcaccgtgcaggagccgggcctgccaggcactagcactctgctcttccagtgccaggaagtgggggcagagcgactgaagaccagcctgcagaaggctctggaggaagagctggagcaaagacctcgacttggaggccttcagccaggccaggacagatggagggggcctgctatggaaaggccgctccctatggagcaggcacgctatctggagccggggatccctccagaacagccccaccagaggaccctagagcacagcctcccaccatccccaaggcccctgccacgccacaccagtgcccgagaaccaagtgcctttactctgcctcctccaaggcggtcctcttcccccgaggacccagagagggacgaggaagtgctgaaccatgtcctaagggacattgagctgttcatgggaaagctggagaaggcccaggcaaagaccagcaggaagaagaaatttgggaaaaaaaacaaggaccagggaggtctcacccaggcacagtacattgactgcttccagaagatcaagcacagcttcaacctcctgggaaggctggccacctggctgaaggagacaagtgcccctgagctcgtacacatcctcttcaagtccctgaacttcatcctggccaggtgccctgaggctggcctagcagcccaagtgatctcacccctcctcacccctaaagctatcaacctgctacagtcctgtctaagcccacctgagagtaacctttggatggggttgggcccagcctggaccactagccgggccgactggacaggcgatgagcccctgccctaccaacccacattctcagatgactggcaacttccagagccctccagccaagcacccttaggataccaggaccctgtttcccttcggccctccagccccaaacctgcccagccagccctgaaaatgcaagtcttgtacgagtttgaagctaggaacccacgggaactgactgtggtccagggagagaagctggaggttctggaccacagcaagcggtggtggctggtgaagaatgaggcgggacggagcggctacattccaagcaacatcctggagcccctacagccggggacccctgggacccagggccagtcaccctctcgggttccaatgcttcgacttagctcgaggcctgaagaggtcacagactggctgcaggcagagaacttctccactgccacggtgaggacacttgggtccctgacggggagccagctacttcgcataagacctggggagctacagatgctatgtccacaggaggccccacgaatcctgtcccggctggaggctgtcagaaggatgctggggataagcccttaggcaccagcttagacacctccaagaaccaggccccgctgatgcaagatggcagatctgatacccattagagccccgagaattcctcttctggatcccagtttgcagcaaaccccacaccccagctcacacagcaaaaacaatggacaggcccagaggctgaagcaaacagtgtcccttctggctgtgttggagcctccccagtaaccacctatttattttacctctttcccaaacctggagcatttatgcctaggcttgtcaagaatctgttcagtccctctccttctcaataaaagcatcttcaagcttgt

SEQ ID NO: 1543 - DNA, 1177 bp, Homo sapiens
cagaaactcctccaagcaacctaactcttaacccaacttctgacaccatgacctgctgccagaccagcttctgtggatatcccagcttctccatcagtgggacctgtggctccagctgctgccagccaagctgctgtgagaccagctgctgccagccacgcagctgccagactagcttctgcggatttcccagcttctcaaccagtgggacctgcagctccagttgctgccagccaagctgctgtgagaccagctgctgccagccaagctgctgtgagaccagctgctgccagccaagctgctgccagatcagctcctgcggaactggctgtggcattggtggtggcatcagctatggccaggagggcagcagtggagctgtgagcacccgtatcaggtggtgccgcccagacagtcgtgtggagggcacctacctacccccctgctgtgtggtgagctgcacgcccccatcctgctgccaactgcaccatgcccaggcctcctgctgccgcccgtcctactgtggacagtcctgctgccgcccagtctgctgctgtgagcccacttgctgaaagccagtttgcttattttcaattgcctaggtcacagtgtctctgaactgttcatcccttgaccacctctggaccactaacaagttctcagactttgcattgcttgtgatggagactactaagtatatgagctcacaattctatctgattccattctacaatgaataccttgacccttcactggggacacagaaatgctacaaagccacctgctgatcatcaatttgcttgggatatactatttctgatatttctgcaggattaaaaattactgacatgttgtggaatttatccatgagaactatccacaagtctaatgtttccatgctttataatctattttatcttgtttacctaaaattttttgcaacatcaaagacaccaaattatagccaagtgacattcctcaagtcaccagagagaatggaagctcatcacccaacattcagcttctaagaagtaggctggactttccacattttaacatctgatccatcccttggtttttggatcataatgatcttgcctgctggatatttcagttatatctgtgatacaatgtcttctgtcatttcttaataaatattatatactaggcaaagaaa

SEQ ID NO: 1544 - DNA, 1659 bp, Homo sapiens
gggtaaggcgggagccaatcgcaccgggttttattgggacacgccggcaagacgcctcttcagttgtctgctactcagaggaaggggcggttggtgcggcctccattgttcgtgttttaaggcgccatgaggggtgacagaggccgtggtcgtggtgggcgctttggttccagaggaggcccaggaggagggttcaggccctttgtaccacatatcccatttgacttctatttgtgtgaaatggcctttccccgggtcaagccagcacctgatgaaacttccttcagtgaggccttgctgaagaggaatcaggacctggctcccaattctgctgaacaggcatctatcctttctctggtgacaaaaataaacaatgtgattgataatctgattgtggctccagggacatttgaagtgcaaattgaagaagttcgacaggtgggatcctataaaaaggggacaatgactacaggacacaatgtggctgacctggtggtgatactcaagattctgccaacgttggaagctgttgctgccctggggaacaaagtcgtggaaagcctaagagcacaggatccttctgaagttttaaccatgctgaccaacgaaactggctttgaaatcagttcttctgatgctacagtgaagattctcattacaacagtgccacccaatcttcgaaaactggatccagaactccatttggatatcaaagtattgcagagtgccttagcagccatccgacatgcccgctggttcgaggaaaatgcttctcagtccacagttaaagttctcatcagactactgaaggacttgaggattcgttttcctggctttgagcccctcacaccctggatccttgacctactaggccattatgctgtgatgaacaaccccaccagacagcctttggccctaaacgttgcatacaggcgctgcttgcagattctggctgcaggactgttcctgccaggttcagtgggtatcactgacccctgtgagagtggcaactttagagtacacacagtcatgaccctagaacagcaggacatggtctgctatacagctcagactctcgtccgaatcctctcacatggtggctttaggaagatccttggccaggagggtgatgccagctatcttgcttctgaaatatctacctgggatggagtgatagtaacaccttcagaaaaggcttatgagaagccaccagagaagaaggaaggagaggaagaagaggagaatacagaagaaccacctcaaggagaggaagaagaaagcatggaaactcaggagtgacattcccttcactccttttcctacccaagggggaagactggagcctaagctgcctgctactgggctttacatggtgacagacatttccgtgggatagggaagatagcaggaagaaaagtaaactccatagaagtgtcattccactgggttttgatattggcttagctgccagtctcccatttgtgacctatgccatccatctataatggaggataccaacatttcttcctaatattctataatctccaactcctgaaaacccctctctcaactaatactttgctgttgaaatgttgtgaaatgttaagtgtctggaaatttttttttctaagaaaaactattaaagtacttcctagtagg

SEQ ID NO: 1545 - DNA, 6203 bp, Homo sapiens
ggaaaagctcctcggagatgagcgtgaccccctggctcgtggtggccgcctgttctcactaacgccatggcggggaccggagtgagaaaccggtgtctgtcactgactgcaaagtgagcgagaagcaggctgcgggccgtcccagcacgacgtggagccccgcggagacctcgagatgccccgcggggaagctcctggccccgggagacggggggctaaggacgaggccctgggcgaagaatcgggggagcggtggagccccgagttccatctgcagaggaaattggcggacagcagccacagtgaacagcaagatcgaaacagagtttctgaagaacttatcatggttgtccaagaaatgaaaaaatacttcccctcggagagacgcaataaaccaagcactctagatgccctcaactatgctctccgctgtgtccacagcgttcaagcaaacagtgagtttttccagattctcagtcagaatggagcacctcaggcagatgtgagcatgtacagtcttgaggagctggccactatcgcttcagaacacacttccaaaaacacagatacctttgtggcagtattttcatttctgtctggaaggttagtgcacatttctgaacaggctgctttgatcctgaatcgtaagaaagatgtcctggcgtcttctcactttgttgacctgcttgcacctcaagacatgagggtattctacgcgcacactgccagagctcagcttcctttctggaacaactggacccaaagagctgcacggtatgaatgtgctccggtgaaaccttttttctgcaggatccgtggaggtgaagacagaaagcaagagaagtgtcactccccattccggatcatcccctatctgattcatgtacatcaccctgcccagccagaattggaatcggaaccttgctgtctcactgtggttgaaaagattcactctggttatgaagctcctcggatcccagtgaataaaagaatcttcaccaccacacacaccccagggtgtgtttttcttgaagtagatgaaaaagcagtgcctttgctgggttacctacctcaggacctgattggaacatcgatcctaagctacctgcaccctgaagatcgttctctgatggttgccatacaccaaaaagttttgaagtatgcagggcatcctccctttgaacattctcccattcgattttgtactcaaaacggagactacatcatactggattccagttggtccagctttgtgaatccctggagccggaagatttctttcatcattggtcggcataaagttcgaacgagcccactaaatgaggatgtttttgctaccaaaattaaaaagatgaacgataatgacaaagacataacagaattacaagaacaaatttacaaacttctcttacagccagttcacgtgagcgtgtccagcggctacgggagcctggggagcagcgggtcgcaggagcagcttgtcagcatcgcctcctccagtgaggccagtgggcaccgtgtggaggagacgaaggcggagcagatgaccttgcagcaggtctatgccagtgtgaacaaaattaaaaatctgggtcagcagctctacattgagtcaatgaccaaatcatcattcaagccagtgacggggacacgcacagaaccgaatggtggtggtgaatgtaagacctttacttccttccaccaaacactgaaaaacaatagtgtgtacactgagccctgtgaggatttgaggaacgatgagcacagcccatcctatcaacagatcaactgtatcgacagtgtcatcagatacctgaagagctacaacattccagctttgaaaagaaagtgtatctcctgtacaaatacaacttcttcctcctcagaagaagacaaacagaaccacaaggcagatgatgtccaagccttacaagctggtttgcaaatcccagccatacctaaatcagaaatgccaacaaatggacggtccatagacacaggaggaggagctccacagatcctgtccacggcgatgctgagcttggggtcgggcataagccaatgcggttacagcagcaccattgtccatgtcccacccccagagacagccagggatgctaccctcttctgtgagccctggaccctgaacatgcagccagcccctttgacctcggaagaatttaaacacgtggggctcacagcggctgttctgtcagcgcacacccagaaggaagagcagaattatgttgataaattccgagaaaagatcctgtcatcaccctacagctcctatcttcagcaagaaagcaggagcaaagctaaatattcatattttcaaggagattctacttccaagcagacgcggtcggccggctgcaggaaagggaagcacaagcggaagaagctgccggagccgccagacagcagcagctcgaacaccggctctggtccccgcaggggagcgcatcagaacgcacagccctgctgcccctccgcggcctcctctccgcacacctcgagcccgaccttcccacctgccgccatggtgcccagccaggccccttacctcgtcccagcttttcccctcccagccgcgacctcacccggaagagaatacgcagcccccggaactgcaccggaaggcctgcatgggctgcccttgtccgagggcttgcagccttacccagctttcccttttccttacttggatacttttatgaccgttttcctgcctgacccccctgtctgtcctctgttgtcgccatcgtttttgccatgtccattcctgggggcgacagcctcttctgcgatatcaccctcaatgtcgtcagcaatgagtccaactctggacccacccccttcagtcaccagccaaaggagagaggaggaaaagtgggaggcacaaagcgaggggcacccgttcattacttcgagaagcagctcacccttgcagttaaacttacttcaggaagagatgcccagaccctctgaatctccagatcagatgagaaggaacacgtgcccacaaactgagtattgtgttacaggcaacaatggcagtgagagcagtcctgctactaccggtgcactgtccacggggtcacctcccagggagaatccatcccatcctactgccagcgctctgtccacaggatcgcctcccatgaagaatccatcccatcctactgccagcgctctgtccacaggatcgcctcccatgaagaatccatcccatcctactgccagcacactgtccatgggattgcctcccagcaggactccatcccatcctactgccactgttctgtccacggggtcacctcccagcgaatccccatccagaactggttcagcagcatcaggaagcagcgacagcagtatataccttactagtagtgtttattcttctaaaatctcccaaaatgggcagcaatctcaggacgtacagaaaaaagaaacatttcctaatgtcgccgaagagcccatctggagaatgatacggcagacacctgagcgcattctcatgacataccaggtacctgagagggttaaagaagttgtactaaaagaagacctggaaaagctagaaagtatgaggcagcagcagccccagttttctcatgggcaaaaggaggagctggctaaggtgtataattggattcaaagccagactgtcactcaagaaatcgacattcaagcctgtgtcacttgtgaaaatgaagattcagctgatggtgcggccacatcctgtggtcaggttctggtagaagacagctgttgagtgactgtgaggatgaaccttcataccctttccaagacgtgttacacagacagacctttttaagtcctggacttttaaatgaccatgaagttatcattgaatgttaagattttttcttcttgattttttaatacacgtaatctttttgaagcagacattgtatacagaatcttacttctctttgttcctgatatattaaaatggccagttaggctctttttgtagttgaattgtcttctaaagagattggatggcctctaaagaggtatgtgtatctttatttcagatgtcacccagagtaaattataattagaagtatagctagaatgagccccaaaccttagcctcatttattttgttctgttacataagtcattttccccttagagtgcttgaagaaatgccacctacaggttgtgtacttttcataatggtttccatgaatgtagtacgttcatacaggcttcattcaacctggcgttcccctccataattaagatgaaacattccggttttctcacaacacattagcacatactgtccattagcatatctgggataaccaggttttgggggttgagttttggccttcatccttgtagatccctttcctattgatttcccaccttccagtgaaattctgaaagtcttatcttaaaaatcgatccgcttaccatgggcctattcttgtaagtttcagttagcatttgcatgtgtaatattaaaatgaaagagcttcttacccagtgctgttgcccttttgagtatttttgtttttaaaataatgattgtaaaatgttttacaagtaatgtaaaagctagtatcattcttacatacttctgtgtttaaattttcattcttaccaaaacagttaactctttctttccaatcaatttatacaaaagaggtcgctccagccctaccacaggtctgactggcactgccttttgtttgcccttgaacagggcagtgttgtggggactgcaaaagagaaaacgtccaggcgagcccagttgtcctcgcccacagggtcctgcaggctccatcagtcaccgctttctatggcgtttgtagttgtgtcttttaagaagtgagtgtgattgtttacttgataaatcagctcactctctggtgctttttagagaagtccctgattccttcttaaacttggaatgatagatgaaattcacacccctgcagatcagaaaaaacaaatagaagaaaatgagggttacagtaacctgttgtctttatataacttgcaacaaactaatttatttttttttcctttttttgtttttggttttttatggttttttaaggaaaatacttttctcctttgaagttttacagctttttgtaaatgcgtcctgataatgattaggaaaatcgaccttttcatccatgatgaccatcctcatagctcagatctcctttcaaagtagtggctttctggatggtaattccatcttaaggtgtcagaactattttcaaatgctgcctttgacagttcttggaattttctgatattaagcagttccatgcaaatattcgtgttttataaatagctctcatagtctgctccatcttgatagttaagtgatttctgaagcgtttgtgtgtgtgttgatcaggttgtgtgatatttttgcttgatagagaatcaaatttgaaacaattaaccagccagtagattgtctgtcagtgaccttctgtagtaataaagtttttgccactgtaaataaaaacagtatccgtagctatcaggatcattgcgcactcatatatgctaagccttctgttctctaatagaagcctttcttttccattgtttctggatatttgtattatccaaatgtgcttatttctttgccttagcacacgttttatggagtacttgttatactaggtttgatttgaaactggtgcttgtcgcagaactgtcagagcatgaggagcgctcctcctgtgggtggacgcattcacgcactcccaggttgcacctgctgctggcggtgagcagggggttcagcagcttgaccgatgccccccgagggggctctccccagcttaaactttgttgtttaaatttgttaactttttatattaatgactattgaaagtggtaataaaaatttatattataggcttcaatgttttcatgaatgttacccaaaaagctgtgttttctttggtcagaggtcaaaatttatgaaaaacaaaatgctgtatgaatggaaatcattttgcaattgagtgacacttcattgtaattcacagtgtaaatttaatccaaactgaaattttgtttcaactgaatttgtaattaactctgaatttgtttttaatcattagtaatatttcagttgggtatctttttaagtaaaaacaacaaataaactctgtacatgtaaaacgtga

SEQ ID NO: 1546 - DNA, 3048 bp, Homo sapiens
gtaactctacggcctagcaaccgttgccaaggagctcgactctgggagcggtctagagcccgggcgcctcctggggggtggggaaacggtttcgtgaggagaatttgaggtaacctcgccaactcgcggtcggaagctcctctgaaccccgaaataggagagagctcccgtcctctctcggtcctgatgcagcacctcgcaagtggaaggggtcgtcgcggttaagcccccggataggggaatcgggccccttctgggattcgagcggatccaggccgctccctggagggatgaactgtcgaggggcccagggcagcccccgctagaggcccggtcgggtgtggggtcccctgtcccctgtcccgagcccggggagggggacactatttctggtactcccaggaggctgcgggtcgatgctcgtgccagcctgggacccaggcagcacggtttctctcccaaattgtgccagagaacacgcacgtcctggttttcattgttccccgcctcctgcgactcgtttgtggttaaaattataagacctaattatgagtgatcaaattaaattcattatggacagtctcaataaggagccctttaggaagaactataatttaatcacgtttgattccttggagccaatgcaactattacaagttctcagtgatgttctggctgagattgacccaaagcaacttgtggatatcagagaggagatgccagagcagacagccaaacgaatgttgagccttcttggtattcttaagtacaaaccttcaggaaatgccacagatatgagtacttttcgtcagggtttggtgattggaagtaaacctgtaatttacccagtgctccactggcttcttcagaggactaatgaactgaagaaaagagcatatttagctcgttttttaataaaacttgaggtaccaagtgagtttcttcaggatgaaactgtggctgacaccaataaacagtatgaagagttaatggaagcctttaaaactttgcataaagaatatgagcagctcaagatatctggattttctacagcagaaataagaaaggatatcagtgcaatggaagaagaaaaggatcagctcattaagagagttgaacatttgaagaaaagggttgagacagctcagaatcatcaatggatgcttaaaatagcaaggcaacttcgagttgaaaaagagagagaagaatatcttgcacaacagaaacaggaacaaaagaatcagctatttcatgcagtgcaaagattgcaaagagtacaaaaccagctgaaaagcatgcgccaagctgcagcagatgcaaagcctgaaagtttaatgaagaggctagaggaggagataaaatttaatttatatatggtaactgaaaaatttcctaaagaattagaaaataagaaaaaggaattacattttttacaaaaagtagtttcagagccagctatgggccattctgatcttcttgaacttgaatctaaaataaatgaaataaacacagaaattaaccagttgattgaaaagaaaatgatgagaaatgagcccattgaaggcaaactctcactgtataggcaacaggcatctatcatttcccgtaaaaaagaagccaaagctgaggaacttcaggaggccaaggagaagttagccagcctagagagagaagcatcagtaaagagaaatcagacccgtgaatttgatggtactgaagttttaaagggagatgagagacaggatctcactctgtcacccaggctggagtgcggtggtgtgatcatggcttactgcagcctgaaactcctaggctcaagtgatcctcctacctcagcctcctgagaagctcggactacaggcacgagccaccatgcccagctaattttctttttttgttttgttttgtagagatgtggtctcactatgtttcccaggctggtcttaaactcccggcctcaagcagtcctcccacttcggcctcctgaagtgttaggattacaggcgtgagcctgcgcctggctgtaattactatacccagtttttacagataaaggatctgagacatgcagaggttttaagctgacttgcctgacaccccattgctagtaagtagtagaaccaggagttggatttagcagtctggctgtagagtcatcaatagtttgcacatgacagaaagctggaagaaatagtcaacctgaaacacatgatggaattataattcagaatcatcttggtagataggggcactgtgcttaaacaaaatgccattaatgggattataataaatataatgtggtagaattcaagttttgtttgccaattcaacacatcatctgttactaacgcagctttaaaaaatgcataaacgattatactacattaatttttttaaaaagtatcctgtttatggtctgattatgcctggagtattattttatatttttgacttcatgttttaagagacaatcatgccagagtcccacatgagggtgactaaaatggacaaaaagtctggaaactttcatatcaataattgattatgtattaactgaaacaaaagactagagaaagacacagtgggaattgattatgtattaactgaggaataaaagactgaagaaagacataataaatagttaaaggattatggaaaagatggtgttcagaaaaaaattaacatgcaggcctgagactgctatccctagaaaggtctgcttgcaaagttggcccttggctggcatctgggggaacttggttcttggatggattcctgccattcactgataagaatggctcaccttgcctaaagtatatgaagagtgtgctttatgtcgagctcctgcttgcttgcctctttctttgtctttctttcttttccttcctcccttccttccttccttccttccttccttccttccttccttccttccttccttccttcctctctctctctctttctttctttcttctttctggaattttggtacaggctaggcagaatgtgcctagatgatcagctcctagtaaaaaccttgagaactaa

SEQ ID NO: 1547 - DNA, 1657 bp, Homo sapiens
gacggaaaccagaatcgttttgggtctggtcgccaagatggcgtcctccgcctccgcccggactccggcagggaagcgagtgataaatcaggaagaattgcggcggttaatgaaggagaagcagcgtctgagcaccagtcggaaacggatagaatctccattcgcgaagtacaaccgtttggggcagctgagttgtgccctgtgtaacactccggttaagagcgagctcctgtggcagactcacgtcctgggaaagcagcaccgagagaaagtggccgagctgaaaggcgcgaaggaagccagccagggttcgtccgccagttcagcgcctcattccgtcaagaggaaagcgccggacgcagacgaccaagatgtcaagagagcgaaggccaccttggtgcctcaggtacagccctccacatctgcgtggaccaccaactttgacaaaataggaaaggagttcattagagcgactcccagtaagccttcaggactcagtttactccccgattatgaagatgaggaggaggaggaagaggaggaggaaggagatggagaaagaaaaaggggggacgccagcaagccgctctccgacgcacagggcaaggagcactcagtttcctcttcacgggaggtaacaagtagtgtgctgccaaacgatttctttagtactaatcctcccaaggcccccataattcctcattcagggtcaattgagaaagcagaaatacatgaaaaagtggtggaaaggagagaaaacaccgcggaagcgttaccggaaggtttttttgacgaccctgaggtagatgcaagagtacgaaaggttgatgctccaaaagatcagatggacaaagagtgggacgaattccaaaaagccatgaggcaggtcaacactatttccgaagccatagttgccgaagaggatgaggagggacggttggaccgccagattggggagatcgatgagcagatagagtgttaccgacgggtggaaaagctacggaatcgccaggatgaaataaaaaataaacttaaagaaatcctgaccataaaagaactgcagaaaaaggaagaagagaatgctgacagcgatgatgagggggaactacaggatttgttgtctcaggattggagggtgaaaggggcattgttatagggttttaaagacccaaggtttctaacagcctctgctgttgtataaaaagtgctgtctctcagtagtatagcggttacttcatgcctcaagatttgggtacctggattgctaaactggattgttgagataaaatgagccagtgagctacagcactttggaaaatttgtgtaacatgtttttgaggtaaagttgtttttgaaatttctgaagtgttatataccaaaatgccaacatttccacgacagacttaactgtataatttcgttgtaaaatctgtaagttgtaaatattgtacatagttaaatctgtattctgttttgaatttttttaattaatagaaagaccaaccggcaaactttcagatgaatgcttactgtggtatttggaatgtatgtatcttctgaaccctacatcaagttgaaaaggtttgttttcttgtttctttggtttttgtatggttttttagaacacttcataaacacataagtcattgtaggttaa

SEQ ID NO: 1548 - DNA, 1971 bp, Homo sapiens
tccttccaccaccagcaccggaccacctgctccaagaccagcctcctggggggaccaggcacccggccttcactggcacccagggagccgtcctcagcagcgtcaacatgtcaaggcccagcagcagagccatttacttgcaccggaaggagtactcccagaacctcacctcagagcccaccctcctgcagcacagggtggagcacttgatgacatgcaagcaggggagtcagagagtccaggggcccgaggatgccttgcagaagctgttcgagatggatgcacagggccgggtgtggagccaagacttgatcctgcaggtcagggacggctggctgcagctgctggacattgagaccaaggaggagctggactcttaccgcctagacagcatccaggccatgaatgtggcgctcaacacatgttcctacaactccatcctgtccatcaccgtgcaggagccgggcctgccaggcactagcactctgctcttccagtgccaggaagtgggggcagagcgactgaagaccagcctgcagaaggctctggaggaagagctggagcaaagacctcgacttggaggccttcagccaggccaggacagatggagggggcctgctatggaaaggccgctccctatggagcaggcacgctatctggagccggggatccctccagaacagccccaccagaggaccctagagcacagcctcccaccatccccaaggcccctgccacgccacaccagtgcccgagaaccaagtgcctttactctgcctcctccaaggcggtcctcttcccccgaggacccagagagggacgaggaagtgctgaaccatgtcctaagggacattgagctgttcatgggaaagctggagaaggcccaggcaaagaccagcaggaagaagaaatttgggaaaaaaaacaaggaccagggaggtctcacccaggcacagtacattgactgcttccagaagatcaagcacagcttcaacctcctgggaaggctggccacctggctgaaggagacaagtgcccctgagctcgtacacatcctcttcaagtccctgaacttcatcctggccaggtgccctgaggctggcctagcagcccaagtgatctcacccctcctcacccctaaagctatcaacctgctacagtcctgtctaagcccacctgagagtaacctttggatggggttgggcccagcctggaccactagccgggccgactggacaggcgatgagcccctgccctaccaacccacattctcagatgactggcaacttccagagccctccagccaagcacccttaggataccaggaccctgtttcccttcggcggggaagtcataggttagggagcacctcacactttcctcaggagaagacacacaaccatgaccctcagcctggggaccccaactccaggccctccagccccaaacctgcccagccagccctgaaaatgcaagtcttgtacgagtttgaagctaggaacccacgggaactgactgtggtccagggagagaagctggaggttctggaccacagcaagcggtggtggctggtgaagaatgaggcgggacggagcggctacattccaagcaacatcctggagcccctacagccggggacccctgggacccagggccagtcaccctctcgggttccaatgcttcgacttagctcgaggcctgaagaggtcacagactggctgcaggcagagaacttctccactgccacggtgaggacacttgggtccctgacggggagccagctacttcgcataagacctggggagctacagatgctatgtccacaggaggccccacgaatcctgtcccggctggaggctgtcagaaggatgctggggataagcccttaggcaccagcttagacacctccaagaaccaggccccgctgatgcaagatggcagatctgatacccattagagccccgagaattc

SEQ ID NO: 1549 - DNA, 5164 bp, Homo sapiens
gcatcatggaatgatataaaaatgcagctttccaatcacactaagggtctctctatttcttctcttgaccaccaatcaggaacctttgctggaagcttgtttctgattggtgaaagtaagccataacagtggaatgccaaggagtaaatacaaaagtgtagcaacaactgagtttgctgtctcactaccctcagcctaggccaacctggactccttcaccccaaatgaggtgaccgctacattttatatgaagacactgatttaccattcaactgtgatccatcttataacatggcaatccaatacagacaggaagataaaactcaacaacagctaaaataaagtgtattcccaggtaaaatagacaagtgctttaatttgaaatggattcgtccgatgagtgtcagttacaagggcagagaaggtaccagtgcagaagagctctgactgtgggcagtgtcaccaggtcccactaagtggcaacacttgtgctgggtgacttgacccatcttgatgtataaacccatagccagacaggacgtgcaaacaggtctcatggtgaatgcgatgctgtggaaaatgacatggagaatggctgtctctcagctagggaggagggtcttggtgtcctagtaaagaatgttcacgtcctggagttggtggttggtgttctatctaggcgatgagagaaggatgcttttcctaatgagcacctggtgggaatagagtctctctttgcacttcgctggaggaagaaatttctaccacttattttttcttcttgcttatagaatacacattgcagaaaaaggatgaagttgaccagtgaaaagttgcccaagaaccccttttatgcctctgtatctcagtatgctgctaaaaaccaaaaatttttccagtggaaaaaggaaaagactgaatcagattacacccatgctaatttggtggataaggcattgcagctcttgaaggaaagaatactgaaaggagacactctggcatatttcctacgaggtcaactatattttgaagagggatggtatgaagaagcattagaacagtttgaagaaatcaaggagaaagaccatcaagcaacttaccagctaggagtgatgtactatgatgggctggggaccactctagacgctgagaaaggggtggactatatgaagaaaattcttgattctccatgtcccaaagcaagacacttaaaatttgcagctgcttacaacctcggaagagcttattatgaaggaaaaggtgttaaacgatcaaatgaggaagctgaaagactgtggcttatcgcagcagacaatggaaatcccaaagctagtgtgaaggctcaaagtatgctcgggctgtattactcaaccaaggagcccaaggagttagaaaaggcattttactggcattccgaagcatgtggcaatgggaatctggagtcccagggtgcacttgggctcatgtacttgtatggacaaggcatccggcaggatacggaagctgccctgcagtgcttaagagaagcagcagaacgcggaaacgtctatgctcaagggaatctcgtggagtattactataagatgaaattttttacaaagtgtgttgcattttccaaaaggatcgctgactatgatgaggttcacgacatccccatgatcgcccaggtcacagactgtctcccggagttcatcggcagaggcatggcaatggcatccttctaccacgcaaggtgtcttcagcttggcttgggcatcaccagggatgaaacaaccgctaaacactattattctaaagcttgtcgtctgaatcccgcattggcagatgaacttcactccttacttattcgtcaaagaatttagaccacaatgtatttcaacaaagatcatcaatgctaacacctcacaatgtgtgtatttttacagtagctatgtttggttattttgcacatcacaaattacactatcctgggtattttacaggtgacatgttacttcgttcttgaattcgtacgctgttaagttttgcaacttgaaacctagacacaaggtcaaattgctggaagagtcctcagaggtccacctcttaccctacagactggccgagaccatatcaagtattaaaaccattctatacagcaagtatcgtttatcctttcttaaacaccgagtctccaaaaatacttagtttagctttagtttagtaagttcagaagtagaaacaaacttatttaaaaccatcatttgaaagtttaattctttaaatttgtctcttagttttgtgaattttgaataataatgtttaaattttgtttcagtcatttaaaatttaaattttcagtcatttaaaattttaaaaatttaaaatttcacaaaactaagggtaaaagacatttaaagaattaaacttaaataagtgtgtgcagcatttctacttctgaagttattaaagctaaaactgcactaagccttttgagacatcctttattcttaaaaagctcataaataattggcttattacatataaacttcaaaaaagtgggttataagacattgctttagaatcttgcccctccaaatcttccctcaaagatcttaatgagtaaaacaactgctacatacatatgcagaatgtgtaataaaacaaaaagcaattgctatatgaaaatattcgtaagaaaagtaaagcaaattgtttctttgtgcttcagctcattttccatatttttaaaaccctgtggtaaaagcctcaatgaaatcatttacaagaactacaattaaatattgttaaaattagcaaaaggctttccgtatatagatgacatctatgaaggcaaaaggtgacagtaaaaacagtaagatccatatgcataagattgtacaaggctattcatttgtgaaacaaatatacatatcgaagacaggtctcagagataccttaactattcctttttttataaacatattaaaggatgtggctttattttataaatcacaaccatcccaacagtggatttaaacaagatttctttttagtaatgggaaaatgcaattaatatggaggtgatagtcactaagaactgttgaatggcagaaaagtatttgctctcgttttatgttctggcttgtctgtattgcctgaacttcattttgtctttgtgtaagggaagaaatttcaacagactcgggtttgagatatcctcaaatggtcatgtatttctgtctcaaatctcttaataccacccatgtaacattccttcaaccacttgaagatccaaattcccaactagtattctcttctccacacttaatccagttcctaaagattattattattattattattattatttttttttttttgagacggagtctcctgacctaatcttagcccggcgcagtggctcacgtctgtaatcccagcactttgggaggctgaggcgggcagatcatgaggtcaggagtttgagaccaggctggccaacgtggtgaaaccccgtctctactaaaaatacaaaaattagccgggcgtgatggcggacgcctgtagtcccagctactcgggaggctgagacagaagaactgcttgaaaccaggaggcagaggttgcagtgagctgagatcgcgcaaattgcactccagcctcggtgacaagagcgagactccatctcaaaaaaaaataaaaagaatcttaaaataggaacataataaaagatcggccctaagtaaagagcactttttaaactgccattaaagatgggtttcagaaatcataaactttgacgtgtgccatacatggtaacatgctatgcttatatgtcttctataaatccaatgcagaatttaaaatttcagtttactctagttaccataaagctaatgctctggcacaagcgagtccctgcaaactaccactgctgaggacagtagtaaaccccttgacctgagactgcggtgagtctgtaactcgagtgcattgagacttccagatcattactcttacacacacacacacacacacacatacacacacacacactccttctctaagattccttgtagctgatatctcatggaaaaatgacattttatcataaataaatatagagacaaaataatagtgatctttctcattcgcaatgtaaacttaacagctacagtttaaatgatagcatagaattatgcctaaaatagacatttcccataattgtattgtgataagttcttcaggcttgacaacttcacattgcctctcttccttgaatgtattttatctggtcttttctatatagtcttttgaaggataatttttatcaatagccaactttgggtatttttttaagtgtcaaatatcatcatggtttgaaaaaaggataaaaaagctataactaaaaaaatcttaaggataacatttggtttactaatttttaatcatttatctttcagaacttgtttcttatcaagaagttagcaggtatgatatgtatatcatacgtatataaactggcataggttacatcctagggcatgaggggagtatctttcagggattcaaatggaatttttacctgttacttgtttaattgttttgttttcaatattcttggggattagacaggggaaggtattttattactgcataatagatggtgaaacccaggaaaattaagtacttgtgcatggccccactatcaataacacaaagtctgtactctggatctcccctaatgtccctgtggtctaaacggcttgataatacaaccgagcccctgaagtagctgccctcctctttccgctcccccatctcggccctgcccatactccaagggtcagctcccatctctcctccctaatgcctcacttcaagcactaatttggctctttctgctcactaaaaatcatatattttacagatttattttgtttctggagaaggcagcaaacttttacttccctgcagaagtagttaagtacatagtgttttctctaaaaaggcatttgataaatatttgaacagcctgtagagtttcaacctctttgagatataagtatcttaaatatcatagagcactgtgattcatttttatattttattgctttgaatgctcaaactatgggaaatctttggtaaaaataaagacaataaaatcttcacaataacttta

SEQ ID NO: 1550 - DNA, 2055 bp, Homo sapiens
ggttacctggcggcgggcgggcgcggccgggagcggagggccgcggtcgcgaagaggatgaagagagagttcccgaacaagtcggaagcagctcacaacaccggacgccgcgcggcagggctgtggacctggggtggtttcgtgtcccagtcttaggaaactacgcgcgaggcaccgtgctgaggcgtagaggtcaccctcgggaggtttcggtgaaacctggtgggaaattccgggcaggcgcccggagtcgcgcccaagtaggcagctccgtgccgccagacttgtgttcgggggagttgagacgaactgcacgggtgggattgcatggctctgccctcccagcgttgacaactcgccccgaccgcccaggaagcgcgagcttactggctccagaagtgatgatgctgggtggaagtcgcagcatgtgaagagttgccggttgttatgggattaaaaaagatgaaagggttatcttatgatgaggcttttgctatggctaatgatcccttggaaggcttccatgaagtaaaccttgcttcacctacttctccggaccttcttggtgtgtatgaatcaggaactcaagagcagactacctcaccaagtgtcatctaccggccacacccttcagctttatcctctgtacctatccaggcaaatgcattagatgtttctgaacttcctacacaacccgtgtattcatcccccagacgtttaaattgtgcggaaatatctagtatcagctttcatgttacagacccagccccttgctctacctctggagtcacagctggattaactaaattaactacaagaaaggacaactataatgcagagagagagtttttacagggtgctactataacagaggcttgcgatggcagtgatgatatttttgggttgagtactgatagtctgtctcgtttacgaagcccatctgttttggaagttagagaaaagggctatgaacgattaaaagaagaactcgcaaaagctcagagggaactgaagttaaaagatgaagaatgtgagaggctttcaaaagtgcgagatcaacttggacaggaattggaagaactcacagctagtctatttgaggaagctcataaaatggtgagagaagcaaatatcaagcaggcaacagcagaaaaacagctaaaagaagcacaaggaaaaattgatgtacttcaagctgaagtagctgcattgaagacacttgtattgtccagttctccaacatcacctacgcaggagcctttgccaggtggaaagacaccttttaaaaaggggcatacaagaaataaaagcacaagcagtgctatgagtggcagtcatcaggacctcagtgtgatacagccaattgtaaaagactgcaaagaggctgacttatccttgtataatgaattccgattgtggaaggatgagcccacaatggacaggacgtgtcctttcttagacaaaatctaccaggaagatatctttccatgtttaacattctcaaaaagtgagttggcttcagctgttctggaggctgtggaaaacaatactctaagcattgaaccagtgggattacaacctatccggtttgtgaaagcttctgcagttgaatgcggaggaccaaaatcacttctgtatgtaacttttttacatacattcgatacattcagcagggactcgtgaaacagcaggatgttgatcagatgttttgggaggttatgcagttgagaaaagagatgtcattggcaaagctgggttatttcaaagaggaactctgatgctctgcgtgggaccatgcctgaactccccgaataactgaaaaatggctgaatatttttatggttacttgatatttatttccaaggagtgagcctaagacttttttccccttttgcaaattgctctaagaagtaccatgatttcttttaaactgatctatgctgtgtttgcttattctttagttgaacacactatgaagaattccaggtgtactagtgaatgtaatttatagttgccaaaaaaaaaaaaaacctgaaataaataaatgttagattg

SEQ ID NO: 1551 - DNA, 6617 bp, Homo sapiens
actgaccccgctgtaccacggccctcttgcggacagccccggggacgtcgttgggacatcgctgggaccccgggctctgcagccacaaccatgtttggccggaagcgcagtgtctcctttgggggcttcggatggatcgacaagaccatgctggcaagtctgaaggtcaagaagcaggagctggccaacagctcggatgcgaccctcccagaccggccgctctcccctcctctcacggcacctcccaccatgaagtcgtcggagttctttgagatgctggagaaaatgcaggacgactatatcccataccccagcatcgacgaggttgtggagaagggaggcccgtaccctcaggtcatcctgccacagtttgggggctattggatcgaggacccggagaacgtgggcaccccaacatcgctggggagcagcatctgtgaggaggaggaagaggacaacctcagccccaacacatttggctacaagctcgagtgcaagggtgaagccagggcctaccggaggcacttcctggggaaggatcatctaaacttttactgtaccggcagcagcctggggaacttgatcctgtccgtcaagtgcgaggaagcagaggggatcgagtacctccgggtcatccttaggtccaaactgaagacggtacatgagcggatccccttggctggactgagcaagcttcccagtgtccctcagattgcaaaggctttctgtgatgatgcagtgggactgagattcaatcctgtcctgtaccccaaggcctcccaaatgattgtgtcctatgatgagcatgaagtcaacaacacattcaaattcggagtcatttatcaaaaagccaggcagaccctggaggaggagctatttgggaacaatgaggagagcccagcttttaaggagttcttggacctgctgggggacacgatcacactgcaggatttcaaaggtttccgaggaggcctggacgtgacccacggacagacaggggtggaatcagtgtacacaacattccgggacagggagatcatgtttcacgtttccacaaagctgccatttaccgacggagacgcccagcagctccagagaaagagacacattggaaatgacatcgtggccatcatcttccaagaggaaaacacgccgtttgtcccagacatgatagcctccaatttcttacatgcctacatcgtcgtgcaggtcgagaccccaggcacagagaccccatcctacaaggtctctgtcactgcgcgggaagatgtgcccacctttggtccacctctgcccagtccccccgttttccagaagggcccggaattcagggagtttctgctcaccaagctcaccaatgccgagaacgcctgctgcaagtcggacaagtttgcaaagctggaggaccggaccagggctgccctcctggacaaccttcacgatgagctccacgcccacacacaggccatgctgggactgggcccagaggaggacaagtttgagaatggaggccacggggggttcctggagtcttttaagagggccatccgcgtacgcagccactccatggagaccatggtgggcggccagaagaagtcgcacagtgggggcatccctggcagcctcagcgggggcatctcccacaacagcatggaggtcaccaagaccaccttctcgcctccagtggtggcggcaacggtgaagaaccagtcacggagtcccatcaagcgacgctcggggctcttcccccgcctgcacacgggctcagaaggccagggcgacagccgggcacgatgtgacagcacatccagcacacccaagaccccagatggtggacactcctctcaggagataaagtctgagacctcatccaatcccagctctccggaaatctgccccaacaaggagaagcccttcatgaagttgaaggaaaacggccgtgccatctcccgctcctcctccagcaccagcagcgtcagcagcactgcaggggagggcgaggccatggaggagggcgacagtgggggcagccagccgtccacgacctcacccttcaagcaggaggtgtttgtctacagcccgtccccgagcagcgagagccccagcctgggggcagctgccaccccgatcatcatgagccggagtcccacagatgccaaaagcagaaactccccgagatcgaacctgaaattccgctttgacaagctcagccatgccagctctggtgcgggtcactaatgtgaaagtggagtccttcgcctgtccaagggaatcccctcttctgtcctggaaaaggctcctgtaccagcagtttgggagtgccgtccacgaccctgacagtcccagccctgctgccccatggccacgtgcccacagatgtgctgttggtccaggtgtcccagtctggccacagccctgcctccgccctcacctacatgccctcccagcccctcccatctctggacgaggcctccttcctcaggttcctcctgctcctgacctcccagtgtgatgtccgggtcctttatcatcctattcatcctggagaggaaaagtgtcgggcaaagggggatctggggggagctcagcagtgactggggagctggtctgcctcagagacagagtagggggtgggagcagagcctcggtgagggtcttggccacagggcagtgccttcctgaacgtggcaggctttactaccaggaacgcactcggtggtggaggccccatgttcccaggagccaagattcgtagcatccttgaggccatcctgataaaattcggcgctattgcccccgtagctctggagctctaaaccgtctatctgcttctgtgctgaacgcctttcccatctgctgacgtaggcccagggctgccctgcccctgctgccagtgtaccgtgagcggggctccagccagttcaagctcagagccagagctggacgggccagaactgcgctgcacacttcctggactgaggcggggactttgggtcccacccggtttctcctgattatggctgctgtggggtgaggggagggaggggcagccccgaggcagtctcttccctttgagaagatattttcccacaaaggggtgggaagccaggagtgagaaggaattcagggagagcaaaggagccagtgctgagatgctgctgtgttggttgaggaaaacctcgggcctgagggccaggccggagcccaggtctctgctgacaatgggggttcaaggaagacgtcgttatctcccctccccacttactcgaggagagaggtgagggggggatgacttgcgggttctgatcaggcccctgggtggggaaggggcacagtgtccctcagcagcttacgcccctggagtcttggggggcccagcctggccctggggccttttccagctactgtgcccttgggcagctgcgtctggggctcaaccccccaatcctgttcccctctccagctgcgggtctgtaggcagctgtcacatctgaagggtttctgcaacctggaccccatctgggtgtgggtcagaccctgtgacccacatgccacccccaccctccacagagcccccttgctgggacagccagctcacctccaaggacatcccctcctggcttctcccccttccgagtctgcagcgccgtgggcttctctgccgatgggcccgggttggggttaaggtgggcatcctccaggtacaacgagcctgaagagcccctttcagtgcagacggggctgcagagtgacactggctgggcacctgccccacgaccaatgacaaggatttccagctgaatgctttattcccatagggatctggacctgtgcccaagatataaatactacactttttttttttttttttaactgacattgtgaaattctccctatagcttttgccattcaagcaacattgtgatctttcttccccgccacgtgtgtgggaatgattgagtcctgtttgcaagctggagaggagctctccctttgctagtactttctctaaagtactagtctagtaaaatttattcttgttagaaggtcaacaaaatatctgtttagcttttatgaagagtcaccgtagcagcccccacggctggaaagaggcctgtacgttctggacgcgttttgttggctgggcttctggaggcactggcaaggtcaaactgcatttctttaagaacagttgcaggatctggctcgcctctgtgggaagccggcattacaggtgcttggtggatgggccgtgtcacattgccatctggggtcctttggggtttccaggttgtcaccatgctgtcccatttgggaatcccatacctgcctgtccccactgcgctggctgacccttgctgcctgctgcctcttgggagggctttgtccctgcctctgagctggtgggcaggatggctgggtggcccccagagaagcacagacctgagatggggtctccatgcccggtttgctgttggaatgatctgaacaggaccccaaatgcctcttccctctggtcatgcctcactatctctaggagctccatcctgtggcttccagagtgtgcacttccagcccacccgggcagtgctgagagggaggaggagaacaaggatggcccagcctcccctccctcccctagaccacggggcgggcagctcgggttcctggagggctgtttcccccacgctgtccctacatctgctctgatctaaaatgtctttccttttatgctgcgcccagtcttggggctcaaagatttgcccaaacctcattggccctcgtgactaggctcatctagatggtgctcacgctggtgtttgaggcatttccactgtgatctccacgaggggatgttttccgggacacatctctggctctgggaactgcctgactcactgaagaaactacttttcaggcactgtagggtcacccatatgcctccagctcagttgacgcttaaaaacaggtgcagaaaagctcgcgatggaaggtcttaatgagagtgtctgtctatgccaatcatgtaaaatgacgtttcttgaaaaagattcagtggttcagctttgtcagcatcatctcaacacaagcctgctggctctttttagcatctcatccaaccatgtcatcgtccagatgagaaatcttagcccaggtgaggggagtaacttgcttgaggtcacacagctggctgttggcaaagctgggattagaaccctcaacccagggtcccttcctctgcagcgcctacatggttggttgaataagtggctgcgtttcctggggccctgggttttggggaagccagttagctgctgctttggcactggcatggaggtgagcagtcaaggatgctggtgaggctgcagtttctgctctttttcatcaggggggatagtctctaggatttttcagtgaggacccttgggctttggatgcagcttgaaccaagaaaacgaggagggaaagggattcagtgaactattcctcagtgggatcggttcttcagctcctgatgggggctgtgtaatgggggcagaggccagggaaaaagatgctgttcacccaccctcagcttcccttttcctaaattaagaggaaaagtggtcaaagaaaaactcttcatttctccctgattcttaaacgaaggtggttaatagaaactcaggctcccgtgacaaggcaggacaagagcctgtttcgctttcctccctgaccctgccaggtgccaactcaaacactacctttctcattggtttctaagtcagtagagacagatctgttttaagcagttgggggttcgagtagatctcatgggtacaggaggccagcagggaccaggccagtcagccatgctcaggacccctcggctcctcccccagcctctagctaccctgtatcgaggcaaggggaggccagtaaagtttgccaagcctgatcctgcagcctggtggggctggctggggtattcttttaccaaactctgttttaccgccagccccttgtacaccccaatcccatgtctccctcccttcagctggaccgtgtgcccctttgggaggaagaagacaagccccactagggccaagggcagcagagccctgccgagtgagaggctgtggggcagcggctctgtcctgtgccttaccagccctggggaggggggcatttggctggaagactggaatttaattgccatcgtctttgattttgtgacatttctgcttggaagtgtgaactacccccccccccccgcttcctgctccttagcatgcgtgcagctctctcctgttttgggtgttccccttggacactccagctcggggactgctggcgtgtgaatgtgcagattcccctgtgtggtcgaacctaagaactgtggcttggaagtgatgctccatgtgacgacgactttgctttctttcctcttagtgaggaggtgattcgtagatcccaactgcctatgtaatgtaaataatgtacatttaatttattgctatggtagcacattgtatttgttaatgtacaaaacaaattctaaaaggttgacaaatgtatattttgttgcttaaatgtgtctttgcagaaattgacaataaataacatattttgtgtcc

SEQ ID NO: 1552 - DNA, 2313 bp, Homo sapiens
attcatccccagcgcagagcagcgctggcagccggcgccgcgatggaggaagagctgaagtgtcccgtgtgcggctctctgtttcgggagcctatcatcctgccctgttcccacaatgtctgcctgccttgcgctcgcaccatcgcggtgcagaccccggacggtgagcagcacctgccccagccgctcctgctttcccggggatcggggctgcaggcgggcgccgccgccgctgcctctctggagcacgacgctgcggctggcccggcctgcggcggtgcaggcgggagtgcagctggcggcctcggcggcggtgcgggaggtggcggagaccacgcggacaagctcagcttgtacagcgagacagacagcggctacgggtcctacaccccgagcctcaagtcccccaacggggttcgcgtgctgcccatggtgcccgcaccacccggctcctcggctgcggcggctcggggtgccgcctgctcctcgctgtcctcgtcttcgagctccatcacgtgcccgcagtgccaccgcagcgcatccctggaccaccgcggcctgcgcggcttccagcgcaaccggctgctcgaggccatcgtgcagcggtaccagcagggccgcggggccgtgccggggacgtctgcagccgcggcggtggccatctgccagctgtgcgaccgcaccccgccagagccagcagccacgctctgcgagcagtgcgacgtcctctactgctctgcctgccagctcaagtgccatccatcccggggacccttcgccaagcatcgcctggtgcagccgccgccgccgccgccgccgcccgccgaggcagcctccgggcccactggcaccgcccagggcgcccccagcggaggcggcggctgcaagagcccgggaggcgcgggggcgggggcgactgggggcagcacggcccgcaagttccccacgtgtcccgagcatgaaatggagaactacagcatgtactgcgtgagctgtcgaaccccggtgtgttatctgtgcctggaggagggccggcacgccaagcacgaggtgaagccgctgggggccatgtggaagcagcacaaggcacaactatctcaggccttaaatggagtttcagataaggcaaaggaagcaaaggagtttctggttcagctaaagaacatattgcagcagatccaggaaaacggactggactacgaagcctgcctcgttgctcagtgtgatgcccttgtggatgctttaactcgtcagaaagccaagctgctcaccaaggtgactaaagagagggaacacaagttgaagatggtttgggaccagatcaatcactgcacattgaagctgcgtcagtccaccggactgatggagtactgcctggaggtgatcaaggagaacgacccctccgggttcttacagatctcagatgctctgatcaagcgcgtccaggtgtctcaggagcagtgggtcaaaggcgccctggagccgaaagtgtctgcggagtttgatctgactttggacagcgagccgctgctgcaggccatccaccagctggacttcattcagatgaaatgtagggtgccacccgtccccctactgcagctggagaaatgctgcacccgtaacaacagcgtcacgctggcctggaggatgccacccttcacccacagccccgtggacggctacatcctggagctggacgacggtgccgggggacagttccgggaagtgtacgtcggtaaggagactttgtgtaccatcgacggtcttcacttcaacagcacctacaacgcccgagtcaaagctttcaactcttctggtgtcgggccttacagtaaaactgtcgtcctgcagacatccgatgtggcctggttcacatttgaccccaactctgggcatcgggacatcattttatccaatgacaaccagacagccacctgcagcagctatgacgaccgggtggtgctgggcacagctgcgttctccaagggcgtgcactactgggagctgcacgtggaccggtacgacaaccacccagaccccgccttcggggtggccagggccagcgtggtcaaggacatgatgctgggcaaggatgacaaggcctgggccatgtatgtggacaacaaccgcagctggttcatgcactgcaactcccacaccaacaggacggaaggtggcgtgtgcaagggggccaccgtgggcgtgctgctggacctgaataagcacactctcaccttcttcatcaacgggcagcagcagggccccacagccttcagccacgaggttcagccctcggttacttccctcttttaa

SEQ ID NO: 1553 - DNA, 3936 bp, Homo sapiens
atggaggaagagctgaagtgtcccgtgtgcggctctctgtttcgggagcctatcatcctgccctgttcccacaatgtctgcctgccttgcgctcgcaccatcgcggtgcagaccccggacggtgagcagcacctgccccagccgctcctgctttcccggggatcggggctgcaggcgggcgccgccgccgctgcctctctggagcacgacgctgcggctggcccggcctgcggcggtgcaggcgggagtgcagctggcggcctcggcggcggtgcgggaggtggcggagaccacgcggacaagctcagcttgtacagcgagacagacagcggctacgggtcctacaccccgagcctcaagtcccccaacggggttcgcgtgctgcccatggtgcccgcaccacccggctcctcggctgcggcggctcggggtgccgcctgctcctcgctgtcctcgtcttcgagctccatcacgtgcccgcagtgccaccgcagcgcatccctggaccaccgcggcctgcgcggcttccagcgcaaccggctgctcgaggccatcgtgcagcggtaccagcagggccgcggggccgtgccggggacgtctgcagccgcggcggtggccatctgccagctgtgcgaccgcaccccgccagagccagcagccacgctctgcgagcagtgcgacgtcctctactgctctgcctgccagctcaagtgccatccatcccggggacccttcgccaagcatcgcctggtgcagccgccgccgccgccgccgccgcccgccgaggcagcctccgggcccactggcaccgcccagggcgcccccagcggaggcggcggctgcaagagcccgggaggcgcgggggcgggggcgactgggggcagcacggcccgcaagttccccacgtgtcccgagcatgaaatggagaactacagcatgtactgcgtgagctgtcgaaccccggtgtgttatctgtgcctggaggagggccggcacgccaagcacgaggtgaagccgctgggggccatgtggaagcagcacaaggcacaactatctcaggccttaaatggagtttcagataaggcaaaggaagcaaaggagtttctggttcagctaaagaacatattgcagcagatccaggaaaacggactggactacgaagcctgcctcgttgctcagtgtgatgcccttgtggatgctttaactcgtcagaaagccaagctgctcaccaaggtgactaaagagagggaacacaagttgaagatggtttgggaccagatcaatcactgcacattgaagctgcgtcagtccaccggactgatggagtactgcctggaggtgatcaaggagaacgacccctccgggttcttacagatctcagatgctctgatcaagcgcgtccaggtgtctcaggagcagtgggtcaaaggcgccctggagccgaaagtgtctgcggagtttgatctgactttggacagcgagccgctgctgcaggccatccaccagctggacttcattcagatgaaatgtagggtgccacccgtccccctactgcagctggagaaatgctgcacccgtaacaacagcgtcacgctggcctggaggatgccacccttcacccacagccccgtggacggctacatcctggagctggacgacggtgccgggggacagttccgggaagtgtacgtcggtaaggagactttgtgtaccatcgacggtcttcacttcaacagcacctacaacgcccgagtcaaagctttcaactcttctggtgtcgggccttacagtaaaactgtcgtcctgcagacatccgatgtggcctggttcacatttgaccccaactctgggcatcgggacatcattttatccaatgacaaccagacagccacctgcagcagctatgacgaccgggtggtgctgggcacagctgcgttctccaagggcgtgcactactgggagctgcacgtggaccggtacgacaaccacccagaccccgccttcggggtggccagggccagcgtggtcaaggacatgatgctgggcaaggatgacaaggcctgggccatgtatgtggacaacaaccgcagctggttcatgcactgcaactcccacaccaacaggacggaaggtggcgtgtgcaagggggccaccgtgggcgtgctgctggacctgaataagcacactctcaccttcttcatcaacgggcagcagcagggccccacagccttcagccacgtggacggggtcttcatgccagccctcagcctcaaccgcaacgtgcaggtcaccctgcacacaggattggaagtgccgactaacctggggcggccaaagctgtcaggcaattagccccgctccagctcggcactgtgcctgtgacagtgacattcacaggcaaaacgcccaccattctcactaagctcaaataacccacaaaagcaggatatgcaaatcatgggtgcaacctggcagcgtggagtgtcatagaaacacattttcttggggacgcagggaatgggtccacgggccatgctcacagctgccactgtcagtggcaaaggaaggtacgtgtgtcacccttattccacccagacattacgaacactccccaagaaggacctttctcaagggagtcagcattcgggcttcatgtctatgtttcctgccatctgttttcaaagcttgtctttttttggagggagaggaaggtagactttgagactggcctcctgagagcggcagtcaggagctgcgctgtaatcccacgccccgggtgttggccctccgtggggaccttgcctcctcagagtcccgagattgcagattctcatcatgctgagaaagttatcttttagcttcttggtcctagagtctttagtagcacctgccacttgcagacccaatgcaggattgatagaaagggacattaatcattcatgcttgacttttgcctctctcactgaagtgttagaaccttttaaaatggcttcctttattaatcagccaattgtgttctctctctctcttcctccatccttcatttcttctccctccctccttctctttctctcttcttctctctctccttccttccctcctttgctctctctttcttcctttcctccttctctcttactttcctccatccctgcctctttcttccctctttcgctctctttccctccctccttctctctctctctcacacacacacaggcatgacagtctcctaaaattaattcactcagttcttagttcttaaatccacgtgaaaacacaagaattttaacaactatgtcataggtcttcgcctggtgatggctcctttctgaaactggcagcccaagaagttaactgaaaatgcatccagattgctcttctgagctgaaccactctcagactcataagcatttaaaatgggagaccctgggaaagcctgttctagtcagtccaccctattgtcattatgaaagcatcatgaacacaagtggcccctgtggcaggccgggacggctctgccctgatgcagtgggcgggatctctggggaaggcaggaaatagaagggcagtatcaggtaccttgtctcccagcttcccactgtgagactgggtgtgccgagtctgacctgccagggcaggactctggaaacaccaggcttctcccttgagatccacattgattcatccacacctctcagagacagctcatggcaggggttttgagcctgccaggctcttgttcccagggaacccttcctctcctccctcctctcatcttcccagtcacctgccacctccagctccacctggtagtaacatttctctctccttttaaaaagaatatattttgtcaagcattttatttctgaggctgagaagtgacttgtcaatttgctggactggatttttataaaattcgcccattcaccagca

SEQ ID NO: 1554 - DNA, 4399 bp, Homo sapiens
ctgctagaaatgcaaataacagaaggtggagggggtagggaacatgccttccagattattcctgtgggtactgatctgctagctaaattgagatgtactttatcaggctaaatggcttttctctccccgatcttttattgtttgtgatggagttgtcaaatatttgcatgcaatataaatacaatttttaggcagcgttgtgatatggatggtgcctgtatttaccagctcagcactgccagtgaaagatgtagaagataaacctgaacaacaaaccagaacaagagagactgacaaatcacccaccagtactgagcctcgacagcaaccaagtgccttatttgctagaggaaacaggaaagcggtcaaaagtccccaaagatcatcgagtaaaataaaagaaaacaagcatccatttgctctttatggctggggagaaaaacagaccgatacaggaagccagaagactcacaacgtctgtgcgtccgctcctgtgcacgagattcatgaatcagcattacgagccaagaacagaagacaggtggaaaaaaggaaactggttgctcaaaggcagcgagctcactctgtggatgtggagaagaacagaaagatgaaggcttcctcctcagagaacccgtggatgacagaatacatgaggtgctattcggcaagagcttaaagaaacacttgcgtggacagcctcttttaaaaagtgtaaatgactgaaaggaaaaacaaaacaaaaaccatcaaaagaaacggacacaggtttaagaaaccaactgattatgcaaggttttttttagggaatttgtaaaagattgttttattttgatgaatattggtcacctacctcggcagtagggcagacagttgaagccatagacatttggttatttatgaagataattccctaaatctttgatattcttataaggtttttgttttaaagcatcttaatcttttaagatactgacaccaaatgcctttaaatggcaacagatgcttacagttcagtattcttttcataagcttaggtagagcctattatcatcttgttctaaataactttccagattccatagctataagatcattccatcctacagcataagactcgttttccttatatgccgttttgtttgtgaaagaatatcaagtcaaaaatgagtgtcagcactactactgattccatgtataatgaaagtagaactttgctagttcctgaaaatttttaacttatttgtatttcagttcagcagcatctttatgtagattgtgatatttaagaattatctgggctgggcgagggtctctttttctctttcagtgatcatctaggcagttattatttaatagtttaatagctcaagtacattccaatagacgaagtgcacacaacacaatatgtgtgtacagtagtagtaaagtttcttttgagtagtcaaagactcactttttttattgcctttttttttttttttaaagaatacatactgtggattcagtcccttgtcacacttgaccttttggcatacacccactgtggacttttgcctcttctgtaatggctggcaatgacatttcaaacttacaatctggaattgcacttggtacattggcattgcttgttccactgggatggggaccagtgtgaagatgcctgttagatagactgcccacccctactttctctttttctttatagcacttaacaataacaaagtcttgatgatgtacagtattcaaactttaggttgaaatacgttactctttgattcctagccagtagatcttatctacactttaatgggagagaatggtggtgtgtgggtaggcacaaatttatgtaaatagtgctccttctctttagtatgtttgctttgggggtagaaaaatggttttaacaaacactggtttccatcaaatgaatgatgtcttctccatcctgtggagacaagaatctgctagaaggatatgtgctaagttccttataagagataatggtgctctgcctatgccagcttggcacccgaagatgtgtgagtggacgtgaggctgagtattaccttagtatttttctctgggtctttggaaaaccatagtcaatttttagaacatattgctttcattccccataaactcttcacacatgataactgtttaagctttgaaaacacatactgaagtattgtgagcttaaaaaaactttttaaatatttgcatagttttgaggtgaatttgtttccttacagatctctcctaatcattgagatgtatatttcaaaagaggaaattttacatgttgtccaaaacagccttgctagtaactggtgaattttggtattaactattattaaagtctttaaacgacacaggtacctaaagatcaccttaatgtggcaatttgtgatggtgtagctagctgattgtgaaaactgttcctttaaagtcgcttcttgcatgttcggtgttagtcatccagctcaggcttgtgttgcagctgacaatctaggaaagacggccttagagagtggtgcaggccccacactgacggactgccttagaaacccgacttcctctagactttgaaccgccagacttttctcttgtttagaaaacaaacttatatttaatgtacttactacttaaaactccagacagagatataatgtagaaggcaaatattggccaattttttcctctttttaagtggaagacaaatgaacgggatttttaaagtgcttttaaagtgcatgaatggttaataaatcagtatgaattgtaagccttcatcttacatccaagtccttagttggttagggtttcttttctttcttttttaaagagtgtcaattaccttttgaacctgtgaaaatttgatagttgttaacagtctgatggtcctaattctttcttttcattctagaaatgaatgtggttgtaatcatgttcctaattcttgggacaacctgcaagacagtgagacagtttaaaaattacctttcatgttgaaaaagtctgaaacagagaacccaatgatatttaaaataaatgctacataaaactctttttaaaattttgattttaacttaattaaaacaatgtcataaatatgctttttgattttgttactgcttttaatattaaagtaatagaatattgaagcaatattgtctagcactctgctggacattaagtccgcgggaggagaagtgaacaggaatcgattctttgtcttttaactgcccttagttaggagatgttaaaatacttggcacctctggttatatgtatgttatgtgtgttctcccccctaaaatttctaagcacatttattcacttttaaaatgaatctttaaaagattatagttagtagttatagttaatattctatttacttggaaaaatgtgaataaatggatcttcaaaagattcattttaaaaatgaataaatgtataataggctataggtgatcttacttgcgtattaggtaggaggcacatatttataccatttcatatgtaatatctttgtcattgtgtttcatcgaagatcaattgctagcaacttgaagggtatttatacttgggtcacttgaactcagctgactaaattgtaagaacgagagcaagcaagatggctgttattggaagccataacttccagaagataattctgcacaattcgtaagttaaaaaaaatctgtagggtcttccactatcctttttcaggttgataatgctgttctgggcacacactttgtaaatggaatgttatggtacagtcgcctctcagtatccatggggcattggttccaggcctcccttaggatgccaaactccatggatactcaaaccccttctataaaatggtgtagtatttgcatatatcctagacacatcctcctgtatgctttaaatcatctctagattacttaaaatacctaatacaatgtaaatgctctgtaaatagttgttatactatattgtttagggaataatgacaaggaaaaaaaagcctgtacatgttcagcacaagtgaaaccatcctttttgcccccaaatattttcaatttgtatttggttgaatccatggatgcagaactcacggatacagagggccgactgtactttctttaaagtgttcaaaagtattactagcaaagaggaggaggagcaaagcatatatcagaagtaaaacaatttttcttgttgactgctttggtaaaaaacagtttgatggatagttttacatttcactggactagataaaaaatggtgctaatatttatgtagcttgatgctatagttgctttggtatcaaacttaatacctaacccatataagatccttattatataattttgtgatcagtaaaatgatattttaaagagtg

SEQ ID NO: 1555 - DNA, 5089 bp, Homo sapiens
gtaggctgcgggcagcgaggagcggctggcgctcgaggcggcggacggcaccatgtccccggggagcggggtgaagagcgagtacatgaagcgctaccaggagccgcgctgggaggagtacgggccgtgctaccgcgagctgctgcactaccgcctaggccgccggctgctggagcaggcgcacgcgccctggctctgggacgactggggcccggccggctcctcggaggactcggcgtcgtcagagtcgtcgggcgccgggggccccgcaccccggtgcgccccgccctcgcccccgccgcccgtagagccggcgacccaggaggaggcggaacggcgggcgcgcggggccccggaggagcaggacgcggaggccggggacgcggaggccgaggacgcggaggacgcggctctgccagcactgccagtgaaagatgtagaagataaacctgaacaacaaaccagaacaagagagactgacaaatcacccaccagtactgagcctcgacagcaaccaagtgccttatttgctagaggaaacaggaaagcggtcaaaagtccccaaagatcatcgagtaaaataaaagaaaacaagcatccatttgctctttatggctggggagaaaaacagaccgatacaggaagccagaagactcacaacgtctgtgcgtccgctcctgtgcacgagattcatgaatcagcattacgagccaagaacagaagacaggtggaaaaaaggaaactggttgctcaaaggcagcgagctcactctgtggatgtggagaagaacagaaagatgaaggcttcctcctcagagaacccgtggatgacagaatacatgaggtgctattcggcaagagcttaaagaaacacttgcgtggacagcctcttttaaaaagtgtaaatgactgaaaggaaaaacaaaacaaaaaccatcaaaagaaacggacacaggtttaagaaaccaactgattatgcaaggttttttttagggaatttgtaaaagattgttttattttgatgaatattggtcacctacctcggcagtagggcagacagttgaagccatagacatttggttatttatgaagataattccctaaatctttgatattcttataaggtttttgttttaaagcatcttaatcttttaagatactgacaccaaatgcctttaaatggcaacagatgcttacagttcagtattcttttcataagcttaggtagagcctattatcatcttgttctaaataactttccagattccatagctataagatcattccatcctacagcataagactcgttttccttatatgccgttttgtttgtgaaagaatatcaagtcaaaaatgagtgtcagcactactactgattccatgtataatgaaagtagaactttgctagttcctgaaaatttttaacttatttgtatttcagttcagcagcatctttatgtagattgtgatatttaagaattatctgggctgggcgagggtctctttttctctttcagtgatcatctaggcagttattatttaatagtttaatagctcaagtacattccaatagacgaagtgcacacaacacaatatgtgtgtacagtagtagtaaagtttcttttgagtagtcaaagactcactttttttattgcctttttttttttttttaaagaatacatactgtggattcagtcccttgtcacacttgaccttttggcatacacccactgtggacttttgcctcttctgtaatggctggcaatgacatttcaaacttacaatctggaattgcacttggtacattggcattgcttgttccactgggatggggaccagtgtgaagatgcctgttagatagactgcccacccctactttctctttttctttatagcacttaacaataacaaagtcttgatgatgtacagtattcaaactttaggttgaaatacgttactctttgattcctagccagtagatcttatctacactttaatgggagagaatggtggtgtgtgggtaggcacaaatttatgtaaatagtgctccttctctttagtatgtttgctttgggggtagaaaaatggttttaacaaacactggtttccatcaaatgaatgatgtcttctccatcctgtggagacaagaatctgctagaaggatatgtgctaagttccttataagagataatggtgctctgcctatgccagcttggcacccgaagatgtgtgagtggacgtgaggctgagtattaccttagtatttttctctgggtctttggaaaaccatagtcaatttttagaacatattgctttcattccccataaactcttcacacatgataactgtttaagctttgaaaacacatactgaagtattgtgagcttaaaaaaactttttaaatatttgcatagttttgaggtgaatttgtttccttacagatctctcctaatcattgagatgtatatttcaaaagaggaaattttacatgttgtccaaaacagccttgctagtaactggtgaattttggtattaactattattaaagtctttaaacgacacaggtacctaaagatcaccttaatgtggcaatttgtgatggtgtagctagctgattgtgaaaactgttcctttaaagtcgcttcttgcatgttcggtgttagtcatccagctcaggcttgtgttgcagctgacaatctaggaaagacggccttagagagtggtgcaggccccacactgacggactgccttagaaacccgacttcctctagactttgaaccgccagacttttctcttgtttagaaaacaaacttatatttaatgtacttactacttaaaactccagacagagatataatgtagaaggcaaatattggccaattttttcctctttttaagtggaagacaaatgaacgggatttttaaagtgcttttaaagtgcatgaatggttaataaatcagtatgaattgtaagccttcatcttacatccaagtccttagttggttagggtttcttttctttcttttttaaagagtgtcaattaccttttgaacctgtgaaaatttgatagttgttaacagtctgatggtcctaattctttcttttcattctagaaatgaatgtggttgtaatcatgttcctaattcttgggacaacctgcaagacagtgagacagtttaaaaattacctttcatgttgaaaaagtctgaaacagagaacccaatgatatttaaaataaatgctacataaaactctttttaaaattttgattttaacttaattaaaacaatgtcataaatatgctttttgattttgttactgcttttaatattaaagtaatagaatattgaagcaatattgtctagcactctgctggacattaagtccgcgggaggagaagtgaacaggaatcgattctttgtcttttaactgcccttagttaggagatgttaaaatacttggcacctctggttatatgtatgttatgtgtgttctcccccctaaaatttctaagcacatttattcacttttaaaatgaatctttaaaagattatagttagtagttatagttaatattctatttacttggaaaaatgtgaataaatggatcttcaaaagattcattttaaaaatgaataaatgtataataggctataggtgatcttacttgcgtattaggtaggaggcacatatttataccatttcatatgtaatatctttgtcattgtgtttcatcgaagatcaattgctagcaacttgaagggtatttatacttgggtcacttgaactcagctgactaaattgtaagaacgagagcaagcaagatggctgttattggaagccataacttccagaagataattctgcacaattcgtaagttaaaaaaaatctgtagggtcttccactatcctttttcaggttgataatgctgttctgggcacacactttgtaaatggaatgttatggtacagtcgcctctcagtatccatggggcattggttccaggcctcccttaggatgccaaactccatggatactcaaaccccttctataaaatggtgtagtatttgcatatatcctagacacatcctcctgtatgctttaaatcatctctagattacttaaaatacctaatacaatgtaaatgctctgtaaatagttgttatactatattgtttagggaataatgacaaggaaaaaaaagcctgtacatgttcagcacaagtgaaaccatcctttttgcccccaaatattttcaatttgtatttggttgaatccatggatgcagaactcacggatacagagggccgactgtactttctttaaagtgttcaaaagtattactagcaaagaggaggaggagcaaagcatatatcagaagtaaaacaatttttcttgttgactgctttggtaaaaaacagtttgatggatagttttacatttcactggactagataaaaaatggtgctaatatttatgtagcttgatgctatagttgctttggtatcaaacttaatacctaacccatataagatccttattatataattttgtgatcagtaaaatgatattttaaagagtgatcttaaaaatatgacctggtcattgcacaacgtttgcatttgaaatgaatttgtgtactatagggtggatatggagttattcagtgcaagtgtgtgcttaatatcaaaccctatgcaaggagctatgtctagatttttggtccaaatttgcctccttcaagcctactagtgtgagatggaaaaaaatcgattgctcttttaatattatttccattttgaaattctcgacacttgaatgaaggcagtagaggcctctttttggatttctcttctaataacaaaactttatttagggaaggtttccctgtgctatcgtaagtttgttttgagcactgcattcactttaaaattctggaggaacaaaggctgggcacataatcacaaagcccaggccacacaataattcggggttgtattttctaagaactatgtattgtttttagcttatagttaatattgtatttacttggaaaaatgtgaataaagttaattaacattacaag

SEQ ID NO: 1556 - DNA, 2511 bp, Homo sapiens
ctacgtcccgcgtcccccgagcgctcggagcctacgcgcccagcgctaccgaaacccagagtcctgcgccctggagtccccgcgccccggagcccgagcacccgggagtcccgagcctcgcgccccggagtgcccgagcctgcgccgccgcacccggataccccgcgtccccgcgagctgccgaggccgcccgccgccgccccgcggacagtaccgccttcctcccctctgtccgcgccatggccgcccccgacctgtccaccaacctccaggaggaggccacctgcgccatctgcctcgactacttcacggatccggtgatgaccgactgcggccacaacttctgccgcgagtgcatccggcgctgctggggccagcccgagggcccgtacgcgtgccccgagtgccgcgagctgtccccgcagaggaacctgcggcccaaccgcccgcttgctaagatggccgagatggcgcggcgcctgcacccgccgtcgccggtcccgcagggcgtgtgccccgcgcaccgcgagccactggccgccttctgtggcgacgagctgcgcctcctgtgtgcggcctgcgagcgctctggggagcactgggcgcaccgcgtgcggccgctgcaggacgcggccgaagacctcaaggcgaagctggagaagtcactggagcatctccggaagcagatgcaggatgcgttgctgttccaagcccaggcggatgagacctgcgtcttgtggcagaagatggtggagagccagcggcagaacgtgctgggtgagttcgagcgtcttcgccgtttgctggcagaggaggagcagcagctgctgcagaggctggaggaggaggagctggaggtgctgccccggctgcgggagggcgcagcccacctaggccagcagagcgcccacctagctgagctcatcgccgagctcgagggccgctgccagctgcctgctctggggctgctgcaggacatcaaggacgccctgcgcagggtccaggatgtgaagctgcagcccccagaagttgtgcctatggagctgaggaccgtgtgcagggtcccgggactggtagagacactgcggaggtttcgaggtaggtgtggaggccccaggtggggagatgactccaggaggggacctgccaaggacctgggcagccagccacgtgttctgtgccctgccactgccagctccaaactcacagtgtcatggtggtgggttgttgggaaaacgtcctctgctcatacttctgacatcagttgtgtgggtattttcacaccaaacaattcttcaacttctggaaacgaattgggtatccaaggattccattcagcattgaacagaattgccagtgctgacactacaggagttagtacagaccccacagattaagggctcagtcccataagactgcccccacttcagatgccagtcacaacttccaggggctgcccatacttctgttccctcagcgcctctgcagatgtgagcattcgctagcacagcccatggaactcagaagagcactttacttactgtcattggtttattgtgaaggataccactcaggaagagccaaatggaagagacacatgggcaaagcctggggaagggctcagagctttcccaccctccctgggtgcaccttcccagcacctcagtgtgctcaccaacctggaaactccctgagccccaagagctgtttaggtgtctttgtggaggttccattacatggttatgattgattaaatcattggtcattggtgatggggctcaacctcagacccctttccccttcctgaggtcagaggctggggctgagtgttcccgccctctactgacaggattggtctttctggtggctggccttatgctgggctctcaggtccccacctcagccactgcagtggcatcaactcaggtgtgatggaaaggggcatcttatgatagcacaagatgcttctatcagtcaggaaattcccagggttctgtgagctctgcgccaggaactgggcacaaaacccaaatctgagtcttgtatcacagtcacccaaaggaagtactatcctcagctcttgctagcaggtcaggagcctgttgtgtaggaactgtgtgcaggcctccagaggtggatagatctgaaatcggagtggtcagggttgggacagctgccctaattcacatccttcatttggagattgaaaggaaaaacagactggatgcattggctcacctctgtaatcccagcactttgagaggctcaggcgggaggattgcttgaggccatcagttcaagaccaacccgggaaacatagcaagactcccatctctacaaataaaaaacaaaaaaatgagccagccatggtggcacacgcctgtaatcccagcagcttgggaggatctgaggcgggaggatcatttgagcccaggagatcaaggctgcagtgagccatgatcgcaccactgcactgcagcctggggccacagagcaagaccctgcctcttt

SEQ ID NO: 1557 - DNA, 2534 bp, Homo sapiens
caggatgcagaggccacggaggagggctgggccagcttctcctgtgagctgtcccacgaggatgaggaggtcgagtggtcgctcaacgggatgcccctgtacaacgacagcttccatgagatctcacacaagggccggcgccacacgctggtactgaagagcatccagcgggctgatgcgggcatagtacgcgcctcctccctgaaggtgtcgacctctgcccgcctggaggtccgagtgaagccggtggtgttcctgaaggcgctggatgacctgtccgcagaggagcgcggcaccctggccctgcagtgtgaagtctctgaccccgaggcccatgtggtgtggcgcaaagatggcgtgcagctgggccccagtgacaagtatgacttcctgcacacggcgggcacgcgggggctcgtggtgcatgacgtgagccctgaagacgccggcctgtacacctgccacgtgggctccgaggagacccgggcccgggtccgcgtgcacgatctgcacgtgggcatcaccaagaggctgaagacaatggaggtgctggaaggggaaagctgcagctttgagtgcgtcctgtcccacgagagtgccagcgacccggccatgtggacagtcggtgggaagacagtgggcagctccagccgcttccaggccacacgtcagggccgaaaatacatcctggtggtccgggaggctgcaccaagtgatgccggggaggtggtcttctctgtgcggggcctcacctccaaggcctcactcattgtcagagagaggccggccgccatcatcaagcccctggaagaccagtgggtggcgccaggggaggacgtggagctgcgctgtgagctgtcacgggcgggaacgcccgtgcactggctgaaggacaggaaggccatccgcaagagccagaagtatgatgtggtctgcgagggcacgatggccatgctggtcatccgcggggcctcgctcaaggacgcgggcgagtacacgtgtgaggtggaggcttccaagagcacagccagcctccatgtggaagaaaaagcaaactgcttcacagaggagctgaccaatctgcaggtggaggagaaaggcacagctgtgttcacgtgcaagacggagcaccccgcggccacagtgacctggcgcaagggcctcttggagctacgggcctcagggaagcaccagcccagccaggagggcctgaccctgcggctcaccatcagtgccctggagaaggcagacagcgacacctatacctgcgacattggccaggcccagtcccgggcccagctcctagtgcaaggtgaggcggccaagtgtgctcgggcctaggctttgaatggcacggagacttggaggtggacaggcccagcctcagtttcttatcatgagggtatagggggtgcaccctgggtggtcactgaggctccccagcatggctgtgaatgagctgctggtgctcacttactcgtgtgtttatttggtcactgtgtgtttctcccacatgccccgtgtgcctggcccccatgcgtaagctcagcgtgtatccgtacataaaacgtgtcacccttatcccagagggacagcctgactcagccgtgccaggcagcctcaggtgctcccagggaagaactgatggtcattagggttgtcattgagagttacagtggcattttagtctttttcttgttgtttacaacagaatacctgaaactgggtaatttataaaggaaataaatttacttcttacagctctggaggctgggaagtccaaggtcaaggggccacatctggtgagggcccttttgctgacaggaactctctgcagagtccccaagggacggcacagggcatcccatggggagggggctgagtgtgctagcttgggcctctcttcatcttcttttaaagccaccactcatatggaagcactttaacccattaacctgttaacccgttgatccatgaatgggttaatccattcccgccttggacccaatcccctcttaaaggctccacctcttaatattgccacattgggattaagtttcaacatgagtttccagggggacattcagatcatagtaggtggctgttcgatcttactgtttggctccacatttgagtggcaggcagagtgagagctgtcattctctcaactctgtagataagaaaactgaagctttagtgggtccatggccagggcaaggtcatcaggcacattgggatcagagcaggcgaggcccagccccatcaccgcagccttcacttggctctgaagtcccgggctggtgtccagagctgagtttgcaggaggtccctactggggtctgaccacagggcgttcacagggttcagtatttgaaaggccccagttgtgatcatcagaagtaacgtaaaccaggaatcatcactgattttttctctccaatggatttggtgaccctggtgaaagtattctgttagcacagtaacgccccatgatctaataaagttggtacccagagttaatttttaaaaaagtc

SEQ ID NO: 1558 - DNA, 2712 bp, Homo sapiens
ctgacaacgtgcgcatccgccaggaaggaaggacatacactctcatctaccggagagtcctggcggaagatgcaggagagatccaatttgtagccgaaaatgcagaatcgcgagcccagctccgagtgaaggagctgccagtgaccctcgtgcgcccgctgcgggacaagattgccatggagaagcaccgcggtgtgctggagtgtcaggtgtcccgggccagcgcccaggtgcggtggttcaagggcagtcaggagctgcagcccgggcccaagtacgagctggtcagtgatggcctctaccgcaagctgatcatcagtgatgtccacgcagaggacgaggacacctacacctgtgacgccggtgatgtcaagaccagtgcacagttcttcgtggaagagcaatccatcaccattgtgcggggtctgcaggacgtgacagtgatggagcccgctcctgcctggtttgagtgtgagacctccatcccctcagtgcggccacctaagtggctcctggggaagacggtgttgcaggctggggggaacgtgggcctggagcaggagggcacggtgcaccggctgatgctgcggcggacctgctccaccatgaccgggcccgtgcacttcaccgttggcaagtcgcgctcctctgcccgcctggtggtctcagacatccccgtagtcctcacacggccgttggagcccaagacagggcgtgagctgcagtcagtggtcctgtcctgcgacttccggccagcccccaaggctgtgcagtggtacaaggatgacacgcccctgtctccctctgagaagtttaagatgagcctggagggtcagatggctgagctgcgcatcctccggctcatgcctgctgatgctggtgtctaccggtgccaggcgggcagtgcccacagcagcactgaggtcactgtggaagcgcgggaggtgacagtgacagggccgctacaggatgcagaggccacggaggagggctgggccagcttctcctgtgagctgtcccacgaggatgaggaggtcgagtggtcgctcaacgggatgcccctgtacaacgacagcttccatgagatctcacacaagggccggcgccacacgctggtactgaagagcatccagcgggctgatgcgggcatagtacgcgcctcctccctgaaggtgtcgacctctgcccgcctggaggtccgagtgaagccggtggtgttcctgaaggcgctggatgacctgtccgcagaggagcgcggcaccctggccctgcagtgtgaagtctctgaccccgaggcccatgtggtgtggcgcaaagatggcgtgcagctgggccccagtgacaagtatgacttcctgcacacggcgggcacgcgggggctcgtggtgcatgacgtgagccctgaagacgccggcctgtacacctgccacgtgggctccgaggagacccgggcccgggtccgcgtgcacgatctgcacgtgggcatcaccaagaggctgaagacaatggaggtgctggaaggggaaagctgcagctttgagtgcgtcctgtcccacgagagtgccagcgacccggccatgtggacagtcggtgggaagacagtgggcagctccagccgcttccaggccacacgtcagggccgaaaatacatcctggtggtccgggaggctgcaccaagtgatgccggggaggtggtcttctctgtgcggggcctcacctccaaggcctcactcattgtcagagagaggccggccgccatcatcaagcccctggaagaccagtgggtggcgccaggggaggacgtggagctgcgctgtgagctgtcacgggcgggaacgcccgtgcactggctgaaggacaggaaggccatccgcaagagccagaagtatgatgtggtctgcgagggcacgatggccatgctggtcatccgcggggcctcgctcaaggacgcgggcgagtacacgtgtgaggtggaggcttccaagagcacagccagcctccatgtggaagaaaaagcaaactgcttcacagaggagctgaccaatctgcaggtggaggagaaaggcacagctgtgttcacgtgcaagacggagcaccccgcggccacagtgacctggcgcaagggcctcttggagctacgggcctcagggaagcaccagcccagccaggagggcctgaccctgcggctcaccatcagtgccctggagaaggcagacagcgacacctatacctgcgacattggccaggcccagtcccgggcccagctcctagtgcaaggtgaggcggccaagtgtgctcgggcctaggctttgaatggcacggagacttggaggtggacaggcccagcctcagtttcttatcatgagggtatagggggtgcaccctgggtggtcactgaggctccccagcatggctgtgaatgagctgctggtgctcacttactcgtgtgtttatttggtcactgtgtgtttctcccacatgccccgtgtgcctggcccccatgcgtaagctcagcgtgtatccgtacataaaacgtgtcacccttatcccagagggacagcctgactcagccgtgccaggcagcctcaggtgctcccagggaagaactgatggtcattagggttgtcattgagagttacagtggcattttagtctttttcttgttgtttacaacagaatacctgaaactgggtaatttataaaggaaataaa

SEQ ID NO: 1559 - DNA, 25575 bp, Homo sapiens
gctgcccagagcccccatagagagaggtccccgccgccaccctcatggatcagccacagttcagcggggcgccccgctttctcacccggcccaaggccttcgtggtgtcggtgggcaaggacgccaccctcagctgccagatcgtgggtaatcccacgccacaggtgagctgggagaaggaccagcagccggtggcggccggcgcgcgcttccgtctggcccaggacggcgacctctaccgcctcactatcctggacctggcgctgggcgacagtgggcaatacgtgtgccgcgcgcgcaatgccataggcgaggccttcgctgctgtgggcctgcaggtggacgcggaggccgcgtgcgccgagcaggcgccgcacttcctgctgcggcccacgtccatccgcgtgcgcgagggctcagaggccaccttccgctgccgcgtgggtggctccccgaggccggcagtgagctggtccaaggacgggcggcgcctgggtgagcccgacggcccccgcgtgcgcgtggaggagctcggcgaggcaagtgcgctgcgcattcgggcggcgcggccgcgcgacggcggcacttacgaggtccgcgccgagaacccgctgggcgctgccagcgccgccgcggcgctagtggtggactcggacgccgcggacacggccagccggcccgggacctccacggccgcgctcctggcgcacctgcagcggcggcgcgaggctatgcgcgccgagggcgcccccgcctcaccgcccagcaccggcacgcgcacctgcacggtgactgaaggcaagcacgcgcgcctcagctgctacgtgaccggcgagcccaagcccgagacggtgtggaagaaggacggccagctggtgaccgagggccggcgccacgtggtgtacgaggacgcgcaggagaacttcgtgctcaagatcctcttctgcaagcagtcggaccgcggcctctacacctgcacggcgtccaacctcgtgggccagacctacagctctgtgctggtcgtagtgcgcgagcccgcggttcccttcaaaaagcggctgcaagatctggaggtgcgggagaaggagtcggccacgttcctatgtgaggtgccccagccgtccactgaggccgcgtggttcaaggaggagacgcggttgtgggcgagcgccaagtacggcatcgaggaggagggcaccgagcgccgcctgaccgtgcgcaatgtctcggccgacgacgacgcggtgtacatctgcgagacgccagagggcagccgcacggtggcggagctcgcagtccaaggaaacctcctccgaaagctccctcggaagacggcggtgcgcgtgggcgacacggctatgttttgcgtggagctggcggtcccggtgggccccgtccactggctgcggaaccaggaggaagtggtggcggggggccgcgtggccatctccgcggagggcacgcgccacacactaaccatctcccagtgctgcctggaggatgtgggccaggtggcctttatggctggcgactgccagacgtccacccagttctgcgtgtcggcccccaggaagcctcccctgcaaccccctgtggatcctgtggtaaaggccaggatggagagttccgtgattctcagctggtccccaccaccccatggggaacgccctgtcactatcgacggctacctggtagagaagaagaagcttggcacctacacctggatcaggtgccacgaggctgaatgggtggctacacctgagctgaccgtggctgatgtggcggaggaggggaacttccagttccgagtgtccgctctcaacagctttggtcagagtccctacctcgagttcccggggactgtccacctggcccccaagctggccgtgaggacaccgctgaaggcggtgcaggcggtagagggtggcgaggtcactttctccgtggacctcacggtggcctcagcgggtgagtggttcctggatgggcaggccctgaaggccagcagtgtgtatgagatccactgtgatcgcacccggcacacgctcaccatccgggaggtgcccgccagcctgcacggggcgcagctgaagttcgtggccaacggcattgagagcagcatccggatggaggtccgggcggccccagggctgactgccaacaagccgccagccgcagctgcccgggaggtgctggctcggctgcacgaggaggcgcagctgctggctgagctgtcagatcaggctgcggctgtgacgtggctgaaggatggtcgcacactgtccccaggccccaagtatgaggtgcaggcatcggccgggcggcgggtgctccttgtgcgagatgtggcccgggacgatgcaggcctctacgagtgcgtcagccgcgggggccgcatcgcctaccagctctccgtgcaaggcctcgcgcgctttctgcacaaggacatggcgggcagctgtgtggatgccgtggctgggggcccggcgcagtttgagtgtgagacctccgaagcccacgtccacgtgcactggtacaaggatggcatggagctgggccactccggtgagcgcttcttgcaggaggatgtggggacgcggcaccggctggtggcagccacagtcaccaggcaggatgaaggcacctactcctgccgcgtgggcgaggactctgtggacttccggctccgcgtctctgagcccaaggtggtgtttgctaaggagcagctggcacgcaggaagctgcaggcagaggcaggagccagtgccacactgagctgcgaggtggcccaggcccagacggaggtgacgtggtacaaggatgggaagaagctgagctccagctcgaaagtgtgcatggaggccacaggctgcacgcgcaggctggttgtgcagcaggcaggccaggcggatgccggggagtatagctgcgaggctgggggccagcggctctccttccatctggatgtcaaagagcccaaggtggtgtttgccaaggaccaggtggcacacagtgaggtgcaggctgaggcaggggccagtgccacgctgagctgcgaggtggcccaggcccagacggaggtgatgtggtacaaagatgggaagaagctgagctccagcttgaaagtgcatgtagaggccaagggctgcagacggaggctggtggtgcagcaggcaggcaagacagatgccggggactacagctgcgaggccaggggccagagggtctccttccgcctgcacatcacagagcccaagatgatgtttgcaaaggagcagtcagtgcataatgaggtgcaggctgaggcgggggccagtgccatgctgagctgtgaggtggcccaggcccagacggaggtgacgtggtacaaggatgggaagaagctgagctccagctcaaaagtgggcatggaggtcaaagggtgcacacggaggctggtgctgccacaggcgggcaaagcagatgctggggagtacagctgtgaggctgggggccagagagtctccttccacctgcacatcacagagcccaagggggtgtttgcgaaggagcagtcagtgcataatgaggtgcaggctgaggcggggaccactgccatgctgagctgtgaggtggcccagccccagacagaggtgacgtggtacaaggacgggaagaagctgagctccagctcaaaagtacgcatggaggtcaagggctgcacacgaaggctggtagtgcagcaggtgggcaaagcagatgctggggagtacagctgcgaggctgggggccagagagtctcctttcaactgcacatcacagagcccaaggcagtgtttgccaaggagcagttggtgcataatgaggtgcggactgaggcaggggccagtgccacactgagctgtgaggtggcccaggcccagacagaggtgacgtggtacaaggatgggaagaagctgagctccagttcgaaagtgcgcatagaggctgcgggctgcatgcggcagctggtggtgcagcaggcaggccaggcagatgctggggagtacacctgtgaggctgggggccagcggctctccttccacctggatgtttcagagcccaaggcggtgtttgcaaaggagcagctggcacacaggaaggtgcaggccgaggcgggggccattgccacgctgagctgcgaggtggcccaggcccagacagaggtgacgtggtacaaggacgggaagaagctgagctccagctcgaaagttcgaatggaggctgtgggctgcacacggaggctggtggtgcagcaggcatgccaggcggacaccggggagtatagctgcgaggccgggggccagcggctctccttcagcctggacgtggcagagcccaaggtggtgtttgccaaggagcagccagtgcacagggaggtgcaggcccaggcgggggccagcaccacactcagctgcgaggtggctcaggcccagacggaggtgatgtggtacaaggacgggaagaagctgagcttcagctcgaaagtgcgcatggaggctgtgggctgcacacggaggctggtggtgcagcaggcgggccaggcggtcgccggggagtacagctgcgaggcggggagccagcggctctccttccacctgcacgtggcagagcccaaggcggtgtttgccaaggagcagccagcgagcagggaggtgcaggctgaggcggggaccagtgccacgctgagctgcgaggtggcccaggcccagacagaggtgacgtggtacaaggacgggaagaaactgagctccagctcgaaagtgcgaatggaggccgtgggctgcacacggaggctggtggtgcaggaggcaggccaggcggacgccggggagtacagctgcaaggccggggatcagcggctgtccttccacctgcacgtggcagagcccaaggtggtgtttgccaaggagcagccagcacacagggaggtgcaggctgaggcgggggccagtgccacgctgagctgcgaggtggcccaggcccagacagaggtgacgtggtacaaggatgggaagaagctgagttccagctcgaaagtgcgcgtggaggccgtgggctgcacacggaggctggtggtgcagcaggcgggccaggcagaggccggggagtacagctgcgaggcagggggtcagcagctctccttccgcctgcaggtggcagagctggagccccaaatttcagagagaccctgccgcagggagcctctggtggtcaaggagcatgaagacatcatcctgaccgccacactggccacaccctctgcggccacggtgacctggctcaaggatggtgtggagattcgccgcagcaagcggcatgagacagccagccagggggacacccacaccctgaccgtgcatggcgcccaggttctggacagcgccatctacagctgccgtgtgggcgcagaggggcaggacttcccagtgcaggtggaagaggtggccgccaagttctgccggctgctggagcctgtgtgcggcgagctgggtggcacggtgacactggcctgcgagctaagcccagcgtgtgcagaggtggtgtggcgctgcggcaacacgcagcttcgggtgggcaagcgcttccagatggtggccgaggggcccgtgcgctcactcactgtgttggggctgcgcgcagaggacgcaggggagtacgtgtgtgagagccgtgatgaccacaccagtgcgcagctcaccgtcagtgtgccccgagtggtgaagtttatgtctgggctgagcaccgtggtcgcagaggagggcggcgaggccaccttccagtgcgtggtgtcccccagtgatgtggcagtcgtgtggttccgggacggtgccctgcttcagcccagcgagaagtttgccatatcacagagtggcgccagccacagcctgaccatctcagacctggtgctggaggacgcgggccagatcaccgtggaggctgagggcgcctcatcctctgctgccctgagggtccgagaggcgcctgtgctgttcaaaaagaagctggagccgcagacggtggaggagcggagctcggtgaccctggaggtggagctgacgcggccgtggccggagctgaggtggacacggaacgcgacggccctggcgccgggaaagaacgtggagatccacgccgagggcgcccgccaccgcctggttctgcacaacgtaggttttgccgaccgtggcttctttggctgcgagacgccggatgacaagacacaggccaaactcaccgtggagatgcgccaggtacggctcgtacggggcctgcaggcagtggaggcacgggagcagggcacggctaccatggaggtgcagctgtcgcatgcggacgtggatggcagctggactcgtgacggtctgcggttccagcaggggcccacgtgccacctggctgtgcggggccccatgcacaccctcacactctcggggctgcggccagaggatagtggccttatggtcttcaaggccgaaggagtgcacacgtcggcgcggctcgtggtcaccgagcttcccgtgagcttcagccgcccgctgcaggacgtggtgaccactgagaaggagaaggttaccctggagtgcgagctgtcgcgtcctaatgtggatgtgcgctggctgaaggacggtgtggagctgcgggcaggcaagacgatggccatcgcagcccagggcgcctgcaggagcctcaccatttaccggtgcgagttcgcggatcagggagtgtatgtgtgtgatgcccatgatgcccagagctctgcctccgtgaaggtacaaggaaggacatacactctcatctaccggagagtcctggcggaagatgcaggagagatccaatttgtagccgaaaatgcagaatcgcgagcccagctccgagtgaaggagctgccagtgaccctcgtgcgcccgctgcgggacaagattgccatggagaagcaccgcggtgtgctggagtgtcaggtgtcccgggccagcgcccaggtgcggtggttcaagggcagtcaggagctgcagcccgggcccaagtacgagctggtcagtgatggcctctaccgcaagctgatcatcagtgatgtccacgcagaggacgaggacacctacacctgtgacgccggtgatgtcaagaccagtgcacagttcttcgtggaagagcaatccatcaccattgtgcggggtctgcaggacgtgacagtgatggagcccgctcctgcctggtttgagtgtgagacctccatcccctcagtgcggccacctaagtggctcctggggaagacggtgttgcaggctggggggaacgtgggcctggagcaggagggcacggtgcaccggctgatgctgcggcggacctgctccaccatgaccgggcccgtgcacttcaccgttggcaagtcgcgctcctctgcccgcctggtggtctcagacatccccgtagtcctcacacggccgttggagcccaagacagggcgtgagctgcagtcagtggtcctgtcctgcgacttccggccagcccccaaggctgtgcagtggtacaaggatgacacgcccctgtctccctctgagaagtttaagatgagcctggagggtcagatggctgagctgcgcatcctccggctcatgcctgctgatgctggtgtctaccggtgccaggcgggcagtgcccacagcagcactgaggtcactgtggaagcgcgggaggtgacagtgacagggccgctacaggatgcagaggccacggaggagggctgggccagcttctcctgtgagctgtcccacgaggatgaggaggtcgagtggtcgctcaacgggatgcccctgtacaacgacagcttccatgagatctcacacaagggccggcgccacacgctggtactgaagagcatccagcgggctgatgcgggcatagtacgcgcctcctccctgaaggtgtcgacctctgcccgcctggaggtccgagtgaagccggtggtgttcctgaaggcgctggatgacctgtccgcagaggagcgcggcaccctggccctgcagtgtgaagtctctgaccccgaggcccatgtggtgtggcgcaaagatggcgtgcagctgggccccagtgacaagtatgacttcctgcacacggcgggcacgcgggggctcgtggtgcatgacgtgagccctgaagacgccggcctgtacacctgccacgtgggctccgaggagacccgggcccgggtccgcgtgcacgatctgcacgtgggcatcaccaagaggctgaagacaatggaggtgctggaaggggaaagctgcagctttgagtgcgtcctgtcccacgagagtgccagcgacccggccatgtggacagtcggtgggaagacagtgggcagctccagccgcttccaggccacacgtcagggccgaaaatacatcctggtggtccgggaggctgcaccaagtgatgccggggaggtggtcttctctgtgcggggcctcacctccaaggcctcactcattgtcagagagaggccggccgccatcatcaagcccctggaagaccagtgggtggcgccaggggaggacgtggagctgcgctgtgagctgtcacgggcgggaacgcccgtgcactggctgaaggacaggaaggccatccgcaagagccagaagtatgatgtggtctgcgagggcacgatggccatgctggtcatccgcggggcctcgctcaaggacgcgggcgagtacacgtgtgaggtggaggcttccaagagcacagccagcctccatgtggaagaaaaagcaaactgcttcacagaggagctgaccaatctgcaggtggaggagaaaggcacagctgtgttcacgtgcaagacggagcaccccgcggccacagtgacctggcgcaagggcctcttggagctacgggcctcagggaagcaccagcccagccaggagggcctgaccctgcggctcaccatcagtgccctggagaaggcagacagcgacacctatacctgcgacattggccaggcccagtcccgggcccagctcctagtgcaaggccggagagtgcacatcatcgaggacctggaggatgtggatgtgcaggagggctcctcggccaccttccgttgccggatctccccggccaactacgagcctgtgcactggttcctggacaagacacccctgcatgccaacgagctcaatgagatcgatgcccagcccgggggctaccacgtgctgaccctgcggcagctggcgctcaaggactcgggcaccatctactttgaggcgggtgaccagcgggcctcggccgccctgcgggtcactgagaagccaagcgtcttctcccgggagctcacagatgccaccatcacagagggtgaggacttgaccctggtgtgcgagaccagcacctgcgacattcctgtgtgctggaccaaggatgggaagaccctgcgggggtctgcccggtgccagctgagccatgagggccaccgggcccagctgctcatcactggggccaccctgcaggacagtggacgctacaagtgtgaggctgggggcgcctgcagcagctccattgtcagggtgcatgcgcggccagtgcggttccaggaggccctgaaggacctggaggtgctggagggtggtgctgccacactgcgctgtgtgctgtcatctgtggctgcgcccgtgaagtggtgctatggaaacaacgtcctgaggccaggtgacaaatacagcctacgccaggagggtgccatgctggagctggtggtccggaacctccggccgcaggacagcgggcggtactcatgctccttcggggaccagactacttctgccaccctcacagtgactgccctgcctgcccagttcatcgggaaactgagaaacaaggaggccacagaaggggccacggccacgctgcggtgtgagctgagcaaggcagcccctgtggagtggagaaaggggtccgagaccctcagagatggggacagatactgtctgaggcaggacggggccatgtgtgagctgcagatccgtggcctggccatggtggatgccgcggagtactcgtgtgtgtgtggagaggagaggacctcagcctcactcaccatcaggcccatgcctgcccacttcataggaagactgagacaccaagagagcatagaaggggccacagccacgctgcggtgtgagctgagcaaggcggcccccgtggagtggaggaaggggcgtgagagcctcagagatggggacagacatagcctgaggcaggacggggctgtgtgcgagctgcagatctgtggcctggctgtggcagatgctggggagtactcctgtgtgtgtggggaggagaggacctctgccactctcaccgtgaaggccctgccagccaagttcacagagggtctgaggaatgaagaggccgtggaaggggccacagccatgttgtggtgtgaactgagcaaggtggcccctgtggagtggaggaaggggcccgagaacctcagagatggggacagatacatcctgaggcaggaggggaccaggtgtgagctgcagatctgtggcctggccatggcggacgccggggagtacttgtgtgtgtgcgggcaggagaggacctcagccacgctcaccatcagggctctgcctgccaggttcatagaagatgtgaaaaaccaggaggccagagaaggggccacagctgtgctgcagtgtgagctgaacagtgcagcccctgtggagtggagaaaggggtctgagacccttagagatggggacagatacagcctgaggcaggacgggactaaatgtgagctgcagattcgtggcctggccatggcagacactggggagtactcgtgcgtgtgcgggcaggagaggacctcggctatgctcaccgtcagggctctacccatcaagttcacagagggtctgaggaacgaagaggccacagaaggggcaacagccgtgctgcggtgtgagctgagcaagatggcccccgtggagtggtggaaggggcatgagaccctcagagatggagacagacacagcctgaggcaggacggggccaggtgtgagctgcagatccgcggcctcgtggcagaggacgctggggagtacctgtgcatgtgcgggaaggagaggacctcagccatgctcaccgtcagggccatgccttccaagttcatagagggtctgaggaatgaagaggccacagaaggggacacggccacgctgtggtgtgagctgagcaaggcggcaccggtggagtggaggaaggggcatgagaccctcagagatggggacagacacagcctgaggcaggacgggtccaggtgtgagctgcagatccgtggcctggctgtggtggatgccggggagtactcgtgtgtgtgcgggcaggagaggacctcagccacactcactgtcagggccctgcctgccagattcatagaagatgtgaaaaaccaggaggccagagaaggggccacggccgtgctgcaatgtgagctgagcaaggcggcccccgtggagtggaggaaggggtctgagaccctcagaggtggggacagatacagcctgaggcaggatgggaccagatgtgagctgcagattcatggcctgtctgtggcagacactggggagtactcgtgtgtgtgcgggcaggagaggacctcggccacactcaccgtcagggccctgcctgcacgattcactcaagatctgaagaccaaggaggcctcagaaggggccacagctacactgcagtgtgagctgagcaaggtggcccctgtggaatggaagaagggtcctgagaccctcagagatgggggcagatacagcctgaagcaggatgggacgaggtgtgagctgcagatccatgacctgtctgtggcggatgctggggaatactcatgcatgtgtggacaagagaggacctcggccacgctcactgtcagggccctgcctgccaggttcacagagggtctgaggaatgaagaggccatggaaggggccacagccacactgcaatgtgagctgagcaaggcagcccctgtggagtggaggaaaggccttgaggctctcagagatggggacaaatacagcctgagacaagacggggctgtgtgtgagctgcagattcatggcctggctatggcagataacggggtgtactcatgtgtgtgtgggcaggagaggacctcagctacactcactgtcagggccctgcctgccagattcatagaggatatgagaaaccagaaggccacagaaggggctacagtcacattgcaatgtaagctgagaaaggcggcccccgtggagtggagaaaggggcccaacaccctcaaagatggggacaggtacagcctgaagcaggatgggaccagttgtgagctgcagattcgtggcctggtcatagcagatgctggagaatactcgtgcatatgtgagcaggagaggacctcggccacgctcactgtcagggccctgccggccagattcatagaagatgtgagaaatcacgaggccacagaaggggccacagctgtgctgcagtgtgagctgagcaaggcggcccccgtggagtggcggaaggggtctgagaccctcagagatggggacagatatagcctgaggcaggacgggacgaggtgtgagctgcagattcgtggcctggctgtggaggacactggagagtatttgtgtgtgtgcgggcaggagagaacctcagctacactcactgtcagggccctgccagccagattcatagacaacatgacaaaccaggaggccagagaaggggccacggccacactgcactgtgaactgagcaaggtggcccctgtggagtggaggaagggacctgaaaccctccgagatggggacagacacagcctgaggcaggatgggaccaggtgtgagctgcagattcgtggcctgtctgtggcagatgccggggagtactcgtgcgtgtgtgggcaggagaggacctcagccacactcacgatcagggaggccacagaaggggccacggctatgttgcagtgtgagctgagcaaggtggcccctgttgagtggaggaagggacctgaaaccctcagagatggggacagatacaacctgaggcaggatgggaccagatgtgagctgcagattcatggcctgtccgtggcagacactggggagtactcatgtgtatgtggtcaggagaagacgtcggccactctcactgtcaaggccccacagccagtgttccgggagccgctgcagagtctgcaggcggaggagggctccacggccaccctgcagtgtgagctgtctgagcccactgctacagtggtctggagcaagggtggcctgcagctgcaggccaatgggcgccgggagccacggcttcagggctgcaccgcggagctggtgttacaggacctacaacgtgaagacactggcgaatacacttgcacctgtggctcccaggccaccagtgccaccctcactgtcacagctgcgcctgtgcggttcctccgagagctgcagcaccaggaggtggatgagggaggcaccgcacacttatgctgcgagctgagccgggcgggtgcgagcgtggagtggcgcaagggctccctacagctcttcccttgtgccaagtaccagatggtgcaggatggtgcagctgcagagctgctggtacgcggagtggagcaggaggatgcgggtgactacacgtgtgacacgggccacacgcagagcatggccagcctctctgtccgtgtccccaggcccaagttcaagacccggcttcagagtctggagcaggagacaggtgacatagcccggctgtgctgtcagctgagtgatgcagagtcgggggccgtggtgcaatggctcaaggagggcgtggagctgcatgcgggccccaagtacgagatgcggagccagggggccacgcgggagctgctgatccaccaactggaggccaaggacacgggcgagtatgcctgtgtgacaggcggccagaaaaccgctgcctccctcagggtcacagagcctgaggtgaccattgtacgggggctggttgatgcggaggtgacggccgatgaggatgttgagttcagctgtgaggtgtccagggctggagccacaggcgtgcagtggtgcctacagggcctgccactgcaaagcaatgaggtgacagaggtggctgtgcgggatggccgcatccacaccctgcggctgaagggcgtgacgcccgaggacgctggcactgtctccttccatttgggaaaccatgcttcctctgcccagctcaccgtcagagctcctgaggtgaccatcctggagcccctgcaggacgtgcagctcagtgagggccaggatgccagcttccagtgccggctatccagagcttcaggccaggaggcccgctgggctttaggaggggtgcccctgcaggccaacgagatgaatgacatcactgtggagcagggcacactccacctgctcaccctgcacaaggtgacccttgaggatgctggaactgtcagtttccacgtgggcacgtgtagctctgaggcccagctgaaagtcacagccaagaacacggtggtgcgggggctggagaatgtggaggcgctggagggcggcgaggcgctgttcgagtgccagctgtcccagcccgaggtggccgcccacacctggctgctggacgacgaacccgtgcacacctcggagaacgccgaggtggtcttcttcgagaacggcctgcgccacctgctgctgctcaaaaacttgcggccacaagacagctgccgggtgaccttcctggctggggatatggtgacgtccgcattcctcacggtccgaggctggcgcctggagatcctggagcctctgaaaaacgcggcggtccgggccggcgcacaggcatgcttcacctgcacgctcagcgaggcggtgcccgtgggagaggcgtcctggtacatcaatggcgcggcagtgcagccggatgacagcgactggactgtcaccgccgacggcagtcaccacgccctactgctgcgcagcgcccagccccaccacgccggggaggtcaccttcgcttgccgcgacgccgtggcctctgcgcggctcaccgtgctgggcctccctgatcccccagaggatgctgaggtggtggctcgcagcagccacactgtgacactgtcttgggcagctcccatgagtgatggaggcggtggtctctgtggctaccgcgtggaggtgaaggagggggccacaggccagtggcggctgtgccacgagctggtgcctggacccgagtgtgtggtggatggcctggcccccggggagacctaccgcttccgtgtggcagctgtgggccctgtgggtgctggggaaccggttcacctgccccagacagtgcggcttgcagagccaccgaagcctgtgcctccccagccctcagcccctgagagccggcaggtggcagctggtgaagatgtctctctggagcttgaggtggtggctgaggctggtgaggtcatctggcacaagggaatggagcgcatccagcccggtgggcggttcgaggtggtctcccagggtcggcaacagatgctggtgatcaagggcttcacggcagaagaccagggcgagtaccactgtggcctggctcagggctccatctgccctgcggctgccaccttccaggtggcactgagcccagcctctgtggatgaggcccctcagcccagcttgccccccgaggcagcccaggagggtgacctgcacctactgtgggaggccctggctcggaaacgtcgcatgagccgtgagcccacgctggactccattagcgagctgccagaggaggacggccgctcgcagcgcctgccacaggaggcagaggaggtggcacctgatctctctgaaggctactccacggccgatgagctggcccgcactggagatgctgacctctcacacaccagctctgatgatgagtcccgggcaggcaccccttccctggtcacctacctcaagaaggctgggaggccaggcacctcaccactggccagcaaggttggggccccagcagccccctctgtgaagccacagcagcagcaggagccactggctgctgtgcgcccaccactgggagacctgagcaccaaagacctgggtgatccctcaatggacaaggcagctgtgaagatccaggctgcctttaagggctacaaggtccggaaggagatgaagcagcaggaagggcccatgttctcccacacatttggggacaccgaggcacaggtgggggatgccctgcggctggagtgtgtcgtggccagcaaggcagatgtgcgagcccgctggctgaaggatggtgtggagctgaccgatgggcggcaccatcacatcgaccagcttggggatggcacctgctctctgctgatcactggcctggaccgtgctgatgctggctgctacacctgtcaggtgagcaacaagtttggccaggtgacccacagtgcctgtgtggtggtcagtgggtcagagagtgaagccgagagctcctctgggggtgagctggacgatgccttccgccgggctgcccgtcggctgcaccggctcttccgcaccaaaagtccggctgaagtttcagatgaggagctcttcctgagtgcagacgagggccctgcagagccagaggagcccgcggactggcagacataccgcgaagatgagcatttcatctgcatccgttttgaggcgctcactgaggcccgccaggcggtaactcgcttccaggagatgtttgccacactgggcattggggtggagatcaagctggtggaacaggggcctcggagggtagagatgtgcatcagcaaagagactcctgcccctgtggtgcctccagagccattgcccagcctactgacttctgacgctgccccagtgttcctgactgagttgcagaaccaagaagtgcaggatgggtatcctgtgagctttgactgcgtggtgacaggtcagcccatgcccagtgtgcgctggttcaaggatgggaagttgttggaggaggatgatcactacatgattaatgaagaccaacagggtggccatcagctcatcatcacagccgtggtgccagcagacatgggcgtctaccgctgcctggccgagaacagcatgggtgtctcctccaccaaggctgagctccgtgtggacttgacaagcacagactatgacactgcagcagatgccacggagtcctcatcctacttcagtgcccaaggctacctgtccagccgggagcaggagggaacagagtccaccactgatgagggccagctgccccaggtggtggaggagctgagagacctccaggtggcccctggcacacgcctggccaagttccagctcaaggtgaaaggctaccctgctcccagattatactggttcaaagatggccagcccctgaccgcatctgcccacatccgcatgactgacaagaagatcctgcacaccctggagatcatctccgtcacccgggaggactctggccagtatgcagcctatatcagcaatgccatgggtgctgcctactcgtctgcccggctgctggttcgaggccctgatgagccagaagagaagcctgcatcagatgtgcatgagcagctggtgccgccccgaatgctggagaggttcacccccaagaaagtgaagaaaggctccagcatcaccttctctgtgaaggtagaaggacgcccggtgcccaccgtgcactggctcagggaggaggctgagagaggcgtgctgtggattggccctgacacaccgggctacaccgtggccagctctgcgcagcagcacagcctggtcctgctggacgtgggccggcagcaccagggcacctacacatgcattgccagcaacgctgccggccaggccctctgctccgccagcctgcacgtctcgggcctgcctaaggtggaggagcaggagaaagtgaaggaagcgctgatttccactttcctgcaggggaccacacaagccatctcagcacaggggttggaaactgcgagttttgctgaccttggtgggcagaggaaagaagagcctctggctgccaaggaggccctcggccacctgtccctcgctgaggtgggcacagaggagttcctgcagaaactgacctcccagatcactgagatggtatcggccaagatcacgcaggccaagctgcaggtgcccggaggtgacagtgatgaggactccaagacaccatctgcatccccccgccatggccgatcacggccatcctccagcatccaggagtcttcctcagagtcagaggacggcgatgcccgaggcgagatctttgacatctacgtggtcaccgctgactacctgcccctaggggctgagcaggatgccatcacgctgcgggaaggccagtatgtggaggtcctggatgcagcccacccactgcgctggcttgtccgcaccaagcccaccaagtccagcccctcacggcagggctgggtgtcaccagcctacctggacaggaggctcaagctgtcacctgagtggggggccgctgaggcccctgagttccctggggaggctgtgtctgaagacgaatacaaggcaaggctgagctctgtgatccaggagctgctgagttctgagcaggccttcgtggaggagctgcagttcctgcagagccaccacctgcagcacctggagcgctgcccccacgtgcccatagctgtggccggccagaaggcagtcatcttccgcaatgtgcgggacatcggccgcttccacagcagcttcctgcaggagttgcagcagtgcgacacggacgacgacgtggccatgtgcttcatcaagaaccaggcggcctttgagcagtacctggagttcctggtggggcgtgtgcaggctgagtcggtggtcgtcagcacggccatccaggagttctacaagaaatacgcggaggaggccctgttggcaggggacccctctcagcccccgccaccacctctgcagcactacctggagcagccagtggagcgggtgcagcgctaccaggccttgctgaaggagctgatccgcaacaaggcgcggaacagacagaactgcgcgctgctggagcaggcctatgccgtggtgtctgccctgccacagcgcgctgagaacaagctgcacgtgtccctcatggagaactacccaggcaccctgcaggccctgggcgagcccatccgccagggccacttcatcgtgtgggagggtgcaccgggggcccgcatgccctggaagggccacaaccgtcacgtgttcctcttccgcaaccacctggtaatctgcaagccccggcgagactcccgcaccgataccgtcagctacgtgttccggaacatgatgaagctgagcagcatcgacctgaacgaccaggtggagggggatgaccgcgccttcgaggtgtggcaggagcgggaggactcggtgcgcaagtacctgctgcaggcacggacagccattatcaagagctcgtgggtgaaggagatctgtggcatccagcagcgtctggccctgcctgtgtggcggcccccggactttgaagaggagctggccgactgcacagccgagctgggtgagacagtcaagctggcctgccgcgtgacgggcacacccaagcctgtcatcagctggtacaaagatgggaaagcagtgcaggtggacccccaccacatcctcattgaagaccctgatggctcgtgtgcactcatcctggacagcctgaccggtgtggactctggccagtacatgtgcttcgcggccagcgccgctggcaactgcagtaccctgggcaagatcctggtgcaagtcccaccacggttcgtgaacaaggtccgggcctcaccctttgtggagggagaggacgcccagttcacctgcaccatcgaaggcgccccgtacccgcagatcaggtggtacaaggacggggccctgctgaccactggcaacaagttccagacactgagtgagcctcgcagcggcctgctagtgctggtgatccgggcggccagcaaggaggacctggggctctacgagtgtgagctggtgaaccggctgggctccgcgcgggctagtgcggagctgcgcattcagagccccatgctgcaggcccaggagcagtgtcacagggagcagctcgtggctgcagtggaagacaccaccctggagcgagcggaccaggaggtcacatctgtcctgaagagactgctgggccccaaggcgccaggcccctccacaggggacctcactggccctggcccctgccccaggggggcacccgcactccaggaaaccggctcccagcccccagtcaccggaacttcggaggcacctgccgtgcccccgagggtgccacagcccctcctccacgaaggcccagagcaggagccggaggccattgccagagcccaggaatggactgtgcccattcggatggagggtgcagcctggcccggggcaggcacaggggagctgctctgggacgtccacagccacgtggtcagagagaccacacagaggacctacacataccaggccatcgacacgcacaccgcacggcccccatccatgcaggtaaccatcgaggatgtgcaggcacagacaggcggaacggcccaattcgaggctatcattgagggcgacccacagccctcggtgacctggtacaaggacagcgtccagctggtggacagcacccggcttagccagcagcaagaaggcaccacatactccctggtgctgaggcatgtggcctcgaaggatgccggcgtttacacctgcctggcccaaaacactggtggccaggtgctctgcaaggcagagctgctggtgcttgggggggacaatgagccggactcagagaagcaaagccaccggaggaagctgcactccttctatgaggtcaaggaggagattggaaggggcgtgtttggcttcgtaaaaagagtgcagcacaaaggaaacaagatcttgtgcgctgccaagttcatccccctacggagcagaactcgggcccaggcatacagggagcgagacatcctggccgcgctgagccacccgctggtcacggggctgctggaccagtttgagacccgcaagaccctcatcctcatcctggagctgtgctcatccgaggagctgctggaccgcctgtacaggaagggcgtggtgacggaggccgaggtcaaggtctacatccagcagctggtggaggggctgcactacctgcacagccatggcgttctccacctggacataaagccctctaacatcctgatggtgcatcctgcccgggaagacattaaaatctgcgactttggctttgcccagaacatcaccccagcagagctgcagttcagccagtacggctcccctgagttcgtctcccccgagatcatccagcagaaccctgtgagcgaagcctccgacatttgggccatgggtgtcatctcctacctcagcctgacctgctcatccccatttgccggcgagagtgaccgtgccaccctcctgaacgtcctggaggggcgcgtgtcatggagcagccccatggctgcccacctcagcgaagacgccaaagacttcatcaaggctacgctgcagagagcccctcaggcccggcctagtgcggcccagtgcctctcccacccctggttcctgaaatccatgcctgcggaggaggcccacttcatcaacaccaagcagctcaagttcctcctggcccgaagtcgctggcagcgttccctgatgagctacaagtccatcctggtgatgcgctccatccctgagctgctgcggggcccacccgacagcccctccctcggcgtagcccggcacctctgcagggacactggtggctcctccagttcctcctcctcctctgacaacgagctcgccccatttgcccgggctaagtcactgccaccctccccggtgacacactcaccactgctgcacccccggggcttcctgcggccctcggccagcctgcctgaggaagccgaggccagtgagcgctccaccgaggccccagctccgcctgcatctcccgagggtgccgggccaccggccgcccagggctgcgtgccccggcacagcgtcatccgcagcctgttctaccaccaggcgggtgagagccctgagcacggggccctggccccggggagcaggcggcacccggcccggcggcggcacctgctgaagggcgggtacattgcgggggcgctgccaggcctgcgcgagccactgatggagcaccgcgtgctggaggaggaggccgccagggaggagcaggccaccctcctggccaaagccccctcattcgagactgccctccggctgcctgcctctggcacccacttggcccctggccacagccactccctggaacatgactctccgagcaccccccgcccctcctcggaggcctgcggtgaggcacagcgactgccttcagccccctccgggggggcccctatcagggacatggggcaccctcagggctccaagcagcttccatccactggtggccacccaggcactgctcagccagagaggccatccccggacagcccttgggggcagccagcccctttctgccaccccaagcagggttctgccccccaggagggctgcagcccccacccagcagttgccccatgccctcctggctccttccctccaggatcttgcaaagaggcccccttagtaccctcaagccccttcttgggacagccccaggcaccccctgcccctgccaaagcaagccccccattggactctaagatggggcctggagacatctctcttcctgggaggccaaaacccggcccctgcagttccccagggtcagcctcccaggcgagctcttcccaagtgagctccctcagggtgggctcctcccaggtgggcacagagcctggcccctccctggatgcggagggctggacccaggaggctgaggatctgtccgactccacacccaccttgcagcggcctcaggaacaggcgaccatgcgcaagttctccctgggtggtcgcgggggctacgcaggcgtggctggctatggcacctttgcctttggtggagatgcagggggcatgctggggcaggggcccatgtgggccaggatagcctgggctgtgtcccagtcagaggaggaggagcaggaggaggccagggctgagtcccagtcggaggagcagcaggaggccagggctgagagcccactgccccaggtcagtgcaaggcctgtgcctgaggtcggcagggctcccaccaggagctctccagagcccaccccatgggaggacatcgggcaggtctccctggtgcagatccgggacctgtcaggtgatgcggaggcggccgacacaatatccctggacatttccgaggtggaccccgcctacctcaacctctcagacctgtacgatatcaagtacctcccattcgagtttatgatcttcaggaaagtccccaagtccgctcagccagagccgccctcccccatggctgaggaggagctggccgagttcccggagcccacgtggccctggccaggtgaactgggcccccacgcaggcctggagatcacagaggagtcagaggatgtggacgcgctgctggcagaggctgccgtgggcaggaagcgcaagtggtcctcgccgtcacgcagcctcttccacttccctgggaggcacctgccgctggatgagcctgcagagctggggctgcgtgagagagtgaaggcctccgtggagcacatctcccggatcctgaagggcaggccggaaggtctggagaaggaggggccccccaggaagaagccaggccttgcttccttccggctctcaggtctgaagagctgggaccgagcgccgacattcctaagggagctctcagatgagactgtggtcctgggccagtcagtgacactggcctgccaggtgtcagcccagccagctgcccaggccacctggagcaaagacggagcccccctggagagcagcagccgtgtcctcatctctgccaccctcaagaacttccagcttctgaccatcctggtggtggtggctgaggacctgggtgtgtacacctgcagcgtgagcaatgcgctggggacagtgaccaccacgggcgtcctccggaaggcagagcgcccctcatcttcgccatgcccggatatcggggaggtgtacgcggatggggtgctgctggtctggaagcccgtggaatcctacggccctgtgacctacattgtgcagtgcagcctagaaggcggcagctggaccacactggcctccgacatctttgactgctgctacctgaccagcaagctctcccggggtggcacctacaccttccgcacggcatgtgtcagcaaggcaggaatgggtccctacagcagcccctcggagcaagtcctcctgggagggcccagccacctggcctctgaggaggagagccaggggcggtcagcccaacccctgcccagcacaaagaccttcgcattccagacacagatccagaggggccgcttcagcgtggtgcggcaatgctgggagaaggccagcgggcgggcgctggccgccaagatcatcccctaccaccccaaggacaagacagcagtgctgcgcgaatacgaggccctcaagggcctgcgccacccgcacctggcccagctgcacgcagcctacctcagcccccggcacctggtgctcatcttggagctgtgctctgggcccgagctgctcccctgcctggccgagagggcctcctactcagaatccgaggtgaaggactacctgtggcagatgttgagtgccacccagtacctgcacaaccagcacatcctgcacctggacctgaggtccgagaacatgatcatcaccgaatacaacctgctcaaggtcgtggacctgggcaatgcacagagcctcagccaggagaaggtgctgccctcagacaagttcaaggactacctagagaccatggctccagagctcctggagggccagggggctgttccacagacagacatctgggccatcggtgtgacagccttcatcatgctgagcgccgagtacccggtgagcagcgagggtgcacgcgacctgcagagaggactgcgcaaggggctggtccggctgagccgctgctacgcggggctgtccgggggcgccgtggccttcctgcgcagcactctgtgcgcccagccctggggccggccctgcgcgtccagctgcctgcagtgcccgtggctaacagaggagggcccggcctgttcgcggcccgcgcccgtgaccttccctaccgcgcggctgcgcgtcttcgtgcgcaatcgcgagaagagacgcgcgctgctgtacaagaggcacaacctggcccaggtgcgctgagggtcgccccggccacacccttggtctccccgctgggggtcgctgcagacgcgccaataaaaacgcacagccgggcgag

SEQ ID NO: 1560 - DNA, 19907 bp, Homo sapiens
gctgcccagagcccccatagagagaggtccccgccgccaccctcatggatcagccacagttcagcggggcgccccgctttctcacccggcccaaggccttcgtggtgtcggtgggcaaggacgccaccctcagctgccagatcgtgggtaatcccacgccacaggtgagctgggagaaggaccagcagccggtggcggccggcgcgcgcttccgtctggcccaggacggcgacctctaccgcctcactatcctggacctggcgctgggcgacagtgggcaatacgtgtgccgcgcgcgcaatgccataggcgaggccttcgctgctgtgggcctgcaggtggacgcggaggccgcgtgcgccgagcaggcgccgcacttcctgctgcggcccacgtccatccgcgtgcgcgagggctcagaggccaccttccgctgccgcgtgggtggctccccgaggccggcagtgagctggtccaaggacgggcggcgcctgggtgagcccgacggcccccgcgtgcgcgtggaggagctcggcgaggcaagtgcgctgcgcattcgggcggcgcggccgcgcgacggcggcacttacgaggtccgcgccgagaacccgctgggcgctgccagcgccgccgcggcgctagtggtggactcggacgccgcggacacggccagccggcccgggacctccacggccgcgctcctggcgcacctgcagcggcggcgcgaggctatgcgcgccgagggcgcccccgcctcaccgcccagcaccggcacgcgcacctgcacggtgactgaaggcaagcacgcgcgcctcagctgctacgtgaccggcgagcccaagcccgagacggtgtggaagaaggacggccagctggtgaccgagggccggcgccacgtggtgtacgaggacgcgcaggagaacttcgtgctcaagatcctcttctgcaagcagtcggaccgcggcctctacacctgcacggcgtccaacctcgtgggccagacctacagctctgtgctggtcgtagtgcgcgagcccgcggttcccttcaaaaagcggctgcaagatctggaggtgcgggagaaggagtcggccacgttcctatgtgaggtgccccagccgtccactgaggccgcgtggttcaaggaggagacgcggttgtgggcgagcgccaagtacggcatcgaggaggagggcaccgagcgccgcctgaccgtgcgcaatgtctcggccgacgacgacgcggtgtacatctgcgagacgccagagggcagccgcacggtggcggagctcgcagtccaaggaaacctcctccgaaagctccctcggaagacggcggtgcgcgtgggcgacacggctatgttttgcgtggagctggcggtcccggtgggccccgtccactggctgcggaaccaggaggaagtggtggcggggggccgcgtggccatctccgcggagggcacgcgccacacactaaccatctcccagtgctgcctggaggatgtgggccaggtggcctttatggctggcgactgccagacgtccacccagttctgcgtgtcggcccccaggaagcctcccctgcaaccccctgtggatcctgtggtaaaggccaggatggagagttccgtgattctcagctggtccccaccaccccatggggaacgccctgtcactatcgacggctacctggtagagaagaagaagcttggcacctacacctggatcaggtgccacgaggctgaatgggtggctacacctgagctgaccgtggctgatgtggcggaggaggggaacttccagttccgagtgtccgctctcaacagctttggtcagagtccctacctcgagttcccggggactgtccacctggcccccaagctggccgtgaggacaccgctgaaggcggtgcaggcggtagagggtggcgaggtcactttctccgtggacctcacggtggcctcagcgggtgagtggttcctggatgggcaggccctgaaggccagcagtgtgtatgagatccactgtgatcgcacccggcacacgctcaccatccgggaggtgcccgccagcctgcacggggcgcagctgaagttcgtggccaacggcattgagagcagcatccggatggaggtccgggcggccccagggctgactgccaacaagccgccagccgcagctgcccgggaggtgctggctcggctgcacgaggaggcgcagctgctggctgagctgtcagatcaggctgcggctgtgacgtggctgaaggatggtcgcacactgtccccaggccccaagtatgaggtgcaggcatcggccgggcggcgggtgctccttgtgcgagatgtggcccgggacgatgcaggcctctacgagtgcgtcagccgcgggggccgcatcgcctaccagctctccgtgcaaggcctcgcgcgctttctgcacaaggacatggcgggcagctgtgtggatgccgtggctgggggcccggcgcagtttgagtgtgagacctccgaagcccacgtccacgtgcactggtacaaggatggcatggagctgggccactccggtgagcgcttcttgcaggaggatgtggggacgcggcaccggctggtggcagccacagtcaccaggcaggatgaaggcacctactcctgccgcgtgggcgaggactctgtggacttccggctccgcgtctctgagcccaaggtggtgtttgctaaggagcagctggcacgcaggaagctgcaggcagaggcaggagccagtgccacactgagctgcgaggtggcccaggcccagacggaggtgacgtggtacaaggatgggaagaagctgagctccagctcgaaagtgtgcatggaggccacaggctgcacgcgcaggctggttgtgcagcaggcaggccaggcggatgccggggagtatagctgcgaggctgggggccagcggctctccttccatctggatgtcaaagagcccaaggtggtgtttgccaaggaccaggtggcacacagtgaggtgcaggctgaggcaggggccagtgccacgctgagctgcgaggtggcccaggcccagacggaggtgatgtggtacaaagatgggaagaagctgagctccagcttgaaagtgcatgtagaggccaagggctgcagacggaggctggtggtgcagcaggcaggcaagacagatgccggggactacagctgcgaggccaggggccagagggtctccttccgcctgcacatcacagagcccaagatgatgtttgcaaaggagcagtcagtgcataatgaggtgcaggctgaggcgggggccagtgccatgctgagctgtgaggtggcccaggcccagacggaggtgacgtggtacaaggatgggaagaagctgagctccagctcaaaagtgggcatggaggtcaaagggtgcacacggaggctggtgctgccacaggcgggcaaagcagatgctggggagtacagctgtgaggctgggggccagagagtctccttccacctgcacatcacagagcccaagggggtgtttgcgaaggagcagtcagtgcataatgaggtgcaggctgaggcggggaccactgccatgctgagctgtgaggtggcccagccccagacagaggtgacgtggtacaaggacgggaagaagctgagctccagctcaaaagtacgcatggaggtcaagggctgcacacgaaggctggtagtgcagcaggtgggcaaagcagatgctggggagtacagctgcgaggctgggggccagagagtctcctttcaactgcacatcacagagcccaaggcagtgtttgccaaggagcagttggtgcataatgaggtgcggactgaggcaggggccagtgccacactgagctgtgaggtggcccaggcccagacagaggtgacgtggtacaaggatgggaagaagctgagctccagttcgaaagtgcgcatagaggctgcgggctgcatgcggcagctggtggtgcagcaggcaggccaggcagatgctggggagtacacctgtgaggctgggggccagcggctctccttccacctggatgtttcagagcccaaggcggtgtttgcaaaggagcagctggcacacaggaaggtgcaggccgaggcgggggccattgccacgctgagctgcgaggtggcccaggcccagacagaggtgacgtggtacaaggacgggaagaagctgagctccagctcgaaagttcgaatggaggctgtgggctgcacacggaggctggtggtgcagcaggcatgccaggcggacaccggggagtatagctgcgaggccgggggccagcggctctccttcagcctggacgtggcagagcccaaggtggtgtttgccaaggagcagccagtgcacagggaggtgcaggcccaggcgggggccagcaccacactcagctgcgaggtggctcaggcccagacggaggtgatgtggtacaaggacgggaagaagctgagcttcagctcgaaagtgcgcatggaggctgtgggctgcacacggaggctggtggtgcagcaggcgggccaggcggtcgccggggagtacagctgcgaggcggggagccagcggctctccttccacctgcacgtggcagagcccaaggcggtgtttgccaaggagcagccagcgagcagggaggtgcaggctgaggcggggaccagtgccacgctgagctgcgaggtggcccaggcccagacagaggtgacgtggtacaaggacgggaagaaactgagctccagctcgaaagtgcgaatggaggccgtgggctgcacacggaggctggtggtgcaggaggcaggccaggcggacgccggggagtacagctgcaaggccggggatcagcggctgtccttccacctgcacgtggcagagcccaaggtggtgtttgccaaggagcagccagcacacagggaggtgcaggctgaggcgggggccagtgccacgctgagctgcgaggtggcccaggcccagacagaggtgacgtggtacaaggatgggaagaagctgagttccagctcgaaagtgcgcgtggaggccgtgggctgcacacggaggctggtggtgcagcaggcgggccaggcagaggccggggagtacagctgcgaggcagggggtcagcagctctccttccgcctgcaggtggcagagctggagccccaaatttcagagagaccctgccgcagggagcctctggtggtcaaggagcatgaagacatcatcctgaccgccacactggccacaccctctgcggccacggtgacctggctcaaggatggtgtggagattcgccgcagcaagcggcatgagacagccagccagggggacacccacaccctgaccgtgcatggcgcccaggttctggacagcgccatctacagctgccgtgtgggcgcagaggggcaggacttcccagtgcaggtggaagaggtggccgccaagttctgccggctgctggagcctgtgtgcggcgagctgggtggcacggtgacactggcctgcgagctaagcccagcgtgtgcagaggtggtgtggcgctgcggcaacacgcagcttcgggtgggcaagcgcttccagatggtggccgaggggcccgtgcgctcactcactgtgttggggctgcgcgcagaggacgcaggggagtacgtgtgtgagagccgtgatgaccacaccagtgcgcagctcaccgtcagtgtgccccgagtggtgaagtttatgtctgggctgagcaccgtggtcgcagaggagggcggcgaggccaccttccagtgcgtggtgtcccccagtgatgtggcagtcgtgtggttccgggacggtgccctgcttcagcccagcgagaagtttgccatatcacagagtggcgccagccacagcctgaccatctcagacctggtgctggaggacgcgggccagatcaccgtggaggctgagggcgcctcatcctctgctgccctgagggtccgagaggcgcctgtgctgttcaaaaagaagctggagccgcagacggtggaggagcggagctcggtgaccctggaggtggagctgacgcggccgtggccggagctgaggtggacacggaacgcgacggccctggcgccgggaaagaacgtggagatccacgccgagggcgcccgccaccgcctggttctgcacaacgtaggttttgccgaccgtggcttctttggctgcgagacgccggatgacaagacacaggccaaactcaccgtggagatgcgccaggtacggctcgtacggggcctgcaggcagtggaggcacgggagcagggcacggctaccatggaggtgcagctgtcgcatgcggacgtggatggcagctggactcgtgacggtctgcggttccagcaggggcccacgtgccacctggctgtgcggggccccatgcacaccctcacactctcggggctgcggccagaggatagtggccttatggtcttcaaggccgaaggagtgcacacgtcggcgcggctcgtggtcaccgagcttcccgtgagcttcagccgcccgctgcaggacgtggtgaccactgagaaggagaaggttaccctggagtgcgagctgtcgcgtcctaatgtggatgtgcgctggctgaaggacggtgtggagctgcgggcaggcaagacgatggccatcgcagcccagggcgcctgcaggagcctcaccatttaccggtgcgagttcgcggatcagggagtgtatgtgtgtgatgcccatgatgcccagagctctgcctccgtgaaggtacaaggaaggacatacactctcatctaccggagagtcctggcggaagatgcaggagagatccaatttgtagccgaaaatgcagaatcgcgagcccagctccgagtgaaggagctgccagtgaccctcgtgcgcccgctgcgggacaagattgccatggagaagcaccgcggtgtgctggagtgtcaggtgtcccgggccagcgcccaggtgcggtggttcaagggcagtcaggagctgcagcccgggcccaagtacgagctggtcagtgatggcctctaccgcaagctgatcatcagtgatgtccacgcagaggacgaggacacctacacctgtgacgccggtgatgtcaagaccagtgcacagttcttcgtggaagagcaatccatcaccattgtgcggggtctgcaggacgtgacagtgatggagcccgctcctgcctggtttgagtgtgagacctccatcccctcagtgcggccacctaagtggctcctggggaagacggtgttgcaggctggggggaacgtgggcctggagcaggagggcacggtgcaccggctgatgctgcggcggacctgctccaccatgaccgggcccgtgcacttcaccgttggcaagtcgcgctcctctgcccgcctggtggtctcagacatccccgtagtcctcacacggccgttggagcccaagacagggcgtgagctgcagtcagtggtcctgtcctgcgacttccggccagcccccaaggctgtgcagtggtacaaggatgacacgcccctgtctccctctgagaagtttaagatgagcctggagggtcagatggctgagctgcgcatcctccggctcatgcctgctgatgctggtgtctaccggtgccaggcgggcagtgcccacagcagcactgaggtcactgtggaagcgcgggaggtgacagtgacagggccgctacaggatgcagaggccacggaggagggctgggccagcttctcctgtgagctgtcccacgaggatgaggaggtcgagtggtcgctcaacgggatgcccctgtacaacgacagcttccatgagatctcacacaagggccggcgccacacgctggtactgaagagcatccagcgggctgatgcgggcatagtacgcgcctcctccctgaaggtgtcgacctctgcccgcctggaggtccgagtgaagccggtggtgttcctgaaggcgctggatgacctgtccgcagaggagcgcggcaccctggccctgcagtgtgaagtctctgaccccgaggcccatgtggtgtggcgcaaagatggcgtgcagctgggccccagtgacaagtatgacttcctgcacacggcgggcacgcgggggctcgtggtgcatgacgtgagccctgaagacgccggcctgtacacctgccacgtgggctccgaggagacccgggcccgggtccgcgtgcacgatctgcacgtgggcatcaccaagaggctgaagacaatggaggtgctggaaggggaaagctgcagctttgagtgcgtcctgtcccacgagagtgccagcgacccggccatgtggacagtcggtgggaagacagtgggcagctccagccgcttccaggccacacgtcagggccgaaaatacatcctggtggtccgggaggctgcaccaagtgatgccggggaggtggtcttctctgtgcggggcctcacctccaaggcctcactcattgtcagagagaggccggccgccatcatcaagcccctggaagaccagtgggtggcgccaggggaggacgtggagctgcgctgtgagctgtcacgggcgggaacgcccgtgcactggctgaaggacaggaaggccatccgcaagagccagaagtatgatgtggtctgcgagggcacgatggccatgctggtcatccgcggggcctcgctcaaggacgcgggcgagtacacgtgtgaggtggaggcttccaagagcacagccagcctccatgtggaagaaaaagcaaactgcttcacagaggagctgaccaatctgcaggtggaggagaaaggcacagctgtgttcacgtgcaagacggagcaccccgcggccacagtgacctggcgcaagggcctcttggagctacgggcctcagggaagcaccagcccagccaggagggcctgaccctgcggctcaccatcagtgccctggagaaggcagacagcgacacctatacctgcgacattggccaggcccagtcccgggcccagctcctagtgcaaggccggagagtgcacatcatcgaggacctggaggatgtggatgtgcaggagggctcctcggccaccttccgttgccggatctccccggccaactacgagcctgtgcactggttcctggacaagacacccctgcatgccaacgagctcaatgagatcgatgcccagcccgggggctaccacgtgctgaccctgcggcagctggcgctcaaggactcgggcaccatctactttgaggcgggtgaccagcgggcctcggccgccctgcgggtcactgagaagccaagcgtcttctcccgggagctcacagatgccaccatcacagagggtgaggacttgaccctggtgtgcgagaccagcacctgcgacattcctgtgtgctggaccaaggatgggaagaccctgcgggggtctgcccggtgccagctgagccatgagggccaccgggcccagctgctcatcactggggccaccctgcaggacagtggacgctacaagtgtgaggctgggggcgcctgcagcagctccattgtcagggtgcatgcgcggccagtgcggttccaggaggccctgaaggacctggaggtgctggagggtggtgctgccacactgcgctgtgtgctgtcatctgtggctgcgcccgtgaagtggtgctatggaaacaacgtcctgaggccaggtgacaaatacagcctacgccaggagggtgccatgctggagctggtggtccggaacctccggccgcaggacagcgggcggtactcatgctccttcggggaccagactacttctgccaccctcacagtgactgccctgcctgcccagttcatcgggaaactgagaaacaaggaggccacagaaggggccacggccacgctgcggtgtgagctgagcaaggcagcccctgtggagtggagaaaggggtccgagaccctcagagatggggacagatactgtctgaggcaggacggggccatgtgtgagctgcagatccgtggcctggccatggtggatgccgcggagtactcgtgtgtgtgtggagaggagaggacctcagcctcactcaccatcaggcccatgcctgcccacttcataggaagactgagacaccaagagagcatagaaggggccacagccacgctgcggtgtgagctgagcaaggcggcccccgtggagtggaggaaggggcgtgagagcctcagagatggggacagacatagcctgaggcaggacggggctgtgtgcgagctgcagatctgtggcctggctgtggcagatgctggggagtactcctgtgtgtgtggggaggagaggacctctgccactctcaccgtgaaggccctgccagccaagttcacagagggtctgaggaatgaagaggccgtggaaggggccacagccatgttgtggtgtgaactgagcaaggtggcccctgtggagtggaggaaggggcccgagaacctcagagatggggacagatacatcctgaggcaggaggggaccaggtgtgagctgcagatctgtggcctggccatggcggacgccggggagtacttgtgtgtgtgcgggcaggagaggacctcagccacgctcaccatcagggctctgcctgccaggttcatagaagatgtgaaaaaccaggaggccagagaaggggccacagctgtgctgcagtgtgagctgaacagtgcagcccctgtggagtggagaaaggggtctgagacccttagagatggggacagatacagcctgaggcaggacgggactaaatgtgagctgcagattcgtggcctggccatggcagacactggggagtactcgtgcgtgtgcgggcaggagaggacctcggctatgctcaccgtcagggctctacccatcaagttcacagagggtctgaggaacgaagaggccacagaaggggcaacagccgtgctgcggtgtgagctgagcaagatggcccccgtggagtggtggaaggggcatgagaccctcagagatggagacagacacagcctgaggcaggacggggccaggtgtgagctgcagatccgcggcctcgtggcagaggacgctggggagtacctgtgcatgtgcgggaaggagaggacctcagccatgctcaccgtcagggccatgccttccaagttcatagagggtctgaggaatgaagaggccacagaaggggacacggccacgctgtggtgtgagctgagcaaggcggcaccggtggagtggaggaaggggcatgagaccctcagagatggggacagacacagcctgaggcaggacgggtccaggtgtgagctgcagatccgtggcctggctgtggtggatgccggggagtactcgtgtgtgtgcgggcaggagaggacctcagccacactcactgtcagggccctgcctgccagattcatagaagatgtgaaaaaccaggaggccagagaaggggccacggccgtgctgcaatgtgagctgagcaaggcggcccccgtggagtggaggaaggggtctgagaccctcagaggtggggacagatacagcctgaggcaggatgggaccagatgtgagctgcagattcatggcctgtctgtggcagacactggggagtactcgtgtgtgtgcgggcaggagaggacctcggccacactcaccgtcagggccccacagccagtgttccgggagccgctgcagagtctgcaggcggaggagggctccacggccaccctgcagtgtgagctgtctgagcccactgctacagtggtctggagcaagggtggcctgcagctgcaggccaatgggcgccgggagccacggcttcagggctgcaccgcggagctggtgttacaggacctacaacgtgaagacactggcgaatacacttgcacctgtggctcccaggccaccagtgccaccctcactgtcacagctgcgcctgtgcggttcctccgagagctgcagcaccaggaggtggatgagggaggcaccgcacacttatgctgcgagctgagccgggcgggtgcgagcgtggagtggcgcaagggctccctacagctcttcccttgtgccaagtaccagatggtgcaggatggtgcagctgcagagctgctggtacgcggagtggagcaggaggatgcgggtgactacacgtgtgacacgggccacacgcagagcatggccagcctctctgtccgtgtccccaggcccaagttcaagacccggcttcagagtctggagcaggagacaggtgacatagcccggctgtgctgtcagctgagtgatgcagagtcgggggccgtggtgcaatggctcaaggagggcgtggagctgcatgcgggccccaagtacgagatgcggagccagggggccacgcgggagctgctgatccaccaactggaggccaaggacacgggcgagtatgcctgtgtgacaggcggccagaaaaccgctgcctccctcagggtcacagagcctgaggtgaccattgtacgggggctggttgatgcggaggtgacggccgatgaggatgttgagttcagctgtgaggtgtccagggctggagccacaggcgtgcagtggtgcctacagggcctgccactgcaaagcaatgaggtgacagaggtggctgtgcgggatggccgcatccacaccctgcggctgaagggcgtgacgcccgaggacgctggcactgtctccttccatttgggaaaccatgcttcctctgcccagctcaccgtcagagctcctgaggtgaccatcctggagcccctgcaggacgtgcagctcagtgagggccaggatgccagcttccagtgccggctatccagagcttcaggccaggaggcccgctgggctttaggaggggtgcccctgcaggccaacgagatgaatgacatcactgtggagcagggcacactccacctgctcaccctgcacaaggtgacccttgaggatgctggaactgtcagtttccacgtgggcacgtgtagctctgaggcccagctgaaagtcacagccaagaacacggtggtgcgggggctggagaatgtggaggcgctggagggcggcgaggcgctgttcgagtgccagctgtcccagcccgaggtggccgcccacacctggctgctggacgacgaacccgtgcacacctcggagaacgccgaggtggtcttcttcgagaacggcctgcgccacctgctgctgctcaaaaacttgcggccacaagacagctgccgggtgaccttcctggctggggatatggtgacgtccgcattcctcacggtccgaggctggcgcctggagatcctggagcctctgaaaaacgcggcggtccgggccggcgcacaggcatgcttcacctgcacgctcagcgaggcggtgcccgtgggagaggcgtcctggtacatcaatggcgcggcagtgcagccggatgacagcgactggactgtcaccgccgacggcagtcaccacgccctactgctgcgcagcgcccagccccaccacgccggggaggtcaccttcgcttgccgcgacgccgtggcctctgcgcggctcaccgtgctgggcctccctgatcccccagaggatgctgaggtggtggctcgcagcagccacactgtgacactgtcttgggcagctcccatgagtgatggaggcggtggtctctgtggctaccgcgtggaggtgaaggagggggccacaggccagtggcggctgtgccacgagctggtgcctggacccgagtgtgtggtggatggcctggcccccggggagacctaccgcttccgtgtggcagctgtgggccctgtgggtgctggggaaccggttcacctgccccagacagtgcggcttgcagagccaccgaagcctgtgcctccccagccctcagcccctgagagccggcaggtggcagctggtgaagatgtctctctggagcttgaggtggtggctgaggctggtgaggtcatctggcacaagggaatggagcgcatccagcccggtgggcggttcgaggtggtctcccagggtcggcaacagatgctggtgatcaagggcttcacggcagaagaccagggcgagtaccactgtggcctggctcagggctccatctgccctgcggctgccaccttccaggtggcactgagcccagcctctgtggatgaggcccctcagcccagcttgccccccgaggcagcccaggagggtgacctgcacctactgtgggaggccctggctcggaaacgtcgcatgagccgtgagcccacgctggactccattagcgagctgccagaggaggacggccgctcgcagcgcctgccacaggaggcagaggaggtggcacctgatctctctgaaggctactccacggccgatgagctggcccgcactggagatgctgacctctcacacaccagctctgatgatgagtcccgggcaggcaccccttccctggtcacctacctcaagaaggctgggaggccaggcacctcaccactggccagcaaggttggggccccagcagccccctctgtgaagccacagcagcagcaggagccactggctgctgtgcgcccaccactgggagacctgagcaccaaagacctgggtgatccctcaatggacaaggcagctgtgaagatccaggctgcctttaagggctacaaggtccggaaggagatgaagcagcaggaagggcccatgttctcccacacatttggggacaccgaggcacaggtgggggatgccctgcggctggagtgtgtcgtggccagcaaggcagatgtgcgagcccgctggctgaaggatggtgtggagctgaccgatgggcggcaccatcacatcgaccagcttggggatggcacctgctctctgctgatcactggcctggaccgtgctgatgctggctgctacacctgtcaggtgagcaacaagtttggccaggtgacccacagtgcctgtgtggtggtcagtgggtcagagagtgaagccgagagctcctctgggggtgagctggacgatgccttccgccgggctgcccgtcggctgcaccggctcttccgcaccaaaagtccggctgaagtttcagatgaggagctcttcctgagtgcagacgagggccctgcagagccagaggagcccgcggactggcagacataccgcgaagatgagcatttcatctgcatccgttttgaggcgctcactgaggcccgccaggcggtaactcgcttccaggagatgtttgccacactgggcattggggtggagatcaagctggtggaacaggggcctcggagggtagagatgtgcatcagcaaagagactcctgcccctgtggtgcctccagagccattgcccagcctactgacttctgacgctgccccagtgttcctgactgagttgcagaaccaagaagtgcaggatgggtatcctgtgagctttgactgcgtggtgacaggtcagcccatgcccagtgtgcgctggttcaaggatgggaagttgttggaggaggatgatcactacatgattaatgaagaccaacagggtggccatcagctcatcatcacagccgtggtgccagcagacatgggcgtctaccgctgcctggccgagaacagcatgggtgtctcctccaccaaggctgagctccgtgtggacttgacaagcacagactatgacactgcagcagatgccacggagtcctcatcctacttcagtgcccaaggctacctgtccagccgggagcaggagggaacagagtccaccactgatgagggccagctgccccaggtggtggaggagctgagagacctccaggtggcccctggcacacgcctggccaagttccagctcaaggtgaaaggctaccctgctcccagattatactggttcaaagatggccagcccctgaccgcatctgcccacatccgcatgactgacaagaagatcctgcacaccctggagatcatctccgtcacccgggaggactctggccagtatgcagcctatatcagcaatgccatgggtgctgcctactcgtctgcccggctgctggttcgaggccctgatgagccagaagagaagcctgcatcagatgtgcatgagcagctggtgccgccccgaatgctggagaggttcacccccaagaaagtgaagaaaggctccagcatcaccttctctgtgaaggtagaaggacgcccggtgcccaccgtgcactggctcagggaggaggctgagagaggcgtgctgtggattggccctgacacaccgggctacaccgtggccagctctgcgcagcagcacagcctggtcctgctggacgtgggccggcagcaccagggcacctacacatgcattgccagcaacgctgccggccaggccctctgctccgccagcctgcacgtctcgggcctgcctaaggtggaggagcaggagaaagtgaaggaagcgctgatttccactttcctgcaggggaccacacaagccatctcagcacaggggttggaaactgcgagttttgctgaccttggtgggcagaggaaagaagagcctctggctgccaaggaggccctcggccacctgtccctcgctgaggtgggcacagaggagttcctgcagaaactgacctcccagatcactgagatggtatcggccaagatcacgcaggccaagctgcaggtgcccggaggtgacagtgatgaggactccaagacaccatctgcatccccccgccatggccgatcacggccatcctccagcatccaggagtcttcctcagagtcagaggacggcgatgcccgaggcgagatctttgacatctacgtggtcaccgctgactacctgcccctaggggctgagcaggatgccatcacgctgcgggaaggccagtatgtggaggtcctggatgcagcccacccactgcgctggcttgtccgcaccaagcccaccaagtccagcccctcacggcagggctgggtgtcaccagcctacctggacaggaggctcaagctgtcacctgagtggggggccgctgaggcccctgagttccctggggaggctgtgtctgaagacgaatacaaggcaaggctgagctctgtgatccaggagctgctgagttctgagcaggccttcgtggaggagctgcagttcctgcagagccaccacctgcagcacctggagcgctgcccccacgtgcccatagctgtggccggccagaaggcagtcatcttccgcaatgtgcgggacatcggccgcttccacagcagcttcctgcaggagttgcagcagtgcgacacggacgacgacgtggccatgtgcttcatcaagaaccaggcggcctttgagcagtacctggagttcctggtggggcgtgtgcaggctgagtcggtggtcgtcagcacggccatccaggagttctacaagaaatacgcggaggaggccctgttggcaggggacccctctcagcccccgccaccacctctgcagcactacctggagcagccagtggagcgggtgcagcgctaccaggccttgctgaaggagctgatccgcaacaaggcgcggaacagacagaactgcgcgctgctggagcaggcctatgccgtggtgtctgccctgccacagcgcgctgagaacaagctgcacgtgtccctcatggagaactacccaggcaccctgcaggccctgggcgagcccatccgccagggccacttcatcgtgtgggagggtgcaccgggggcccgcatgccctggaagggccacaaccgtcacgtgttcctcttccgcaaccacctggtaatctgcaagccccggcgagactcccgcaccgataccgtcagctacgtgttccggaacatgatgaagctgagcagcatcgacctgaacgaccaggtggagggggatgaccgcgccttcgaggtgtggcaggagcgggaggactcggtgcgcaagtacctgctgcaggcacggacagccattatcaagagctcgtgggtgaaggagatctgtggcatccagcagcgtctggccctgcctgtgtggcggcccccggactttgaagaggagctggccgactgcacagccgagctgggtgagacagtcaagctggcctgccgcgtgacgggcacacccaagcctgtcatcagctggtacaaagatgggaaagcagtgcaggtggacccccaccacatcctcattgaagaccctgatggctcgtgtgcactcatcctggacagcctgaccggtgtggactctggccagtacatgtgcttcgcggccagcgccgctggcaactgcagtaccctgggcaagatcctggtgcaagtcccaccacggttcgtgaacaaggtccgggcctcaccctttgtggagggagaggacgcccagttcacctgcaccatcgaaggcgccccgtacccgcagatcaggtggtacaaggacggggccctgctgaccactggcaacaagttccagacactgagtgagcctcgcagcggcctgctagtgctggtgatccgggcggccagcaaggaggacctggggctctacgagtgtgagctggtgaaccggctgggctccgcgcgggctagtgcggagctgcgcattcagagccccatgctgcaggcccaggagcagtgtcacagggagcagctcgtggctgcagtggaagtcactgagcaagagactaaagtccccaagaaaaccgtcatcatagaagagaccatcaccactgtggtgaagagcccacgtggccaacgacggtcccccagcaagtccccctcccgctcaccttcccgctgctctgccagcccgctgaggccaggcctactggcccccgacctgctgtacctgccaggtgctggccagccccgcaggccggaggcagaaccaggccagaagcccgtggtgcccacactgtatgtgacggaggccgaggcccactctccagctctgcccggactctcggggccccagcccaagtgggtggaggtggaggagaccattgaagtccgggtgaagaagatgggcccgcagggtgtgtctcccaccacagaggtgcccaggagctcatcggggcatctcttcacactgcccggtgcgacccccggaggggaccccaattccaacaactccaacaacaagctgctggcccaggaggcctgggcccagggcacagccatggtcggcgtcagagagccccttgtcttccgcgtggatgccagaggcagtgtggactgggctgcttctggcatgggcagcctggaggaggagggcaccatggaggaggcgggagaggaagagggggaagacggagacgcctttgtgacggaggagtcccaggacacacacagccttggggatcgtgaccccaagatcctcacgcacaacggccgcatgctgacactggctgacctggaagattacgtgcctggggaaggggagaccttccactgtggtggccctgggcctggcgcccctgatgaccctccctgcgaggtctcggtgatccagagagagatcggggagcccacggtggggcagcctgtgctgctcagcgtggggcatgcactgggtccccgaggccctctcggcctctttaggcctgagccccgtggggcgtcaccaccgggaccccaggtccgtagccttgagggcacctccttcctcttgcgggaggccccggctcggcctgtgggcagtgctccctggacgcagtctttctgcacccgcatccggcgttctgcggacagtggccagagcagcttcaccacagagctttccacccagaccgtcaacttcgggacagtgggggagacggtcacccttcacatctgcccagacagggatggggatgaggcggcacagccctga

SEQ ID NO: 1561 - DNA, 7817 bp, Homo sapiens
agatggcgaccgcggcgctgcttcgaggcgccactccggggcgcggcggcccggtctggcgctggcggctgcgcgcggccccaaggtgccgcctggcccacagctcctgcagtcctggtggcgacccaacggccggagcggcctgggcctgcttccggctggacgggcgcaccctgctgcgcgtgcgtggccccgacgcggcgcccttcctgctagggctgctgaccaatgaactgccgcttccgagtcctgcggccgcgggggccccgcctgctgcgcgcgcgggctacgcccacttcctgaacgtgcagggccggacgctctatgacgtcatcttgtacgggctccaggaacactcggaggtgtctggcttccttctggagtgtgacagctcggtgcagggcgcgctgcagaagcacctcgcgctatacaggatccggcggaaggtcacggtggagccgcacccggagctgcgagtgtgggcggtgttgcccagttcccctgaggcctgcggggctgcatcgctgcaggagagggcaggggctgccgccatcctcatccgcgacccgcgaacagcacgcatggggtggcggctcctcacccaggatgaaggcccagccctggtgcccgggggccggctcggggacttgtgggattatcaccagcaccgatacctgcaaggcgttcctgagggggtccgagacttgcctcctggggtggccctgcccctggagtccaacctggccttcatgaacggcgtgagcttcaccaaaggctgctacattggccaggagctgacggcccgcacccaccacatgggcgtcatccgcaagcgcctcttccctgtccggttcttggacccccttcccaccagtggcatcacccctggtgccacggtgctgactgcctcaggacagactgtgggcaagttcagggctggccagggcaacgtggggctggccctgctgtggtcagagaagatcaagggtcctctgcacatcagagcctctgagggtgcccaggtggccttagccgcatctgtgccagactggtggcctacagtctccaagtagtccgaagccttggctggcgcaggctgatggggaggctggggcctggggcctttggcctctgtccagggtcttcccgtcccatctgtctgctgcgcctactgggtgggagccctggtttccatctgggaaagtcccccttgtaggtgccctgcctggccccacccatgctcaggggccccaggcacgtgggttgttttctccctggacttcctgtggccccagaggagcccaccgtgtgagtgctgggctccagatggcgccgggtcccaatcgtggctccacacagggttgtctgggaggacgggacggtgtctctggccagcactggcagcttccgggccttgtaccccactctgcctggcatgagcctcatggggggttggtccctgtgcctggaagcggggtggtgtccagggtctgcaggctggggctcgggctttgggagttgtttcactgtgcttgcttccagcatgtctcagggtggggctatgcgtggtctagaggggtctggggcattggatcaggtggcatgtgggtgtctacacatcgagaagcacacagggatgagccactaggtatcccatgctggaggcttgtggaaggctgtgcccatctcccatgtttccccacctctgttcctcctcagagccctccaggagcgtggggtgggggccagcgcagggctcaggagccagcagggcagagttctgcctgtgtgtgctgggttttggcatagcctgtgtttgcagtgagagtgacttgctgtcagtcacggggcacagcctcctgttcacccactggcttcccccttcccactgaagtgtgagctctatgtttcagggcatctattaaagagtgagccacaggcagccccttgggagctctggtttcatttgggggagagggaggtgggggcttagtttttgtgatctggctgactggaccccgggaacagcgctcctttgagaacgcccagacctaccagatgaagcacttggcatggctgcaggccagcaggggaggcctcagaggcccaggctgggcacgtgggtgccgagtctgcaaaggacagccccatggctgtgagctgtcggctgcagggcgcagggcctggggggcaggcgtttgggccaccaagctggacgttagggtggccacagagggccaagcaggcagggagcctgtgccgccatcctggggggccacaggtgctctctagaaatctgcagccatggcggttttggggtcaggggtctaaaggcagctctgagctgcagtgtagtttgtgatcacccaggaggagggtgtagagcggatggacgggaggaagcggctgcagctggagggaagagaggggccgtccagcctcacccgctgcagtcagctctcctatgggcaaggaaacagctaggtggccctgacccctgcggtcctgagagccggtggccttcagcccctcttggacaggtcatggtctggaagcgcccagcgcaggatggattccagaccagcatccctgcaaccttttcagccccactggctgctgctttaaactggcatggagacatttgatcagcttcccagccagttttctctccagctcagccaggagtgggtgcctgtggcctgtgtcaccaagagctggtgtctcctgcatgaggggcatgcacccctggaatgagggtctgtgcctcgagctcaaagtgtcccggctctgtcatctgcctgaagttgcctggcttttccagtggggcctccttgagtgctgcagcatctgggagcatcctagcctgtcccgtgggtgtggctgggtgagggctaggaggtgagccaggaaggaagcactccactccagagtgaggtgccgcctgagccatcctgtgccccctcagtgtcttcaggtctctgcaggtgtcaggatctcaaaatacttggttcagatcaaacacatttcgtgttcttctgtgtccttttttttttttttttttttttttgagatggagtcttgctctgttggccaggctggagctcagtggcacaatctctgctcactgcaacctctgcctcccaggttccagtgattttcctgcctcagcctcctgggtagctgggactacaggcacatgccccatgcccggctaatttttgtatttttagtagagatggggttttaccatgttggccaggatggtctcaattacaggcatgagccactgtgcccagcctcttctgtgtctttaaaaaggaaagtgtcagtcaacaaaagagcccctctgtcatacaaaccaaatcagttttcaccaaaatgtccttagtcctctcagaaaggcctggcctttaggaccttggaagcaggccctaaagcgcatcggcagggtcagagctttgtgttcaggaacactgggatctgctgagagctggtgtagccgctccaaaactgcacactgcttttcctgtctgctttagtttgtgttgtaaaaacataggaagttcgtgtgtgtgtgtgtgtgtgtgaattcaaggcataaggtgcagttgtgttatgtgggtatagtgcatggtggtgcagtctgggcttcttaccctcacacctcctgcctcccctcgttagagtcccccacatccgccttccactttctgagcccacattgcctgttgggcagctcctggttatgaggcaggacgtgtggtgtttgactgtctgtttctgagctgttttacttaacacagtgtatatggtgcatctttaggaaagcatgcttgtattttcctttcaaagccagatatgggcgggtgtggtggctcatgcctgtgatcccagcactttgggaggccgaggcaggaggattgcttgagcccaggagtttgagagcagcctgggcaacatatcaagactctgtctcttaaaaaaaaaaaaattagccaggcatggtggtccacacctgtggtcccacctattcgggaggctgaagtgcgaggatcacttgagcccaggaggttgaggctgcagtgagctgtgattgtgccactgcactccagcctgggcaacagagcaagaccctgtcttaaaacaaagaaagaataaaaaagaagagaagttgcagttggtagtatttccagagcccggcagacagtgtagaaactgtgagaaacccacctccaaatcaggccttagatagaaaacatcctaagaagtatacgttcattgtaaaatcattatcatcatcatcttctaatccccaaggagacaagctccctgttctgtgttcttgtatgaggcggtcagtcaagcgcagcccgagaggagaggcaggagcctgggagagcctctgctagacctttcctggcacttccccaggaaaggcaaggcagggcagatgtgcggctggccagctggagtgatttccatgggctccaagctgtaggagtggtccctggctgccagagtgctctggccagatagaggtgggctctggactggtgaggctgcattgcggaggcgcgcacacccagctgggcccttatctgtaaggactggctggcctgggaggggcagtctcccagccagaaggtggaatttttttttttttttgagataccaaaacatcctaaggtacaggaaagaaattgtcaacacacacacacagtaccataaacaaggcccagcagaaaggcagacagaagcacacacaccaatgttctgatcttagagtaagcagacacatcacatggaatgaggatgtttaatatatttaaagaaaacaatttatgcacaggaagcaagagactataaaaatgaccaagcagattttaaaaagagaacttgttgaaataaaaataaaatactctaaaaaatattccatgatgtgtttcctgaagaatcgggaactgtttgaagaaatgacccaaagtgcagcacagaaagacagagctggaaaatatgagatgggatgagacaagaagatggagagtttagtatgacatccgcaatttacgagtaattccagaaggaggggaaagagaatatggggtggaggcaagtattcagagaaatacggctgagaactttcccaaaccaacaggagcccctgctccttaggttcaggaaccagcagctcccaagcagcatagttaaaaagctctacccaaacagtcacgtcttggtgaaagtacagaatctcatgacaaagagatcttaaggcagaaaagaaagagattatctggaaagaagaaaataagtagttgattaaaagcaacagtggaagccagaaagatagtaaataatatcttcaaagtcctgggagaaaatagtgatagcctagaattgtgtacccagaaaatccgtctttcaagaatgaggggccaggcgcagtggctcacgtctgtattcccagcactttgggaggccaaggcaggtggatcacctgaggtcaggagttcaagaccagcctgatcaacatggtgaaaccctgtctctactaaaaatataaaaattagctgggtgtggtggcatattcctgtaatcccagctactcgggaggctgaggcaggagaatcacttgaacccaggaggcagaggttgcagtgagccaagattgtgccattgcactccagcctgggcaatagaatgagactctgtctcaaaaaaaaaaaaaaaaaaaaaaaaaaaaagagggctaaacgcattttcataccacgaaactgccctcactccggagtttgctgccagcagagcctagagcgtctaaggcatgtctgggcttctggcgagggatcctgtggggaagctggagatggaagaaggagtgaataggcaggaaggtggatttgtgggcatgtctaaaacaccacatctagaagcttctacttagaatgcctacttttggagtttataaaaaagatgccacatgttgagttgggagagaggtgcccaaacctacagtgttctaaagtccccctactggtcggaaggagggcacggacactgacttcagcatctgttacaaggcttatcagagttttcagataatctctaaaagaatggaaatatatcttccaaactatagagggaagaccatggaatttaaaagccagtccttcaaggagaaatgaacaaactcaaaatcgtagttgggagtgttttttttttttttgagacagagtctcactcttgcccaggctggagtggagtggcataaacacagctcactacagcctcaaccttctgggctcagatgattctcctgcctcagcctcctgagtagcaggaactacaggtgtgagtcatcacactcagctaattttttttttttttttttactttttgtagagatggggttctcactgcattgcccaggctggtcttgaatttctgggctcaggtgatcttcccacctcagcctcctgagtagctgggaccacaggtgcatgctaatttttaaaattttttgtttttaaatgctggtcttcaactcttgtccccaagtagctgggattggggcatgaggcactgtgctaacttcatgttgaaattgaattgccattctaacagtgttaagagatggggcctgtaagaggtgattaggctgtgagggctccactctccaagggcggagttaatgttatgaaagggtaagtccagcccgcttgtgcctctcttgccctccagtgttcaaagcaccatcttggaggtggaattcccaagtcggccagttcctggatcttggactgtccggtctccagaaccgtgagccaataaacctctgttccttgtaaatgagtcagcctcaggtattctcttgtagcagcacaaatggaggcagacacttccttcaccaatctcatgggaggcccactcctgtgagctgcctctagttccccaggccacagactccatcagggctcacctggagccgtccctgtctcacctggaagctctcccactcctctggccagcctgggcatctccacccaatatgagtgatggcgactgattcccttactttagcaagctgggaataaggaatgtttgcctgttcttattcaggggtctctgcatctccacacttgcacaggttgtgtgtacatacattttcctgtctttctggtaagcccctggggtggagctctgggccacagggcaggaaaactcagtgttgctaggaactgccagacattttcccggagtgagtgcagcatttacattcccaccagaagtgtgccaggttcttgtcatactgcgtcctcgccagcgcttggtgctgtcagtcttcttagtttccatttagagattcagtgtttaaattttgaacgtcttgggtgaacaccttggtttgagaaaagtaagaaaaagggtctgtctggctatgggccatggagacccagggcagtgctccacgtgccaaccctggggcagggagcccaagctaggactgtgactgtctgggctgtgggcatctgaccatctccagtgtccccgtctttgatttccctggcgatggtgctagcttagtttgtgcgcatcggcatttgtgggagaaatgaaggattaatacattttgttttatgtcagactctctcagtgagaagttctcagggacaataatagcagggggtcctgctgaagaaaaactgggagatggctgagctctggtccatctttcattgattcattcatttcttcattcattcaaccatgtattgaatgcttatagccaatgaaaataaagtacacagtatatttta

SEQ ID NO: 1562 - DNA, 2362 bp, Homo sapiens
gcggccgccgccccaccgtaggtccgtagcaggtggtcgaagtcgggcctccccgcgggcgtcacccagcgccgccggctgccccagccctgcgtgaaggcgctggaaaacacgcagggcaggttgggcagcaagaagccccgcacaaagtcggcgtaggagaaggcgcccggctccgagacgaaggctacccggcccggagcctggccgacgccggggacatcgacccccaggcctcggaagtggctgtcggcgagggcgcgcgtctcgcggtccatccagctcagcacgggtcgaaggaccctcctcctcacttccgccggagcggaaacggtgaggaccagcctcggaaccagaagacgcagggcgccgcgtttctgccccgccagcgcctggggctccgggcctgcacgcatgcgcgcggctcgccgcggtcttcactgcgcaggcgccgagcggccgaggcgccgcggtcggctctgggactcgtctggcgtccctcagaggcagaagaggcctggaccttggcgcacacagacccaggaacagatgagcagggatgtctgcatccacacctggccgtgcacctactacctggagcccaagaggcgatgggttactggacagctgtccttaacatcgctgtcgctcaggttcatgactgacagcactggagagattctggtcagcttccccctctccagcatagttgagatcaagaaggaggcttcacattttatcttcagctccatcaccatcctggagaagggccatgccaagcactggttcagctccctgcggccaagtcgaaatgtggtcttcagcatcatcgagcatttctggagggagctgctgctgtctcagcctggagccgtggcagacgcatctgtcccaaggacccggggcgaggagctgacgggactcatggctggatcccagaaacgcctggaggacacggcgagggtcctgcaccaccagggccagcagctggacagcgtcatgagaggcctggacaagatggagtcagacctggaggtggcggacagattgctgacagaactggaatctcctgcttggtggccctttagctccaagctttggaagacaccaccggaaacaaagcccagggaagatgtctccatgaccagttgtgaaccctttgggaaagaagggatactgataaaaattcctgctgttatttcccacagaacagagtctcacgttaaaccagggaggctcaccgtccttgtgtctgggttggaaatacatgactccagttctttgctcatgcacaggtttgaaagagaagacgtggacgacatcaaggtccactcaccttacgaaattagcatccgccagcggtttattggaaagccagacatggcctatcgtttgatatctgccaagatgccagaggttatccccattttagaagtgcagttcagcaagaagatggagctgttagaagatgcattggtgctcagaagcgcaagaacctcttcccccgcagagaagagctgctcagtctggcatgcagcatctgggctgatgggccgtaccctgcaccgtgagccacccgcaggagaccaggagggcacagcactgcacctgcagacaagcctgccagccctttctgaggcagatacccaggaactaacccagatcctgaggaggatgaaggggctggccctggaggccgagagtgagctggagagacaagacgaagccctggatggcgttgcagcagctgtggacagggcaaccttgaccatcgacaagcacaacaggcggatgaagaggctgacctaggggcagaacgtccctgcattcctgtctcaccctgcacatcccgctgagatggagggctgggcggcagtgccagggctgcagaggcctgtggccctccggagtggtcttcctctggatggggctgctactgtggggctgcttctgcaccaggggcctccccaggtgtgcaccatgcctgcctcccacttggctgtccctgctgctgggcaggacccggccacatgttctgcggatgctgcagaagtgtggaccatggcgggaccccaaggacacttggcacaggcctggaagaggccgccctcgtcttgtctcggctccctttcatggacagactggccttcttagctgtactataaatttgtgagtgaagttagagcccagctcacttagccagctcactttgagggcatcctataaacacccaactgttcttttatcgtctcggttttagccaaaagtgaaattagcatgactgcatctttcaaacaaaaatattgatttctgcttttagggccccgtttccatccagaaataaagggaaatgctggcttca

SEQ ID NO: 1563 - DNA, 1446 bp, Homo sapiens
atgagggcaaggctccggttcctgccctcacagggtcccagaagcaagggcagtgaggacctggcccacgtccctggcacgggctgtctgattctccttcgctgtggcgggaagatggccggatttgaagattgctgacagaactggaatctcctgcttggtggccctttagctccaagctttggaagacaccaccggaaacaaagcccagggaagatgtctccatgaccagttgtgaaccctttgggaaagaagggatactgataaaaattcctgctgttatttcccacagaacagagtctcacgttaaaccagggaggctcaccgtccttgtgtctgggttggaaatacatgactccagttctttgctcatgcacaggtttgaaagagaagacgtggacgacatcaaggtccactcaccttacgaaattagcatccgccagcggtttattggaaagccagacatggcctatcgtttgatatctgccaagatgccagaggttatccccattttagaagtgcagttcagcaagaagatggagctgttagaagatgcattggtgctcagaagcgcaagaacctcttcccccgcagagaagagctgctcagtctggcatgcagcatctgggctgatgggccgtaccctgcaccgtgagccacccgcaggagaccaggagggcacagcactgcacctgcagacaagcctgccagccctttctgaggcagatacccaggaactaacccagatcctgaggaggatgaaggggctggccctggaggccgagagtgagctggagagacaagacgaagccctggatggcgttgcagcagctgtggacagggcaaccttgaccatcgacaagcacaacaggcggatgaagaggctgacctaggggcagaacgtccctgcattcctgtctcaccctgcacatcccgctgagatggagggctgggcggcagtgccagggctgcagaggcctgtggccctccggagtggtcttcctctggatggggctgctactgtggggctgcttctgcaccaggggcctccccaggtgtgcaccatgcctgcctcccacttggctgtccctgctgctgggcaggacccggccacatgttctgcggatgctgcagaagtgtggaccatggcgggaccccaaggacacttggcacaggcctggaagaggccgccctcgtcttgtctcggctccctttcatggacagactggccttcttagctgtactataaatttgtgagtgaagttagagcccagctcacttagccagctcactttgagggcatcctataaacacccaactgttcttttatcgtctcggttttagccaaaagtgaaattagcatgactgcatctttcaaacaaaaatattgatttctgcttttagggccccgtttccatccagaaataaagggaaatgctggcttca

SEQ ID NO: 1564 - DNA, 540 bp, Homo sapiens
gccacgatgccgcagtaccagacctgggaggagttcagccgcgctgccgagaagctttacctcgctgaccctatgaaggcacgtgtggttctcaaatataggcattctgatgggaacttgtgtgttaaagtaacagatgatttagttcagtggcatttaaattactgtactttaagacatggaattgctggaggcttggaaacttgagtgcaatttccctagtacgacctccaaggagaatagagcaaaacagtgtgtttggtgtataaaacagaccaagctcaagatgtaaagaagattgagaaattccacagtcaactaatgcgacttatggtagccaaggaagcccgcaatgttaccatggaaactgagtgaatggtttgaaatgaagactttgtcgtgtacttaggaagtaaatatcttttgaattagagaaagtgttgggacagaaagtactttatgtaactaagtgggctgttcagaagcttagaggtcattttttgtaattttctttttaattactttagagagctagggatg

SEQ ID NO: 1565 - DNA, 1596 bp, Homo sapiens
ggggctgctgggactcgcgtcggttggcgactcccggacgtaggtagtttgttgggccgggttctgaggccttgcttctctttacttttccactctaggccacgatgccgcagtaccagacctgggaggagttcagccgcgctgccgagaagctttacctcgctgaccctatgaaggcacgtgtggttctcaaatataggcattctgatgggaacttgtgtgttaaagtaacagatgatttagttagacagtgtcttgctctattgctcaggctgcagtgcagtggcatgatcatagctcactgcatcctcgacctcctgggctcaagcggtcctcttgcttcagcctcctgaatagcagagactacagtgtttggtgtataaaacagaccaagctcaagatgtaaagaagattgagaaattccacagtcaactaatgcgacttatggtagccaaggaagcccgcaatgttaccatggaaactgagtgaatggtttgaaatgaagactttgtcgtgtacttaggaagtaaatatcttttgaattagagaaagtgttgggacagaaagtactttatgtaactaagtgggctgttcagaagcttagaggtcattttttgtaattttctttttaattactttagagagctagggatgcaaatgttttcagttagaaagcctttatttacttttggaaattgaacaagaaatgcatctgtcttagaaactggagattatttgatgttaggtaaaacatgtaattgtttctctggcaaatttgtatcagtaatttgaaaatgagatattaggaaaaaccaattcttcttaaatttagttcatctttctttaaaagaacattaaatgtaaccattttgtcagatccatgtattttggagcataaaatgtatgctgttgtgaccaataaatataaaatatggtaattggaattaactccacaccatagtatgcattgttatacatactgtgtacctaattatgtatagcagtgtagtctcaattatatctgaaagtaattgtgactaacaagtatgctttgccttatttccacatttaaactacctgttaatataagggatttgtagtatcagcttgttgagcaatgactttgaatctagttttcagtgatcagaagcagcagttatttgagtgtatgaatggaatgatgatcactgtgctataatgtactgaaaccaccatattacagaaatatttactacatattttccatctgtagtttctcagaagggctatggattagtttgaactgtcaaatccttgcatacttctgtgacacccctgcccattttctgtctttaattaaccaaggtgttaggtgtgactgtcacaactgttatgttttccagtaaactagaagtacgatatttgataattatatttgtatttcaccacctaaatgtaatgttgattcctcaagaatgaaatgaaggcactacattgaaatatgttttgtataaatttgtcatgttgaacagcattttagcatggtaagttcccttagctatatgaattttggcatgtttcagagagatcagtaaataaaatattagataaaatata

SEQ ID NO: 1566 - DNA, 2890 bp, Homo sapiens
atgcaggccaatggggcaggaggaggaggaggaggtggcggcggcggcggtggaggaggagggggcggcgggggccagggacagaccccggaactcgcctgcttgtcggcccagaacggggagtcgtccccctcgtcgtcgtcgtccgcgggggacctggcccacgccaatgggctcctgccttccgccccctccgccgccagcaacaatagcaacagcctgaatgtcaataacggggttcccggcggggcggccgccgcatcctcagccaccgtcgcagctgcctccgccaccaccgccgcctcctcttccttggccaccccagaactgggcagcagcctcaagaagaagaagcggctctcccagtcagatgaggatgtcattaggctaataggacagcacttgaatggcttagggctcaaccagactgttgatctcctcatgcaagagtcaggatgtcgtttagaacatccttctgctaccaaattccgaaatcatgtcatggaaggagactgggataaggcagaaaatgacctgaatgaactaaagcctttagtgcattctcctcatgctattgtggcacaaacattttctgaaacttccatcaacttttttcccctgactgctgctttctgtcatgtcagaggatgaagtttttgctgctgcagcagaagtacctagaatacctggaggatggcaaggtcctggaggcacttcaagttctacgctgtgaattgacgccgctgaaatacaatacagagcgcattcatgttcttagtgggtatctgatgtgtagccatgcagaagacctacgtgcaaaagcagaatgggaaggcaaagggacagcttcccgatctaaactattggataaacttcagacctatttaccaccatcagtgatgcttcccccacggcgtttacagactctcctgcggcaggcggtggaactacaaagggatcggtgcctatatcacaataccaaacttgataataatctagattctgtgtctctgcttatagaccatgtttgtagtagactggtgaattgacaaaatgtaattctaaattattgattgggaaaagaagcaaggaagaccgtgtttcaagatacacttaaaggaggcagttcccatgttatacgcagcagatacttacggagcattgtaatgaagtgtggttctgtaaattctctaatgatggcactaaactagcaacaggatcaaaagatacaacagttatcatatggcaagttgatccggatacacacctgctaaaactgcttaaaacattagaaggacatgcttatggcgtttcttatattgcatggagtccagatgacaactatcttgttgcttgtggcccagatgactgctctgagctttggctttggaatgtacaagaaaactatccccatgtaccttttattattacaccaagggcagctattatctctcagatcctgtttctaatccatgaacaaaatggaatcaagactagattaaatgacaggagaactaaggacaaaaatgagccagtctcatgaagacagtttgacaagtgtggcttggaatccagatgggaagcgctttgtgactggaggtcagcgtgggcagttctatcagtgtgacttagatggtaatctccttgactcctgggaaggggtaagagtgcaatgcctttggtgcttgagtgatggaaagactgttctggcatcagatacacaccagcgaattcggggctataacttcgaggaccttacagataggaacatagtacaagaagatcatcctattatgtcttttactatttcaaaaaatggccgattagctttgttaaatgtagcaactcagggagttcatttatgggacttgcaagacagagttttagtaagaaagtatcaaggtgttacacaagggttttatacaattcattcatgttttggaggccataatgaagacttcatcgctagtggcagtgaagatcacaaggtttacatctggcacaaacgtagtgaactgccaattgcggagctgacagggcacacacgtacagtaaactgtgtgagctggaacccacagattccatccatgatggccagcgcctcagatgatggcactgttagaatatggggaccagcaccttttatagaccaccagaatattgaagaggaatgcagtagcatggatagttgatggtgaatttggagcagacgacttctgtttaacttaaaattagtcgtattttaatggcttgggatttggtgcaaacaaacatgattgatagctggacagacatgctcgtcatgaaaaaagaaccatttctgaagcccgattggggccaaacatttacaccttgcttcatagtaaccagttgagatgaagcacgtcgttagaacgttgttggacaccatgttgaattattcccccatcggttgtgaagaactgtgctacattcaggcttacccattgaactcagtatatatatttttttccttcctgtcttttgtctggcaggataccattcttgttgctcttctgtgtaatgaagtttaaatgcttgtttggaaaactttatttaacagtttagaaggcttgatagaaagagtgcattagtctgaagagtatacattggataggaaagaatttccttcttttgtttctccaaatctttccgccttatttagcttgagatctttgcagcttggttcatggattctagccttgcccgttgcgcagtatatactgatccagatgataaaccagtgaactatgtcaaaagcactctcaatattacatttgacaaaaagttttgtacttttcacatagcttgttgccccgtaaaagggttaacagcacaattttttaaaaataaattaagaagtatttatagg

SEQ ID NO: 1567 - DNA, 8233 bp, Homo sapiens
ccaggcggcggcggccaaactccgcggcgtccccagggcgccagcttcgccctcgccgccgcggccgcgctgctcttcggctccgacatggaagatggaccttctaataatgcgagctgcttccgaaggctgaccgagtgcttcctgagccccaaatgaggatagaagagaggaaatcccaacatttaacaggtttgacagatgaaaaagtgaaggcatatctttctcttcacccccaggtattagatgaatttgtatctgaaagtgttagtgcagagacagtagagaaatggctgaagaggaagaacaacaaatcagaagatgaatcagctcctaaggaagtcagcaggtaccaagatacgaatatgcagggagttgtatatgaactaaacagctatatagaacaacggttggacacaggaggagacaaccagctactcctctatgaactgagcagcatcattaaaatagccacaaaagccgatggatttgcactgtatttccttggagagtgcaataatagcctgtgtatattcacgccacctgggataaaggaaggaaaaccccgcctcatccctgctgggcccatcactcagggcaccaccgtctctgcttatgtggccaagtccaggaaaacactgctagtagaagacatccttggagatgaacgatttccaagaggtactggactggaatcagggactcgtatccagtctgttctttgcttaccaattgtcactgcaattggtgacttgattggtattctcgagctgtatcggcactggggcaaagaagccttctgtcttagtcaccaggaggttgcaacagcaaatcttgcctgggcttcagtagcaatacatcaggtgcaggtatgcagaggccttgccaaacagacagaattgaatgacttcctactcgacgtatcaaaaacatattttgataacatagttgcaatagattctctacttgaacacataatgatatatgcaaaaaacctggtgaatgccgatcgttgtgcgcttttccaggtggaccataagaacaaggagttatattcagacctttttgatattggagaggaaaaggaaggaaaacctgtcttcaagaagaccaaagagataagattttcaattgagaaaggaattgctggccaagtagcaagaacaggggaagtcctgaacattccagatgcctatgcagacccacgctttaacagagaagtagacttgtacacaggctacaccacgcggaacatcctgtgcatgcccatcgtcagccgaggcagcgtgataggtgtggtgcagatggtcaacaaaatcagtggcagtgccttctctaaaacagatgaaaacaacttcaaaatgtttgccgtcttttgtgctttagccttacactgtgctaatatgtatcatagaattcgccactcagagtgcatttaccgggtaacgatggaaaagctgtcctaccatagcatttgtacttcagaagagtggcaaggtctcatgcaattcacccttcccgtgcgtctctgcaaagaaattgaattattccactttgacattggtccttttgaaaacatgtggcctggaatttttgtctacatggttcatcggtcctgtgggacatcctgctttgagcttgaaaagttgtgtcgttttattatgtctgtgaagaagaactatcggcgggttccttatcacaactggaagcatgcggtcactgtagcacactgcatgtatgccatacttcagaacaatcacacgcttttcacagaccttgagcgcaaaggactgctgattgcgtgtctgtgtcatgacctggaccacaggggcttcagtaacagctacctgcagaagttcgaccaccctctggccgctctctactccacttccaccatggagcagcaccacttctcccagactgtgtccatcctccagttggaagggcacaatatcttctccactctgagctccagtgaatatgagcaggtgcttgagatcatccgcaaagccatcattgccacagaccttgctttatactttggaaacaggaagcagttggaagagatgtaccagaccggatcactaaaccttaataatcaatcacatagagaccgtgtaattggtttgatgatgactgcctgtgacctttgttctgtgacaaaactgtggcccgttacaaaattgacggcaaatgatatatatgcagaattctgggctgagggtgatgaaatgaagaaattgggaatacagcctattcctatgatggacagagacaagaaggatgaagtcccccaaggccagcttgggttctacaatgccgtggccattccctgctatacaacccttacccagatcctccctcccacggagcctcttctgaaagcatgcagggataatctcagtcagtgggagaaggtgattcgaggggaggagactgcaacctggatttcatccccatccgtggctcagaaggcagctgcatctgaagattgagcactggtcaccctgacacgctgtcccacctacagatcctcatcttgcttctttgacattcttttcctttttttggggggggtggggggaacctgcacctggtaactggggtgcaaacctcttcaagaaggtaacatcaaataaataagtcaagcagaggacttcctgccaatctcttctgtgaggcatcatagacactgagcaaccaggaccacccccacgttcagaaatcagctggccaagtgactccatttgacttgcaaaccagccttttctaataggctaatattgctgaggccttaaaggaaatggacaaaaattatccagaaggggtacttttccattgtatctttctaataagggtttaaaatggtactattatggtattgtacttgggctttaacatcaatgttgctttgatgttgttggatataaataggaatttttacacattactattgtgaatggtgaatgttcatgtatgacctacttgtaattaacttgagttgtagtccacagcctcaggacaaatgtcgttgaggttacagagtaagaaatgatggcaaaacgtcaaactcttatttcagagcttcatgaatttagttagactaaacataattctttaagttcaacctaaagggctgagatcaataaatttaacactagacgaagtagacttcctgtctttttgagaagagatgaggtatatgttacaataaatctcagaacttcaagtagcagttcaaaagatgtcagtttttaaaattgtttttgttgttgtcttggcagttttactgaaccctttgcataaagaacaaaataaaagctcggcattgtaatttttttaatggacaagtcttatggatacgaagggtacatttttcataatgattcctttatattttcactttgtgtcattgcagaattttagactctcattcacaatgaaaagtttattttaaacattgtttaattaaaataccatacagttctcttttaaacatcaaaccataaaaagtgtattttgtaattttactctgacctgccgcagtcacctctcacttatctcttccacgtactgcacggtcgtatttcatgagctttctgtccatagcacagaaacagagcagaaagtagtacaatcatgttggaccttctttctgttctctttactcttctcacagatcagatcactccatagaagcctgtgggtttcgatggtttcttctatacacctttttggttgaccagtattactatacaatgtaagtgttttaaaaaatacgaaagtaatactctgcaccccttcctacaaagatgataaagcagtcacttctggcgcattttaataatttaaagatttttagtgcaatggcacggtaacctccaaacctgaattagacagagactcactcaggaagtgacaggcccatcatatcaaataacttattcacttttcatgtggcaggaaactggaatatcgcttttaataaaatggaaaaatatgcttctacatatttaccaccataggcgttttgttcatatgagcctggtttgtgcaaaattaaatcagaggcttctacaacatggtttatttatgttgtagcaaagttggctctacataaacattgttcttattttaaaattaacactatgtgttcagttttcttgtgggcttctgaaagttgccatcttccctccgtggagctccatttgctattttcattatacactatgaggtaaaatgtaataacaaaagagagagaagtaccactgtggctagatatatacacacacatatatatatggatggatgtaatatatgtagaacacacacatagatgtatataggatacacactcatgtatgtaaacgtatacatatgtgtatatatgatacatacacatacacacacacgagagacagaaggaaagagaggaagagagaagcaaacatgtaggaaaaaatataaatcagccccattctcccattctttaagaacaatgatttttcttgatggaaaatgcatatcacttgacagttgacaagaaagtgtcatttttgtgttagtgtatcatataattgaatttgaacaagatacatatttttctgcatacaaatttatgaagctggagtctaccaaacacagctttagtcacaaaagttagtttagttatctcatttcgcttggagatggaatttcaggaagggatatattatttaagattattgtttaattacaagaattttaaaagaatgtatgaattctgttttttaatatagaaaataattatggagttaggaatctcatggctacatttacatttttaggttattacagaaaattctcttaatttattatagtcaagtgtattatgtaatctctatttagaacagtttcccaaaggaatgtgattggatttactggttggttaatttcttgtgaaatattgtcataatagaagcacagcttgaacaaaagactgaattctgatataaactgtcaatattgcttttaccatgtgtaagatttacttagtaatcacagatttacctaaaataaaaggacccgggttgcagtgatatttagttaatgatttgttttggaaaacatgcagttaggagtatttttgtattttgtcagatgtttaggagacagactttcgggtcatgtttcttgtcttgttcccagatcttttcttaaaagaacagtgtgacaccagaagccaagagatggtttttactaacaacagctttgatgagttcctattaaggtcgtattgtgtattgtgccaaattttccacccagtataaatttagtaacccgctatgagcatatgtaggatattcaatttgcagatacttttgttggttatgttggtttataatagacaagttttatggtcatatgcaattattccattatctttttggacacagtgaatatgttttttagctaaaaatgtccttggaaacataaatgcctgccaataacatggaatattgaattcgggcaatgtgaattgattaattagaaaagggtcaaaagaaatacaatggatgtggaaactaattctaaaaaatagccctattaatagggcagagactctggtccatttcccagctgtacttctctctaagaggtgtatgaaaaacccatcttgcaaaagagaccaaaatattagacacaatcgttcccattcctgactcttcaatggaaaaggaaggtacagatgtttacagtggtgccccaggtgactcgttctcaccacaacaaaagcaactaattggaaactagatgtgttcaataatagatttcctcttttttggcatgctttttagattttttttcattttgtaaaatctcagttaatttttctttattggtatatttgtgtatgcgagacaaatcctgtattgtacaggatataaatagatgcataaatccttagatacctgggttttttaataggtttaggtttgggtattgtgtttctggtcttttaactcaaaattaaggtttgagctttaataggactaaattattcacctgccttggcctgtgcctttattttaaatactgcaattttacttcttcattcatgtatttattattttgcttttcttgcttaagtataattgaaaatatttgcaggaacgcacaattcattttatcaagttgaatgaataggaccattctctcctcatcagatttctgttctttatttgacttcattgacatataccctggtgactataaccagtgaactgttcagagtcagtcttttcggcaagaacttcagagaactgtgacactggttatgatgtgattttggggggtttcaggtacctaagcatgatttttaaaatcacttctctctttacatatttcgaacatatgtttgctttctacactttgcagattttatttaggatttaattctttaaagactatattcatttagtcactatagtggatctcttctactgcaagtattcatctgatttttaaattatgtaaaatgtaaatcagccaagtatgtcatccgttatagtttccccatgctttcagcgcatggccatgagatttttacatgtgcataagtatttagccaatacacattttgctgacttctttaaccatttatattgtttaaattagtaatatccaatgcagtgcacacttttttgtcttttttccaacggaatattttggttgtctgtagcgttggaagcattttatatgataaaaatagcaagaaaaaattaaaaagtgtcaacggtgtgctggttctaaattaagaagatagaacaaagagaaagacattaatgttacctaagaaacacatttaacatccgaagaagcaatgctgtcctcacttgatgtttctcttctcaacccagcaatggagagcagggcttgcaaagccgtacagagcctacgtgctctttcctgcaagtgggagaaaactaatcaatggcacacagggccaggtgtggccctgtgaggcaaaggataatgtcacctcaggaccaaggtggaaacttacagctgaatccagggcttactaagtagggaagtcagtttacatatttcagttttcctctgatgtttttgaggtactgtgtatttgcagaagtttaagcagaagggttttgtttctattgtaagttaggttctaaaagtgtataatctgatactctagcccaactgaaatattatatcttgggcgttacagcctttgtctttttctttagtcaccttaatacccagtcctatgctgtatctctgatagcctatataaatgacatataggaatattattttccatatgatctgttgtatggtgtatatgctatgtgttcatttcgtgtgcaagttcagagtgtaatagatttacccagagaaggtgtttctatacaatgcccctacctatttgaaattacatgcttgcccaacacactgtgaaatagttaccaaaatttgtacaaatgcagcatcttcattctttctgagaagacaagatggttttctttacatgaacaaatgaacaaaagagatcctagatccataacgtagctaaggcatctaagagtttgctgttgataatcttgctgaccaaaaactactggagagtaacacaggttatatgccatcacaaatacaatgctcatgaagaactgatttgtagagtcaatgaacctgtgtccagaattttaataggctctctattggaaggagaaagaatttcaagttaacagtatctaactttatcatagttgatgttagtaaattttaaaaaatgattttatatgtatgacaaaaatctttgtaaaatgcgcaagtgcaataatttaaagaggtcttaactttgcatttataaattataaatattgtacatgtgtgtaattttttcatgtattcatttgcagtctttgtatttaaaaaacatttactgttatgtttgtataatagaacagtaatcatttattataatctaggcaagttgtaaataaattcataattcaaacagccagtatatatgcatatatgagtgttatattgcaaaatctttgttttacttacatggttaaagcagcaagaattcttttgttgatatgtaattatacacataaaatatatatatgtatgatacatgaaatatatttagaaatgttcataattttaatggatatcctttggtgtgaataattgaatacagagtttttaaaatatc

SEQ ID NO: 1568 - DNA, 1819 bp, Homo sapiens
ggcagtggcatcagcgatggcggctgcgtcggggtcggttctgcagcgctgtatcgtgtcgccggcagggaggcatagcgcctctctgatcttcctgcatggctcaggtgattctggacaaggattaagaatgtggatcaagcaggttttaaatcaagatttaacattccaacacataaaaattatttatccaacagctcctcccagatttaaaataaccaatgactgcccagaacaccttgaatcaattgatgtcatgtgtcaagtgcttactgatttgattgatgaagaagtaaaaagtggcatcaagaagaacaggatattaataggaggattctctatgggaggatgcatggcaatacatttagcatatagaaatcatcaagatgtggcaggagtatttgctctttctagttttctgaataaagcatctgctgtttaccaggctcttcagaagagtaatggtgtacttcctgaattatttcagtgtcatggtactgcagatgagttagttcttcattcttgggcagaagagacaaactcaatgttaaaatctctaggagtgaccacgaagtttcatagttttccaaatgtttaccatgagctaagcaaaactgagttagacatattgaagttatggattcttacaaagctgccaggagaaatggaaaaacaaaaatgaatgaatcaagagtgatttgttaatgtaagtgtaatgtctttgtgaaaagtgatttttactgccaaattataatgataattaaaatattaagaaataacactttcctgacttttttattattaaaatgcttatcactgtagacagtagctaatcttattaatgaaaaacaatagacaaacatctgtgcataatttttcagacacaattctgtaaatatttggaaaccttttaagtatttaaacttttaaatttttgaaataaagtattctaaactaatataaataaggacaatgaaaaaacatgaaaggacttagcataatgttattttatcttttctacaactttgtttaaattacctttccaaagatatttgtgtttatgtaattttccacggaataacattaatactctaggtttataaaccggtttcacattatttcatttgatcatcacaagagctttgtgaagtaagccgagaagttgttactggtatttaataatagcaatagaggagttaaagactttcccacagcttgcaggtcaagacaagaaattcaggtctcctaattctcagtggagctctatttctgttaacccaaattgctgctctgttttaggtctcaatttcatctgtaaaatgatactaatagtacttatcccattggatttttgttgagatttaaataaatagccaaaagccaatacataataaacactcaataaagattaaccataaggagagtcatgatctggttccaggaatacattgttagatgactgaaaaattgtattacttcaatgaaaatactataaataataacattttcatatattagttggttctcatgcatacataatctaattttatttgatcctcacaactgtttaagttttattaaatatacattatccctatttgtataaatagaatcatacaatacctgcctgctttcattcaacaaaattatcatgagatttttccatgttgtgtacatcaatagttcatctattttattgctcagtaatattccattgtgtggatgtatcactatttgtttacacattcaccactgatatataagttgcttccagtgtgaggctgttttaaataaagctgctatgaatattcatgtaaga

SEQ ID NO: 1569 - DNA, 1898 bp, Homo sapiens
cgcggcaacgcaggggcggaaccgcatgactggcagtggcatcagcgatggcggctgcgtcggggtcggttctgcagcgctgtatcgtgtcgccggcagggaggcatagcgcctctctgatcttcctgcatggctcaggtgattctggacaaggattaagaatgtggatcaagcaggttttaaatcaagatttaacattccaacacataaaaattatttatccaacagctcctcccagatcatatactcctatgaaaggaggaatctccaatgtatggtttgacagatttaaaataaccaatgactgcccagaacaccttgaatcaattgatgtcatgtgtcaagtgcttactgatttgattgatgaagaagtaaaaagtggcatcaagaagaacaggatattaataggaggattctctatgggaggatgcatggcaatacatttagcatatagaaatcatcaagatgtggcaggagtatttgctctttctagttttctgaataaagcatctgctgtttaccaggctcttcagaagagtaatggtgtacttcctgaattatttcagtgtcatggtactgcagatgagttagttcttcattcttgggcagaagagacaaactcaatgttaaaatctctaggagtgaccacgaagtttcatagttttccaaatgtttaccatgagctaagcaaaactgagttagacatattgaagttatggattcttacaaagctgccaggagaaatggaaaaacaaaaatgaatgaatcaagagtgatttgttaatgtaagtgtaatgtctttgtgaaaagtgatttttactgccaaattataatgataattaaaatattaagaaataacactttcctgacttttttattattaaaatgcttatcactgtagacagtagctaatcttattaatgaaaaacaatagacaaacatctgtgcataatttttcagacacaattctgtaaatatttggaaaccttttaagtatttaaacttttaaatttttgaaataaagtattctaaactaatataaataaggacaatgaaaaaacatgaaaggacttagcataatgttattttatcttttctacaactttgtttaaattacctttccaaagatatttgtgtttatgtaattttccacggaataacattaatactctaggtttataaaccggtttcacattatttcatttgatcatcacaagagctttgtgaagtaagccgagaagttgttactggtatttaataatagcaatagaggagttaaagactttcccacagcttgcaggtcaagacaagaaattcaggtctcctaattctcagtggagctctatttctgttaacccaaattgctgctctgttttaggtctcaatttcatctgtaaaatgatactaatagtacttatcccattggatttttgttgagatttaaataaatagccaaaagccaatacataataaacactcaataaagattaaccataaggagagtcatgatctggttccaggaatacattgttagatgactgaaaaattgtattacttcaatgaaaatactataaataataacattttcatatattagttggttctcatgcatacataatctaattttatttgatcctcacaactgtttaagttttattaaatatacattatccctatttgtataaatagaatcatacaatacctgcctgctttcattcaacaaaattatcatgagatttttccatgttgtgtacatcaatagttcatctattttattgctcagtaatattccattgtgtggatgtatcactatttgtttacacattcaccactgatatataagttgcttccagtgtgaggctgttttaaataaagctgctatgaatattcatgtaaga

SEQ ID NO: 1570 - DNA, 1101 bp, Homo sapiens
ggaacatcggcggctgcccgggtgacttggttatatgtcacagaataacattcgagaatgggacatggaatgaggcgacggccccagcaagccccagcagccccagccccagccccaggcccagcagcagcagcagcagcccctgctctcccgccgcccggagaggctctgcagccatgaagccaaccgtcccgaggcaccgccggtaagcagggagcctccgcggagctcccgccgccgctcccccttggcgccaaaggcacccggtcccggagcagccacgcgcggcccgtgagcctcgccaccagcgggggctcagaggaggaggacaaagacggcggggtgctgttccacgtcaacaagagcggcttccccatcgacagccacacctgggagcgcatgtggatgcacgtggccaaggtgcaccctaaggggggagaaatggtgggcgccatcaggaacgccgccttcttggcaaagccttcaataccccaggtcccaaactacaggctgtcgatgacgatcccagactggctccaggcgatccagaattacatgaagaccctacaatataatcacacagggacccagttctttgaaattaggaaaatgagaccgctgagtgggttaatggaaacagcaaaagaaatgacccgagagtccttgcctatcaaatgccttgaagctgtcatcctgggcatctacttaaccaatgggcagccttccattgagcggttccccatcagctttaaaacctacttctcaggaaactactttcaccacgttgtgctggggatttactgcaatggccgctatggctcattgggcatgagccgcagggctgagctgatggacaagccattgacttttcggactctgagtgacctcatctttgactttgaggactcttacaagaaatacctgcacacagtcaagaaggtcaagattgggctgtacgtcccccatgagcctcatagcttccagcccattgagtggaagcagctggtcctcaacgtctcaaagatgctgagggctgacataaggaaggagctggagaaatatgccagggacatgagaatgaagggcttgtgcagtcactaa

SEQ ID NO: 1571 - DNA, 3572 bp, Homo sapiens
gccccagcagccccagccccagccccaggcccagcagcagcagcagcagcccctgctctcccgccgcccggagaggctctgcagccatgaagccaaccgtcccgaggcaccgccggtaagcagggagcctccgcggagctcccgccgccgctcccccttggtgagtcctgccgcagcgagaggcatggagaaggccgcccccgcggggcgctgatcccctcgccgcgcccgcgcgcacacgccccccgccgccgccgccgctgccgccgccgcgcgcccccagtacctcgctccccgcccaggccccaccatgaccggctccgcggccgacactcaccgctgcccccaccccaaaggcgccaaaggcacccggtcccggagcagccacgcgcggcccgtgagcctcgccaccagcgggggctcagaggaggaggacaaagacggcggggtgctgttccacgtcaacaagagcggcttccccatcgacagccacacctgggagcgcatgtggatgcacgtggccaaggtgcaccctaaggggggagaaatggtgggcgccatcaggaacgccgccttcttggcaaagccttcaataccccaggtcccaaactacaggctgtcgatgacgatcccagactggctccaggcgatccagaattacatgaagaccctacactacttaaccaatgggcagccttccattgagcggttccccatcagctttaaaacctacttctcaggaaactactttcaccacgttgtgctggggatttactgcaatggccgctatggctcattgggcatgagccgcagggctgagctgatggacaagccattgacttttcggactctgagtgacctcatctttgactttgaggactcttacaagaaatacctgcacacagtcaagaaggtcaagattgggctgtacgtcccccatgagcctcatagcttccagcccattgagtggaagcagctggtcctcaacgtctcaaagatgctgagggctgacataaggaaggagctggagaaatatgccagggacatgagaatgaagatcctgaaacctgcaagtgcccactctccgacccaagtgagaagccggggaaaatccctgtcccccagaaggagacaggcaagccccccgaggaggctcggccggcgagagaagtcgcctgcactgcctgaaaagaaggtggctgatctgagcactctgaatgaagtgggctatcaaatccgaatttagccaagccataccggccagcaagagggtttctgtggtgcttctctctgcactttacccagcatcttcaggaggaactgcaactatttattaagaacttgtgaattttatttttaaggattcacctggaaatagaatctgagtgggtggtaaccattagctttaaaaaattcactaaaaggcaccatgaaaaggctgaagtaataagccccactggggttggactatgtccctcactcaagatcttaaggataaccgtaactgaagttttatatttttccatttacctactttcttttacttgctttgaacattatgcctcaccaatagtaaatgttcatgaaataatctcttgaacttttggtatagtaaggtaactctaacagtattactgtctttttcagcaataacagaaagcaaaaatgggtgggttttttttaagcagttattacctcagcattttgacatcagatatgcaaacttaatggcgttttgtttttttatattctatttgtattctttccccagtatttcccatggggatctccacaagtttggagttttttcctggtgcacacacgtgaggagatttaaggtactatatgcaagtgttttactaaaaagcactgaaattcttctggcaatacaagaaccattttcaggatcttggagttacttccttcttaatctttcttaaagcattcactgatgtttttgttttttcaaaatgaaacaaaaatatcacattgagaagctagtctatgttctgtcactaacatttaaactttgcagactctaacaaaaagcacaagaggtcacgtactattatacaaatttagcggtactggatttacctctgacattaacacactcaggcagagaccaggagtgatcagcaggtcttcagaaccaaaaaacctttctgttcacatttcatctgatttttaaactgaggcaggctttgattcttctgaaggatgccaagaatcaaactaagggaggactcactgttaaagatgtgttctgatgtcttatattaagaccaaatgtgacatgatgtgattatcttccagtactttgcttttaggtaccatttcatgacattttaggaatgagtattggaaaatataaagaattagaaaagcagcactttttttttaatggaaaagtcttcggtccagtgttacaccttatagtgtaattcagtccctaagcacagaatgaatgtctggcctgcatatggtagttacagtgtaacctctggctgcagaccacacaggacaaccctaacagcctagtcttgtatggtgtaaatatcaagagtacagcttcaatttcatttgctttatcttagcaacaatgccaactcaggagagcagacggccgatttcagtgaagtctggtagtcaacagatgttatttcagtctcagtgcatctcctctggctttctttgactgaaggtgtttataggaaggaagttaaaaaaaaaaaaagctcattgagattctttaccaattctttacaagatttctgggggtgacagggaaagcaaaaggacttcaaagcaaaagggtgcacaagagcttacttcaccctgaaaatcagtattattaatgaaaagtactgttttcttaaagaagtcgaatgtcctttagatgaacaagaccaagtatacatctccattagattaaaatgtagcacagggttaaaaattatcagtttaatctctttaagaacagtattatcagagtttaaaatgagttagctctgtttatctacacacagcaaacccattcgcagcctcttggccacatgtattcagatgtttgaaatagtgaatcatttcattttcattctaaaacaatactgacttagccatataccttctgtttgtcaatctgaaacttgcttacatctaataagtagacctcttataacactgcaaccattctaagagttggaatttatttttgccaagtattaagtactgttacatctaaaatacagaatgtcaaatggttgcatagcttgtttcccacaacaaggaggaaaagaacaggaatacaaactctgtaatatgctgataaagaagccttagaactgccaactggcttgatggttcaattagtaagctaatttctcccacacccgctccttgatttttagactaattttcccaaagcaaggtttagtcacacaaacttgaaagtacatttaaaatgttcttagttgtcatcctacttttattgcctatggaatatgctaatttctaaaaaaaatacgggagaggcaccaaacccctaaattctagtgcaataatttaaaaaa

SEQ ID NO: 1572 - DNA, 1369 bp, Homo sapiens
gttgcggtggccaatagacgcattcggaacatcggcggctgcccgggtgacttggttatatgtcacagaataacattcgagaatgggacatggaatgaggcgacggccccagcaagccccagcagccccagccccagccccaggcccagcagcagcagcagcagcccctgctctcccgccgcccggagaggctctgcagccatgaagccaaccgtcccgaggcaccgccggtaagcagggagcctccgcggagctcccgccgccgctcccccttggtgacctcgccaccagcgggggctcagaggaggaggacaaagacggcggggtgctgttccacgtcaacaagagcggcttccccatcgacagccacacctgggagcgcatgtggatgcacgtggccaaggtgcaccctaaggggggagaaatggtgggcgccatcaggaacgccgccttcttggcaaagccttcaataccccaggtcccaaactacaggctgtcgatgacgatcccagactggctccaggcgatccagaattacatgaagaccctacaatataatcacacagggacccagttctttgaaattaggaaaatgagaccgctgagtgggttaatggaaacagcaaaagaaatgacccgagagtccttgcctatcaaatgccttgaagctgtcatcctgggcatctacttaaccaatgggcagccttccattgagcggttccccatcagctttaaaacctacttctcaggaaactactttcaccacgttgtgctggggatttactgcaatggccgctatggctcattgggcatgagccgcagggctgagctgatggacaagccattgacttttcggactctgagtgacctcatctttgactttgaggactcttacaagaaatacctgcacacagtcaagaaggtcaagattgggctgtacgtcccccatgagcctcatagcttccagcccattgagtggaagcagctggtcctcaacgtctcaaagatgctgagggctgacataaggaaggagctggagaaatatgccagggacatgagaatgaagatcctgaaacctgcaagtgcccactctccgacccaagtgagaagccggggaaaatccctgtcccccagaaggagacaggcaagccccccgaggaggctcggccggcgagagaagtcgcctgcactgcctgaaaagaaggtggctgatctgagcactctgaatgaagtgggctatcaaatccgaatttagccaagccataccggccagcaagagggtttctgtggtgcttctctctgcactttacccagcatcttcaggaggaactgcaactatttattaagaacttgtgaattttatttttaa

SEQ ID NO: 1573 - DNA, 1206 bp, Homo sapiens
agcagcagcagcagcagcccctgctctcccgccgcccggagaggctctgcagccatgaagccaaccgtcccgagccttcaataccccaggtcccaaactacaggctgtcgatgacgatcccagactggctccaggcgatccagaattacatgaagaccctacaatataatcacacagggacccagttctttgaaattaggaaaatgagaccgctgagtgggttaatggaaacagcaaaagaaatgacccgagagtccttgcctatcaaatgccttgaagctgtcatcctgggcatctacttaaccaatgggcagccttccattgagcggttccccatcagctttaaaacctacttctcaggaaactactttcaccacgttgtgctggggatttactgcaatggccgctatggctcattgggcatgagccgcagggctgagctgatggacaagccattgacttttcggactctgagtgacctcatctttgactttgaggactcttacaagaaatacctgcacacagtcaagaaggtcaagattgggctgtacgtcccccatgagcctcatagcttccagcccattgagtggaagcagctggtcctcaacgtctcaaagatgctgagggctgacataaggaaggagctggagaaatatgccagggacatgagaatgaagatcctgaaacctgcaagtgcccactctccgacccaagtgagaagccggggaaaatccctgtcccccagaaggagacaggcaagccccccgaggaggctcggccggcgagagaagtcgcctgcactgcctgaaaagaaggtggctgatctgagcactctgaatgaagtgggctatcaaatccgaatttagccaagccataccggccagcaagagggtttctgtggtgcttctctctgcactttacccagcatcttcaggaggaactgcaactatttattaagaacttgtgaattttatttttaaggattcacctggaaatagaatctgagtgggtggtaaccattagctttaaaaaattcactaaaaggcaccatgaaaaggctgaagtaataagccccactggggttggactatgtccctcactcaagatcttaaggataaccgtaactgaagttttatatttttccatttacctactttcttttacttgctttgaacattatgcctcaccaatagtaaatgttcatga

SEQ ID NO: 1574 - DNA, 4224 bp, Homo sapiens
attcgagaatgggacatggaatgaggcgacggccccagcaagccccagcagccccagccccagccccaggcccagcagcagcagcagcagcccctgctctcccgccgcccggagaggctctgcagccatgaagccaaccgtcccgaggcaccgccggtaagcagggagcctccgcggagctcccgccgccgctcccccttggcgccaaaggcacccggtcccggagcagccacgcgcggcccgtgagcctcgccaccagcgggggctcagaggaggaggacaaagacggcggggtgctgttccacgtcaacaagagcggcttccccatcgacagccacacctgggagcgcatgtggatgcacgtggccaaggtgcaccctaaggggggagaaatggtgggcgccatcaggaacgccgccttcttggcaaagccttcaataccccaggtcccaaactacaggctgtcgatgacgatcccagactggctccaggcgatccagaattacatgaagaccctacaatataatcacacagggacccagttctttgaaattaggaaaatgagaccgctgagtgggttaatggaaacagcaaaagaaatgacccgagagtccttgcctatcaaatgccttgaagctgtcatcctgggcatctacttaaccaatgggcagccttccattgagcggttccccatcagctttaaaacctacttctcaggaaactactttcaccacgttgtgctggggatttactgcaatggccgctatggctcattgggcatgagccgcagggctgagctgatggacaagccattgacttttcggactctgagtgacctcatctttgactttgaggactcttacaagaaatacctgcacacagtcaagaaggtcaagattgggctgtacgtcccccatgagcctcatagcttccagcccattgagtggaagcagctggtcctcaacgtctcaaagatgctgagggctgacataaggaaggagctggagaaatatgccagggacatgagaatgaagatcctgaaacctgcaagtgcccactctccgacccaagtgagaagccggggaaaatccctgtcccccagaaggagacaggcaagccccccgaggaggctcggccggcgagagaagtcgcctgcactgcctgaaaagaaggtggctgatctgagcactctgaatgaagtgggctatcaaatccgaatttagccaagccataccggccagcaagagggtttctgtggtgcttctctctgcactttacccagcatcttcaggaggaactgcaactatttattaagaacttgtgaattttatttttaaggattcacctggaaatagaatctgagtgggtggtaaccattagctttaaaaaattcactaaaaggcaccatgaaaaggctgaagtaataagccccactggggttggactatgtccctcactcaagatcttaaggataaccgtaactgaagttttatatttttccatttacctactttcttttacttgctttgaacattatgcctcaccaatagtaaatgttcatgaaataatctcttgaacttttggtatagtaaggtaactctaacagtattactgtctttttcagcaataacagaaagcaaaaatgggtgggttttttttaagcagttattacctcagcattttgacatcagatatgcaaacttaatggcgttttgtttttttatattctatttgtattctttccccagtatttcccatggggatctccacaagtttggagttttttcctggtgcacacacgtgaggagatttaaggtactatatgcaagtgttttactaaaaagcactgaaattcttctggcaatacaagaaccattttcaggatcttggagttacttccttcttaatctttcttaaagcattcactgatgtttttgttttttcaaaatgaaacaaaaatatcacattgagaagctagtctatgttctgtcactaacatttaaactttgcagactctaacaaaaagcacaagaggtcacgtactattatacaaatttagcggtactggatttacctctgacattaacacactcaggcagagaccaggagtgatcagcaggtcttcagaaccaaaaaacctttctgttcacatttcatctgatttttaaactgaggcaggctttgattcttctgaaggatgccaagaatcaaactaagggaggactcactgttaaagatgtgttctgatgtcttatattaagaccaaatgtgacatgatgtgattatcttccagtactttgcttttaggtaccatttcatgacattttaggaatgagtattggaaaatataaagaattagaaaagcagcactttttttttaatggaaaagtcttcggtccagtgttacaccttatagtgtaattcagtccctaagcacagaatgaatgtctggcctgcatatggtagttacagtgtaacctctggctgcagaccacacaggacaaccctaacagcctagtcttgtatggtgtaaatatcaagagtacagcttcaatttcatttgctttatcttagcaacaatgccaactcaggagagcagacggccgatttcagtgaagtctggtagtcaacagatgttatttcagtctcagtgcatctcctctggctttctttgactgaaggtgtttataggaaggaagttaaaaaaaaaaaaagctcattgagattctttaccaattctttacaagatttctgggggtgacagggaaagcaaaaggacttcaaagcaaaagggtgcacaagagcttacttcaccctgaaaatcagtattattaatgaaaagtactgttttcttaaagaagtcgaatgtcctttagatgaacaagaccaagtatacatctccattagattaaaatgtagcacagggttaaaaattatcagtttaatctctttaagaacagtattatcagagtttaaaatgagttagctctgtttatctacacacagcaaacccattcgcagcctcttggccacatgtattcagatgtttgaaatagtgaatcatttcattttcattctaaaacaatactgacttagccatataccttctgtttgtcaatctgaaacttgcttacatctaataagtagacctcttataacactgcaaccattctaagagttggaatttatttttgccaagtattaagtactgttacatctaaaatacagaatgtcaaatggttgcatagcttgtttcccacaacaaggaggaaaagaacaggaatacaaactctgtaatatgctgataaagaagccttagaactgccaactggcttgatggttcaattagtaagctaatttctcccacacccgctccttgatttttagactaattttcccaaagcaaggtttagtcacacaaacttgaaagtacatttaaaatgttcttagttgtcatcctacttttattgcctatggaatatgctaatttctaaaaaaaatacgggagaggcaccaaacccctaaattctagtgcaataatttaaaaaacaaaaaacaaaacaaaacaaaaaacatgttatatgcacccccctcccaaagctgattttaagactggctagaattcaaaatataaaaaataaaactatgaagtgatttgaaatcggttttaaaaagttgttagtgcaagagaaattttatgtttaagccatcatggcaatatatgcaaagtttaaatgaatgacagaaatcttgattttagactgtatgttgtgctgttttgagtacactttatttcggagatatttagtattttctatacactctgaaatcatgagcatttcactttttctaagtcaattatttcataaggattttattaatagatattggtaaatagaactttggaaatcttaattcagaattcttactatacctgagtcttttgtaagctatagttttatgtacaaccttgtacagtttttttgacatacaattcagaactttgtttattctcttggactttgttctggccaatacattttttttaaatctttaagaagaactgtgattgttttagtgggtatttttctaattaaatgaaaacttgtataatggtattttagagaatgccagtaagtgcatgtttcaagttaatgtttttctcatcacttgtatgtttctaacacagcatgggactttaataaaaccatcctggaaacttaa

SEQ ID NO: 1575 - DNA, 1218 bp, Homo sapiens
agttccgacgaaaaatggcggggtctcctgagttggtggtccttgaccctccatgggacaaggagctcgcggctggcacagagagccaggccttggtctccgccactccccgagaagactttcgggtgcgctgcacctcgaagcgggctgtgaccgaaatgctacaactgtgcggccgcttcgtgcaaaagctcggggacgctctgccggaggagattcgggagcccgctctgcgagatgcgcagtggacttttgaatcagctgtgcaagagaatatcagcattaatgggcaagcatggcaggaagcttcagataattgttttatggattctgacatcaaagtacttgaagatcagtttgatgaaatcatagtagatatagccacaaaacgtaagcagtatcccagaaagatcctggaatgtgtcatcaaaaccataaaagcaaaacaagaaattctgtccttgcctgcattaattgaacaaggagagggattttcccaagttctcaggatgcagcctgttatccacctccagaggattcaccaagaagtcttttccagttgtcataggaaaccagatgctaaacctgagaactttataacacagatagaaaccacaccaacagagactgcttccaggaaaacctctgacatggtactgaaaagaaagcaaactaaagactgcccccagagaaaatggtatccattgcggccaaagaaaattaatcttgatacatgagctctttctgtttattttgggagttgaaaataggcaccatcaacatttagattacagcctaattaatacctagataagacttcatttgaaataagaaataactcttttactagtgattcatttatacagatatagtatctctgtgcggggatatgatataatattgtatttccttactgttttatctattgtaaataaaaagcattttaaaaagtattgacacaaagcccatcagtgggcattaaaaatattaaaagtgcagacttttactgtccttaagtgccatcaactctcagctcccttgtagcttttgtgggatttaacaagtaacaaattctgttgtgtttccctggtatacatctttctaggaaaaaaaaaaaaaagagagagagctgtataatgatttttcgtttacatgctgaaaagtaattatcagttctgcacagcagcagatgcagggtttttttttaaagatgtagtt

SEQ ID NO: 1576 - DNA, 722 bp, Homo sapiens
cccacagttccgacgaaaaatggcggggtctcctgagttggtggtccttgaccctccatgggacaaggagctcgcggctggcacagagagccaggccttggtctccgccactccccgagaagactttcgggtgcgctgcacctcgaagcgggctgtgaccgaaatgctacaactgtgcggccgcttcgtgcaaaagctcggggacgctctgccggaggagattcgggagcccgctctgcgagatgcgcagtggacttttgaatcagctgtgcaagagaatatcagcattaatgggcaagcatggcaggaagcttcagataattgttttatggattctgacatcaaagtacttgaagatcagtttgatgaaatcatagtagatatagccacaaaacgtaagcagtatcccagaaagatcctggaatgtgtcatcaaaaccataaaagcaaaacaagaaattctgaagcagtaccaccctgttgtacatccactggacctaaaatatgaccctgatccagtccttgcctgcattaattgaacaaggagagggattttcccaagttctcaggatgcagcctgttatccacctccagaggattcaccaagaagtcttttccagttgtcataggaaaccagatgctaaacctgagaactttataacacagatagaaaccacaccaacagagactgcttccaggaaaacctctgacatggtactgaaa

SEQ ID NO: 1577 - DNA, 2317 bp, Homo sapiens
cccacagttccgacgaaaaatggcggggtctcctgagttggtggtccttgaccctccatgggacaaggagctcgcggctggcacagagagccaggccttggtctccgccactccccgagaagactttcgggtgcgctgcacctcgaagcgggctgtgaccgaaatgctacaactgtgcggccgcttcgtgcaaaagctcggggacgctctgccggaggagattcgggagcccgctctgcgagatgcgcagtggacttttgaatcagctgtgcaagagaatatcagcattaatgggcaagcatggcaggaagcttcagataattgttttatggattctgacatcaaagtacttgaagatcagtttgatgaaatcatagtagatatagccacaaaacgtaagcagtatcccagaaagatcctggaatgtgtcatcaaaaccataaaagcaaaacaagaaattctgaagcagtaccaccctgttgtacatccactggacctaaaatatgaccctgatccagcccctcatatggaaaatttgaaatgcagaggggaaacagtagcaaaggagatcagtgaagccatgaagtccttgcctgcattaattgaacaaggagagggattttcccaagttctcaggatgcagcctgttatccacctccagaggattcaccaagaagtcttttccagttgtcataggaaaccagatgctaaacctgagaactttataacacagatagaaaccacaccaacagagactgcttccaggaaaacctctgacatggtactgaaaagaaagcaaactaaagactgcccccagagaaaatggtatccattgcggccaaagaaaattaatcttgatacatgagctctttctgtttattttgggagttgaaaataggcaccatcaacatttagattacagcctaattaatacctagataagacttcatttgaaataagaaataactcttttactagtgattcatttatacagatatagtatctctgtgcggggatatgatataatattgtatttccttactgttttatctattgtaaataaaaagcattttaaaaagtattgacacaaagcccatcagtgggcattaaaaatattaaaagtgcagacttttactgtccttaagtgccatcaactctcagctcccttgtagcttttgtgggatttaacaagtaacaaattctgttgtgtttccctggtatacatctttctaggaaaaaaaaaaaaaagagagagagctgtataatgatttttcgtttacatgctgaaaagtaattatcagttctgcacagcagcagatgcagggtttttttttaaagatgtagtttgatttatcaaattaatgtgctgatgataatactggctttgactttgttactccatgttcagctaatttaggtttgtgagattaactttaggattttttgttgtgtaagacaatgataactattatttgtgcaacattactctttgaaataaaaattggcatgtagccaatgtttcctgcccacactcacttttttctatagaccattaacataatttgacttggaactaatggtttctttttagggtttcttatttatttctttacaaatcattccagttcaaaatatatatcagattaatacactggcaaagtgtcattgtgttattgaactatttcacatttgaagatgtttatatatcaggtatataatcactgggagaagtctgagaaaacgatattggctttacttctaacatttaactatagtttcttatagctcttattgtgtgtcttacattatacagtgtaggcagggccatcaaacttaccaactgtttccccttttgatgactctgataccttcattcatttttcaaaggaatttactgatcatgaggttggaaaatctgtatttctcttgcttattatgtattaataatcataaatgtctagattcaccagaagtcaccagaaggtctgtctcagtgaagaaaacttataaagccactttgttgcattttgtgtttcagtgttacagtttgagatctgtatatttgtacacagctatgtgtttttcattgaaataatgtacaaagactgatcttgatgctgtgtatttttatgagttgtcttaggcattcctgagctcagcttcagttggatggtgggtcagcaccctgcgtttctgaacatactagacttcagtttaaaactgttttgaggctgtataatatgttgctgtttttacagtgctaatgtttttatagtattaaaattctgtatgatttgtttcacttcagaggtcccca

SEQ ID NO: 1578 - DNA, 1344 bp, Homo sapiens
ggacgctctgccggaggagattcgggagcccgctctgcgagatgcgcagtggacttttgaatcagctgtgcaagagaatatcagcattaatgggcaagcatggcaggaagcttcagataattgttttatggattctgacatcaaagtacttgaagatcagtttgatgaaatcatagtagatatagccacaaaacgtaagcagtatcccagaaagatcctggaatgtgtcatcaaaaccataaaagcaaaacaagaaattctgaagcagtaccaccctgttgtacatccactggacctaaaatatgaccctgatccaggagccaagcctggtggactagctctaggggcagtttaggagagaaggggatcggggaaccttcatcccttctgcctctggtgaactggcaagatgaagaggatgaagctgggtgacccagagcccgccctccctctctcggcagtcatctccaaggccggagtagactggactggagggcctctgagaggacacagccaggaagcacactctccctgtgctcttcacccaccatgaagagacaggacgggaaagtccgtgctgtgctggtgtccatcagagggagggacaccatccagcccctgggaccgggctcggctctgttgttgcacagaagtcatttggagatccccacgtgccacatggaggattgtgggaggaccccaccgaggtggctggcagcctctcatggacaccatggagagtgacccaatcactctgcatttgaggactgcagagtggctcagcggtctggacattgaagaggagccaacctcaggggtaacacagtgccgctgggagctgagatgagccaggtggtcggtgggggacacaagcctagaacaaattcaataaaccagccacagacgttatcatcagatgtgcccagagacaaggtggacaggggcatttgctgtggagaccagagggccagagagagtacagggacctggatagatggctccagcacctcttcttctccctacacccatatgccatcttgataaacagcagggaaatctgaaaaataccaagtcttcccatagggacagtgttacctcccaaaaactgtttgaataattggcttgaactggattttctgaactgaactaatgctattgttttgtgggtttttttcttcctactgagtagagtagttgtttatgggggacatctgatcctttcattttcttccagagagctaaccacctgttctgacaccatttattgaatagtacctcttttcccccactgatgtgagaggctgcatttttcatctaataaaatcgaatatatatttagatcta

SEQ ID NO: 1579 - DNA, 774 bp, Homo sapiens
gggagccggaggggacgcgccggaggaaagatggaagactaccaggctgcggaggagactgcttttgttgttgatgaagtgagcaacattgtaaaagaggctatagaaagcgcaattggtggtaacgcttatcaacacagcaaagtgaaccagtggaccacaaatgtagtagaacaaactttaagccaactcaccaagctgggaaaaccatttaaatacatcggtaatggagtcttgtttcttttatatttgcgggatggttttttaacactgatcagaggggcatccagtaccagaaacaacagctaacgtggctcaactcaaggaaggctcctggtgggagtcggtcgtgtgtgtagtatacgttagcgtacgcttgaccatttggctgctggtacaattgcagatcgtatgtgaagcgggatcttacaggaggtcccatcagatgcttttagaacaagtgaagcatagaggaagtgtggacagcccccagctgacagtggctcaacttagaatttttcaactttgatggatttaccagggtattaagtgcatttgcaacttacattttcatatattgttgatttatgatgggtttatgggatgttgtaagtcaaggagcacctataatttgtcaatatagtgagacaaggcaatctgtccctataatttttatcgagaacatcaaccacgtggagctacatacattgtacgtttgctaaaagtggacagaatgacatttgtgttacccagtagacttctctaacaaaaatt

SEQ ID NO: 1580 - DNA, 2891 bp, Homo sapiens
ttttcgtactgtaaccatatgggaggtgatacagtgcctttcctttgtgattaaggtcacggtagtcacttggaaggatcctttaagcttccagaaatgacttaatctctaagatattgcaaattgttcttcactcagtgagttggttttgtttccaagtccgacttctgagtacagcaagtgaggtggcttcgggcagtcagctcctgaaccccctaaaaagaaagggcagggcctgcagtggacagcagccagacagggaggaagactcactgccaagtcagggttctctgccttgattccctcaggatgcacgttgactgagggccccaggggttgccctctcgaaggcgtgtccagagctacgtacctttcctgggactcagcagtaactttaaacgcttgtgctcatgtgaagagcacattggcaggcaagtgcctgactaatgttattttcaggatgaccttttacccattcagatctaccatgtgtaaaaggaaaactatactcctggcactagattcctgcaggcagcccacctcctgagtcatccagacactgacagagaacagccatgctggcagctggtggttagtcctggagtcggagggcagcactgggaaagaaaaataattacctggagataatgtaatcatcgtacattttacaagtaatggtgctttaaaaaaatctcctcaaggtcaaactgatcctcctaatcagtttacatcatggaagagagaattacatcttaaatggattacttcagcagcttcagttaatttatacaaaaatcaaccaactcattaagcctctctattggttaatgattctagcagccagttgaaatggaagaagagaatgaattctagtttaaagtgaagtcttagattgtggcatgattaaaacaaaacagggccaggtgtggtggcttacgcctgtaatcccagcattttgggaggctgaggcgggaggatcacctgaggtcaggagttcgagaccagcctggccaacatgatgaaaccccatctctactaaaaatacgaaaattagccgggtgtggtggagggcacctgtaatcccagctacttgggaggctgaggcaggagaatcacttgaacctgggaggcagagattgcagtgagctgagattgcgccactgcattccagcctgggctacagagcgacactccgtctcaaaaataaataaataaaaataaaacaatacctttaaattatgtgcatgtattctagtcttctggtttctgaagactgtaatgccatccttggtaaagctgaacagtctagttagattatttctaaggtcttcatttctacattatgttcattacctacatttgcatttatcaatgtagtggaaatatcttttaaataaatcaaacttaactgaatgttcttccttacagactgcttttgttgttgatgaagtgagcaacattgtaaaagaggctatagaaagcgcaattggtggtaacgcttatcaacacagcaaagtgaaccagtggaccacaaatgtagtagaacaaactttaagccaactcaccaagctgggaaaaccatttaaatacatcggtaatggagtcttgtttcttttatatttgcgggatggttttttaacactgatcagaggggcatccagtaccagaaacaacagctaacgtggctcaactcaaggaaggctcctggtgggagtcggtcgtgtgtgtagtatacgttagcgtacgcttgaccatttggctgctggtacaattgcagatcgtatgtgaagcgggatcttacaggaggtcccatcagatgcttttagaacaagtgaagcatagaggaagtgtggacagcccccagctgacagtggctcaacttagaatttttcaactttgatggatttaccagggtattaagtgcatttgcaacttacattttcatatattgttgatttatgatgggtttatgggatgttgtaagtcaaggagcacctataatttgtcaatatagtgagacaaggcaatctgtccctataatttttatcgagaacatcaaccacgtggagctacatacattgtacgtttgctaaaagtggacagaatgacatttgtgttacccagtagacttctctaacaaaaatttgttttaacttaagtgacctgtgtaattatgcagaagaatggagctggattacacacagcaagttcctgcttctgggacagctctactgacggtatgattttcattcatgtttgtgaagttttgttgtgtgaaatatatgactggaagtttcctatctttgaatgcaatgcatgtttatcaccttttaaaacatttaataatagacttgccaaggttctttgtgtagcatagagatgggtacttgaatgttggccttattgtgagtaaaacgtcgtcccccagctttccctgccgtaaatgctgctctcttccctcccgcagggagctgcactgtgcgatgggagaataagaccatgtactgcatcgtcagtgccttcggactgtctatttgacctgcagtccagcctatggcctttctccttttgtctctagttcatcctctaaccaccagccatgaattcagtgaactcttttctcattctctttgttttgtggcactttcacaatgtagaggaaaaaaccaaatgaccgcactgtgatgtgaatggcaccgaagtcagatgagtatccctgtaggtcacctgcagcctgcgttgccacttgtcttaactctgaatatttcatttcaaaggtgctaaaatctgaaatctgctagtgtgaaacttgctctactctctgaaatgattcaaatacactaattttccatactttatacttttgttagaataaattattcaaatctaaa

SEQ ID NO: 1581 - DNA, 726 bp, Homo sapiens
agggagccggaggggacgcgccggaggaaagatggaagactaccaggctgcggaggagactgcttttgttgttgatgaagtgagcaacattgtaaaagaggctatagaaagcgcaattggtggtaacgcttatcaacacagcaaagtgaaccagtggaccacaaatgtagtagaacaaactttaagccaactcaccaagctgggaaaaccatttaaatacatcgtgacctgtgtaattatgcagaagaatggagctggattacacacagcaagttcctgcttctgggacagctctactgacgggagctgcactgtgcgatgggagaataagaccatgtactgcatcgtcagtgccttcggactgtctatttgacctgcagtccagcctatggcctttctccttttgtctctagttcatcctctaaccaccagccatgaattcagtgaactcttttctcattctctttgttttgtggcactttcacaatgtagaggaaaaaaccaaatgaccgcactgtgatgtgaatggcaccgaagtcagatgagtatccctgtaggtcacctgcagcctgcgttgccacttgtcttaactctgaatatttcatttcaaaggtgctaaaatctgaaatctgctagtgtgaaacttgctctactctctgaaatgattcaaatacactaattttccatactttatacttttgttagaataaattattcaaatctaaa

SEQ ID NO: 1582 - DNA, 5170 bp, Homo sapiens
gaaattttaatttattattcccccccttttttcctgcatctataggataatattgtaaaatagcaattgaaaccaataattattaaataaatatcaaggaaaatccaagcaaagctttctttttgttggactagtggtgtggtgtttggagacagtctctgaatgtgaacaggaaagcacccatcagcaaaacactatcactctctagggagacagctgggggaatctgactctggcttctgcttttgttttaagggattaacttccctgtcaagtccaagaagacttgcgtatgagaagattacctgatggacttaattctaagattagcttttttcatcaagatggaaaaagatctttaggagcagaaaaggggagtgctaactgggggagcgagaagggagacgagcaaaagaaacaaaatcttgccacgtggctctgttttgtcagcaagaggatttaagactcacccagggcaaacactgggaccactgtaagagcgctggaacattctgcctcttgagtgaaggggccttctttctagcctctatggcactgaggggtgcgccggctggtggaggagcagtccgatggagccctgcgttccccggggacacagggccaagctttgaggtggaaagtttctggttctgaaacaacaaggagagagtctgtttttcttcctaaaatttggactcttgtctgcacaaactctggtctgttttgcacggtttgtgtgcctttttttccctttatgcaatctttttcagctttagcagcagaaatttgtctagttcaggaaacatgctagagggtggcttcagaaggaagatgatcctgtgtattctgtctctgcatccgaacttttgaagagaaaaattcgagctagagggattcttaaagccttaagttacttgaaatctatgtatttgcaaccctttgtctctggaatcatattacactaaactggaatctcaggctgaatgagaataaccaagtggagtaaaaagaagaaaaccgtttcttgatcaccacttaattaacgatgctctttctccaaaggatcagcacgttcttcctctgagaacttgaaaatacaaatggaccccatgtttttttaagcattaccttttcttagaagactgccatcatcttttatagaggaattttttcactatgcattcggtggatctttataaaatactgaccttctaattagattcaggtcagtcttaattaaagggggaaaaaagcaacgcaagccaaccacaaaaacacatataccaatgaaagaaattggtttaaatttcacagcattaacattactttttaagtaaaacagttcattgaagaaagtatgtatgcagcagtggaacatgggcctgtgctttgcagcgattccaacatcctgtgcctgtcctggaaggggcgtgtccccaagagtgagaaggagaagcctgtgtgcaggagacgctactatgaggaaggctggctggccacgggcaacgggcgaggagtggttggggtgactttcacctctagtcactgtcgcagggacaggagtactccacagaggataaatttcaacctccggggccacaatagcgaggttgtgctggtgaggtggaatgagccctaccagaaactggccacgtgcgatgcggacggaggcatattcgtgtggattcagtacgagggcaggtggtctgtggagctggtcaacgaccgcggggcgcaggtgagtgatttcacgtggagccatgatggaactcaagcacttatttcctatcgagatgggtttgtcctggttgggtctgtcagtggacaaagacactggtcatccgaaatcaacttggaaagtcaaattacgtgtggcatatggactcctgacgaccaacaggtgctgtttggcacggccgatgggcaggtgattgtcatggattgccacggcagaatgctggcccacgtcctcttgcacgagtcagacggtgtcctcggcatgtcctggaactacccgatcttcctggtggaggacagcagcgagagcgacacggactcagatgactacgcccctccccaagatggtccggcagcatatcccatcccagtgcagaacatcaagcctctgctcaccgtcagcttcacctcgggagacatcagcttaatgaacaactacgatgacttgtctcccacggtcatccgctcagggctgaaagaggtggtagcccagtggtgcacacagggggacttgctggcagtcgctgggatggaacggcagacccagcttggtgagcttcccaatggtccccttctgaagagtgccatggtcaagttctacaatgttcgtggggagcacatcttcacactggacactctcgtgcagcgccccatcatctccatctgctggggtcaccgggattcgaggctgttgatggcatcaggaccagccctgtacgtggtgcgtgtggagcaccgggtgtccagcctgcagctgctgtgccagcaggccatcgccagcaccttgcgtgaggacaaggacgtcagcaagctgactctgcccccccgcctctgctcctacctctccactgccttcatccccaccatcaagcccccaattccagatccgaacaacatgagagactttgtcagctacccatcagccggcaacgagcggctgcactgcaccatgaagcgcacagaggacgacccggaggtgggcggcccgtgctacacgctctacctggagtacctgggcgggcttgtgcccatcctcaaagggcggcgcatcagcaagctgcggccagagttcgtcatcatggacccgcggacagatagcaaaccagatgaaatctatgggaacagcttgatttctactgtgatcgacagctgcaactgctcagactccagtgacattgagctgagtgatgactgggctgccaagaaatctcccaaaatctccagagctagcaaatcacccaaactcccaaggatcagcattgaggcccgcaagtcacccaagctgccccgggctgctcaggagctctcccggtccccacggttgcccctgcgcaagccctctgtgggctcgcccagcctgactcggagagagtttccttttgaagacatcactcagcacaactatcttgctcaggtcacgtctaatatctggggaaccaaatttaagattgtgggcttggctgctttcctgccaaccaacctcggtgcagtaatctataaaaccagcctcctgcatctccagccgcggcagatgaccatttatctcccagaagttcggaaaatttccatggactatattaatttacctgtcttcaacccaaatgttttcagtgaagatgaagatgatttaccaggtgatgcagtttggacggattgatggcagtgcgtacattctagacttccagtatccgttctcagccgtgcaggcctttgcagttgccctggccaacgtgactcagcgcctcaaatgaagagactggtgtggggaggagagagatgcagagagcctttggaagaggtcttcggagatgccagaggagccctctaggggtccgatgcctgggaggaccagaagccaacagcaaaactggaaaagcccggcaggcccaggagagggcgctgacctgtggtcgtcatttatttggttgggttttattaccttttattgtctgttcttcttttcttctttcatttcagtggcatttggaagcaaagagtgctaggcacctgctgttctttcaggaaacagcttggctgtggtaatgctctactgggcccttcagaatgaagacagtctgccttagagcctgctattcttttagacatagggaggatgcattatcctgtattctcctccaacatcaccactagcgtaaaagcaaaaagcttttacaaaacacagccaaaaattctcaagatgcaggttcttggggaatgggatggggacagcatttgatttacactgattatgttactccccaaaaggtgacttaattaataaagggcatttgggcagacacactgtgttggaccaacaaagtaggctctttacaggggtgttctcaccaggtagaaatgcgatttgctcactgaggatgttggggaagggacgaagggtaaagaagaaactgcacgtatacacaggttcacatcactctgcagacagcaatgtgactcagcgtgtgacttgtagcagcagtacgagggctacactcctctgctgaggatgtctacattgaaagcctccactagtttcatcgtttgtcaaagttccgtaggatcagtgatggtcattcagcatgactggttctgggagaaggtgagagacaaaaatggaaagatcctggcctgtggtagtggtagcagttttctcaaataatgtggtgacagtcactagatcctcacatgctgagaaacagcctctactctctctgccccttttactttttaatctggaatgcattactgtaaacatgatctttcccatgagataccatgttctatgccttcccattctaaaagtgtggacaacgcttgatttgaaaccactccttttctcctcttggctacattaaaattcagttgactacaaatgctttctatcaaattagaaatgtaaccaaaaaaatgttaagtgttcaccagggtattaaaatacagaggagtatggtcaaatctttgacaaaattttcatgatcttctctaacaaaaaaagttgtttattaactgtacagactgtttactaaggagctaaaccactgagaaaacgttattaaaattgtaatacctaggtagttggttgatcacagtttgttaattgtataaaaaaaaattacctagaatatctcttcccacttcctcgtcctcgtgagaacctgtgggcagtattcaagccctgatgacaaaacccagtgttttttgttgttgttttttgttgttgttttttgtttttgtttttgtttttctcagtcttacctgtgatgttgtttaggatcaggcccctctcctgggcctgctgtgcaggagcacaggaactatctgctggcgttgggttccaaatttgcattttatttggaaacagacaagtagaagatgctacagaaaagtattttcaaatttaaacgttttttaatcccctgttttagttaaaaaa

SEQ ID NO: 1583 - DNA, 11123 bp, Homo sapiens
gaaattttaatttattattcccccccttttttcctgcatctataggataatattgtaaaatagcaattgaaaccaataattattaaataaatatcaaggaaaatccaagcaaagctttctttttgttggactagtggtgtggtgtttggagacagtctctgaatgtgaacaggaaagcacccatcagcaaaacactatcactctctagggagacagctgggggaatctgactctggcttctgcttttgttttaagggattaacttccctgtcaagtccaagaagacttgcgtatgagaagattacctgatggacttaattctaagattagcttttttcatcaagatggaaaaagatctttaggagcagaaaaggggagtgctaactgggggagcgagaagggagacgagcaaaagaaacaaaatcttgccacgtggctctgttttgtcagcaagaggatttaagactcacccagggcaaacactgggaccactgtaagagcgctggaacattctgcctcttgagtgaaggggccttctttctagcctctatggcactgaggggtgcgccggctggtggaggagcagtccgatggagccctgcgttccccggggacacagggccaagctttgaggtggaaagtttctggttctgaaacaacaaggagagagtctgtttttcttcctaaaatttggactcttgtctgcacaaactctggtctgttttgcacggtttgtgtgcctttttttccctttatgcaatctttttcagctttagcagcagaaatttgtctagttcaggaaacatgctagagggtggcttcagaaggaagatgatcctgtgtattctgtctctgcatccgaacttttgaagagaaaaattcgagctagagggattcttaaagccttaagttacttgaaatctatgtatttgcaaccctttgtctctggaatcatattacactaaactggaatctcaggctgaatgagaataaccaagtggagtaaaaagaagaaaaccgtttcttgatcaccacttaattaacgatgctctttctccaaaggatcagcacgttcttcctctgagaacttgaaaatacaaatggaccccatgtttttttaagcattaccttttcttagaagactgccatcatcttttatagaggaattttttcactatgcattcggtggatctttataaaatactgaccttctaattagattcaggtcagtcttaattaaagggggaaaaaagcaacgcaagccaaccacaaaaacacatataccaatgaaagaaattggtttaaatttcacagcattaacattactttttaagtaaaacagttcattgaagaaagtatgtatgcagcagtggaacatgggcctgtgctttgcagcgattccaacatcctgtgcctgtcctggaaggggcgtgtccccaagagtgagaaggagaagcctgtgtgcaggagacgctactatgaggaaggctggctggccacgggcaacgggcgaggagtggttggggtgactttcacctctagtcactgtcgcagggacaggagtactccacagaggataaatttcaacctccggggccacaatagcgaggttgtgctggtgaggtggaatgagccctaccagaaactggccacgtgcgatgcggacggaggcatattcgtgtggattcagtacgagggcaggtggtctgtggagctggtcaacgaccgcggggcgcaggtgagtgatttcacgtggagccatgatggaactcaagcacttatttcctatcgagatgggtttgtcctggttgggtctgtcagtggacaaagacactggtcatccgaaatcaacttggaaagtcaaattacgtgtggcatatggactcctgacgaccaacaggtgctgtttggcacggccgatgggcaggtgattgtcatggattgccacggcagaatgctggcccacgtcctcttgcacgagtcagacggtgtcctcggcatgtcctggaactacccgatcttcctggtggaggacagcagcgagagcgacacggactcagatgactacgcccctccccaagatggtccggcagcatatcccatcccagtgcagaacatcaagcctctgctcaccgtcagcttcacctcgggagacatcagcttaatgaacaactacgatgacttgtctcccacggtcatccgctcagggctgaaagaggtggtagcccagtggtgcacacagggggacttgctggcagtcgctgggatggaacggcagacccagcttggtgagcttcccaatggtccccttctgaagagtgccatggtcaagttctacaatgttcgtggggagcacatcttcacactggacactctcgtgcagcgccccatcatctccatctgctggggtcaccgggattcgaggctgttgatggcatcaggaccagccctgtacgtggtgcgtgtggagcaccgggtgtccagcctgcagctgctgtgccagcaggccatcgccagcaccttgcgtgaggacaaggacgtcagcaagctgactctgcccccccgcctctgctcctacctctccactgccttcatccccaccatcaagcccccaattccagatccgaacaacatgagagactttgtcagctacccatcagccggcaacgagcggctgcactgcaccatgaagcgcacagaggacgacccggaggtgggcggcccgtgctacacgctctacctggagtacctgggcgggcttgtgcccatcctcaaagggcggcgcatcagcaagctgcggccagagttcgtcatcatggacccgcggacagatagcaaaccagatgaaatctatgggaacagcttgatttctactgtgatcgacagctgcaactgctcagactccagtgacattgagctgagtgatgactgggctgccaagaaatctcccaaaatctccagagctagcaaatcacccaaactcccaaggatcagcattgaggcccgcaagtcacccaagctgccccgggctgctcaggagctctcccggtccccacggttgcccctgcgcaagccctctgtgggctcgcccagcctgactcggagagagtttccttttgaagacatcactcagcacaactatcttgctcaggtcacgtctaatatctggggaaccaaatttaagattgtgggcttggctgctttcctgccaaccaacctcggtgcagtaatctataaaaccagcctcctgcatctccagccgcggcagatgaccatttatctcccagaagttcggaaaatttccatggactatattaatttacctgtcttcaacccaaatgttttcagtgaagatgaagatgatttaccagtgacaggagcatctggtgtccctgagaacagcccaccttgtaccgtgaacatccctattgcaccgatccacagctcggctcaggctatgtcccccacgcagagcatagggctggtgcagtccctactggccaatcagaatgtgcagctagatgtcctgaccaaccagacgacagctgtagggacagcagaacatgcaggtgacagtgccacccagtacccagtctccaaccggtactccaatcctggacaggtgattttcggaagcgtggaaatgggccgcatcattcagaacccccctccactgtccctgcctcccccgccgcaggggcccatgcagctgtccacggtgggccatggagaccgagaccacgaacacctgcagaagtcagccaaggccctgcggccaacaccgcagctggcagctgagggggacgcagtggtctttagtgccccccaggaggtccaggtgacgaagataaaccctccacccccgtacccaggaaccatccccgctgcccccaccacagcagcacccccgccccctctgccgcccccacagcccccagtggatgtgtgcttgaagaagggcgacttctccctctaccccacgtcagtgcactaccagacccccctgggctatgagaggatcaccaccttcgacagcagtggcaacgtggaggaggtgtgccggccccgcacccggatgctgtgctcccagaacacgtacaccctccccggcccgggtagctctgccaccttgaggctcacggccactgagaagaaggtccctcagccctgcagcagtgccaccctgaaccgcctgaccgtccctcgctactccatccccaccggggacccacccccgtatcctgaaattgccagccagctggcccaggggcggggggctgcccagaggtccgacaatagcctcatccacgctaccctgcggaggaacaaccgtgaggctacgctcaagatggcccagctggccgacagcccgcgggcccccctgcagcccctggccaagtccaagggcgggcccgggggggtggtgacacagctcccagcgcggcccccacctgccctgtacacctgcagtcagtgcagtggcacagggcccagctcacagcccggagcctccctggcccataccgccagcgcctccccgttggcctcccagtcctcctacagcctcctgagcccacccgacagcgcccgcgaccgcaccgactacgtcaactcggccttcacggaggacgaggccctgtcccagcactgtcagcttgagaagcccttgaggcaccctcccctgcctgaagctgctgtcaccctgaaacggccacccccttaccagtgggaccccatgctgggtgaggatgtttgggttcctcaagaaaggacagcacagacttcagggcccaaccccttaaaactgtcctctctgatgctgagtcagggccagcacctggacgtgtcccgactgcccttcatctcccccaagtctcctgccagccccactgccactttccaaacaggctatgggatgggagtgccatatccaggaagctataacaacccccctttgcctggagtgcaggctccctgctctcccaaagatgccctgtccccaacgcagtttgcacaacaggagcctgctgtggtccttcagccgctgtacccacccagcctctcctattgcaccctgccccccatgtacccaggaagcagcacgtgctctagtttacagctgccacctgtcgccttgcatccatggagttcctacagcgcctgcccgcccatgcagaacccccagggcactctccccccaaagccacacttggtggtggagaagccccttgtgtccccaccacctgccgacctccaaagccacttgggcacagaggtgatggtagagactgcagacaacttccaggaagtcctctccctgaccgaaagcccagtcccccagcggacagaaaaatttggaaagaagaaccggaagcgcctggacagccgagcagaagaaggcagcgttcaggccatcactgagggcaaagtgaagaaggaggctaggactttgagtgactttaattccctaatctccagcccacacctggggagagagaagaagaaagtgaagagtcagaaagaccaactgaagtcaaagaagttgaataagacaaacgagttccaggacagctccgagagcgagcctgagctgttcatcagcggggatgagctcatgaaccagagccagggcagcagaaagggctggaaaagcaagcgctccccacgggccgccggcgagctggaggaggccaagtgccggcgggccagtgagaaggaggacgggcggctgggcagccaaggcttcgtgtacgtgatggccaacaagcagccgctgtggaacgaggccacccaggtctaccagctggacttcggggggcgggtgacccaggagtccgccaagaacttccagattgagttagaggggcggcaggtgatgcagtttggacggattgatggcagtgcgtacattctagacttccagtatccgttctcagccgtgcaggcctttgcagttgccctggccaacgtgactcagcgcctcaaatgaagagactggtgtggggaggagagagatgcagagagcctttggaagaggtcttcggagatgccagaggagccctctaggggtccgatgcctgggaggaccagaagccaacagcaaaactggaaaagcccggcaggcccaggagagggcgctgacctgtggtcgtcatttatttggttgggttttattaccttttattgtctgttcttcttttcttctttcatttcagtggcatttggaagcaaagagtgctaggcacctgctgttctttcaggaaacagcttggctgtggtaatgctctactgggcccttcagaatgaagacagtctgccttagagcctgctattcttttagacatagggaggatgcattatcctgtattctcctccaacatcaccactagcgtaaaagcaaaaagcttttacaaaacacagccaaaaattctcaagatgcaggttcttggggaatgggatggggacagcatttgatttacactgattatgttactccccaaaaggtgacttaattaataaagggcatttgggcagacacactgtgttggaccaacaaagtaggctctttacaggggtgttctcaccaggtagaaatgcgatttgctcactgaggatgttggggaagggacgaagggtaaagaagaaactgcacgtatacacaggttcacatcactctgcagacagcaatgtgactcagcgtgtgacttgtagcagcagtacgagggctacactcctctgctgaggatgtctacattgaaagcctccactagtttcatcgtttgtcaaagttccgtaggatcagtgatggtcattcagcatgactggttctgggagaaggtgagagacaaaaatggaaagatcctggcctgtggtagtggtagcagttttctcaaataatgtggtgacagtcactagatcctcacatgctgagaaacagcctctactctctctgccccttttactttttaatctggaatgcattactgtaaacatgatctttcccatgagataccatgttctatgccttcccattctaaaagtgtggacaacgcttgatttgaaaccactccttttctcctcttggctacattaaaattcagttgactacaaatgctttctatcaaattagaaatgtaaccaaaaaaatgttaagtgttcaccagggtattaaaatacagaggagtatggtcaaatctttgacaaaattttcatgatcttctctaacaaaaaaagttgtttattaactgtacagactgtttactaaggagctaaaccactgagaaaacgttattaaaattgtaatacctaggtagttggttgatcacagtttgttaattgtataaaaaaaaattacctagaatatctcttcccacttcctcgtcctcgtgagaacctgtgggcagtattcaagccctgatgacaaaacccagtgttttttgttgttgttttttgttgttgttttttgtttttgtttttgtttttctcagtcttacctgtgatgttgtttaggatcaggcccctctcctgggcctgctgtgcaggagcacaggaactatctgctggcgttgggttccaaatttgcattttatttggaaacagacaagtagaagatgctacagaaaagtattttcaaatttaaacgttttttaatcccctgttttagttaaaaaattggaaaagaaaccgacccatttttttcccagatcaagatgacatgacatcactcccaattctctccaaaccccagagaaatactgacgaagttttctgatgtggcaaaggatatttcccatctaataccagtttctcatttatatttaacgtattggacctgatatttttagtgggtgcattcttccagaaagaattcagcaatgttatcagaattaattcttttatatgagtttatgtagcttgatatggtgtttcagtgcttattggttgtgcaataatggttatagcctgttagataatctaaatgcaattcccctgttttgtcgtttaggagataattatttatcttgcttttcatagtgttcttaggaattattttgttgttacgttttggtgagttatacccattttatttatttagaaaaatagtatctttgttaacgacttacatggtcacagtatattttgctgcaagaaataaagaggatatgatagaaggtttttttttttttttttttttttttttgagacggagtcccactcttgtcgcccaactagagtgtagtggcacaatctcggctccccacaacctctgactccagggttcaggtgattattttgcctcagcctcccaagcagctgggattatagacacccgccaacacgccaggctaatgtttttgtatttttaatagagatggggttttgccatgttggccaggctggtcttgaactcctgacctcaggtgatccgcccgcctcggcctcccaaagtgctgggattacagacgtgagccaccactcccggcccatagaaggttttttgctggataatttgtaacttttctaattgggaaaaaattcctattaatcacttaaaaatttttttttgtattttgtgttattgattatatacaaaggagactttttttttgagataacactcaaatagtattctcttcttttgaaaattttatttttatctgaaaataacagttgatctgaaataaaaaggggagacctattagaatgagagtagccaaggaaagagttactaggtaataagcttcactttttgtgttctaattgtttttgagatataaagaccctgaaaaagcccattttagaacctgtttaataagagcaaatataggggaaaatctttgaaatgaaagctacaaatacatgtgagaagaaaaaaatggatttttttagcaaataattaactaagcttctaaatgcctagctccctcccccaaaggcgctttcccccgatggaggcacaggcttctgtctcggatgtttggcgcacgtgagtttgtatgagtttgtaccggagtgaccccggcagccactgcccacctcccctctacccaggggcctgaaaagaggggctgccctcctgcgccaaggcagacacaagctgcgggctgtgcggtcctagtagtgtgacgtttcagttaatagtggtggtcttattttcaactatgctttcattcagtcagtctctgttgactaaatacgacgaaaattcatactttatgcaggagatttctaaaaatttaatgtttattaatagtttatgaatatcaagatacctcattgaatccctaaatttaaaagcagtccagtaaaaggttaactgtataaagaatctatgactttttgagggaagtgtgatatattaacaaatataaccaattctaaatttgttttagctctaacctcatcaaaccaaaggcacagatttgtgtacaatatacccattgaatgtatatcctgagaaaaattggggccaaagaagcaggaaaatctcaaagctctaatggcagcataaatcaaagaatttcacaggctagtgtttttatccatagccattgctcccttgtcaagtgtctcacaaggacatggaagaatgtgttatgttcatcttgtaatcatagcaaaaagtctgcaaaccccagggtcaagcctgctctgccacagggttggatggtgaccttgggcaagtccctggggctggctaggcctccacttgtccatctgtgaaatgaaaggatcagcctggacagccctctaaactcccttacagctctcagcctaagagcgcagcactgaacagcctcatcattccacttttcatgggaaatatatttcacaccattgcctttgtgtagagaaatatttcttttcctgtgttaatgagctatgtactgaatataaaccagtgcatttaaagtaatatcttttgtgcacctctaaatgtgtttggaattgtgtttgttctcatagaatatacaaaagtactgattctaggtaagaaggagtctccacgggtgtgccctgctcagctggatgtccatgagaacagccatgaaataagtcactacttgtccccaaaaccacaggaatatatacctaggtcacctcaaattcctgagtgtgctctgccatgttacacggtcttcaaattgaaaaggtttcttgaaaaggaaagtttggcccagcaactggagaaggagtccatggtgtcgctgtgtgcctgtatcatttggccaagtcaatggttgtaagcaaagttagtggagacaaaaatgtgtccaaaatgtcgtttgagttcctgggatttctgtaatagcacacaactcagaactcttcagcatttgtgtgattccttacctctggctgataaaactctaatgggttgtggcttactttgtttccattttctttggctttgtgcaatttttgtgtaactttacttgtacctatattttctgtttacagttctttttaaggggaggggtagggttctaagatcttgttgtttattgtagataaaaattttttcgtgttgtagaaaagcatgggttatgcgtttgactgaaaaagacactgtattatttaccaaaggggtattgtttttgcatttgtttataaatgcattattttggtactgtaaatttggacataatttctgagtttattactactggcattttctttttcccttttttttttttttaaccgtaagtgcacgatgcaggtgcataggccccagaccaaactagaccaccagcatgttcatgtccagacctcggcagtggcgtgcactgcttgtgcacctcagttcctccagtgttggtttgtttgttttttaattcagcatcctgctggttttactttccaagcaagatctgttgcgactcccaaatgcgttttaatgagctcatccttatttgcctttcttcttacgtattttgtgtattagattgtgcaggagatattctagaaggcattaatggtttgcattcaaaacgatgtggtttgtccaagttattttctgtctttattactgagacggattaatctccttatttttttcttgatgatttgaagttgtaagagttgtccagctattgcttaataaaattttgcagatcaaaaaa

SEQ ID NO: 1584 - DNA, 5988 bp, Homo sapiens
ggctctgtgtatgaatgacaaggataccttcagccagctcattctggatgaatgaatgattacactaagtgtcctccacattcctctgtgggctcacttcatggactcactttgcgtgcttgttaaatgtgctgtgttgctcccaagaccatgtaaagcctactgaccactaacctccctcacagcagaaactagacgtcaggttaaaatgggcaactccgacagtcagtacacccttcaaggatctaaaaatcatagcaatactattactggtgctaagcaaattccttgctccctgaaaatacgtggcattcatgcaaaagaggaaaagtcattgcatggatggggtcacggaagcaacggagcaggttacaagtccaggtccctggcccgaagctgcctttctcactttaagagtaaccagccttacgcatcgagactcggtggccccacatgcaaggtctccagaggtgttgcctactccacgcacaggacaaatgccccagggaaggatttccagggcatcagtgctgctttctcaactgagaatggcttccactctgttggccacgagctggcagataaccacatcacctccagagactgcaacggacaccttctcaactgctacgggaggaatgagagcattgcctccaccccaccgggcgaagaccgcaagagcccccgagtgctcatcaaaacgctggggaagctggatgggtgtttaagggtcgagttccacaatggtggcaaccccagcaaagtgcctgcagaggactgcagtgagccggtgcagctgctgaggtactcacctaccttagcatcggaaacctcccctgtgcctgaagccaggagggggtccagcgccgattccctgcccagccatcgcccctctcccacggactctcgcctgcggtccagcaaaggcagctccctgagttctgagtcatcctggtacgactccccttggggcaatgctggagagctgagcgaggctgagggctccttcctggcccccggcatgcctgaccccagtctccatgccagcttcccacctggcgatgccaaaaagcctttcaaccaaagctcttccctctcctccctccgggaactgtacaaagatgccaacctggggagcctctccccctcaggtatccgcctttctgatgaatacatgggcacgcatgccagcctgagcaaccgtgtctcttttgcttccgacattgatgtgccctccagagtggcacacggggaccccatccagtacagttccttcactctcccctgtcggaagcccaaagcctttgttgaggatactgcgaagaaggactccctcaaagccaggatgcgacggatcagtgactggacgggaagcctctcaaggaagaaaaggaaactccaggagccgaggtccaaggagggcagtgactactttgacagtcgctctgatggactgaatacagatgtgcagggatcctcccaggcatctgcttttctgtggtcagggggctctactcagatcctgtctcagagaagtgaatccacacatgcgattggcagcgatcccctccggcagaacatttatgagaatttcatgcgagagttggaaatgagcaggaccaacactgagaacatagaaacatctacagaaaccgccgagtccagcagcgagtcactcagctctctggaacagctggatctgctctttgagaaggaacagggggtggtccggaaggccgggtggctcttcttcaagcccctggtcactgtgcagaaggaaaggaagcttgagctggtggcacgaaggaaatggaaacagtactgggtaacgctgaaaggatgcacgctgctgttttatgagacctatgggaagaattccatggatcagagcagtgcccctcggtgtgctctgtttgcagaagacagcatagtgcagtctgttccagagcatcccaagaaagaaaatgtgttctgcctcagcaactcctttggagatgtctaccttttccaggccaccagccagacagatctagaaaactgggtcactgctgtacactctgcttgtgcatccctttttgcaaagaagcatgggaaagaggacacgctgcggctgctgaagaaccagaccaaaaacctgcttcagaagatagacatggacagcaagatgaagaagatggcagagctgcagctgtccgtggtgagcgacccaaagaacaggaaagccatagagaaccagatccagcaatgggagcagaatcttgagaaatttcacatggatctgttcaggatgcgctgctatctggccagcctacaaggtggggagttaccgaacccaaagagtctccttgcagccgccagccgcccctccaagctggccctcggcaggctgggcatcttgtctgtttcctctttccatgctctggtatgttctagagatgactctgctctccggaaaaggacactgtcactgacccagcgagggagaaacaagaagggaatattttcttcgttaaaagggctggacacactggccagaaaaggcaaggagaagagaccttctataactcagatatttgattcaagtggcagccatggattttctggaactcagctacctcaaaactccagtaactccagtgaggtcgatgaacttctgcatatatatggttcaacagtagacggtgttccccgagacaatgcatgggaaatccagacttatgtccactttcaggacaatcacggagttactgtagggatcaagccagagcacagagtagaagatattttgactttggcatgcaagatgaggcagttggaacccagccattatggcctacagcttcgaaaattagtagatgacaatgttgagtattgcatccctgcaccatatgaatatatgcaacaacaggtttatgatgaaatagaagtctttccactaaatgtttatgacgtgcagctcacgaagactgggagtgtgtgtgactttgggtttgcagttacagcgcaggtggatgagcgtcagcatctcagccggatatttataagcgacgttcttcccgatggcctggcgtatggggaagggctgagaaagggcaatgagatcatgaccttaaatggggaagctgtgtctgatcttgaccttaagcagatggaggccctgttttctgagaagagcgtcggactcactctgattgcccggcctccggacacaaaagcaaccctgtgtacatcctggtcagacagtgacctgttctccagggaccagaagagtctgctgccccctcctaaccagtcccaactgctggaggaattcctggataactttaaaaagaatacagccaatgatttcagcaacgtccctgatatcacaacaggtctgaaaaggagtcagacagatggcactctggatcaggtttcccacagggagaaaatggagcagacattcaggagtgctgagcagatcactgcactgtgcaggagttttaacgacagtcaggccaacggcatggaaggaccgcgggagaatcaggatcctcctccgaggtctctggcccgccacctgtctgatgcagaccgcctccgcaaagtcatccaggagcttgtggacacagagaagtcctacgtgaaggatttgagctgcctctttgaattatacttggagccacttcagaatgagacctttcttacccaagatgagatggagtcactttttggaagtttgccagagatgcttgagtttcagaaggtgtttctggagaccctggaggatgggatttcagcatcatctgactttaacaccctagaaaccccctcacagtttagaaaattactgttttcccttggaggctctttcctttattacgcggaccactttaaactgtacagtggattctgtgctaaccatatcaaagtacagaaggttctggagcgagctaaaactgacaaagccttcaaggcttttctggacgcccggaaccccaccaagcagcattcctccacgctggagtcctacctcatcaagccggttcagagagtgctcaagtacccgctgctgctcaaggagctggtgtccctgacggaccaggagagcgaggagcactaccacctgacggaagcactaaaggcaatggagaaagtagcgagccacatcaatgagatgcagaagatctatgaggattatgggaccgtgtttgaccagctagtagctgagcagagcggaacagagaaggaggtaacagaactttcgatgggagagcttctgatgcactctacggtttcctggttgaatccatttctgtctctaggaaaagctagaaaggaccttgagctcacagtatttgtttttaagagagccgtcatactggtttataaagaaaactgcaaactgaaaaagaaattgccctcgaattcccggcctgcacacaactctactgacttggacccatttaaattccgctggttgatccccatctccgcgcttcaagtcagactggggaatccagcagggacagaaaataattccatatgggaactgatccatacgaagtcagaaatagaaggacggccagaaaccatctttcagttgtgttgcagtgacagtgaaagcaaaaccaacattgttaaggtgattcgttctattctgagggagaacttcaggcgtcacataaagtgtgaattaccactggagaaaacgtgtaaggatcgcctggtacctcttaagaaccgagttcctgtttcggccaaattagcttcatccaggtctttaaaagtcctgaagaattcctccagcaacgagtggaccggtgagactggcaagggaaccttgctggactctgacgagggcagcttgagcagcggcacccagagcagcggctgccccacggctgagggcaggcaggactccaagagcacttctcccgggaaatacccacaccccggcttggcagattttgccgacaatctcatcaaagagagtgacatcctgagcgatgaagatgatgaccaccgtcagactgtgaagcagggcagccctactaaagacatcgaaattcagttccagagactgaggatttccgaggacccagacgttcaccccgaggctgagcagcagcctggcccggagtcgggtgagggtcagaaaggaggagagcagcccaaactggtccgggggcacttctgccccattaaacgaaaagccaacagcaccaagagggacagaggaactttgctcaaggcgcagatccgtcaccagtcccttgacagtcagtctgaaaatgccaccatcgacctaaattctgttctagagcgagaattcagtgtccagagtttaacatctgttgtcagtgaggagtgtttttatgaaacagagagccacggaaaatcatagtatgattcaatccagatatgggttaaattcctcattttacttttaaactggtggtaaagtggaaattgcaaaaaaaaaaaaaaaaaaaaactgttcattcctgggttttgtgcagtatacattttcccacaaaatggttgtaaagatttaagttattttaatttattgtggatcagaaacctagatgaaactggtcagaatctgtaaattacttagtttatatccactttgagcaggtatcaaatgatttaggatccttaaaattacattctaataattaagttatgtggaaaaagtaaggctggggaagtcgtgattaatagttttcaaagggccattttttaaaatcctctgggcattttctttcagctgtttgttagtttttgctttatttaaagcatatttaagttattttaatgtggtttaggggcaaaatgtgcagatacttcatttttgtaagatagattgtaatagatgctgtttatactaaacatgtcataactatctatacagtatatattaaaagaaagcttgtactgtatcttatttgatgatatttattttctctgccaagctgtatagtaaaaggaaaataagtcaca

SEQ ID NO: 1585 - DNA, 3281 bp, Homo sapiens
gccagggcggcacgggagggcggcgcaggaggtgggacctgcgccgggaaggctccgggacgccagcgcacgcggagcggggaccccggagagccagcaggcgagaagaccggccgagggagagccgatcgcgcctcgagagatccgaggaagtggtcgcgggccgggaggctcccgtgccgagccgaggccaggggtctggggtcgcagcccggcgtgcctgcagctgccgtcgctcgggagcagcagctgtgcccgggatcccggcggcggcgggggaaggaggagctgcagctggactgtggcagctggagggagagggccgggctcccctggcggagccgcgctgggacgactggctgaccgcggccatgcagtcttgacggagtcgctcgggcgcaggggagcagccgcgggcgcgccctcccgggaaggggcaccggagcgcaggcagcagcactttatctgcgactctccagcccagcgagaggcgaagcggtttaccatggaacccgtgaccaagtggagccccaaacaagtggtggactggactagagggttggatgactgcctgcaacaatatgtccacaagtttgaacgagagaagatcaacggcgagcagctgctgcagatttcccatcaggacctggaggagctgggggtcacacggattggacaccaggagcttgtgttggaggctgtggaccttctctgtgcactgaattatggcctcgaaactgataacatgaagaacttggttctgaaactgagagcatcttcccacaatttacagaattacataagtagccgacggaaaagtcccgcttacgatggcaacacctcccgcaaggcccccaatgagttcctgacctcggtggtggagctcatcggcgccgccaaggccctgctggcgtggctggaccgggctccgtttacagggatcactgatttctcagtcacgaagaacaaaattatccagctttgcttggacctgaccactacagtccagaaggattgctttgtagcggaaatggaggataaagttttaactgtggtcaaggttttaaatggcatctgtgacaaaacaatccgatctaccacagatcctgtgatgagccagtgtgcatgtctggaggaagttcacttaccaaacattaaacctggggaaggcctgggcatgtacatcaaatcaacctatgatgggttacacgtgattactggaaccacagaaaatgtgggatggcagctgaaaaatctggtgaagaaattgagagagaatcccaccggagttgtgttactgcttaagaagcgccccaccgggtctttcaactttactcctgctcccctgaaaaacctacggtggaagccacctcttgtacagacctcacctccacccgcgacaacccagtcccctgaaagcactatggatacctcactgaagaaggagaagtcagccatcctggatctttatattcctcctccgcctgctgttccctactctccccgggatgagaatggcagttttgtttatggagggtccagtaagtgcaaacaaccattgcctggtcctaagggttcagagtccccgaattccttcttggaccaggaaagccggagacgaagattcaccattgcagactcggatcagttgcctgggtactcggtggaaaccaacattctgcccacaaaaatgagagagaaaacaccatcttatggcaagccacggcctttgtccatgcctgctgatgggaactggatggggattgtggacccttttgccagacctcgaggtcatggcaggaaaggggaggatgccctttgccggtatttcagtaacgagcggattcctccgatcattgaagagagctcctctcccccataccggttctccagacccacgaccgagcggcatctggtccggggtgcggactacatccgaggaagcaggtgctacatcaactcagatctccacagcagcgccacgattccattccaggaggaagggaccaaaaagaaatctggctcctcagctacgaagtcctcgtccacagaaccgtccctcctggtcagctggtttacgcgcctcaaactgttgactcactgagagggaccctgctcaggccacctgcctggctcctgccccaagtgccttgcttttacagtggacagcctcttctcgtttcagcctcagtattatgtagggaccttatgcaatttctttttcttttgaaaagttatctactgcccttcttggaagtttgcaggattggatgggaacaaattcagaggatcttaggtgctggcttgtggagacaaaaggagggaaatgggtagagcctgtttgtcttgcttccccagagatagaatgtgaagacacgcgctagaaatcgcagtcctggccagagacgttatggtcattgtgagggactggtggcattgttcctttttgaggggctggggggactcaaattggtggctgttttcacacagatgtgttggtttgtggtccaacttctttatctgaaaaagccagtgagaaaacatttttgatttgatttttctaaactatctaccatattttaagtgtagcagctttgactttgcaataacgtggcaagtatctgatttctcctttgaggcagaggtttaagtgtaggcctgttacacttgtttgatacctttttcatgacagtctcagtatagatcagttggtacagaaatacatgaacacattttgatagggcttatttcacacaaagaagtttatggttatttgtgtggggtggtgttgttatatattattgtctttaagggaaaagaagctataagattcgctgacagccaaagtatcatttagaaaagtgaagcaacaagatttaggttgatgaaagatacatgagtttgcattttgacctgttcagtgtctgtcttccagcacggtgtgtacacttcttcaaaattgtacacagtttgctaattagaaatatcttggaaagcctcatggtcactaattttcaactagcatcaggtattttgaaaacgtgtgtctggatattaactcttgtttaaactgaatgtatgatattttgttagaatggaaaagtactatcttgttaatttaagtattttaaatatagttgtatatttttcttactcttagtcacctgtaattgaaatatttctgttttgcgtcatacacgaagctagtgaaaaagaaagtgcaaggcattttcagatgagcaagtgactatcgtggctgttgccagcagggcagtattgtt

SEQ ID NO: 1586 - DNA, 3268 bp, Homo sapiens
aactttgcaacccgagcgcgcacgctctgcgctcggccctgccagggcggcacgggagggcggcgcaggaggtgggacctgcgccgggaaggctccgggacgccagcgcacgcggagcggggaccccggagagccagcaggcgagaagaccggccgagggagagccgatcgcgcctcgagagatccgaggaagtggtcgcgggccgggaggctcccgtgccgagccgaggccaggggtctggggtcgcagcccggcgtgcctgcagctgccgtcgctcgggagcagcagctgtgcccgggatcccggcggcggcgggggaaggaggagctgcagctggactgtggcagctggagggagagggccgggctcccctggcggagccgcgctgggacgactggctgaccgcggccatgcagtcttgacggagtcgctcgggcgcaggggagcagccgcgggcgcgccctcccgggaaggggcaccggagcgcaggcagcagcactttatctgcgactctccagcccagcgagaggcgaagcggtttaccatggaacccgtgaccaagtggagccccaaacaagtggtggactggactagagggttggatgactgcctgcaacaatatgtccacaagtttgaacgagagaagatcaacggcgagcagctgctgcagatttcccatcaggacctggaggagctgggggtcacacggattggacaccaggagcttgtgttggaggctgtggaccttctctgtgcactgaattatggcctcgaaactgataacatgaagaacttggttctgaaactgagagcatcttcccacaatttacagaattacataagtagccgacggaaaagtcccgcttacgatggcaacacctcccgcaaggcccccaatgagttcctgacctcggtggtggagctcatcggcgccgccaaggccctgctggcgtggctggaccgggctccgtttacagggatcactgatttctcagtcacgaagaacaaaattatccagctttgcttggacctgaccactacagtccagaaggattgctttgtagcggaaatggaggataaagttttaactgtggtcaaggttttaaatggcatctgtgacaaaacaatccgatctaccacagatcctgtgatgagccagtgtgcatgtctggaggaagttcacttaccaaacattaaacctggggaaggcctgggcatgtacatcaaatcaacctatgatgggttacacgtgattactggaaccacagaaaattctcctgcagacagatctcagaagattcatgctggtgacgaagtcattcaagttaatcagcaaactgtggtgggatggcagctgaaaaatctggtgaagaaattgagagagaatcccaccggagttgtgttactgcttaagaagcgccccaccgggtctttcaactttactcctgctcccctgaaaaacctacggtggaagccacctcttgtacagacctcacctccacccgcgacaacccagtcccctgaaagcactatggatacctcactgaagaaggagaagtcagccatcctggatctttatattcctcctccgcctgctgttccctactctccccgggatgagaatggcagttttgtttatggagggtccagtaagtgcaaacaaccattgcctggtcctaagggttcagagtccccgaattccttcttggaccaggaaagccggagacgaagattcaccattgcagactcggatcagttgcctgggtactcggtggaaaccaacattctgcccacaaaaatgagagagaaaacaccatcttatggcaagccacggcctttgtccatgcctgctgatgggaactggatggggattgtggacccttttgccagacctcgaggtcatggcaggaaaggggaggatgccctttgccggtatttcagtaacgagcggattcctccgatcattgaagagagctcctctcccccataccggttctccagacccacgaccgagcggcatctggtccggggtgcggactacatccgaggaagcaggtgctacatcaactcagatctccacagcagcgccacgattccattccaggaggaagggaccaaaaagaaatctggctcctcagctacgaagtcctcgtccacagaaccgtccctcctggtcagctggtttacgcgcctcaaactgttgactcactgagagggaccctgctcaggccacctgcctggctcctgccccaagtgccttgcttttacagtggacagcctcttctcgtttcagcctcagtattatgtagggaccttatgcaatttctttttcttttgaaaagttatctactgcccttcttggaagtttgcaggattggatgggaacaaattcagaggatcttaggtgctggcttgtggagacaaaaggagggaaatgggtagagcctgtttgtcttgcttccccagagatagaatgtgaagacacgcgctagaaatcgcagtcctggccagagacgttatggtcattgtgagggactggtggcattgttcctttttgaggggctggggggactcaaattggtggctgttttcacacagatgtgttggtttgtggtccaacttctttatctgaaaaagccagtgagaaaacatttttgatttgatttttctaaactatctaccatattttaagtgtagcagctttgactttgcaataacgtggcaagtatctgatttctcctttgaggcagaggtttaagtgtaggcctgttacacttgtttgatacctttttcatgacagtctcagtatagatcagttggtacagaaatacatgaacacattttgatagggcttatttcacacaaagaagtttatggttatttgtgtggggtggtgttgttatatattattgtctttaagggaaaagaagctataagattcgctgacagccaaagtatcatttagaaaagtgaagcaacaagatttaggttgatgaaagatacatgagtttgcattttgacctgttcagtgtctgtcttccagcacggtgtgtacacttcttcaaaattgtacacagtttgctaattagaaatatcttggaaagcctcatggtcactaattttcaactagcatcaggtattttgaaaacgtgtgtctggatattaactcttgtttaaactgaatgtatgatattttgttagaatggaaaagtactatcttgttaatttaagtattttaaatatagttgtatatttttcttactctta

SEQ ID NO: 1587 - DNA, 3431 bp, Homo sapiens
atgcggtcccgggttctgtggggcgctgcccggtggctctggccccgccgggccgttggcccagcccgccggcccctgagctccggtagcccgccgctggaggagctgttcacccggggcgggcccttgcggaccttcctcgagcgccaggcggggtctgaagcccatttgaaggtcaggaggcccgagttgctggcggtgatcaaactgctgaacgagaaggagcgggagctgcgggagactgagcacttgctgcacgatgagaatgaagatttaaggaaacttgcagagaatgaaatcactttgtgtcaaaaagaaataactcagctgaagcatcagattatcttacttttggttccctcagaagaaacagatgaaaatgatttgatcctggaagtaactgcaggagttggaggtggccttagacatgcatctgccagcattgggggttcagaagcctataggcacatgaaatttgaaggaggtgttcacagagtacaaagagtgccaaagacagaaaagcaaggccgcgtccatactagcaccatgactgtagcaatattaccccagcctactgagattaatctggtgattaatccgaaagatttgagaattgacactaagcgagccagtggagctggggggcagcatgtaaataccacggacagtgctgtccggatagttcatcttccaacagattggaagtaaaggaagatcagagaaaataagaacatataattttccacagaaccgggtcacagatcacagaataaacaagacgctgcatgatcttgaaacttttatgcaaggagattatctactggatgaacttgtacagtcattgaaggaatacgccgattatgaatctttagtagaaattatttcccaaaaagtttaagttgatttgttatttatagactttcgtatcttagaaaaattctacagtacatccacatagggtgaaagtacccttactctcttgaaaaacgttgagttaacacagttggaggtaatatgcatattctgaagtcatagataatttacacagatctctctcaatgcattagcaaaaatcatacaatatacagatggtcctcgatttacattgtggttaattcccaataaacccatcataagttaaaaatgcatataacgttagcaacacagcagtctcctaattaatgacagcttgacttaacaattttccaactttaccatggtgtgaaagaggtatgattcctaagccctaaggagctcctcagcttgaaatggggctgcatccctataaacccatcataaagtcaaaaaatcctaaaacataagttggtgaccatctgtaatcatgatgtggtggtaaatcttggacgctaccttacaataactagacaaaggaaaatcatcctttgtcctgttctgtgtaaatatttaatgaatgatcaaaacttcagtttaaatattatgaaaaactttaaacataaagtagtagaaataagacagtaaatactgtatcctaatatccagtcaggatacagaaaccataccattaacttgaacagggataattttaatataaaaactgttaactgataatggtattaacttttaagagggatgaaagagagctatgatgtcctaggactgagagtaccccaggaaagaatacccttgaaagggtctccccttccccatggtgaagtcaggcctaatggagagagtggctacagcctactcagtgattgggaaattccctgtcttgccctgggccagagctggtgtaccgctggtggatcaggtcttacaagcaaagaacctcacactcccaactggtaagccagaagcctcttgctagggtgtgagcaaaacttggacaggaactctcagtagatgtttgtgtttgtcaagattctccagacaaacttccttaaaaggattggcttgtgttgttattattaagtctaacaagtccaaaagctggagtgtgaggcaggaggctggaaacccaggaaagctgatggtgcaaggtccagtccaaaggtatctgttggaggattctcttgttctgggaagaggacggtctttttttctcttcagaccttcacctgactggatcaagcccactaacatcgaggaggacagtctgcattactcagagttcactgattgatttaaatgtcaatctcatataaaacaccctcacagaaacacctagaataatgtttgaccttataattggaaaatcagagcaaaagttaaatctcaaaaaaaaaaaaaaaaaaagtatgacccagtagctaggcacctgtggccccgccaagttgacacataaaattaactgtcacagtatcatcttagaagtgaaagaagcccctttatcctgcagtgcccctctaccaccacctactgacaaagaacatggtgctatctggcatgggagaaatgttcagtttgctatggcttgtatgtgtcccctcaaattcaagtgttgccaatgtgacagcatcaagaggtggggtctttaagagatcactaggccatgagggattctcttaggactgggatgaaggcccataataaaagaggtttcggggagcatcctgctagcttgccttctgtatgtgagaacacagcaagaaagccctagtcaacaagtgccagctccttgatcttagacttcccatcctccagaactgtgagaaatacatttctgttccttacaaattacccagtctcctgtattctgttatagcagcacaaaatgaagataccatacctgaacacctgaacattcttcacaaggtagtaaatgcactgctttattctggtctcagtattgtgtgcttaataaggaaatgagaaagggtggatcagggcataggatgaacaagttactgctagacctctcacaatgccactaatggataagattgtattttcatcattcttgtctcttcggaagctaacaccatgctataataggcactaaatagatgtctaaaaacaccttaagtatttgtctagaaatctggtgcattgttcagaaagaaccaaaattcaaaataatttcaaagggcctaaagcactagttaatcaaaattcattagtttttaatggtactaccactctcaaatttaaaatgtcatcttacgttcctcttcctcgcattggatttattgctaaaacctggtaaacacttttaatccttttcaattccattaccactgctcttgtccagaattacttcgcagactaatagtcacctgacttctcccctgcatccgatttgctgtctaattctggttacaaataagtaactgccaaactaatctttctaaaaagcaagactgatctcgtcactcctttgctcaacaatgtaaaagctcccattgtctcccaaataaaaccagctttccactgtgtatacaatacatcca

SEQ ID NO: 1588 - DNA, 3539 bp, Homo sapiens
atgcggtcccgggttctgtggggcgctgcccggtggctctggccccgccgggccgttggcccagcccgccggcccctgagctccggtagcccgccgctggaggagctgttcacccggggcgggcccttgcggaccttcctcgagcgccaggcggggtctgaagcccatttgaaggtcaggaggcccgagttgctggcggtgatcaaactgctgaacgagaaggagcgggagctgcgggagactgagcacttgctgcacgatgagaatgaagatttaaggaaacttgcagagaatgaaatcactttgtgtcaaaaagaaataactcagctgaagcatcagattatcttacttttggttccctcagaagaaacagatgaaaatgatttgatcctggaagtaactgcaggagttggaggtcaggaggcaatgttgtttacatcagagatatttgatatgtatcagcaatatgctgcatttaaaagatggcattttgaaaccctggaatattttccaagtgaactaggtggccttagacatgcatctgccagcattgggggttcagaagcctataggcacatgaaatttgaaggaggtgttcacagagtacaaagagtgccaaagacagaaaagcaaggccgcgtccatactagcaccatgactgtagcaatattaccccagcctactgagattaatctggtgattaatccgaaagatttgagaattgacactaagcgagccagtggagctggggggcagcatgtaaataccacggacagtgctgtccggatagttcatcttccaacagattggaagtaaaggaagatcagagaaaataagaacatataattttccacagaaccgggtcacagatcacagaataaacaagacgctgcatgatcttgaaacttttatgcaaggagattatctactggatgaacttgtacagtcattgaaggaatacgccgattatgaatctttagtagaaattatttcccaaaaagtttaagttgatttgttatttatagactttcgtatcttagaaaaattctacagtacatccacatagggtgaaagtacccttactctcttgaaaaacgttgagttaacacagttggaggtaatatgcatattctgaagtcatagataatttacacagatctctctcaatgcattagcaaaaatcatacaatatacagatggtcctcgatttacattgtggttaattcccaataaacccatcataagttaaaaatgcatataacgttagcaacacagcagtctcctaattaatgacagcttgacttaacaattttccaactttaccatggtgtgaaagaggtatgattcctaagccctaaggagctcctcagcttgaaatggggctgcatccctataaacccatcataaagtcaaaaaatcctaaaacataagttggtgaccatctgtaatcatgatgtggtggtaaatcttggacgctaccttacaataactagacaaaggaaaatcatcctttgtcctgttctgtgtaaatatttaatgaatgatcaaaacttcagtttaaatattatgaaaaactttaaacataaagtagtagaaataagacagtaaatactgtatcctaatatccagtcaggatacagaaaccataccattaacttgaacagggataattttaatataaaaactgttaactgataatggtattaacttttaagagggatgaaagagagctatgatgtcctaggactgagagtaccccaggaaagaatacccttgaaagggtctccccttccccatggtgaagtcaggcctaatggagagagtggctacagcctactcagtgattgggaaattccctgtcttgccctgggccagagctggtgtaccgctggtggatcaggtcttacaagcaaagaacctcacactcccaactggtaagccagaagcctcttgctagggtgtgagcaaaacttggacaggaactctcagtagatgtttgtgtttgtcaagattctccagacaaacttccttaaaaggattggcttgtgttgttattattaagtctaacaagtccaaaagctggagtgtgaggcaggaggctggaaacccaggaaagctgatggtgcaaggtccagtccaaaggtatctgttggaggattctcttgttctgggaagaggacggtctttttttctcttcagaccttcacctgactggatcaagcccactaacatcgaggaggacagtctgcattactcagagttcactgattgatttaaatgtcaatctcatataaaacaccctcacagaaacacctagaataatgtttgaccttataattggaaaatcagagcaaaagttaaatctcaaaaaaaaaaaaaaaaaaagtatgacccagtagctaggcacctgtggccccgccaagttgacacataaaattaactgtcacagtatcatcttagaagtgaaagaagcccctttatcctgcagtgcccctctaccaccacctactgacaaagaacatggtgctatctggcatgggagaaatgttcagtttgctatggcttgtatgtgtcccctcaaattcaagtgttgccaatgtgacagcatcaagaggtggggtctttaagagatcactaggccatgagggattctcttaggactgggatgaaggcccataataaaagaggtttcggggagcatcctgctagcttgccttctgtatgtgagaacacagcaagaaagccctagtcaacaagtgccagctccttgatcttagacttcccatcctccagaactgtgagaaatacatttctgttccttacaaattacccagtctcctgtattctgttatagcagcacaaaatgaagataccatacctgaacacctgaacattcttcacaaggtagtaaatgcactgctttattctggtctcagtattgtgtgcttaataaggaaatgagaaagggtggatcagggcataggatgaacaagttactgctagacctctcacaatgccactaatggataagattgtattttcatcattcttgtctcttcggaagctaacaccatgctataataggcactaaatagatgtctaaaaacaccttaagtatttgtctagaaatctggtgcattgttcagaaagaaccaaaattcaaaataatttcaaagggcctaaagcactagttaatcaaaattcattagtttttaatggtactaccactctcaaatttaaaatgtcatcttacgttcctcttcctcgcattggatttattgctaaaacctggtaaacacttttaatccttttcaattccattaccactgctcttgtccagaattacttcgcagactaatagtcacctgacttctcccctgcatccgatttgctgtctaattctggttacaaataagtaactgccaaactaatctttctaaaaagcaagactgatctcgtcactcctttgctcaacaatgtaaaagctcccattgtctcccaaataaaaccagctttccactgtgtatacaatacatcca

SEQ ID NO: 1589 - DNA, 3676 bp, Homo sapiens
atgcggtcccgggttctgtggggcgctgcccggtggctctggccccgccgggccgttggcccagcccgccggcccctgagctccggtagcccgccgctggaggagctgttcacccggggcgggcccttgcggaccttcctcgagcgccaggcggggtctgaagcccatttgaaggtcaggaggcccgagttgctggcggtgatcaaactgctgaacgagaaggagcgggagctgcgggagactgagcacttgctgcacgatgagaatgaagatttaaggaaacttgcagagaatgaaatcactttgtgtcaaaaagaaataactcagctgaagcatcagattatcttacttttggttccctcagaagaaacagatgaaaatgatttgatcctggaagtaactgcaggagttggaggtcaggaggcaatgttgtttacatcagagatatttgatatgtatcagcaatatgctgcatttaaaagatggcattttgaaaccctggaatattttccaagtgaactaggtggccttagacatgcatctgccagcattgggggttcagaagcctataggcacatgaaatttgaaggaggtgttcacagagtacaaagagtgccaaagacagaaaagcaaggccgcgtccatactagcaccatgactgtagcaatattaccccagcctactgagattaatctggtgattaatccgaaagatttgagaattgacactaagcgagccagtggagctggggggcagcatgtaaataccacggacagtgctgtccggatagttcatcttccaacaggtgttgtttctgaatgtcaacaagagagatctcagctgaaaaataaagagctggctatgacaaagttacgtgcaaaactgtacagcatgcatctagaagaagaaataaataaaagacagaatgctagaaaaattcagattggaagtaaaggaagatcagagaaaataagaacatataattttccacagaaccgggtcacagatcacagaataaacaagacgctgcatgatcttgaaacttttatgcaaggagattatctactggatgaacttgtacagtcattgaaggaatacgccgattatgaatctttagtagaaattatttcccaaaaagtttaagttgatttgttatttatagactttcgtatcttagaaaaattctacagtacatccacatagggtgaaagtacccttactctcttgaaaaacgttgagttaacacagttggaggtaatatgcatattctgaagtcatagataatttacacagatctctctcaatgcattagcaaaaatcatacaatatacagatggtcctcgatttacattgtggttaattcccaataaacccatcataagttaaaaatgcatataacgttagcaacacagcagtctcctaattaatgacagcttgacttaacaattttccaactttaccatggtgtgaaagaggtatgattcctaagccctaaggagctcctcagcttgaaatggggctgcatccctataaacccatcataaagtcaaaaaatcctaaaacataagttggtgaccatctgtaatcatgatgtggtggtaaatcttggacgctaccttacaataactagacaaaggaaaatcatcctttgtcctgttctgtgtaaatatttaatgaatgatcaaaacttcagtttaaatattatgaaaaactttaaacataaagtagtagaaataagacagtaaatactgtatcctaatatccagtcaggatacagaaaccataccattaacttgaacagggataattttaatataaaaactgttaactgataatggtattaacttttaagagggatgaaagagagctatgatgtcctaggactgagagtaccccaggaaagaatacccttgaaagggtctccccttccccatggtgaagtcaggcctaatggagagagtggctacagcctactcagtgattgggaaattccctgtcttgccctgggccagagctggtgtaccgctggtggatcaggtcttacaagcaaagaacctcacactcccaactggtaagccagaagcctcttgctagggtgtgagcaaaacttggacaggaactctcagtagatgtttgtgtttgtcaagattctccagacaaacttccttaaaaggattggcttgtgttgttattattaagtctaacaagtccaaaagctggagtgtgaggcaggaggctggaaacccaggaaagctgatggtgcaaggtccagtccaaaggtatctgttggaggattctcttgttctgggaagaggacggtctttttttctcttcagaccttcacctgactggatcaagcccactaacatcgaggaggacagtctgcattactcagagttcactgattgatttaaatgtcaatctcatataaaacaccctcacagaaacacctagaataatgtttgaccttataattggaaaatcagagcaaaagttaaatctcaaaaaaaaaaaaaaaaaaagtatgacccagtagctaggcacctgtggccccgccaagttgacacataaaattaactgtcacagtatcatcttagaagtgaaagaagcccctttatcctgcagtgcccctctaccaccacctactgacaaagaacatggtgctatctggcatgggagaaatgttcagtttgctatggcttgtatgtgtcccctcaaattcaagtgttgccaatgtgacagcatcaagaggtggggtctttaagagatcactaggccatgagggattctcttaggactgggatgaaggcccataataaaagaggtttcggggagcatcctgctagcttgccttctgtatgtgagaacacagcaagaaagccctagtcaacaagtgccagctccttgatcttagacttcccatcctccagaactgtgagaaatacatttctgttccttacaaattacccagtctcctgtattctgttatagcagcacaaaatgaagataccatacctgaacacctgaacattcttcacaaggtagtaaatgcactgctttattctggtctcagtattgtgtgcttaataaggaaatgagaaagggtggatcagggcataggatgaacaagttactgctagacctctcacaatgccactaatggataagattgtattttcatcattcttgtctcttcggaagctaacaccatgctataataggcactaaatagatgtctaaaaacaccttaagtatttgtctagaaatctggtgcattgttcagaaagaaccaaaattcaaaataatttcaaagggcctaaagcactagttaatcaaaattcattagtttttaatggtactaccactctcaaatttaaaatgtcatcttacgttcctcttcctcgcattggatttattgctaaaacctggtaaacacttttaatccttttcaattccattaccactgctcttgtccagaattacttcgcagactaatagtcacctgacttctcccctgcatccgatttgctgtctaattctggttacaaataagtaactgccaaactaatctttctaaaaagcaagactgatctcgtcactcctttgctcaacaatgtaaaagctcccattgtctcccaaataaaaccagctttccactgtgtatacaatacatcca

SEQ ID NO: 1590 - DNA, 6434 bp, Homo sapiens
cgcgcttgggcggcggaggctgcagctacctcggcgccggctcggctctaggacgtgtcgggctgcacgggtcgggggcggctccctgctgcttccgagcctagccgcctggccttcggcatttgcagacacactgccctccagaaacgatgggtgtcgctagatccagctgggactctgccagcctccggcactcagtctaagagaagggccatcttccagccctgctgtccctgcctgtcatggccacattcggctgctgtctgcatgtctggggacacagggcacccagccccagccctgagaagttaagccaggccttctggctcagttccacaggggcactccagaccccaggcccctttcagagcaaaagcaactgatgctatgggagaagcccctgcccacctgtccactcgcctggcactgcccactctgagacccatgcactgggttcccctggaggtgccaaccctgtgagtccctccctgtcccctgacgctgagaaggccctgccaacccccaccatgtgtgaggtgatgcccacaatcaatgagggggaccgcctgggtccccctcatggcgccgatgctgacgccaacttcgagcagctgatggtgaacatgctggacgagcgggagaagttgctggagtctcttcgggagagtcaggagaccttggcggccacacagagccggctccaggatgccatacacgagcgggaccagctccagcgccaccttaactccgccctcccccaggaatttgccaccttaacccgggagctgagcatgtgtcgggagcagcttctagagcgggaggaagagatatcagaactgaaagcagaacggaataacacacggctgcttctggaacatctggagtgcctggtgtcccgccatgaacggtcactgcggatgactgtggtgaagcgccaggcccagtcaccttcgggggtctccagtgaggtggaggtgctgaaggccctcaagtcactgtttgagcaccacaaggccctggatgagaaggtgcgagagcggctccgggcagcgctggagcgagtcaccaccttggaggagcagctggcaggtgcccaccagcaggtgtctgccctgcagcagggggcaggggtgcgggatggagcggcagaagaggaggggactgtggagctggggccgaaacgcctgtggaaggaggatacgggccgggtagaggagctgcaggagctcctggagaagcagaactttgagttgagccaggcccgggagcgactggtcaccctaacaacaaccgtgactgaactcgaggaggacctgggcacggcccgccgggacctcatcaagtcggaggagctgagcagcaagcatcagcgggacctccgggaggctctggcccagaaggaggacatggaagagcggattactacactggagaagcgctacctggctgctcagcgtgaggcaacatccatccatgacctcaatgacaagctggagaatgagctggccaacaaggagtccctgcaccgccagtgtgaggagaaggcccgacacctgcaggagctgctggaggtggcagagcagaagctgcagcagacgatgcgcaaggcagagacgctgccagaggtggaggctgagctggcccagagaattgcagccctcaccaaggctgaagaacggcatggcaacattgaggagcacctgcggcagctggagggacagctggaggagaagaaccaggagctggcacgggtgcgccagcgggaaaagatgaatgaggaccacaacaagcggctgtcggacacagtggaccggctgctcagcgagtccaacgagcgtctgcagctccacctgaaggagcgcatggctgccctggaggagaagggccgcctgtctgaagagattgagaagctgcgccaagaggtggaccagctgaagggccgaggggggccgtttgtggatggcgtccactccaggtcgcacatgggcagtgcagcagacgtgcggttctccctgggcacaaccacacacgcacccccaggcgtgcatcgccgctactcggcattgagggaagagtctgccaaggactgggagacttctccactgcctgggatgctggccccggcagctggccctgcctttgacagtgaccctgagatctccgacgtggatgaggatgagccagggggtctggtgggctctgcggatgttgtctcccccagcggccactcagatgcccagaccctggccatgatgctgcaggagcagctggatgccatcaatgaggaaatcaggatgattcaggaagagaaggagtccacggagctccgcgcggaggagattgagacgcgtgtaaccagtggcagcatggaagccctaaacctgaagcagctgcgcaagcgtggttccatccccacctctctgacggccctgtccctggccagcgcgtccccaccactcagcggccgctccacacctaagctcacctcccgcagtgctgcccaggacctggaccgaatgggggtcatgaccctgcccagtgacttaagaaagcataggaggaagctgctgtcgccagtgtctcgggaagagaaccgagaggataaagccaccataaaatgtgagacttctcctccttcctcacccaggacgctgcggctagagaagcttggccacccagccctgagccaggaagaaggcaagagtgccttggaggatcagggcagcaaccccagcagcagcaacagcagccaggactccctgcacaagggcgccaagcgcaagggcatcaagtcgtccattggccgcctgtttgggaagaaggagaagggcaggctgatccagctgagtcgggatggagccacaggccatgttctgctaacagactccgaattcagtatgcaggagcctatggtgcctgccaagctggggacccaggcagagaaggaccggcggctaaagaagaaacaccagctgcttgaagatgcccgcaggaaaggaatgccctttgcccagtgggatggtcctactgtggtctcctggttggagctctgggtggggatgcctgcctggtatgtggcagcctgccgggccaacgtcaagagtggtgccatcatgtccgctctgtcggacacagagatccagcgggagatcggcatcagcaatgccctgcaccggctcaagctccgcctggccattcaggagatggtgtcattgaccagcccctctgccccacccacctccaggacttcttctgggaatgtctgggtcacccatgaagagatggaaactctggaaacatctactaaaacagacagtgaggagggcagctgggctcagaccctggcctatggggacatgaaccatgagtggattgggaatgaatggctacccagcctggggctcccgcagtaccgcagctacttcatggagtgcctggtggacgcccgcatgctggaccacctcaccaagaaggacctgcgggtccacctgaagatggtggacagcttccatcgaaccagtcttcagtatggcatcatgtgtctgaagaggctgaattatgaccggaaggagctggagaagaggcgagaggagagccagcatgagatcaaggatgtgttagtctggaccaacgaccaggtggttcattgggtccagtctattgggctccgggactacgcaggaaacctgcatgagagtggtgtgcatggagccttgctggccctggacgagaacttcgaccacaacacactggccctgatcctccagatccccacacagaacacccaggcacgccaagtgatggaaagagagttcaataacctgttggccttgggcacagaccggaagctggatgacggggatgacaaggtgtttcgccgcgcgccctcctggaggaagcgcttccggccgcgggagcaccacggtcgcggcggcatgctcagcgcttccgcggagaccctcccggcgggcttccgtgtgtccaccctggggaccctgcagcccccaccggccccgccaaagaagatcatgcctgaagctcactcccactatctctacggacacatgctctccgccttccgggactagccatggcccccagggctggcttcctccttctgggtttcacaggctcctctggccctgacccctcttgctcgttccccttccttccgcagctcctagtctcgtccgtgactttccggttgccctggatctcagaatatattcgtccaccccctcggcaccccattaccccgagtcccaccgtgtgtccgttgtaagtccggtggatgtggctggggtttcctggtattgtggaggcacccaggttgtccatgcttgggattctgggggaaggagagaagggcagctcagggtggatgtgaagccacccttcctcttctggacccagcctggtctgcactgcaacctccaccaggaccaggatcctgggccacaggctgggatggtccttccaagaaagggtcatttcagacgcagccctgcttgggctattcaatcttagggtgtctatccacgtctggctgtgccaaatggtctggcagctggttttggcatccccagcatcaccactctcccaacccatcaccgtgactgcagttcctgcccccattctcttggggtcagggaggggctgggaagggctactgaaggccccattctcccacaggatggtgaggctgggaggaggaagactgaggtagagattccaggccctggcataagctgaatcccaaatttgagtttgggaagaaccagagagaaatggatccctgagctctgagccaagggtgaggatggggaaactctaagctcccacctaataagaagcataggcagaccagccagagggagagccaatggcctctggtagccttaagcccaaagggcagtgggaatgtcccctgccccaaccatcgggtggagctcctgctgggctatggggaagggaggttgtgcggatcttgactctagggcagaacagatctaaccatgcattgctagctctgctcccagcatcccttccccttctctcctcctctgcctcacttctttagtaatcccaaccctataaaaatgaacctaatgggtggattgaatatacattgagcccaaagtcaagtttggggaaaaggcagactaaggcctcctttctctgacctcccaggaagaaaatagcttctcctacagtgattcatgtcccaggtccaggaaatccaatgttggtgaaggcagccactctcttgcttgtccccaaatcacctaaccctcatccagggctattttggtgggcagggactgcctcctcccggaattcctaagatccgcccagctgccaccattttcattgctttccccagcagcatgatgggaacccaagctgagggatacaggtcctgatttggtaggaatattattcccaagaaatacccgctcctcacctactccctcatcctaccaaggtgcctgaaaatgttcaagacttatgttcagggtgggatgatggaaccgagggcttcatcaaagtgagaggaaaggaaaagcatctggcatgtgtttcttggataggggccagtgcagtgccatcctacaggtggctggagcagctgctttgcaacctgatcaccttgagttctgagcagggactaggcttgcaggtgagataatgggccagggcacccagtccagaaggagcaatggcacctgggcagtgccagggcttaaagcccgctgctccttttcggtagaggagaggcccatcactggtgtggtggggtgggctctcccttaggcttgggcaaggcagccacctgcccttgctctcccttagtgttccctggcctccctgccatcaggttgctgggagtggagatggagggattattgagcagaaaatgagttggatggagataaacagctcccatccctgggtaatggatggtaagatgatggagattcctaagattggtggagttgggcaatgcatagccatctgactccttcagggtgctcttgatgggctggctgtaagggagactcagtcccagcctctcccctctacaactcctgccactgttggccatgtcgtaaggcagcagctgtgccaggatagctgggtccattcagagcaccttgagaagtgttgcagggaggtgttaagaagagaactctgtgcaaacagtgatggaaggctgttgtcttggtgtatcccttgcctcatagtcaatatattttttttttggcgagtcaccagtgacccgagccctccacaccagcctcctgtatctcatcaggtcccttctcagtactgtatttgctcagtgcatcaggaatgggtgtatgggtgtgtgtgggtgggtgtgagtgtgggtgtgtacgtaccaataaacaacctggttttaagacaatgta

SEQ ID NO: 1591 - DNA, 3970 bp, Homo sapiens
gttgtcgggtcttattggccgctgattagaccagccggggtccactagccctgggcttcagggaggctgctgcgtccagtgaacacttcagcacctgtagcacagaagggccaaggagctgcagtcctcgaccagcaggaggtttgctcctcagcccactcgctgcatccagatcagctcacccctctcccttccctgcccaccaggactctgatagcccctggcagccacagcccattttgccaagatgtctagagtagccaaatatcgccggcaggtgagtgaagaccccgacatcgacagcctgctggagaccctgtctcccgaggagatggaggagctggagaaggagctggacgtggtggacccagacgggagtgttcccgtggggctgcggcagagaaaccagacggagaaacagtccacgggtgtgtacaaccgggaggccatgctcaacttctgtgaaaaggagaccaagaaacttatgcagagggagatgtccatggatgaaagcaagcaagtggagaccaagacagatgccaagaatggagaggaaaggggcagagatgccagcaaaaaagccctgggccccagacgggactcagatctggggaaggagccaaagaggggtggtttaaagaaaagcttctctagagacagagatgaagctggtggcaagagtggcgagaagcccaaggaggagaagatcatccggggcattgacaagggccgggtcagggctgcagtggataagaaggaggcagggaaggatgggagaggagaggagagggcagtggccaccaagaaggaagaggagaagaaagggagtgacaggaacacaggcttgagcagggacaaggataaaaagagagaggagatgaaggaggtggccaagaaagaggatgatgagaaggtaaaaggggagcgtaggaacacagacaccagaaaagagggtgagaagatgaaaagagcaggtgggaacacagacatgaaaaaggaggatgagaaggtaaaaagaggaactgggaacacagacaccaaaaaggacgatgaaaaagtcaagaagaatgaacccttacatgaaaaggaagccaaggatgacagcaagaccaaaacacccgagaaacagacgcccagtggccccaccaagccctctgaaggaccggccaaggtggaggaggaggcagctcccagcatatttgatgagcctctggagagagtgaagaacaatgaccccgagatgactgaggtgaacgtcaacaactcagactgcatcacaaatgagatcttggtccggtttactgaggctctggagttcaacactgtggttaagctgttcgccttggccaacacgcgagccgatgaccacgtggcctttgccattgccatcatgctcaaggccaacaagaccatcaccagcctcaacctggactccaaccacatcacaggcaaaggcatcctggccatcttccgggccctcctccagaacaacacgctgaccgagctccgcttccacaaccagcgacacatctgtggaggcaagacggagatggagatcgccaagctgctgaaggagaatactaccctgctcaagctgggctaccattttgagctggccgggccccgaatgactgtcaccaatctgctcagccgcaacatggacaagcagagacaaaagcggctgcaggagcaaaggcaggcacaggaagccaagggagagaagaaggatctgctggaggtacccaaggccggggccgtggctaagggctccccaaaaccttcacctcaaccatctccaaagccctctccaaagaactcacccaaaaaagggggtgctccagctgccccaccaccccctccccctcccttggctccaccccttatcatggagaacctgaagaattcactctcaccagctacccagaggaagatgggagacaaagtcctccctgcccaggagaagaactcccgtgaccagctattggctgccatccgctccagcaacctcaagcagctcaagaaggtggaagtgcccaaactgcttcagtaggaccaggctgccaggcaccatctgccaatgccatgactgctcaggcctcacctcccagggctacacagaccctgcccaccccatccctggctgacctgctgtggatgtccctattctgccatgggagagtccaggcctgggtcacgctcaaggaaggatgccttatctcttctcactttccttttcttgtctctgaggctctccaaattttgctttagtacatggagctcaggtttctggacaagaagagtccttttagcacatcactgagaagatggcactgtccagggcccatgtagctggcaagctgcaaaaggcctgtgatccaggaaagatgtcccacagggaccacatccaccccagccccactgccctccagggccaggattcaggcctctgaggagcccacggggcaaagctgctgggccagtggcactctgtgtgggaaaatggcagaaagatggagaggcatgggggcccaaaggggagcgtggggaggggctgaggataccccaaagtccaggctaattagaggatgtggcaggggcagtggcctggatgcacagtgcctgatgggagtaggctccagacaggaggagtgggacagacagcagctggacttgaaggtttgatgccaaagcagacattttcctcacacccacctgctgctgtatgaatagctgtgtatctgtttttccataagattttgataatatatacaaacctttagctgtgaatggctgtgccccacctgttgtcctgaactgtgagtcctgatcctaaccctgggctccctggaggactctagaagctcaggttccctgccacactatttgagttggccaagaaataaattcacatcctcagaaagtgcagcatggaggaaaatctgaactctaagcagaagactctccactgacctggttgtccaggtctagaaggccaggcctctactaggtctgctcctgaaccagtcctgctgcctggagtcagtagccagagttgttctcaggggtgctggggcagagtggagcccagggtgctgggatggctatattaggcatgttcagggatgctcattccatgactctgcctaaccatgggctcagggccaggtcctcacagcagtcacaggcccaggaaggcggcaggcagagaagtggagtgactatttggagaatagcacccatatctgtgtgccctagggctcagaggggcctcatcttccccagccctccccacctgctcaccaattccacttcctgccccaactgcaggaatgctgacaatgctgccatgcccaccatcgggtgtaggtgaaaggcatctttctgaatttcattctcttgaaggtgctgccaccccttggcactgtggaactgccaccttgggtctgtgtcacttgtaggtttctctgcctccaggttgcctcaacagcaggaggcacagcagtttcaccatctttgaggtgagggtggggtgccccagctaggaagcaagatcgctgtgctaggtctgaccaaaaccagagggcagtctagtcctgggggtaaagccctcagatcccagggtacactcttctccattccctccacccacttgcctgtcaccccagtcacctaagcaatcactgggcccagaggagaggagacagacacacactggctcctggacctaaagggtatgagctggagctaaggccagctagagcttccactgtcagccctcactgtcagtcccactgcacccccctgtgcctgctgggcactgggcactagctagatgctttaggttgcttcagctgatccttcaactctgtgaggtggataccaatattctattttgcagatagaatttggcccagagaggttaactaatatatccatgatcacacagctaataaaagtcagagctcaggtc

SEQ ID NO: 1592 - DNA, 1096 bp, Homo sapiens
ccactccgcaccccaccctctgtctggtacagcttaccaaaccaaagtgcccaaagccgtgacatcccggccggcggctcgcaggcccccgccctccgcacgtcacggccgccgggtgcagtgccccctaggggcccctgggacgaggaggaagcgccaggtccttcccgccgccgccgccgccgccgccgcctgctcccctggcacgcgccccgccgccctcggcagccgcagctccgtgtcccctgagaaccagccgtcccgcgccatgggcacgcgtctgccgctcgtcctgcgccagctccgccgcccgccccagcccccgggccctccgcgccgcctccgtgtgccctgtcgcgctagcagcggcggcggcggaggcggcggcggtggccgggagggcctgcttggacagcggcggccgcaggatggccaggcccggagcagctgcagccccggcggccgaacgcccgcggcgcgggactccatcgtcagagaagtcattcagaattcaaaagaagttctaagtttattgcaagaaaaaaaccctgccttcaagccggttcttgcaattatccaggcaggtgacgacaacttgatgcaggaaatcaaccagaatttggctgaggaggctggtctgaacatcactcacatttgcctccctccagatagcagtgaagccgagattatagatgaaatcttaaagatcaatgaagataccagagtacatggccttgcccttcagatctctgagaacttgtttagcaacaaagtcctcaatgccttgaaaccagaaaaagatgtggatggagtaacagacataaacctggggaagctggtgcgaggggatgcccatgaatgttttgtttcacctgttgccaaagctgtaattgaacttcttgaaaaatcaggtgtcaacctagatggaaagaagattttggtagtgggggcccatgggtctttggaagctgctctacaatgcctgttccagagaaaagggtccatgacaatgagcatccagtggaaaacacgccagcttcaaagcaagacggagtctcgttctgtcaccaggctggagtgcaggcgcgtgatctag

SEQ ID NO: 1593 - DNA, 996 bp, Homo sapiens
gtggccgggagggcctgcttggacagcggcggccgcaggatggccaggcccggagcagctgcagccccggcggccgaacgcccgcggcgcgggactccatcgtcagagaagtcattcagaattcaaaagaagttctaagtttattgcaagaaaaaaaccctgccttcaagccggttcttgcaattatccaggcaggtgacgacaacttgatgcaggaaatcaaccagaatttggctgaggaggctggtctgaacatcactcacatttgcctccctccagatagcagtgaagccgagattatagatgaaatcttaaagatcaatgaagataccagagtacatggccttgcccttcagatctctgagaacttgtttagcaacaaagtcctcaatgccttgaaaccagaaaaagatgtggatggagtaacagacataaacctggggaagctggtgcgaggggatgcccatgaatgttttgtttcacctgttgccaaagctgtaattgaacttcttgaaaaatcagtaggtgtcaacctagatggaaagaagattttggtagtgggggcccatgggtctttggaagctgctctacaatgcctgttccagagaaaagggtccatgacaatgagcatccagtggaaaacacgccagcttcaaagcaagcttcacgaggctgacattgtggtcctaggctcacctaagccagaagagattccccttacttggatacaaccaggaactactgttctcaactgctcccatgacttcctgtcagggaaggttgggtgtggctctccaagaatacattttggtggactcattgaggaagatgatgtgattctccttgctgcagctctgcgaattcagaacatggtcagtagtggaaggagatggcttcgtgaacagcagcacaggcggtggagacttcactgcttgaaacttcagcctctctcccctgtgccaagtgacattgagatttcaagaggacaaactccaa

SEQ ID NO: 1594 - DNA, 3604 bp, Homo sapiens
tgagtcccactccgcaccccaccctctgtctggtacagcttaccaaaccaaagtgcccaaagccgtgacatcccggccggcggctcgcaggcccccgccctccgcacgtcacggccgccgggtgcagtgccccctaggggcccctgggacgaggaggaagcgccaggtccttcccgccgccgccgccgccgccgccgcctgctcccctggcacgcgccccgccgccctcggcagccgcagctccgtgtcccctgagaaccagccgtcccgcgccatgggcacgcgtctgccgctcgtcctgcgccagctccgccgcccgccccagcccccgggccctccgcgccgcctccgtgtgccctgtcgcgctagcagcggcggcggcggaggcggcggcggtggccgggagggcctgcttggacagcggcggccgcaggatggccaggcccggagcagctgcagccccggcggccgaacgcccgcggcgcgggactccatcgtcagagaagtcattcagaattcaaaagaagttctaagtttattgcaagaaaaaaaccctgccttcaagccggttcttgcaattatccaggcaggtgacgacaacttgatgcaggaaatcaaccagaatttggctgaggaggctggtctgaacatcactcacatttgcctccctccagatagcagtgaagccgagattatagatgaaatcttaaagatcaatgaagataccagagtacatggccttgcccttcagatctctgagaacttgtttagcaacaaagtcctcaatgccttgaaaccagaaaaagatgtggatggagtaacagacataaacctggggaagctggtgcgaggggatgcccatgaatgttttgtttcacctgttgccaaagctgtaattgaacttcttgaaaaatcaggtgtcaacctagatggaaagaagattttggtagtgggggcccatgggtctttggaagctgctctacaatgcctgttccagagaaaagggtccatgacaatgagcatccagtggaaaacacgccagcttcaaagcaagcttcacgaggctgacattgtggtcctaggctcacctaagccagaagagattccccttacttggatacaaccaggaactactgttctcaactgctcccatgacttcctgtcagggaaggttgggtgtggctctccaagaatacattttggtggactcattgaggaagatgatgtgattctccttgctgcagctctgcgaattcagaacatggtcagtagtggaaggagatggcttcgtgaacagcagcacaggcggtggagacttcactgcttgaaacttcagcctctctcccctgtgccaagtgacattgagatttcaagaggacaaactccaaaagctgtggatgtccttgccaaggagattggattgcttgcagatgaaattgaaatctatggcaaaagcaaagccaaagtacgtttgtccgtgctagaaaggttaaaggatcaagcagatggaaaatacgtcttagttgctgggatcacacccacccctcttggagaagggaagagcacagtcaccatcgggcttgtgcaggctctgaccgcacacctgaatgtcaactcctttgcctgcttgaggcagccttcccaaggaccgacgtttggagtgaaaggaggagccgcgggtggtggatatgcccaggtcatccccatggaggagttcaaccttcacttgactggagacatccacgccatcaccgctgccaataacttgctggctgccgccatcgacacgaggattcttcatgaaaacacgcaaacagataaggctctgtataatcggctggttcctttagtgaatggtgtcagagaattttcagaaattcagcttgctcggctaaaaaaactgggaataaataagactgatccgagcacactgacagaagaggaagtgagtaaatttgcccgtctcgacatcgacccatctaccatcacgtggcagagagtattggatacaaatgaccgatttctacgaaaaataaccatcgggcagggaaacacagagaagggccattaccggcaggcgcagtttgacatcgcagtggccagcgagatcatggcggtgctggccctgacggacagcctcgcagacatgaaggcacggctgggaaggatggtggtggccagtgacaaaagcgggcagcctgtgacagcagatgatttgggggtgacaggtgctttgacagttttgatgaaagatgcaataaaaccaaacctgatgcagaccctggaagggacacctgtgttcgtgcatgcgggcccttttgctaacattgctcacggcaactcttcagtgttggctgataaaattgccctgaaactggttggtgaagaaggatttgtagtgaccgaagctggctttggtgctgacatcggaatggagaaattcttcaacatcaagtgccgagcttccggcttggtgcccaacgtggttgtgttagtggcaacggtgcgagctctgaagatgcatggaggcgggccaagtgtaacggctggtgttcctcttaagaaagaatatacagaggagaacatccagctggtggcagacggctgctgtaacctccagaagcaaattcagatcactcagctctttggggttcccgttgtggtggctctgaatgtcttcaagaccgacacccgcgctgagattgacttggtgtgtgagcttgcaaagcgggctggtgcctttgatgcagtcccctgctatcactggtccgttggtggaaaaggatcggtggacttggctcgggctgtgagagaggctgcgagtaaaagaagccgattccagttcctgtatgatgttcaggttccaattgtggacaagataaggaccattgctcaggctgtctatggagccaaagatattgaactctctcctgaggcacaagccaaaatagatcgttacactcaacagggttttggaaatttgcccatctgcatggcaaagacccacctttctctatctcaccaacctgacaaaaaaggtgtgccaagggacttcatcttacctatcagtgacgtccgggccagcataggcgctgggttcatttaccctttggtcggaacgatgagcaccatgccaggactgcccacccggccctgcttttatgacatagatcttgataccgaaacagaacaagttaaaggcttgttctaagtggacaaggctctcacaggacccgatgcagactcctgaaacagactactctttgcctttttgctgcagttggagaagaaactgaatttgaaaaatgtctgttatgcaatgctggagacatggtgaaataggccaaagatttcttcttcgttcaagatgaattctgttcacagtggagtatggtgttcggcaaaaggacctccaccaagactgaaagaaactaatttatttctgtttctgtggagtttccattatttctactgcttacactttagaatgtttattttatggggactaagggattaggagtgtgaactaaaaggtaacattttccactctcaagttttctactttgtctttgaactgaaaataaacatggatctagaaaaccaa

SEQ ID NO: 1595 - DNA, 746 bp, Homo sapiens
ttcccagaaatacatttgccaccaacagagtagccaaatttataaggaaaaatgattcccaatggatatttgatgtttgaggatgaaaattttattgagtcttctgttgccaaattaaatgccctgaggaaaagtggccagttctgtgatgttcgacttcaggtctgtggccatgaaatgttagcacacagagcagtgctagcttgctgcagtccctatttatttgaaatctttaatagtgatagtgatcctcatggaatttctcacgttaaatttgatgatctcaatccagaagctgttgaagtcttgttgaattatgcctacactgctcagttgaaagcagataaggaattggtaaaagatgtttattctgcagcaaaaaagctgaagatggatcgagtaaagcagcatcttctctacttctgtctgcattcaacatcaacatcatctctcctgtagagcccagttcagatactgcgtttcatgaagccttaccaaattattctacttgaaaatacttatgtgaacttacatagcatttcaatttgttgtacctctccttaaactaaaacttacatatctgtatggcataattagatgtttatcatttgtatacgtgttattaccactattaacatttgttgtattaagacagtgatttttgattctttgtatcttcacatagtctttaccacactgaacattaaatatttgttgaataaaagatatgtaagtgttggcactca

SEQ ID NO: 1596 - DNA, 4199 bp, Homo sapiens
gaagcgggctgggaggcgtcggcggcggcagcgcacgtggtgacgtgcgagggggtgcggcgcgagcggtcggcggcggcggaggcagtgtctcccggtcgcgcgtggaggtcggtcgctcagagctgctgggcgcagtttctccgcctgctgcttcggcgcggctgtatcggcgagcgagcgagttcccgcgagttctcggtggcgctcccccttcctttcagtctccacggactggcccctcgtccttctacttgaccgctcccgtcttccgccgccttctggcgctttccgttgggccgattcccgcccgcttcctcctgcttcccatcgaagctctagaaatgaatgtttccatctcttcagagatgaaccagattatgatgcatcattatcacagaagaaattcgtgtctatagcttttaaggacttgattacatcattttcaagcctgatagttttggaatcaccattagagcttaagacacacctgccttcatttcaaccacctgtcttcataccctgacgaagtgcaccttttaacactcctttgtccttggattacttaagagttcccagaaatacatttgccaccaacagagtagccaaatttataaggaaaaatgattcccaatggatatttgatgtttgaggatgaaaattttattgagtcttctgttgccaaattaaatgccctgaggaaaagtggccagttctgtgatgttcgacttcaggtctgtggccatgaaatgttagcacacagagcagtgctagcttgctgcagtccctatttatttgaaatctttaatagtgatagtgatcctcatggaatttctcacgttaaatttgatgatctcaatccagaagctgttgaagtcttgttgaattatgcctacactgctcagttgaaagcagataaggaattggtaaaagatgtttattctgcagcaaaaaagctgaagatggatcgagtaaagcaggtttgtggtgattatttactgtctagaatggatgttaccagctgcatctcttaccgaaattttgcaagttgtatgggagactcccgtttgttgaataaggttgatgcttatattcaggagcatttgttacaaatttctgaagaggaggagtttcttaagcttccaaggctaaagttggaggtaatgcttgaagataatgtttgcttgcccagcaatggcaaattatatacaaaggtaatcaactgggtgcagcgtagcatctgggagaatggagacagtctggaagagctgatggaagaggttcaaaccttgtactactcagctgatcacaagctgcttgatgggaacctactagatggacaggctgaggtgtttggcagtgatgatgaccacattcagtttgtgcagaaaaagccaccacgtgagaatggccataagcagataagtagcagttcaactggatgtctctcttctccaaatgctacagtacaaagccctaagcatgagtggaaaatcgttgcttcagaaaagacttcaaataacacttacttgtgcctggctgtgctggatggtatattctgtgtcatttttcttcatgggagaaacagcccacagagctcaccaacaagtactccaaaactaagtaagagtttaagctttgagatgcaacaagatgagctaatcgaaaagcccatgtctcctatgcagtacgcacgatctggtctgggaacagcagagatgaatggcaaactcatagctgcaggtggctataacagagaggaatgtcttcgaacagtcgaatgctataatccacatacagatcactggtcctttcttgctcccatgagaacaccaagagcccgatttcaaatggctgtactcatgggccagctctatgtggtaggtggatcaaatggccactcagatgacctgagttgtggagagatgtatgattcaaacatagatgactggattcctgttccagaattgagaactaaccgttgtaatgcaggagtgtgtgctctgaatggaaagttatacatcgttggtggctctgatccatatggtcaaaaaggactgaaaaattgtgatgtatttgatcctgtaacaaagttgtggacaagctgtgcccctcttaacattcggagacaccagtctgcagtctgtgagcttggtggttatttgtacataatcggaggtgcagaatcttggaattgtctgaacacagtagaacgatacaatcctgaaaataatacctggactttaattgcacccatgaatgtggctaggcgaggagctggagtggctgttcttaatggaaaactgtttgtatgtggtggctttgatggttctcatgccatcagttgtgtggaaatgtatgatccaactagaaatgaatggaagatgatgggaaatatgacttcaccaaggagcaatgctgggattgcaactgtagggaacaccatttatgcagtgggaggattcgatggcaatgaatttctgaatacggtggaagtctataaccttgagtcaaatgaatggagcccctatacaaagattttccagttttaacaaatttaagaccctctcaaactaacaggcttagtgatgtaattatggttagtagaggtacacttgtgaataaagagggtgggtgggtatagatgttgctaacagcaacacaaagcttttgcatattgcatactattaaacatgctgtacatactttttgggtttatttggaaaggaatgcaaagatgaaggtctgttttgtgtacttttaagactttggttattttactttttggaaaagaataaaccaagaattgattgggcacatcatttcaagaagtcccctctcctccacatttgttttgccaatttgcacattaaatgactcttccctcaaatgtgtactatggggtaaaaggggtagggtttaaagatgtagacagttgggttttttaagggccctttttcaataactggaacactctataacaaaggatacttatttaaatagatgacattgactatttttgtttttattaaaaggaagcttacatgcctaccaatatttaatcttttatgattgcctttttataactttttatattctcagcagagtgctttaccaattgaagtaaaatgtggcaggctggagttattgaagcagagtggcagtcttcagtttgcagagtaggggtctgtcttttaaactctgagtgcaaacttcagagttcttgccttggctgcagtttttttccttcaagaatgcagtactaacatttatttgagtggagttactgaacagtaacatagctgtgatttttggtatttgaaacactggttttaaatattttgacttgttgagggtatgttttatatagcaagacattatatagcagtaaaaaatggtgttttatcttctatataattcctgtttttattattaacaaaacagtcctaaatagcagccctcaattgtgaaaaaatttactttaaactacattaggttgtgaatgcaggttttatcagaactatgtttttgttcagtttatctgttcatatggataaatattggttgggatgacttggtgtctaatgtgtagtgctacacacctaacttatggggccaaaatagcatgtcctaatgcttgctgctgatttaaacacattaaaggtactttgcaggaaatccttgcaccatgggattaatatccaattgctgcttgtacactcattcattactaaaagttttgagaaatttttttttccagtaatgagcttaagaaatttgtggaaaataactcacctggcatcttacatctgaaataaggaatgatataaggtttttttttctcacagaagatgaagcacacaggaacctaatgggccaactgggatgaggtgactattctgagatgactattcagtggctaacttgggttaggaagaaaataattaggtattttctccaaatgttcactggtactctgccactttatttctctcatctgttacacaaagaaccaccaggaaagcaaatcagtttggttggtaactctgtaattcctaactatcactggtttggttctggactaaaactacattgacagattgaatttgcctaatatgatgactgtttttaatatggatctgtatgtgttctattcagcacaaggaaataaaattttagttgaggattcagcactaaaa

SEQ ID NO: 1597 - DNA, 622 bp, Homo sapiens
ctttgccgctggtcgggattgggatgtcgaagaacacagtgtcgtcggcccgcttccggaaggtggacgtggatgaatatgacgagaacaagttcgtggacgaagaagatgggggcgacggccaggccgggcccgacgagggcgaggtggactcctgcctgcggcaaggaaacatgacagctgccctacaggcagctctgaagaacccccctatcaacaccaagagtcaggcagtgaaggaccgggcaggcagcattgtcttgaaggtgctcatctcttttaaagctaatgatatagaaaaggcagttcaatctctggacaagaatggtgtggatctcctaatgaagtatatttataaaggatttgagagcccgtctgacaatagcagtgctatgttactgcaatggcatgaaaaggtgcctcttgtatgattccagatatggaggaggcccgggaagcccacagaggtacagcatgtcatctgcctcaaggtggtgctacttcaccacattgatgatccaaccacaagcaacatgggacacagcattcactttaacatttctattttcctttatcatttctgttacttgagtgtgtaagagtaatcaacataaataatcta

SEQ ID NO: 1598 - DNA, 1670 bp, Homo sapiens
gggctgtttggaggcgcttggggcgcacaatctggggcaggcggaaccttagtcctcagcctcgcgtttcccgcgactccgctctcaccgctacactaccacacaaacggcctccttcccccacccccgggggcccatcccggtggcgggctccggagctcgggactgctaatttcagcgaaacgattaaaagacgcccctacagctgacggcactttctctcctccggcagggaaggacgtccagcgtagcgtcgcccgcgcttccccgccggcgcagagcaggcctcacagaatcgcacgccgctggcacgcacgccgccccgcccccacggcccagcgccagccgcgccccgcgctcgcacgcatcccggcctcactgcccctcgactcctgttccgttggaggggcctgaggcgagcctgagcgcgctgttggccggagggaagccggaggagaccgggtcgactgggcagagcggcagagggtcgaggagcctgctctgcacgcccagggagtagaagtgggcagggagcagggtcacgtgagggagcgcgccgcgactgagcttgggtccgactggagctcaggctcgcgacccagactggtgggccaggcctccaagccggccttacacccaatccaaggaggacagaccggacacagagggacggagcgagcaaggagacatggcttcatcattcctgcccgcgggggccatcaccggcgacagcggtggagagctgagctcaggggacgactccggggaggtggagttcccccatagccctgagatcgaggagaccagttgcctggccgagctgtttgagaaggctgccgcgcacctgcaaggcctgattcaggtggccagcagggagcagctcttgtacctgtatgccaggtacaaacaggtcaaagttggaaattgtaatactcctaaaccaagcttctttgattttgaaggaaagcaaaaatgggaagcttggaaagcacttggtgattcaagccccagccaagcaatgcaggaatatatcgcagtagttaaaaaactagatccaggttggaatcctcagataccagagaagaaaggaaaagaagcaaatacaggttttggtgggccagttattagttctctatatcatgaagaaaccatcagggaagaagacaaaaatatatttgattactgcagggaaaacaacattgaccatataaccaaagccatcaaatcgaaaaatgtggatgtgaatgtgaaagatgaagagggtagggctctacttcactgggcctgtgatcgaggacataaggaactagtcacagtgttgctgcaacatagagctgacattaactgtcaggacaatgaaggccaaacagctctacattatgcctctgcctgtgagtttctggatattgtagagctgctgctccagtctggtgctgaccccactctccgagaccaggatggctgcctgccagaggaggtgacaggctgcaaaacagtttctttggtgctgcagcggcacacaactggcaaggcttaatcaaaagactggaaaactgcagtctgtaatagcataaggcttccattatgaaagaaaactacaaaaataatacttcttttccacccgtctttggtatgtattggctaataaaatcagttctgtggaactggga

SEQ ID NO: 1599 - DNA, 13491 bp, Homo sapiens
gcccgactgctcccgccctgcctcgcgccgccgccacagccgctgccgctggcgccgctcctcctccgtgtcagttgttgggctgtaatggcgactgggccgcccctgacgaagtgactcccgggccggggagcggggccagacctgcgccagagagaactgcagggagccgcagctcggggggtggcttgccctgagggaggggaggcagcctttccgccttgtcttccttcccagcggaccggcggatccccggagccggtgcgaggagggcacccggtgcgtccccggagcggggaggccaggccgggcagccctggggccggtcggggcggcgtcactgcaccctccgccaggctccgcgggatgcaccgtggtagccgagggcggaggcgacactctcaggtaaattggcaggatgaggagcagcaaatcaaaagaggtgcctttaccaaatccaaggaactctcaaagcaaggatactgttcaagcagatataaccacatcgtgggatgcactttctcaaaccaaggctgctctgagacacattgaaaataaattagaagtagcccctacaagtacagctgtgtgtgattctgtcatggataccaagaagtcttctacaagtgctactcgaaaaataagtagaaaagatggtagatacctggatgattcttgggttaatgctccaatctccaaatccactaaatcacgaaaagagaaatctcgtagtcctctcagggccaccaccctggagagtaatgtgaagaaaaataatcgtgtggaatttcgtgaacctttggtttcttatagggaaatccatggtgcaccttccaatttcagttccagccatctggaatcaaagcacgtatactgtgtagatgttaatgaagaaaagactgagagcggtaactggatgataggcagtcgagaagaacggaatatacggagctgtgattttgagagctcccaatcatctgtcatcaatgatacagttgttaggtttttaaatgatcgaccagcaattgatgcattgcaaaattctgaatgtttgattaggatgggagcttctatgagaactgaggaagaaatgcctaacagaacaaaaggaagtgagaataatttgaagctttctgtgaataacatggcccatgatactgatccaaaagcgttacgactaactgactcttctccatcctctactagtacttctaattcccaaagattagatattctaaagcggcgacaacatgatgtcaaactggaaaaacttaaggaacggattagaaaacagtgggaacactcagaagaaacaaatggccggggccagaagctgggtcatattgaccatccagtaatggttgttaatgttgataactcagtaacagcaaaagtcagaaaagtggcaacagcaccacctgctccagcatataaaggtttcaacccttcagagaccaagattcgaacacctgatgggaaagtgtggcaggaggctgagtttcaaaacatgagtagagaactgtatcgagatttagcacttcactttgcagatgatatttctataaaggagaaacctgctgaaaaaagtaaagagaagaaagtagtcaagccagtacgaaaagtccaaaaagtagcacagttatcaagtacagaatgcagaacaggtagtagtcatcttataagtacatcttcttggcgagatggacaaaaattagtaaagaagattctgggacctgctcccagaatggagccaaaagagcaaagaacagcatcaagtgacagaggtggaagagaaagaactgctaaatctgggggtcacattggaagagcagaatctgatcccaggttggacgttttacatagacatcttcaaagaaactcagaacgttcgagaagtaaatctcggtctgaaaataatataaagaaactagcttcatctcttccagataataagcaggaggaaaatactgccttaaataaggactttttacctattgaaattcgtggcattcttgatgacctacagctggattctacagctcacactgcaaagcaagatactgtagagttacagaaccagaagtcatcagcaccagtacatgctcctaggagtcacagcccagtaaaaagaaaacctgacaaaataacagctaatgaagatccccctgttatttccaaaaggcgccactatgacacagatgaggtacgacagtacattgttaggcagcaggaggaaaggaagagaaagcaaaatgaagagaagaaggctcaaaaggaggctacagaacagaaaaacaaacgattacaagagctctaccggaagcagaaggaagcctttactaaagtaaaaaatgtccctccttctgagccatcagcaactaggcgactacaggaaacttactccaaattgctactagaaaagaccttgcttgaagagccatctcatcaacatgttacgcaggaaacacaggccaaaccagggtatcagccatctggagaatctgacaaagaaaacaaagtacaggaacgtcccccaagtgcatcttccagtagtgacatgtctctctcagaacctccacagcctcttgcaagaaaagacttgatggaatctacatggatgcagcctgaaagattgagcccacaagttcaccattctcaaccacagccttttgctggaacagctggaagtttactctcccatctcttgagtttagagcatgtaggaattttgcataaggattttgaatctattttaccaaccaggaagaatcataatatggcttcaaggccattaacttttacacctcaaccatatgtgacctcaccagctgcttatacagatgccttgttaaaacctagtgccagccaatataagagtaaactggatcgtattgaagccttgaaagcaacagctgcttctttgtccagcagaattgaaagtgaagccaagaaattagctggggccagcattaactatgggtcagcatggaacactgagtatgatgtgcagcaggcacctcaagaagatggaccttggaccaaggctgtaactccacctgtgaaagatgataatgaagatgttttctctgccagaattcagaagatgctgggaagctgtgtatctcatgcaacttttgatgatgatcttcctggtgtaggcaatcttagtgaatttaaaaagcttcctgagatgataagaccacagagtgccatatcaagctttagagtgagatcccctggtcccaaaccagaagggctactggcacagttatgtaaaaggcagactgactcttctagctctgatatgcaagcctgttctcaagacaaagccaaaatatctcttggttccagcatagattcagtcagtgaagggcctcttcttagtgaggggagtctctctgaagaagagggagaccaggatggacagccccttttgaaagtagcagaaattttaaaagaaaaggaattttgtcctggagaaagaaatagttatgaacccatcaaagagtttcagaaagaagctgaaaaattcttgccactttttgggcacataggtggtacacaaagcaaaggaccatgggaagaattggcaaagggaagtccacatagcgtcattaatatttttacaaaatcctatcagttatatggaaaagggtttgaagacaagttggacagaggaacatcaacatcacggcctttgaatgccaccgcaactcctctaagtggtgtttcatatgaagatgattttgtctcctctccagggactgggacttcgacagaaaaaaaatcaactcttgaacctcatagcactttaagccctcaggaggaccattctaacagaaagtctgcctatgatccttcctctgtggatgttacctcccagcattcatcaggagcccagtctgctgcatcgtctcgttcatctacttcttctaaaggaaagaaaggaaaaaaggaaaagacagaatggttggattcattcactggaaatgttcagaactcacttcttgatgaggaaaaagcagaacgtggctcccatcaaggaaagaaatctgggaccagcagcaaactttctgttaaagattttgagcagactcttgatacagatagcactttggaggatctttctggacattctgtgagtgtctcatcagataagggaagatctcagaaaactccaacttctcccctgtcaccaagttcccagaaatcattgcagtttgacgttgcaggaacttcttcagaaagatctaagtcgtcagtaatgcctccaactataacaggatttaagcctaatgcacctctcactgatctgaacccggcagccagcagaacaacgacagagaacatggctccaataccaggttctaagcgcttttctcctgctggcctccatcatcgtatggcagcagaactcagttatctgaacgccattgaggagtcggtgcgccaactgtcagatgtagaaagagttagaggcatttcacttgctcagcaggagagtgtgtctctagctcagataataaaggcacaacagcaacgccatgaaagagacttggccctcttgaaactaaaggctgaacaagaggctctggagagtcagagacaattagaagaaacccgaaacaaagcagctcaggtccatgcagaatcattacagcaggtggttcaatcacaacgggaagtaactgaagtcctgcaggaagcaacgtgtaaaatagcagctcagcagtcagaaactgctcgcctcaccacagacgcagcacgtcaaatctgtgagatggcagagttgactagaactcatatctcagatgctgtcgtggcttcaggagctccccttgcaatactgtatgaccaccaacggcagcaccttccagactttgtgaaacagctgaggaccagaactgaaacagataggaaaagtccatctgtttcactctctcagagtaaagaagggacccttgactcaaagcatcagaagtattctgcttcatatgatagttattctgagtcttcaggatacaagaatcatgatagaagaagtagcagtggtagcagccgccaagaaagtccttcagttccatcttgtaaggaaaatgagaagaaacttaatggtgaaaagatagagagttccattgatgaacaggttcagactgctgcagatgattctctacgaagtgatagtgttccatctcttcctgatgaaaaagactcaacgtctattgcaacagaatattctctgaaatttgatgaatccatgacagaagatgaaatagaagaacaatcatttcgatcattactaccttcagagagtcaccgcagatttaacatggaaaagagaagaggtcatcatgatgactctgatgaagaagcttctccagaaaaaactacactgtctactgccaaggaactgaacatgccattctcaggaggacaagatagcttttctaaatttactatggagatggttcgacagtatatgaaagaggaagaaatgagggcagctcaccagtcttcactcctgcgtctccgtgaaaaggccttgaaggagaagactaaggctgaattggcctggttagagcatcaaaaaaaacatctacgagacaaaggagaggatgataaaatgcccccgctccggaagaaacagcgtggtttgcttttaaggttgcagcaagaaaaggcagaaataaaacgtcttcaagaagccaataaggcagctcggaaggaaagacagctgattcttaaacagcaggaggagatagaaaagatccgacagaccaccataaaactacaggagaaattgaagtctgcaggggagagtaaattggactctcatagtgatgatgatacaaaggataataaggcaaccagtcctggtccaactgacttggagacccgcagtccttctcccatttcaatctccagcagtgaaactagcagcattatgcagaaactgaagaaaatgagaagccgcatggatgaaaagtttctgacaaagcgggagcaaaaattaatgcaacggcgacaacatgcagaggagctcctagagtggaagcgacgtttagatgcagaagaagcagaaattcgtcaaatggaaaaacaagctttggctgcctgggacaaagaattaataaaacccaaaactcctaagaaagaactggaggaccagagaacagaacagaaagaaatagcaagtgaagaggaatctccagtacctctgtactctcatctaaacagtgaaagctccattccagaagaattaggcagccctgctgttgaatatgtaccatccgagtctataggacaggagcagccagggagtccagatcacagtatacttactgaagaaatgatttgttcacaggaactagaatcttctacctctcctagtaaacattcacttcccaaaagctgcacatctgtgtcaaagcaggagtctagcaaaggaagtcataggactggaggacaatgtcacctgcctatcaagtcccatcagcactgttatagttggtcagatgagtcattatctatgacacagtcagaaactacatctgaccagagtgatattgaaggtaggatcagagctctgaaggatgagttgcggaaaagaaaatcagttgtgaaccagctgaagaaggaacagaaaaaaaggcaaaaggaaagactgaaagcccaagaagccagtctgatcaagcagttagagtcatatgatgaatttattaagaaaactgaagccgagcttagccaagatttggaaacatcaccaacagccaagcctcagattaaaacgctctcctcagcttctgaaaaacccaagatcaaacccctcacaccactacacagatctgaaacggcaaagaattggaaatcactaacagagtcagaacgttccagaggatccctggagtctattgctgaacatgttgatgcttcactgtctggttctgagagatcagtatcagaaaggtctttatctgcatatgcaaagagagtaaatgaatgggacagtcgaacagaagattttcagaccccatctccagttctcagatcatcaaggaaaatcagagaagaatctggagattctctagaaaatgtacctgcattacatcttctcaaagaattaaatgccactagtagaattcttgatatgtcagatggcaaggttggagaatctagtaaaaaatcagaaataaaagaaatagagtatacaaaattgaagaagagtaagattgaagatgccttttctaaagaaggtaaatctgatgtcttactgaaattagtcctagaacagggagattcatctgaaattctttcaaagaaagatcttcctttagattctgaaaatgttcagaaagacctagttggattagctattgaaaatctccataaaagtgaggaaatgttgaaagagagacagtcagatcaagatatgaatcatagtccaaacatccaatcaggaaaagacattcacgaacaaaagaacacaaaggaaaaagatttgtcttggtcagaacatctttttgctcctaaagagataccatactctgaagattttgaagtgtcttctttcaagaaagaaatttcagctgaattgtacaaagatgattttgaggtgtcatctttgctgtcactcaggaaagactctcagtcttgcagagataagccacagccaatgaggagctctacaagtggagccactagctttggtagtaatgaggaaatcagtgagtgcctaagtgagaaaagcctttctatccatagcaatgttcattctgacaggctgttggaactcaagtcccctactgagctgatgaaaagtaaggagcgcagtgatgtggagcatgaacagcaagttactgaatccccttccttggcttcagttcctactgcagacgagttatttgatttccacattggtgatagggtgttgattggaaatgttcagccaggaattcttcgattcaaaggtgagactagttttgctaaaggattttgggccggagtggagttagataaacctgaaggaaataacaatggaacatatgatggtattgcatattttgagtgcaaagaaaagcatggtatttttgctcctcctcaaaaaatatctcacattccagaaaactttgatgactatgtagacattaatgaagatgaagactgttactcagatgaacgatatcagtgctataatcaagagcaaaatgatacagagggtccaaaagacagagaaaaggatgtcagtgaatatttttatgagaaatccctacctagtgtgaatgatatagaagcctcagttaatagaagtagaagccttaaaatagaaacagacaatgtacaggacatttctggggtacttgaagcccatgttcaccagcagtcttcagtggattcacagatttcttcaaaggaaaacaaagacctcatttctgatgccacagaaaaggtttccatcgctgcagaagatgacactttagacaataccttttccgaagaattggagaagcaacagcagtttacagaagaggaagacaacctatatgctgaagcttcagaaaagctttgtacaccacttctggatcttttaacaagagaaaaaaaccaactggaagcccagctgaagtcatcactaaatgaggaaaaaaagtcaaaacaacaactggaaaaaatcagcttactgacagacagtttactaaaagtctttgtaaaggacacagtcaatcaactacaacaaatcaaaaaaaccagggatgagaaaatccagcttagcaatcaggagcttcttggtgatgaccaaaagaaagtaacaccccaagacctatcccaaaatgttgaggaacagtcgccaagtatttcaggttgcttcttaagttctgaattggaagatgaaaaagaagagatttcctctccagatatgtgtcccagaccggagagcccagtatttggtgccagtgggcaggaagaacttgctaagagacttgctgaacttgaactcagccgggagttcctgagcgcgttaggagatgatcaagactggtttgatgaagactttggtttgagctcttctcacaagatccaaaaaaataaggcagaagaaaccattgtacctctaatggcagaacctaaaagagtaacccaacaaccatgtgaaacattattggcagtcccccatactgcagaagaagtagagattcttgtacataatgcagcagaagaactttggaaatggaaagaattaggccacgatcttcatagcatcagtattcctacaaaactgcttggctgtgccagtaaaggtctagatatagaaagcactagtaaaagggtctacaaacaggcggtttttgatttaacaaaagagatttttgaggaaatatttgctgaggatcccaacttaaatcaacctgtctggatgaagccatgtagaatcaactctagttatttccgacgagtgaaaaatccaaataaccttgatgaaatcaagagcttcatagcaagtgaagtactcaagttgttcagtcttaaaaaggagccaaaccacaaaacagattggcagaaaatgatgaaatttggaagaaagaaaagagaccgagtggatcatatcctggttcaggagctccatgaggaggaggcacagtgggtgaactatgatgaggatgagttgtgtgtgaaaatgcagctagccgacgggatctttgagaccctgatcaaagatactattgatgttctgaatcagatcagtgaaaagcaggggagaatgctacttgtgtgacatcttgcaaataaatcgaacgctgagtgctaatgtgagtcctgggcctttctgcctcctgatgtacacccatcgccatcatagcaagagtgcttctggaccttgtacttattcttaaagactaccagtatggagttcataggacaatgtggtacacctggtattacagcctttgcctttcgagactatccactggattaatgggttattttcagtgggcagggttgcacagtgtaatcctacaccttttgctaacacccctactaggtcccagagggccagaaacacctgacttacctctgagtttagactagggtatcacttctttgagtctgaagtcaagtgagagaggtatagataaatgcatcacatcacttttgaaatgtaattctggtctataccatggaagtcataaatggacattatagtctctaaacagtattaaacccttaaccacttctaaaataggcaagctcaataatgtctgccaacttcacattctggagtttatttcatttctttttgaagaccattttcttccattattgtagttgagcagcaccaagtggactgtcaggctaacaggaataagtggtagccttgctttctgagcaccatctaaagaattttaaacctctgcattatgtttagtgttctctgtgtgggcatgaaaacaaagaaatgcccctactgaagactgggctcaaaggaccaatgcagggctggttcttttaccccttggtttactcctgcacttgtcttactcattctgaatctctaccagctgctcccagaatcacagatactcaggaccatctcaggcatccaggcatggcaaagtggaaataattcattttggcctgcaaaccttcaactcccatctttccccaagaagtcagagatgctgttacttgaatgatttaggaaatgagtgtgtgcaccaaagacaaaaagatattgtctattgtttgtgtgcttgttttgcgctatggaacattttttaatttattttaagataaattattaagttgaaaatgtgtgtccctattcagaagtgaaagattcatcttgtaatagttaaacctccatcttgaagcttctatggttcatagtctttgcacaggaacctgtggttttaacaaaccaatacacatattgaagaagtcattttaattcagtgaaacgaagatgggcttttccagatcacctgcaatagcagcagtgggataaaatgatttaaaaacactgtacaatttaactctgcctctcttgcagcattgcttctcacaactattacctgcatctgaaaaaaaatctatagactccagctgctacattagagcataagagatgctctcctgggacctcagtaccctgccttcttgactggtttccgttcatcagtcctgtccctcttcaagtaatctagaagaatgtggatactcttaggcgtgaatgtaaatgccttaatattgaaggtcctggttagaagcatgatacaagacatctactggattcatatttacaaatatcctggaatgttatagcttcaaagtatattagaaaaaccccaaagatggtataatctttaagtgtgcacgttcgtttatttctgcatcttccctccaaacttgcctttgcatcttaaatatttcactatgcacactcccattcctcttgggtttcatcttgtcgtttaagaaatgtactgaaataatcattggaatatttgcattttgcacaatgactggtatgatagctcttgacaaataaggaaagcactgaaatgttgtgattgggtctcgggaaatgctcagattgatgtcttaccagcatttcttctgggcttgtgatgttgagctgtagtcttgtagccataatgagcaaattgactaagagaagcaaaggtttcttggggttattaaccagtagtgtggaaatactagttttatgtggccaaggaaaagcaaaggcttttcttttcagtttgtgttatttggaagacagaaaaacatcttgtctacatcctttggctgtttgtaggatcacgttgtccttacgatactgaaactttacagctgctgtaaattttttataaatgaatttcaaaatgttataatgggactgtaggttgtttttctacatcttcattatttggacctaaaaccagtttttaataagaaagtttatctttactctttctgaaattatgactccagaaaaagaaaaaaaaaatacaagtcatggaatcagcaatctggtaagaaatgctgccaagaatgtggcagtagctgtcctgacagactccaactgtctttactatctgaagaatcctaggctccacatgagaggcagaaatggatcagtcttattcttttctagaaatggttatctgtagtttggtagcaaaaaaaaagaaaaaagaatccataattagcagatttcttattaactatttggatctaattgaaatggctttattcttaggattaagaaagatagatgtggatacccagccactcgttccatattggtatctttttaaatcagctctgcctcttaatcaagaacctaaatattccctctttctaatctttgttccttctccctacaccctcatcctctttcactcttccttcataattcctctaagaaaaatatctttgcatcagcagtaatatcttttagaatagcactatcagaatttagcagtaaaccaacatacaggcttcagatttacttctgagtccaaaacaatttgtgctatccagggtagttaactctgggttaaacaagtacagggtatagattccctcttcaggtctacacaggaatttttaccatagggaaaagtggggagagctcaaacgtagttaataaggaaggtaatttgtttttcttttacctaaaagaaaagaaaattccttctgtgactacaggtctctgagaaattatctttcaaaagagatttcattgctcataagagtgttgtggcctattgataaaaacaattttgttcagtttcttgtcttgaaaaaaaagtggccttagctttttgcaatacttgaataaagtgtgtactcgcaaaagaatttctgtagcacagcattagagactcataacttttctgcaagaaatacaaacttacatcttccttttactaccttaagaatactagtgaataaaacattaattcaaagagcaaattatagaaactacaatgacatttaatgcaaattgtaggaatttacatgtttacaaatcatcttcaactggttgtgcagcaattcaataaaatatctttgtattataaaaatgtgaagaaaaaatgtaaactgatgtaaaggaggtactgtcattttaattaacctatgtttaatagcttttccttctggactttgcaaagccttcttggcaaacacattgcaaagcattctctgggaggttcagcctccttgtgtgtactgtactgtgcagacatgaaaaaataaacccgtttactgtgtgcgtgtaaatagcctggtcatcaggccattttcagccaatagtcacatccagtgcaattttgcaccgaacacttaagggtgtggtttgtaagtacgatctgtaaaataactgggatgaattcccatgtatacctgtgtaaatagatttgttaactgaaatatactttaagaaagataaaatctgtaaataaactgatttataaattaatttca

SEQ ID NO: 1600 - DNA, 3632 bp, Homo sapiens
acctcgcgtcttcccaccgcgtcggaggacgtaggcgcctgggatcctggaaggcttcggatgggaagtttgcgttggagtccaacacccgacaggaaccccagttaacgcctccgcatggccaggggcagagttcttgacacctgtagcttaatcaacgcaggtggagattcagggcttgaatcgcccggccacgcgcaagccgcagggcaccctcatactactacttctgccttattacccttaaaactggagtctcagttatttgtatcccactattggtttttttttaaatcttttttcgtgggtttgcccccttttcctcagctgcgtttctgtcttcagtcctgtagggcacaatgtctgaacaagagcgtatacaggaatgtctgcggaaggaaataaggtcacttctcatttccaccaaagatggtttgagcccacaggagttggagaaggagtaccttttgatggttggcaaccatctaccactccgaatccttgggtatcggtccactatggagctggtattggacatgcctgatgttgttcgtgtctgccccggtgcaggtggtactgtaatactgaaagccattccagatgaatctaccaaaggaatagcaagcttagttgcaaaacagaggagcagccataagcttcgaaactcaatgcataagggaagacctagtatttattctggaccgagatctcatcggcgagtaccttaccgaggaagggttgcccctattcttccagctgttgtgaagagtgagttgaaggacctgttggcgttatctcctgttcttctttctgattttgaaaaggcatttgccaaaagatttggacgatcattccaatacatgcaatatggatttctctctatgtttgaagtgcttaatgcggcttcagatgtcatttctgtagagcagaccagagcaggttctttgttgatgctaaagaagagtgtaacagaggaaaagccgagaggatgtccagcaggtaaaatttttacccagccatttagaatgaaacaagggtcatactccacaggctttccggtagcaaagccatgcttttcacaacccacttcaaacatggaaccaccgaagcaaataatgagcatggaaaagacttccaagttaaatgtagtggagacttcaagactgaatcacactgaaaaattaaaccagctggagaacacattcaaatcagttattgcacagattggacctggaggaactatcagttcagaactaaaacataagataaaatttgttgtatctaagttcccagagggtttgtttatttctaaactgcttggagagtatgaggtaatttttaaagagcaactatcaccaaaaaaattaggcttcttaaatgtgacagaacttgttggagctcttagtgacattctccatgttgagttcaggaaaggacaccaagacttactagtgtttgatgcggataagaagcctctaccacctgttcagtcagataagaaaatagaagccaaagcttgtgtctccagtccacctagaaattcattgtctactgctgctgtcaaagagactgtatggaattgcccttcaaaaaaacaaaaagagccacaacagaagatttgcaagaagcctaatctggtggtaaagcctttacagctgcaagtagaaacaaacaaatcagagctcaacttggcaatggcaaatcatgacatcccgccagacgctgtgccgaacaagaaattatgcagactcccaccattagacaccagttccctcataggggtctttgtggagtatatcatctctcctagtcaattctacatccggatctatagcagggattcgtcagagttactcgaagacatgatgattgaaatgcggcgctgttattctaatcagctggtttctgatcgatatgtcatgccagaatgttttattcagccgggacatctctgttgtgtaaggatttctgaggataagtggtggtatcgggtcattatccatcgagtccttgagaaacaggaagttgaagtgttctacccagactttggaaatattggaattgttcagaagtcctccctgaggttcctcaagtgctgctacacaaagcttccagctcaggctatcccttgttctttggcttgggtgagaccagtagaggaacactggacatcgaaagctattttgcagttccagaagttgtgcggtttgaagccattagtgggggtagtggatgaatatgtagatggaatccttaacatttttttgtgtgacacatcctcaaacgaagatgtctatttccatcatgtcttgagaacagagggccatgctattgtatgccgagaaaatatctcttctaagggtttcagtgagctcaaccctttagctttatacacgacatccagtggagggccagaggacattgtcttgacagaactgggttatccttcccagcagcactattttaatgaagaccgaaagataagtccacagtcaaaagagagtgagttacgtatcttggatgagatccccactggaatgccatgcctggagtcagtgaccataggtgatgatatttgggatgagaactggttacctctacaggctaagatgggaaaaggaggtgatgctgcctcccatctatttactgcaagccttggtggaaagaatcagtattcatcatgtaaagaaatgccacagaaggactggtgtttttctacccctaaagatacatgggatgattcttggcagccttcaggccttgtaaatggaacgaaagtagaagttcataagccagaagtactgggtgctcaggaaaaaaatactggcacaaacaggactcaaaagcaactagacataaatggttcttcagattcttccacactgcccaaattggaagaattctgtacctctcttacccagtcagagcagtcagcagacgggagccagtctgaacccaacaacagtcagactcagccaaagcaaattcagctttccacagcagcaccctgttcaacaactgcagtggatgattccgcagaaaagccctctggttctgtggaaagctcaccagagatcctaaagaatgaagatttttctagcagccgtgctattacattgtacaaagacaagcgtcaagaatctgtagaccagctgtctttgattttgtcttatgagtgccagatttctcagaagctctacattcctcgaagtacagccactgctgccttaggtgctgccgcacggttagctacatccaggagcctcctacactggtaccccagtgtgaaaaggatggaagcatgagggagggagggaggagggagaaaaacagaatccagccgcttaggctttgatgaactcccaggccaaaatgaggagttattgaagcaaaatagtatcttgatcattgatacttttgtctttctgtgactatatgttagctttattatgctaacagtctactttgatgtgtaagtaagtattgatatttactgttaatcttgatttttcttgattttattctgtgtcattttgttcacctttgtttttaatgtagtttaaaggaatttgtttttttgtgtttgtttttcttgtacattatcatgactgataaatgaaaattgaaaaact

SEQ ID NO: 1601 - DNA, 785 bp, Homo sapiens
aggggctgttgtggggagttgaagaacaccctggcctcctccatcatgtcggccaagagggcagaattgaagaaaacacatctggtaaaagagagacattgctggacaagcaagaactacaaggcagtttgcctggaattgaagccagagccgaccaaaacatttgattacaaagcagttaaacaagaagggcggtttaccaaagcaggagtgacacaggacctaaagaatgaactcagggaagtgagagaagagctcaaggagaaaatggaggagataaaacagataaaggatctaatggacaaggattttgataaacttcacgaatttgtggaaattatgaaggaaatgcagaaagatatggatgagaagatggacattttaataaatacacagaagaactataagcttccccttagaagagcaccaaaggagcagcaggaactcaggctgatgggaaagactcacagagaaccacagctcaggcccaagaaaatggatggagccagtggagtcaatggagcaccctgtgctcttcacaagaagacgatggcaccacaaaaaacaaaacagggctcactggatccccttcatcactgtgggacctgctgcgagaaatgtttgttgtgtgctctaaagaacaactacaatcggggtatatacgctgcagtgggactgctggatctatggtagctcaatttttagttttttgaggaacaacctccaaactgttctccatagtggctgtactaatttacattcccaccaacagtgtacaaagattc

SEQ ID NO: 1602 - DNA, 2377 bp, Homo sapiens
agtggcctggtcccaggggctgttgtggggagttgaagaacaccctggcctcctccatcatgtcggccaagagggcagaattgaagaaaacacatctgagcaagaactacaaggcagtttgcctggaattgaagccagagccgaccaaaacatttgattacaaagcagttaaacaagaagggcggtttaccaaagcaggagtgacacaggacctaaagaatgaactcagggaagtgagagaagagctcaaggagaaaatggaggagataaaacagataaaggatctaatggacaaggattttgataaacttcacgaatttgtggaaattatgaaggaaatgcagaaagatatggatgagaagatggacattttaataaatacacagaagaactataagcttccccttagaagagcaccaaaggagcagcaggaactcaggctgatgggaaagactcacagagaaccacagctcaggcccaagaaaatggatggagccagtggagtcaatggagcaccctgtgctcttcacaagaagacgatggcaccacaaaaaacaaaacagggctcactggatccccttcatcactgtgggacctgctgcgtaagtgaaaccctgcccgagcccagcactggtgccagacccctggctccggctccctggtgacttccccgagcttgtgctgtatcatagtgaagggacaggtccgcccgctgctgacttctgggtgccgcccgagcctgcgccctccctgacctgccttgccttctaggcctgtggagcctccttagctgtgaccatgcaggacttgaccctggatgggcctacccgccagctccaccctcttattctgtccttccctttagcaagggcagataaggtgcctagcaggctgcccttcttggaccaggggaaattgatctttcttgtgccgtttctgtcctctgcaggagaaatgtttgttgtgtgctctaaagaacaactacaatcggggtaggtagattcatacaagatgtgccttttctcgatcaggtgccttgttgtccccaaggccatgtgctcccagccgcattcacatcacacccctcctgaggttgtgccaggagtagggactgttagcagatgctgccacccagcatgctcagtcatacaggatgtggcaccaggaaggaggacttgggtcacccagcctagaggctgctgcctggggctcccatggtggggagggtgcaccactagtggcggaactgaccttgcctcaggtcctgccctttctccccatccagtgggaaatattcacaccaggtctgggcacccttttcacccttggcttctggagctgccttctgatttatctgtacctcaaccccggtgacatcgaatatgtgtttccaacctagcgcagctgcagaacctaccagcagttccgattcatcacctccaagctccttaagatgcacagtcagggcttcttgtcctgttaaataccaccccaaccccaggcctccactggagattaaaaaccttcattcaaagccaaaggggatgtcatggttttgagtaccagtccaaaacttgagtgtgtggaggttgattatttttggttctatatcagtgtatttcagactccaacccttccccctgcttcctgatggattggtgggaaattacatcttagtcatcttagggtcctcccaaccaccacctccctccattccacctgggtctgcaaacgtcccaggtcatagcatggggagggcccctgatgatagcggacgccagtctgtgtggtctcaggagagaccctgctgcctggcccatccgctccctccacataatcagcctccacctgtgcatggggccagggtgtcttgggtgatgcagggaacccctcagcctcgagttctgcctgcaccacacccctctgaggtcttgtcaccaagcaggactcaggtccctgctgctcataggaactgggtagctttcttgggttctggggatccacccttctcacccccttgaaggtttcctctccctccctccacccccaaagggaacattccttcagaggcctcaggcctttacaaaggtggagaggagccagtgaccacccaaccttctgtgggccacgctgtgcctgccccaaagtcccagactgagggaaggtgaagcttaactgccagcttgaaatgagagtaaagaagatacagagcaaacagtgtttcagaaactgtcctgccctgggtgtgattctttggcttcaatttgaaggacgaggaatgatgggatttcatattttatttcacaccagttcctccttgtttcatctctttgctaagctggctgcttctaccatctaataaataattggccaagtt

SEQ ID NO: 1603 - DNA, 2452 bp, Homo sapiens
gttgcctaggacagtggcctggtcccaggggctgttgtggggagttgaagaacaccctggcctcctccatcatgtcggccaagagggcagaattgaagaaaacacatctgagcaagaactacaaggcagtttgcctggaattgaagccagagccgaccaaagtaagaagcccttttgaggccatgcaggcagccaggcctgagatccatggggaagtgaccaggagtcaggggtcatttgctgatcctagtggccaagatttgtcccagacatttgattacaaagcagttaaacaagaagggcggtttaccaaagcaggaaggacacccagactcttggaggagttgtctttgctcctactgcccctgtgacttggagtcaaggccttccatggccacccgtgtactggttatctccttgtcatgctgcaaaatgtctccccaactctctgcccctccctggccctcctcccccagtccccttagaagagcaccaaaggagcagcaggaactcaggctgatgggaaagactcacagagaaccacagctcaggcccaagaaaatggatggagccagtggagtcaatggagcaccctgtgctcttcacaagaagacgatggcaccacaaaaaacaaaacagggctcactggatccccttcatcactgtgggacctgctgcgtaagtgaaaccctgcccgagcccagcactggtgccagacccctggctccggctccctggtgacttccccgagcttgtgctgtatcatagtgaagggacaggtccgcccgctgctgacttctgggtgccgcccgagcctgcgccctccctgacctgccttgccttctaggcctgtggagcctccttagctgtgaccatgcaggacttgaccctggatgggcctacccgccagctccaccctcttattctgtccttccctttagcaagggcagataaggtgcctagcaggctgcccttcttggaccaggggaaattgatctttcttgtgccgtttctgtcctctgcaggagaaatgtttgttgtgtgctctaaagaacaactacaatcggggtaggtagattcatacaagatgtgccttttctcgatcaggtgccttgttgtccccaaggccatgtgctcccagccgcattcacatcacacccctcctgaggttgtgccaggagtagggactgttagcagatgctgccacccagcatgctcagtcatacaggatgtggcaccaggaaggaggacttgggtcacccagcctagaggctgctgcctggggctcccatggtggggagggtgcaccactagtggcggaactgaccttgcctcaggtcctgccctttctccccatccagtgggaaatattcacaccaggtctgggcacccttttcacccttggcttctggagctgccttctgatttatctgtacctcaaccccggtgacatcgaatatgtgtttccaacctagcgcagctgcagaacctaccagcagttccgattcatcacctccaagctccttaagatgcacagtcagggcttcttgtcctgttaaataccaccccaaccccaggcctccactggagattaaaaaccttcattcaaagccaaaggggatgtcatggttttgagtaccagtccaaaacttgagtgtgtggaggttgattatttttggttctatatcagtgtatttcagactccaacccttccccctgcttcctgatggattggtgggaaattacatcttagtcatcttagggtcctcccaaccaccacctccctccattccacctgggtctgcaaacgtcccaggtcatagcatggggagggcccctgatgatagcggacgccagtctgtgtggtctcaggagagaccctgctgcctggcccatccgctccctccacataatcagcctccacctgtgcatggggccagggtgtcttgggtgatgcagggaacccctcagcctcgagttctgcctgcaccacacccctctgaggtcttgtcaccaagcaggactcaggtccctgctgctcataggaactgggtagctttcttgggttctggggatccacccttctcacccccttgaaggtttcctctccctccctccacccccaaagggaacattccttcagaggcctcaggcctttacaaaggtggagaggagccagtgaccacccaaccttctgtgggccacgctgtgcctgccccaaagtcccagactgagggaaggtgaagcttaactgccagcttgaaatgagagtaaagaagatacagagcaaacagtgtttcagaaactgtcctgccctgggtgtgattctttggcttcaatttgaaggacgaggaatgatgggatttcatattttatttcacaccagttcctccttgtttcatctctttgctaagctggctgcttctaccatctaataaataattggccaagt

SEQ ID NO: 1604 - DNA, 802 bp, Homo sapiens
ctgtaagttgcctaggacagtggcctggtcccaggggctgttgtggggagttgaagaacaccctggcctcctccatcatgtcggccaagagggcagaattgaagaaaacacatctgagcaagaactacaaggcagtttgcctggaattgaagccagagccgaccaaaacatttgattacaaagcagttaaacaagaagggcggtttaccaaagcaggagtgacacaggacctaaagaatgaactcagggaagtgagagaagagctcaaggagaaaatggaggagataaaacagataaaggatctaatggacaaggattttgataaacttcacgaatttgtggaaattatgaaggaaatgcagaaagatatggatgagaagatggacattttaataaatacacagaagaactataagcttccccttagaagagcaccaaaggagcagcaggaactcaggctgatgggaaagactcacagagaaccacagctcaggcccaagaaaatggatggagccagtggagtcaatggagcaccctgtgctcttcacaagaagacgatggcaccacaaaaaacaaaacagggctcactggatccccttcatcactgtgggacctgctgcgagaaatgtttgttgtgtgctctaaagaacaactacaatcgggcgcagctgcagaacctaccagcagttccgattcatcacctccaagctccttaagatgcacagtcagggcttcttgtcctgttaaataccaccccaaccccaggcctccactggagattaaaaaccttcattcaaagcca

SEQ ID NO: 1605 - DNA, 398 bp, Homo sapiens
gtatgagctcagagaggagcatctggacaaaatatttaaacacagagaactgcagcagaagctggtggatgcaaagcttgagcaggcccaagaaatgatgaaggaagcggaggagcgacacaaacgagaaaaggaatatttgctgaaccaggcagcagagtggaaacttcaggcgaaagtgctgaaggagcaagagacagtcctgcaggctcaggtgaggccaggtggacgaggcatgggggtgctgtcctcactgtccccagataaaaaggctggggccaaaggtgggcagcagaagtcctcctatgtggcaggggatggggggatgggaattggaaatgaagaacaacttcacatttattcatattttcaagtaaaaataaaagcacaatattata

SEQ ID NO: 1606 - DNA, 2766 bp, Homo sapiens
gcgactgcgcagcgtggcccagcgcggtcaaattataatacataaaagttgtcagggcggagagcaagacattactcttctcggattgccggttcgctcgcgagacttgagcgttgctaggagattcggcaggcgggcggagccagactcggcggggcggggaggggtggggctaggctcggcgaggcgaggaagggtgggtggagccaggcttggcgggctgtgcgtgctcgcggtgggcggtggcggcggctgcctcgcgaaggttcgagatccgtcgcgtgcgggaggcgggccgcgatcttgcgcagggtcggtgtgggcgcaggctgcagcgccgcgactcgtgcgggtaggcgtctgcgctcggtttgagggctcggcgcggggtttcctgttcctccttctgcgcggctgcagctcgggacttcggcctgacccagcccccatggcttcagaagagctacagaaagatctagaagaggtaaaggtgttgctggaaaaggctactaggaaaagagtacgtgatgcccttacagctgaaaaatccaagattgagacagaaatcaagaacaagatgcaacagaaatcacagaagaaagcagaacttcttgataatgaaaaaccagctgctgtggttgctcccattacaacgggctatacggtgaaaatcagtaattatggatgggatcagtcagataagtttgtgaaaatctacattaccttaactggagttcatcaagttcccactgagaatgtgcaggtgcatttcacagagaggtcatttgatcttttggtaaagaatctaaatgggaagagttactccatgattgtgaacaatctcttgaaacccatctctgtggaaggcagttcaaaaaaagtcaagactgatacagttcttatattgtgtagaaagaaagtggaaaacacaaggtgggattacctgacccaggttgaaaaggagtgcaaagaaaaagagaagccctcctatgacactgaaacagatcctagtgagggattgatgaatgttctaaagaaaatttatgaagatggagacgatgatatgaagcgaaccattaataaagcctgggtggaatcaagagagaagcaagccaaaggagacacggaattttgagactttaaagtcgttttgggaactgtgatgtgatgtggaaatactgatgtttccagtaagggaatattggtgagctgcatatataaatttgacagatagctatttacatagccttctaagtaaaggcaatgaattctccatttcctactggaggatttatttaaataaaatatgcttattaaacactcctgcaaagatggttttattagtaccctggtcattttgttcaaggaagggttatattgcattctcacgtgaaatataaaaagcaagtcttgcccaataaaaacgctacattgtgtgtattttttgttcagctaagaattggaaaagtatttgcttgccttttaagttactgacatcagcttccaccagtgtaaaaattgagtaaaacctgaagttttgcataaaatgcaaatcggtgcctgtgcttgaaggttgctgtagagcatctgaccccttattaccaccttaagcaatgtatatgccatgcattaccatgcactaattcaatcacaggtgtttctatctagatttaaatatatttgtcaatgaatgtggaatagaaaatctaaacatgacaataatagacatatctttgtatggtaccagttagttttgccgtggatcagatggtttataaaagtaataaccataaagcaaaaaataatttgaaagcccgtctattcctatgctcaataaagttaagtttttcttcattagaacagttttatgatttatttgtctaggagtatgtcagaaaaatcaggcttttagtaggaattactcctattccccctgaagtcaggaccagtgcctgtgatctccattactttattttcctggaggtattagccaacacagttagatcagagaaagcaattgaagccaggcatgaaggctggcgcccgtaatcccagctactaaggctggaggatcacttcagcccaggagtttaaggctgcagtgagctatgatgatgccactgtactgcagcttgggtaacagattgagaacctgtctcattaaaaaaaaaaaaaaaaaaaaagccgttagacacacaggaaaaatccagaagggtaaactaaactaaagctacaattaatatgggaatttggaagaagtggtaggatttaaaatacagaaacagtttatgtataggatagctataagtaaatactgaaacacattatgcctctgtaattggggttgacacatgaacagaatagcagacacaatgcatatgaaagttacagaatatggtaaaagtggggtaaagatgggtttttaatgatactaagataactgaaaataggcatatagatatattccaagccgcctgacgatctaattgtaaaaagtaaagcatacaaatactagaagaaaatggaggaaaacgacattatatgtgacttaaaacctagaagaaataaataaaactattgatcaattttaactacataaaaatgtttataggacaagaaaaaccccaccataacccaaggcaaacaatgtattgacaggattccaataattaagaatacttcatacaaaaagaaatgtaaatgacctttaacatgtaaagatgctcaccttgttcagaagagaataaaccagtgtttttacctttc

SEQ ID NO: 1607 - DNA, 2834 bp, Homo sapiens
cattttctttgatggtaaacaggctcacttataccgaatccaaacccaggcgagaactacggactcttgaaatggtcggtgaaaggggcgaaagcaccaggaaatcgtgcttcaacagtccatgactgaaaggagggcctgaaactgtggccataggcgggcccttttgttagggccttgacctgggcttccgctacagggcccggtcacgaggccaacgtagctccacctctacggcggccagtgatgacgccaccacgtcggaactgttagaccgcggtgacgtctccaccgcgccaaactcactgaaaatcaaaccgctaccattaggagccctccacgcttaacatatccgttctttctcgtttgaaagtaaccaggctgctcctccccatttttcgccttcttctcgcggaggctgagagactaaccttacacaacatggcggcctggtgtgtctggtgtcctagagcggacgaaagcaggtgactctctagtcaacttccgacttggactccgaagatcgctacagaaagatctagaagaggtaaaggtgttgctggaaaaggctactaggaaaagagtacgtgatgcccttacagctgaaaaatccaagattgagacagaaatcaagaacaagatgcaacagaaatcacagaagaaagcagaacttcttgataatgaaaaaccagctgctgtggttgctcccattacaacgggctatacggtgaaaatcagtaattatggatgggatcagtcagataagtttgtgaaaatctacattaccttaactggagttcatcaagttcccactgagaatgtgcaggtgcatttcacagagaggtcatttgatcttttggtaaagaatctaaatgggaagagttactccatgattgtgaacaatctcttgaaacccatctctgtggaaggcagttcaaaaaaagtcaagactgatacagttcttatattgtgtagaaagaaagtggaaaacacaaggtgggattacctgacccaggttgaaaaggagtgcaaagaaaaagagaagccctcctatgacactgaaacagatcctagtgagggattgatgaatgttctaaagaaaatttatgaagatggagacgatgatatgaagcgaaccattaataaagcctgggtggaatcaagagagaagcaagccaaaggagacacggaattttgagactttaaagtcgttttgggaactgtgatgtgatgtggaaatactgatgtttccagtaagggaatattggtgagctgcatatataaatttgacagatagctatttacatagccttctaagtaaaggcaatgaattctccatttcctactggaggatttatttaaataaaatatgcttattaaacactcctgcaaagatggttttattagtaccctggtcattttgttcaaggaagggttatattgcattctcacgtgaaatataaaaagcaagtcttgcccaataaaaacgctacattgtgtgtattttttgttcagctaagaattggaaaagtatttgcttgccttttaagttactgacatcagcttccaccagtgtaaaaattgagtaaaacctgaagttttgcataaaatgcaaatcggtgcctgtgcttgaaggttgctgtagagcatctgaccccttattaccaccttaagcaatgtatatgccatgcattaccatgcactaattcaatcacaggtgtttctatctagatttaaatatatttgtcaatgaatgtggaatagaaaatctaaacatgacaataatagacatatctttgtatggtaccagttagttttgccgtggatcagatggtttataaaagtaataaccataaagcaaaaaataatttgaaagcccgtctattcctatgctcaataaagttaagtttttcttcattagaacagttttatgatttatttgtctaggagtatgtcagaaaaatcaggcttttagtaggaattactcctattccccctgaagtcaggaccagtgcctgtgatctccattactttattttcctggaggtattagccaacacagttagatcagagaaagcaattgaagccaggcatgaaggctggcgcccgtaatcccagctactaaggctggaggatcacttcagcccaggagtttaaggctgcagtgagctatgatgatgccactgtactgcagcttgggtaacagattgagaacctgtctcattaaaaaaaaaaaaaaaaaaaaagccgttagacacacaggaaaaatccagaagggtaaactaaactaaagctacaattaatatgggaatttggaagaagtggtaggatttaaaatacagaaacagtttatgtataggatagctataagtaaatactgaaacacattatgcctctgtaattggggttgacacatgaacagaatagcagacacaatgcatatgaaagttacagaatatggtaaaagtggggtaaagatgggtttttaatgatactaagataactgaaaataggcatatagatatattccaagccgcctgacgatctaattgtaaaaagtaaagcatacaaatactagaagaaaatggaggaaaacgacattatatgtgacttaaaacctagaagaaataaataaaactattgatcaattttaactacataaaaatgtttataggacaagaaaaaccccaccataacccaaggcaaacaatgtattgacaggattccaataattaagaatacttcatacaaaaagaaatgtaaatgacctttaacatgtaaagatgctcaccttgttcagaagagaataaaccagtgtttttacctttcacttg

SEQ ID NO: 1608 - DNA, 1849 bp, Homo sapiens
gggcacatttggctatttttcaaagagagcatgtagttcaagaaatggcttattttgttttttattcttctttttgtggtctatttaggaaaacaaaatgaaggtggcctttgtctttcagttatggaacagctaccggacctgcatagccatttttctgatctgaacctggaagctcatatgtatgcatcccagtggtttctcactctttttactgccaagttcccactctgcatggtgttccacatcattgacttactgctttgtgagggtttgaacataatctttcatgtagctttggctctcctaaagacctcaaaggaagaccttctgcaggctgattttgaaggtgctttaaagttctttagagttcagcttccaaagagatacagggcagaggaaaatgcaagaagactgatggagcaggcttgcaatattaaagtaccaaccaagaagctgaagaaatatgagaaagaatatcagacaatgcgagagagtcagctgcaacaggaagacccaatggatagatacaagagggagaaccgaagattacaggaggccagcatgaggttggaacaagagaatgatgaccttgcccatgaactagtaacaagcaaaattgctctacggaatgacttggatcaggcagaagacaaggcagatgtgttgaataaagagctccttttgaccaaacagaggctggtggagactgaagaggagaagaggaagcaagaggaagagactgcccagctaaaagaagtcttcaggaaacagctagagaaggcagaatatgaaataaagaagactacagctatcattgctgagtataaacagatctgttcgcagttgagtaccaggctggagaaacagcaagcagccagcaaggaggagctggaagtggtaaagggtaagatgatggcatgcaaacactgcagtgacattttcagcaaggagggtgctttgaaactagcagccacaggcagagaggaccagggaattgaaacagatgatgagaaggactcacttaagaagcagctgagagagatggaactggaactggcacaaaccaaactgcagttggtggaggccaagtgtaaaattcaggaacttgaacatcagagaggagcccttatgaatgaaatccaagctgcgaaaaactcttggtttagcaaaaccctgaactctatcaaaacggccacgggcacccagccattgcagccagcaccggtcacccagccacccaaggagagcacatagttccagccttacccaagcacaagagcacaatgttcaaaccaatggaaatctgggaggattcttcctggtgtccctttgaaggaaagtcaaggaggccagaaaacaagccagaatttttcagtagctctcactctttcttgtatgacacttttcaaagggatgctatttaaactgacctgttctatgttgaatacctattttccagcttctggaaggccatgttcagatccatcatagtattacacattattttgtttgcctgatgtttagttggaaataagtaattcagaactaaatgcttttttatttagaattattcataattatttttatcttacataaaaatggagacatctgttattccaaggttgaagtgataagaagatctttgtcacaggaaaaaaaaaattgaaacctaaacatcttaagttttcaggatttattcagataaagcacactgtggggccaggcatgaccactctcaggtttcctcctgagcctgattcccagggaagtgttaatcctgtccaaaggaaagaaccaatcagcgatcattggtttactttcattttctgttcggtacatctggaaa

SEQ ID NO: 1609 - DNA, 1425 bp, Homo sapiens
aagtatctttgttccattgaatgtttgcggtcacagagagaacttagagttatatgacactcaaaggaaaagcaaaagagcattaagaagtgtctgtttttgttattgccatttcataaatattttagtaggtgttcaatttcattggatattctttttttttaattgtctttgtacctatgattgaaaacagtagttggtctatgacttttgaggagagggagaaccgaagattacaggaggccagcatgaggttggaacaagagaatgatgaccttgcccatgaactagtaacaagcaaaattgctctacggaatgacttggatcaggcagaagacaaggcagatgtgttgaataaagagctccttttgaccaaacagaggctggtggagactgaagaggagaagaggaagcaagaggaagagactgcccagctaaaagaagtcttcaggaaacagctagagaaggcagaatatgaaataaagaagactacagctatcattgctgagtataaacagatctgttcgcagttgagtaccaggctggagaaacagcaagcagccagcaaggaggagctggaagtggtaaagggtaagatgatggcatgcaaacactgcagtgacattttcagcaaggagggtgctttgaaactagcagccacaggcagagaggaccagggaattgaaacagatgatgagaaggactcacttaagaagcagctgagagagatggaactggaactggcacaaaccaaactgcagttggtggaggccaagtgtaaaattcaggaacttgaacatcagagaggagcccttatgaatgaaatccaagctgcgaaaaactcttggtttagcaaaaccctgaactctatcaaaacggccacgggcacccagccattgcagccagcaccggtcacccagccacccaaggagagcacatagttccagccttacccaagcacaagagcacaatgttcaaaccaatggaaatctgggaggattcttcctggtgtccctttgaaggaaagtcaaggaggccagaaaacaagccagaatttttcagtagctctcactctttcttgtatgacacttttcaaagggatgctatttaaactgacctgttctatgttgaatacctattttccagcttctggaaggccatgttcagatccatcatagtattacacattattttgtttgcctgatgtttagttggaaataagtaattcagaactaaatgcttttttatttagaattattcataattatttttatcttacataaaaatggagacatctgttattccaaggttgaagtgataagaagatctttgtcacaggaaaaaaaaaattgaaacctaaacatcttaagttttcaggatttattcagataaagcacactgtggggccaggcatgaccactctca

SEQ ID NO: 1610 - DNA, 1988 bp, Homo sapiens
ggcctggacgagcgcgcttccgacccgccgccaccgcctcctcccctccttctcggcccgccccctccctcgcctcttcctgccaggcggcccttctcccctcccctctcagttccctccgccctcctcgggctccagcggtggcggagcgaacgggaccggcccggcttcagagcgcgaggtggagggtggaacgcgggcgcctgaaggagttgttgtctcggcagcgcccgcggagacgtgaagaggtggttgtgggaagagaagtttgcagaactgaaatggaggtcagagcttcattacagaagatagtttctaatggtgatgaacaattggaaaaagccatggaagagattttgagagattccgagaaaaggccaagcagtcttcttgttgattgtcaaagttccagtgagatttcagaccattcgtttggagatattccagccagccaaacaaataagccatctcttcagttaattttggatccgtctaacacagaaatttctacacccagaccatcttctccaggtggactacctgaagaagatagtgttttatttaataaactgacctacttaggatgtatgaaggtttcttccccacgtaatgaagtagaggctttacgggcaatggcaaccatgaaatcttccagtcaatacccctttcctgttaccctgtatgtaccaaatgttccagaaggttctgtgagaattatagaccaatccagcaatgtggagatagcatcttttccaatctataaggtgttattctgtgcacgtggacatgacggaacaacagagagcaattgctttgcatttacagagagttcccatggttcggaagaatttcagatacatgttttctcctgtgaaattaaagaggcagtaagcagaattttgtacagtttctgtacagcattcaaacgttcttccagacaagtgtctgatgttaaagactcagttattcctacccccgacagtgatgtgtttaccttcagtgtctccttggaggtaaaagaagacgatggaaaaggaaactttagccctgtgcctaaggatagagataaattttatttcaaattaaagcaaggaatagagaagaaggttgtgattacagtgcagcaactttctaacaaagaattagctattgaaagatgttttggaatgttattaagcccaggtcgaaacgtgaagaacagtgacatgcatttactggatatggaatccatgggaaagagctatgatgggagagcttatgtcatcactggcatgtggaaccccaatgcaccagtatttctggcacttaacgaggaaaccccaaaagataagcaagtatacatgactgtggcagtggatatggtagtcacagaggtggtggagcctgttcgctttctcctggagacagtagtccgtgtgtaccctgcaaatgagcgattttggtatttcagcagaaagactttcacagagactttcttcatgagattgaaacagtctgagggaaaaggccataccaatgctggagatgcaatatatgaggtggtgagtctacagcgagagtctgacaaggaggaaccagtcactcctactagtggagggggtccaatgtcaccccaggatgatgaagcagaagaggagagtgataatgaactctcaagtggaacaggtgatgtgtctaaggattgtcctgagaagatcctgtattcttggggagagttgctaggaaaatggcacagtaaccttggtgcacgaccgaaagggctgtctactctggtgaagagtggtgtccctgaagcattgagggcagaggtatggcagttattggcaggctgccatgacaaccaggcaatgctggatagataccgaattcttatcacaaaggtctgttggagtttgctggaggtccactccagaccctgtttgcctgggtatcaccagtggaagctgcagaacagcaaatattgcagaatggcaaatgttgctgcctga

SEQ ID NO: 1611 - DNA, 2481 bp, Homo sapiens
atggaggtcagagcttcattacagaaggttagtggatcatctgattctgtggctacaatgaacagtgaagaatttgttttggttcctcagtatgcagatgataattctacaaaacatgaagaaaaacctcaactgaagatagtttctaatggtgatgaacaattggaaaaagccatggaagagattttgagagattccgagaaaaggccaagcagtcttcttgttgattgtcaaagttccagtgagatttcagaccattcgtttggagatattccagccagccaaacaaataagccatctcttcagttaattttggatccgtctaacacagaaatttctacacccagaccatcttctccaggtggactacctgaagaagatagtgttttatttaataaactgacctacttaggatgtatgaaggtttcttccccacgtaatgaagtagaggctttacgggcaatggcaaccatgaaatcttccagtcaatacccctttcctgttaccctgtatgtaccaaatgttccagaaggttctgtgagaattatagaccaatccagcaatgtggagatagcatcttttccaatctataaggtgttattctgtgcacgtggacatgacggaacaacagagagcaattgctttgcatttacagagagttcccatggttcggaagaatttcagatacatgttttctcctgtgaaattaaagaggcagtaagcagaattttgtacagtttctgtacagcattcaaacgttcttccagacaagtgtctgatgttaaagactcagttattcctacccccgacagtgatgtgtttaccttcagtgtctccttggaggtaaaagaagacgatggaaaaggaaactttagattattggtaattcctattccttttgaatatttcagccctgtgcctaaggatagagataaattttatttcaaattaaagcaaggaatagagaagaaggttgtgattacagtgcagcaactttctaacaaagaattagctattgaaagatgttttggaatgttattaagcccaggtcgaaacgtgaagaacagtgacatgcatttactggatatggaatccatgggaaagagctatgatgggagagcttatgtcatcactggcatgtggaaccccaatgcaccagtatttctggcacttaacgaggaaaccccaaaagataagcaagtatacatgactgtggcagtggatatggtagtcacagaggtggtggagcctgttcgctttctcctggagacagtagtccgtgtgtaccctgcaaatgagcgattttggtatttcagcagaaagactttcacagagactttcttcatgagattgaaacagtctgagggaaaaggccataccaatgctggagatgcaatatatgaggtggtgagtctacagcgagagtctgacaaggaggaaccagtcactcctactagtggagggggtccaatgtcaccccaggatgatgaagcagaagaggagagtgataatgaactctcaagtggaacaggtgatgtgtctaaggattgtcctgagaagatcctgtattcttggggagagttgctaggaaaatggcacagtaaccttggtgcacgaccgaaagggctgtctactctggtgaagagtggtgtccctgaagcattgagggcagaggtatggcagttattggcaggctgccatgacaaccaggcaatgctggatagataccgaattcttatcacaaaggactcagcccaggagagtgttattactcgagatattcatcgtacatttcccgcacatgattactttaaagatactggaggagatggtcaagaatcgctctataagatctgcaaggcctactctgtgtatgatgaagacattgggtactgtcaagggcagtcttttcttgctgctgtattactgctgcatatgccagaggaacaagcattctgtgttttggtgaaaatcatgtacgactatggtttgagagacctctacagaaacaacttcgaagatcttcattgcaaattctaccagttggagagactaatgcaggaacagctaccggacctgcatagccatttttctgatctgaacctggaagctcatatgtatgcatcccagtggtttctcactctttttactgccaagttcccactctgcatggtgttccacatcattgacttactgctttgtgagggtttgaacataatctttcatgtagctttggctctcctaaagacctcaaaggaagaccttctgcaggctgattttgaaggtgctttaaagttctttagagttcagcttccaaagagatacagggcagaggaaaatgcaagaagactgatggagcaggcttgcaatattaaagtaccaaccaagaagctgaagaaatatgagaaagaatatcagacaatgcgagagagtcagctgcaacaggaagacccaatggatagatacaagtttttttttctt

SEQ ID NO: 1612 - DNA, 7613 bp, Homo sapiens
agccaagcggcgggctggcggcgggctccgacgtctgcgccaggacctggctggctgagcccggcgcagcagcagcagccagggcagcgcggcccctactccctgtcaggtcgtagaggcgagcagggaccagctggtcgccggcccctcgggcaagatggggaaccgggagatggaggagctgatcccgctggtgaaccgtctgcaggacgcgttttcggcgctgggacagagctgcctgctggagctgccgcagatcgccgtggtgggcggccagagcgccggcaagagctcggtgctcgagaacttcgtgggcagggactttctccctcgagggtcgggcattgtaacaagacgacctcttgtgctgcagcttgttacttctaaagcagaatatgccgagtttctacattgcaaaggaaagaaatttacagattttgatgaagttcgccttgagattgaagcagaaacagatcgcgtgactggaatgaataaaggcatttcctccatacccattaatttacgagtctattccccacacgtgttaaatctaacccttattgatctacctggaataactaaagtgcctgtgggagatcagccaccagatatcgagtatcagatcagagaaatgattatgcagttcatcacgagggagaactgtctgattttagctgttactccagccaacactgatcttgcaaactcagatgcgctgaagctagctaaagaagttgatcctcaaggtctgagaaccattggagttatcaccaaactggaccttatggatgaaggaacggatgccagggatgttctagagaacaaactgttgcctcttcgcaggggttacgtgggggtggtaaacagaagccagaaggacatagatgggaagaaggacataaaggcagccatgctggcagagaggaagtttttcctttcccacccggcttacagacatatcgctgaccgaatgggaaccccacacctgcagaaggtccttaatcagcaacttaccaaccacattcgggataccctaccaaacttcaggaacaaactacagggacagttgctctccatagaacatgaagtagaagcctacaaaaatttcaaaccagaagacccaacaaggaagaccaaagcattgctgcagatggttcagcaatttgctgtggactttgagaagagaattgaagggtcaggggatcaagtagataccctggaactctcaggtggtgctaaaatcaatcgtatttttcatgaacgctttccttttgagatagtaaagatggagttcaatgagaaagaattgcgaagagaaataagctatgcaatcaaaaacatacatggtatcaggacagggttgtttactccagacatggcatttgaagcgatagtcaagaaacagattgtaaagttgaaagggccttccttgaagagtgtggatctggtaatacaagaattaatcaacactgtgaagaagtgtaccaaaaaactggcaaacttccccagactctgcgaggaaacggaaaggattgttgctaaccacattcgtgagcgagaagggaagacaaaggaccaggtattgctattgattgacattcaagtctcttacatcaacaccaaccatgaagacttcattggcttcgcaaatgctcagcagaggagcagtcaggttcacaagaaaaccacagttggaaatcaggtgattcgcaaggggtggctcaccatcagcaacattggcatcatgaaaggcggctcgaagggatactggttcgtccttactgcggaaagcttgtcctggtataaagatgatgaggaaaaagaaaagaagtacatgcttcccttggacaacctgaaagttcgggatgtggaaaagagctttatgtctagcaagcacatctttgcactctttaatacagagcaaaggaatgtatacaaagactatcgcttccttgagctggcatgtgattcccaggaggatgtcgacagctggaaggcatctctactaagagctggggtctatcctgacaaatctgtagctgaaaatgatgagaatggacaagcagaaaacttttccatggacccacaattggagaggcaagtggagaccattcgcaacctcgtagactcctacatgtccattatcaacaaatgtatccgagatctaattccaaaaacaataatgcaccttatgatcaataacgttaaagatttcataaattccgagctcctagcacagttgtattcttcagaggaccaaaataccctgatggaggaatctgctgagcaggctcagcgccgggatgagatgcttcgaatgtatcaagcactgaaagaagcccttgggataattggggacatcagcacagccaccgtgtccactccggcaccccctccagtggatgactcctggatacagcactctcgcaggtcacctcctccaagccccacaacccaaaggaggccaacactaagtgctcccctcgcaaggcccacatccggccgaggaccagctcctgccattccctctcctggcccccactctggggctcctccagtcccattccgtccaggcccattacctcctttccccagcagcagtgactccttcggagcccctccacaagttccatctaggcctacgagggccccgcccagtgtcccaagccggagaccacccccatcaccaactcgtcccactataatccgcccactagaatcctccctgttagactaaacgaagtgtctggcatggcaattaatcactaatgaattatgcgaaagcaacatatttgataaccgttgcagtaaatcatgagtagtcgcatgtgtggacatcagtaggcaagtaaccagttttactaatgcattcatcgctcatcttcattgctcatggtatgtcaaacctttggggtttgactcagaaactgctaaccttttagaggctttatatgttgtactgaccaaggtaggtttgtatagcagccctatactttggggatcatttgcctaccatggcatatatttgaaattgctttggacaagttttctaggctatctaccaggtagctcattaaacgtaattcttcagatatgagatagtgggcttagacctaagccatacatatttcttttcccacattctgtttaggatgacagtaattctgttgtctaccattaatgctactacctactccataattgcctatttagctcctcttttcttcctttttatttcataagactgctaggaagtgattttttaaaattaggactccttaagaataaacttttccagaagcacgaggtagtttgcaaaggaaaagtctgcactgtttgctctaaagagcttctcctcattccaatgtgttttgcttcatgctagaagcatatgcaacagtgaataaaagcttctttttttgttaatcagtcaataaatttggctaattagtttcagagttcaaggaagaagcaaaatatcacatctctagaagtgttgggaaaaatataatttctttctttacttatattcacctcatggtaggttatattgaaggctgacatggagaatgtttacttttctatttggcatagctaactacactttgatactaactccagttttactattattattttggttggaaaaaaaattcactctttacgtgctaatttgtaatcttgttttgtaagaatttatcctacccttgaaacaggctcagtgtaactgtatatccattctaggctttcttaataaatcttgaggctatgggataatcacatttaaagaatggttcctgaaatgaagtcagtagaaatggcatgggataagagcagagctcacacttttacagttgcagtatttcaaagtccctatccaggtcactccagaaaagggtattgaaacgttgaaatctaaagcaaatttgcaatttcttaagatttctaaaatttaccagaacagtttagcctgggggttaatagttaagtcttgaggctaagttttggactaccaaggaccagatgattcacatgtaggaaacagccagaagccaactggaattttgtgtgctaactgttcccagacagcagagcaagtattcactgagtaggggtgtcccatgacactatttcatattctacagaagtaaatcaggtttcaccaactgaaatgtctccctttgaaagtagcaaacatgatttgtatgttaacttaactttaatttcctgtgtagtttacacccagagcagatactcataaagtataaagtaaaaacttttaaccattattaaacagagaacttgccatgttgagtgccattgtattgaacttattctaaaggcttatgctaacccatttataattggtaaaaatcagaaaatacaagatttacataaaggtcatttcaacttttaaggttaccagtgattgtataaaaacatcacaatcctaaatcctctcgtatctcaccccaaaccccaaactgggggaaaaaaagttaactctttgtgaatggaaccaatgtgcaagatacatactgcatttttaaaatagtgtctcagctaaatggaaaactgttaagcaaacatccatagtaaaacaaataatcttcagtgagatctttttataaaacttcttgtttttaggattccctttgcttcttcctttgaattctctaaaataggcagctaacggattatatacttcagggtttggctttgtgctaaatgtggttttgtgttttgctgtatttcaaaattttccttctgttaaaggaaaatattgtgaataaccactggtgtgttcttagatcagcacaaaccatgtcaaaaaaaattggagatttttttccaattttccttccactgatcttaggcagtaataaacaatggcatttgtcatctttggcacttgcttttagattatagtcccacagttgcactgccccaattgtctacctttgtgggtacatttttgttctttactcctaagttatttctcatagaacccagcctactctagaatttcagcagtgacattggagaatatttttaatttgctgcagtactatgtcatattattagtatgaatctcatttcccaaagggtttgtattctgctaaaaggagatgccaatgttgaatgaagtctgaaactctagtatgtgcatagtttgacgtgcagcatgcacaccaggccttaagatgggaatgtagcttaatgattttctgtttcccataccatttctaatcttttgtgtaattttctcttaactgattgctctgatattgtaaacacaatagatgtagctctatcatgtctagcataatttaaaaaatcagtgtttttaggatttgggaaaataaactgtaaatgtttatttgataggtaaatatagttttattgtcacatgctaaatattgcatgcatattgactaattggaataaccatttactcaattatggacagcttattgaaatagtattgatttagaaaaagtatattgcatttctaaaaaacatctaccaaggttactcgtctgaatattgcttttagccgtgttttataacatagacgagcagtagggtctgtttattagcaaatttcctatttgttccaatacaaactcactttattctaaagtatattaatgaaaccagttcctgtgatgtaactgtaagccttctcgacttagacttaaaaagtggtcacatagattaattttgtgactttttagtatagactgtagccataattctcaaatatgaaatgggacctaataccagtatgtgataaatgttgatgttttctgtgtacaaacacattttctatgcatgtgtctctgtgtatatggcatatacctagtaagtatgtttctgtaagtatgtgtattttatgtccatttgagtaggtaggtaggttttaaaaatactagttaaaatgccacaagcatgagtgtgattgtatgtgcactgtgtgtatatatataaatatatgtatatgtatggttgtaaatatctatgtatacatgtacttagtatgtgtggtatcaggatattttttaaactgtgataatacaacagatagctttgaatgatctgccataacatgtggtaacaatagttcatttctcataacatatatgaggtatacaaaattttctaactccagattgtagtcattttgagaggtacaaagctcataattaccatgacaacatggtaatgtccatagacatttgtatctgaatccacaagaagatctgaatctaagaaggaattacctttgacaatatttttcggtaagaagtaaaacctctggagacctatctttaagatctctaattggaattataaattatttttggattgctgagctgaatcttaaaaagccaagttgatatacatagtcatttttcctctatggtagaagtaaaaaaaaaaaaaaaggacatagcaacattaaagtagtggatttttctgagtaaatttgctgaaaatataagagagaagctatctaataccttggaggtaggtcatccactttttcaggtaaacatttttcatttggcaaatggcataattatttgaaagtgacaggaatctcctcagaatgaagaataaagcctactaggtctctaactgttgaactcatgaaagaagatagtgtatgagacttaagccatgagttttgtatcatttcaattagaagactactagctgtgagctcagagtttaatgtaaatgaatctagatgattttgaagaaatgattattcgttcaccagatcactcattgtacattctaaaaagctcaaatgagtcttctagatactcttactcatcctgtctggttgctatgtttaaaattatgtggtgctgtgtaggtgaaactttaagaatatttttgaagcatatgtaatatatgcactgctatttgtgtgtgtgtgtgtgtctttgtatatatgtaagaatgtgtgtatgtgtgagagcaagagagaggaaactcaaagaggagtgtttgtcttaagacctgttcatactggtatattggtgagacttctcacttctggttggaggtttcacatatggctcaactcaagtcattaatctctttttaatttttactcttgaattccttaaacttcgctcattatgaaatgttttaaaattatgacaaaaattactctgtctaaccacttgccttgtctgctaccagtttgttaaaaattattccccccaaccagtaattccaccagtactacttgatttgtgttatatttcctatgtacatgtacagcctttgttttgcttgcttgtctatttttactttcccttttttgggtcaaatttttcttttgctttgtttgaagaaggaatatacagaagtaaaatcttgtcttctctgctgattctttaattaatatgagccggatactttccactgtcttcttggcactttcaggatttcttaatgctgatatatggactcttagaatggaatttttgaagaaaaatctcaaagcctgtatcgttcttgaaggtcacatgtacctattgtgaaaatgtgaagctgtatttctgaagctgaaataaattataacatttgaagga

SEQ ID NO: 1613 - DNA, 5492 bp, Homo sapiens
agtgaatcgctctcgtcggcagtgtttgtggagggcctgaagagacagggaggttgtgccaggctggaggaggcttgtctttccgaagctggagaggatcttacgggggttcgcttttccctgcctgggaagaatttcccctgtggtagcagcagcagcagcagcagaagcagaaacagcagcagcagcaacagcagcagcagcagcagcaccaccaccaccactacctcctcttctggggcacaagacagaatgcctgtgctagagcgatatttccacccagcagagctaggcaggaggtggacaggcccagaaggtgtgctgccctcctccccgggaagccggccggggtgccagcaggggccgctgccctgggacttgccagagatgatcaggatggtaaagctggtttggaaatccaaaagtgagctgcaggcgaccaaacagagaggcattctggacaatgaagatgctctccgcagctttccaggagatatacgactaaggggtcagacgggggttcgtgctgaacgccgtggctcctacccattcattgacttccgcctacttaacagtacaacatactcaggggagattggcaccaagaaaaaggtgaaaagactattaagctttcaaagatacttccatgcatcaaggctgcttcgtggaattataccacaagcccctctgcacctgctggatgaagactaccttggacaagcaaggcatatgctctccaaagtgggaatgtgggattttgacattttcttgtttgatcgcttgacaaatggaaacagcctggtaacactgttgtgccacctcttcaatacccatggactcattcaccatttcaagttagatatggtgaccttacaccgatttttagtcatggttcaagaagattaccacagccaaaacccgtatcacaatgctgttcacgcagccgacgtcacccaggccatgcactgctacctgaaagagccaaagcttgccagcttcctcacgcctctggacatcatgcttggactgctggctgcagcagcacacgatgtggaccacccaggggtgaaccagccatttttgataaaaactaaccaccatcttgcaaacctatatcagaatatgtctgtgctggagaatcatcactggcgatctacaattggcatgcttcgagaatcaaggcttcttgctcatttgccaaaggaaatgacacaggatattgaacagcagctgggctccttgatcttggcaacagacatcaacaggcagaatgaatttttgaccagattgaaagctcacctccacaataaagacttaagactggaggatgcacaggacaggcactttatgcttcagatcgccttgaagtgtgctgacatttgcaatccttgtagaatctgggagatgagcaagcagtggagtgaaagggtctgtgaagaattctacaggcaaggtgaacttgaacagaaatttgaactggaaatcagtcctctttgtaatcaacagaaagattccatccctagtatacaaattggtttcatgagctacatcgtggagccgctcttccgggaatgggcccatttcacgggtaacagcaccctgtcggagaacatgctgggccacctcgcacacaacaaggcccagtggaagagcctgttgcccaggcagcacagaagcaggggcagcagtggcagcgggcctgaccacgaccacgcaggccaagggactgagagcgaggagcaggaaggcgacagcccctaggggccggcccaacttagacgcggctctcctccggcagggcccccagagggcagaagcagcgtggaggggccctcacgcagcagcccagccactttctgagtgttgtcctggggctctttggaacgccatcttcctcccacttacctgcctcccctccttttcgcaaatgtacagaagccatttgtcacctcagcattcgctgccgaaatgagcaactccattcagtaacgtgggagctgatcccacgggcaggctctccctgctccaggagaagactaggaggaagaatgaggtgctcctgccgtgtccgccttgttccgggtcgcactggaacaggcagcaattcctaagtccggagcgtttgagcgtttgctatctgactgctgatctgcgtgacagaaacaccagcatatttgcaacgccaaggatattggtcttaagtgcaagagcacaaatgagagtgtgagagaaagtaccttctattttaataataatattattataaaaataataaatctttttaacttttatattttatgcactagacaatggatctgcaactttggactaaggtcattcaatgtacccaaacttgaacagggggttcattgttttgctattgactttattatgccactttggggcagagacttggcatcttcgcagtttaagaaaccacgtttcctatccaatccgaagggaaggtgctgtacagttcattcctttgcaccattagccaatctgtcttttatggattctgtgacatgtttatattcacccatgtacattttctgtaaataccaaacgctactgattcccatgccaaaatacatgagtattatgggattgctacctgtataaacaatggcactgtgaaaatactgttagttttaatacaagagaatgcatttgtaaatatggtatagagtttattaatatactattgtttgcagataaaggccttaactttaaacatctttcatcttctgaaagctgcccaacttaaatcctcatagatgtctttctcaactgccttcccatgttcatctgtatgttttccagctaaggtcacaaaccaaaactgaataaagtctttgaggaaacattttggaaacttcacatgcattccgcttgagaccatagtgtttaatctatggcaccaagcatcgtttcctcagattaatgagacccttcaacaagcctgaatcagtcacttttcaacacagcgatgttttaacaagccagctgctaagcttgtgtttatgtgactcttgttacagatcatggcggtgcgtcagcctcacaggagacatagcaggtctcagaaaccttctatgaccctgtcatctaaccatcagggaattccctgctcccatgccacacatttgtctattatggctatagtaccaaagtacttttggtgtttggttggtgtgcatttctttagtgtcgatagtaactggatttttctttttccttaatctcatgtgaacaactacccaactgtttagctgaagttcatattatttaagtaaagaaaatatttcagttttataacagactttaccttcctggcaggtcattgtagttaattatgtctctagcttggagtgtcaccttggaatttcgttgccattttttctcagacacctggccgtaaaatcagtttgttacagcattcttctctaggctgctaaacgctgtgcattgaaccttttctttagaagtttcagcgtaactaatgttagatgaaaattgttgatgcccctttctttttactttaaacaatgtggtagtgggagaatgactgtttctgccactatcaacctgatcctcatgctgatagaatgacagctagcacttatttcctaagtgcaactgttttagagatttttctcctaacatgcaaaggaaatactgattggcctataataagttcctatagggagactgaggcttgcagaattaaggttcaggggaaattttggaaagttggttgtattttcattgaagtaggagagattatcagatggtgctaaagaaagtgtgaagatcttatgaaataggtggatggtaagttgaaattattgatgtgggtaagaagggaggttgtggaaagttaacactagctttgtatttttttttctgtaaaactgtgaactgatatattttcctttatcactttagtattctgcagttctcagcttggtgaggctccaaaagagaatatgtcagatgtattcctacttccaaacctgtcttactttggtttgatggtacacatagggcttttgaacagtctatttttaatgtatatgaggtcaaatcaaggaaggcaattgctggggacaagaaaagtagaggtaggaaagaagacactattttagctaatggggtttcttgggactaaaaaatggctttgtttaaattataattatataataatttaaataaatgagattggaggtattcttagtagttctgagttgatagtttacattacaattaggtcttgaagaagagctcacagagaaaaaactaccaaatatccaatgggtaagcccatgatgtagccactagtacaataaaaatctgaagtaaaatgaggcataaacttgatgcagctgcctccctcattcaactggggagttcttgagttcctcatttgttggtaaaaagaaaaagaatgtgaaaatgtctctttttttcttggctattagtggctgtcttgcaatatttcaataggagtccaattactagttaaaacactggcggggtgcggtggctcacgcctgtaatcctagcactttgggaggccaagttgggcagatcacaagttcaagagatcgagaccattctggccaacatggtgaaaccccgtctctactaaaaatacaaaaattagctgggcatggcagtgcgtgcctgcaatcccagctactcaggaagctgaggcaggagaatcgcttgaacctgggaggtggaagttgtagtgaactgagatcgcaccactgcactccagcctggcaacagagctagaatccgtctcaaacaaacaaacaaaaaatcccacagctattggatcatccacagattttttctttacaatcttgttctccttgtccatggaccatcaatagttgacttgccaggtttaattctttcattgcttgagaagaaaggaatcaaaggactgtgtgtagtaagctgacggtaaagttaagattaaattaagacagagagagaatacatatcactgccaggcctgataggaaaaatctgctcttccttttaataacagtgatgaattgtcaggaccttatttaggaaaccctgacctacccataactccctgctaggctaagtagaaaccaggttatttctccctgcttatggctccccgcaaagggacttgcagcgtgtcctgcaactttgtcttcagatagtgcttcctacaaaactaggtcttgttttgtaatcttttctcgtgttgaatcagatctgcttacttatttaggtttggttatgagcttgtatctcactgtatttctcatgctttgttcttttaaacaaatcctttaaactgtgtcattttgtatacacatgtgaggtttgaaaaaaaaaaaaaaaaaaaaaagaactaccttgtgagttttgctcaaaatgtggcctaagtagccattggcatgtctagatgaacaaataaaaataaagataatttctttaaaata

SEQ ID NO: 1614 - DNA, 1295 bp, Homo sapiens
ttgtttaacagctggcccggaagtttaagtgaatatgcggcttgggctccaaaagttgctgtacggtattttattttaaagtagaaatctgtccgcttttcacttacggaggccttacagtgtgtgttctgtgttacttgagtttatacgcactgcagaatttgtttaccctgctcttttggaaacgtattccggaagcgaaaccctgagtaatcggaagtggttaggagtgagagagctgctggatatgcggagggactgggcgggtcggcttccgaatggaagaggtctgtgagaagttaacctggtgataccgatccgaagagcctatcaagtgaagccccctgaaatacggagaataagaatcttagaggttgttcagcagaagtcttggagtgcattttcagtggttaaggtgaaaaaatgactactaaaaatttagaaaccaaagtcaccgttacttcatccccaatccgaggagcaggagatggaatggaaactgaggaaccacctaaatctgttgaagttacctccggagtccaatctagaaagcatcatagtcttcagagtccatggaagaaagcagttccatcagagagcccaggagttcttcagctagggaaaatgctcactgaaaaagcaatggaagttaaagctgtaagaatattagttcccaaagctgctataactcatgatatccccaacaaaaatacaaaggttaagtctctgggacatcataaaggagaattccttggtcagtcagagggagttatagaacctaataaggaactctcagaggtaaagaatgtattggaaaagctcaagaattctgaaagaaggttactacaggacaaagaaggtctttcaaaccagctccgtgtacagacagaggtaagaagagccttaatcgataaaatgagtactactctttacgtctggaccttttaaacgtgcatgttagaaaactacatttctttatgggaatgtcattcatcctagcttgtcagttctctaaaatgcttcctcttaaatttctcattctttctcagttctctagggatactttatattgggaacttatactctaaacctcattgaagatggaggtgtgaggtgctttggacaagaccaccaataagttgtaaaagtaggttacaattataaactgccagaccaaagattgaccaagtcaggcatagtaattgaccagcagtccttgttttaaggatccgtaaattccaagtagttttgcttgtgtatacgggatacttggaataaagagaatggcgatataa

SEQ ID NO: 1615 - DNA, 2749 bp, Homo sapiens
ttgtttaacagctggcccggaagtttaagtgaatatgcggcttgggctccaaaagttgctgtacggtattttattttaaagtagaaatctgtccgcttttcacttacggaggccttacagtgtgtgttctgtgttacttgagtttatacgcactgcagaatttgtttaccctgctcttttggaaacgtattccggaagcgaaaccctgagtaatcggaagtggttaggagtgagagagctgctggatatgcggagggactgggcgggtcggcttccgaatggaagaggtctgtgagaagttaacctggtgataccgatccgaagagcctatcaagtgaagccccctgaaatacggagaataagaatcttagaggttgttcagcagaagtcttggagtgcattttcagtggttaaggtgaaaaaatgactactaaaaatttagaaaccaaagtcaccgttacttcatccccaatccgaggagcaggagatggaatggaaactgaggaaccacctaaatctgttgaagttacctccggagtccaatctagaaagcatcatagtcttcagagtccatggaagaaagcagttccatcagagagcccaggagttcttcagctagggaaaatgctcactgaaaaagcaatggaagttaaagctgtaagaatattagttcccaaagctgctataactcatgatatccccaacaaaaatacaaaggttaagtctctgggacatcataaaggagaattccttggtcagtcagagggagttatagaacctaataaggaactctcagaggtaaagaatgtattggaaaagctcaagaattctgaaagaaggttactacaggacaaagaaggtctttcaaaccagctccgtgtacagacagaggtaaatcgtgagttaaaaaagttactggtggcttctgttggggatgatcttcagtatcactttgaacgtctagcccgtgagaaaaatcagcttattttagaaaatgaagccctaggtcgaaacacagctcagctttctgaacagttagaacgtatgtcaatacagtgtgatgtatggcgaagtaaattccttgcaagcagggtaatggcagatgagttaaccaactcaagagcagctttacagcgtcaaaaccgtgatgcacacggggctatacaagatctcctaagtgaacgggaacagtttcgtcaagaaatgatagctacccagaaattattggaggagctcttagtttccttgcaatggggaagagagcaaacttactcccctagtgtacaaccccacagcacagcagagctagcattaacaaatcacaagttggcaaaagcagtaaattctcatcttctgggaaatgttggcattaacaatcaaaaaaagattccatcaacagttgaattctgcagcaccccagctgagaaaatggctgaaacggttctaagaattttagatccagttacctgcaaagagagttcacctgataatccattttttgagtcttcaccaaccaccttacttgctacaaagaaaaatattggacgatttcatccctatactagatatgaaaatataactttcaattgctgcaatcactgccggggagaactgattgccctttaacagtcaatatgttggaggcatgctaaggtacttccttattacccaagagtcattattatttgggagctggggttcttacaatgctagaaataatatcacttcctatttacataatgtatacacccaaagatattttatgtactagactccagattaccctttcttaataaatatctcagggtaaggaaagaaagaaactgtatagatatatttaaaatagagaatactttccaagcaatacatgatacttttcctaaaagactctaaaagaaaaagattctgtaactctcttttagcaccaaattattgtttatcttgctggatattttatatgaacagtgttaatttagatgcactaaagcaaaggtaggcaaactacaaccatgagtcaaacatggccacacccattcatgtgctattgtctaagctggttttgcactacaactgcagagttgaatagatgcagcagatcctttacagaaaaagttttctgacctcaattctaaagtaattgtagtagggagctggaggactttctttccctttatggtaattttttgagctacaaaagagccttgcagaaatgggtgaagggattaatcttttaaaaataaatgctatatattaggaaaataaaaaatattttagagccaagttaacaagtacttcagcaaaacatgctagttttatgcaggggattctgtattccaaatggatacaatccgacatatataaaagaaacagattcttaactattgactcttatttagcaaatgcaacagacaagaatatccaacttgatatttataaaaggtagactttttccaaaagtgtataagctcaaagaaaaaatgcaacctgtcaattaatatatactatgtaatatatattattgtgtatttatgattagccatcataaatgcccattgcttggcctttaagaataatcacaaaatatttatattaaattatacaaatttgttgcagaagtgcctgtgagagaaatcttcaaaagacaaacctggtcaaataataataattttaatgtcaatgattttttttgtctgactcatctgagttatatttagttttcaagtggcaataaatttatctaccttcttta

SEQ ID NO: 1616 - DNA, 623 bp, Homo sapiens
ctcgcacccggaacaacaaagcaaggaagacggagtccgagcctcgggggctcctagcaacgggccggggcgggagttccatggagactggggagcgcgcccgtctcatcctcatccttgtcctccagcttctccttcgcatccgacgcaaccggcagcagcgctgccgccgcgtcctcagccaccgctccctcttcccacggagcgaggtttcaccaggctggtctccaactcctgacctcaaatgatccacccatcttggcctcccagagtgctgagattacaggcgtgaggcaccactcctggatgtgatcttcgtggtggaaagctaaattttaaaaccaccccaatggatgcagacagtgatgttgcattggacattctaattacaaatgtagtctgtgtttttagaacaagatgtcatttaaacttaaggaagattgctttggaaggagcaaatgtaatttataaacgtgatgttggaaaagtattaatgaagcttagaaaacctagaattacagctacaatttggtcctcaggaaaaattatttgcactggagcaacaagtgaagaagaagctaaatttggtgccagacgcttagcccgtagtctgcagaaactag

SEQ ID NO: 1617 - DNA, 808 bp, Homo sapiens
atttattgtcgcggggaagctgcggccgcctcgcacccggaacaacaaagcaaggaagacggagtccgagcctcgggggctcctagcaacgggccggggcgggagttccatggagactggggagcgcgcccgtctcatcctcatccttgtcctccagcttctccttcgcatccgacgcaaccggcagcagcgctgccgccgcgtcctcagccaccgctccctcttcccacggatgtgatcttcgtggtggaaagctaaattttaaaaccaccccaatggatgcagacagtgatgttgcattggacattctaattacaaatgtagtctgtgtttttagaacaagatgtcatttaaacttaaggaagattgctttggaaggagcaaatgtaatttataaacgtgatgttggaaaagtattaatgaagcttagaaaacctagaattacagctacaatttggtcctcaggaaaaattatttgcactggagcaacaagtgaagaagaagctaaatttggtgccagacgcttagcccgtagtctgcagaaactaggttttcaggtaatatttacagattttaaggttgttaacgttctggcagtgtgtaacatgccatttgaaatccgtttgccagaattcacaaagaacaatagacctcatgccagttacgaacctgaacttcatcctgctgtgtgctatcggataaaatctctaagagctacattacagattttttcaacaggaagtatcacagtaacaggtattctatgatattgaaaccacacttatcaattatggattgaatgatacaa

SEQ ID NO: 1618 - DNA, 1270 bp, Homo sapiens
ggcaggaagccgccttgtctctgggcgcggccatgttggaggctccgggcccgagtgatggctgcgagctcagcaaccccagcgccagcagagtcagctgtgccgggcagatgctggaagtgcagccaggattgtatttcggtggggccgcggccgtcgcggagccagatcacctgagggaagcgggcatcacggccgtgctaacagtggactcggaggagcccagcttcaaggcggggcctggggtcgaggatctatggcgcctcttcgtgccagcgctggacaaacccgagacggacctactcagccatctggaccggtgcgtggccttcatcggtcaggcccgcgctgagggccgtgcggtgttggtgcactgtcatgcaggagtcagtcgaagtgtggccataataactgcttttctcatgaagactgaccaacttccctttgaaaaagcctatgaaaagctccagattctcaaaccagaggctaagatgaatgaggggtttgagtggcaactgaaattataccaggcaatgggatacgaagtggatacctctagtgcaatttataagcaatatcgtttacaaaaggttacagagaagtatccagaattgcagaatttacctcaagaactctttgctgttgacccaactaccgtttcacaaggattgaaagatgaggttctctacaagtgtagaaagtgcaggcgatcattatttcgaagttctagtattctggatcaccgtgaaggaagtggacctatagcctttgcccacaagagaatgacaccatcttccatgcttaccacagggaggcaagctcaatgtacatcttatttcattgaacctgtacagtggatggaatctgctttgttgggagtgatggatggacagcttctttgcccaaaatgcagtgccaagttgggttccttcaactggtatggtgaacagtgctcttgtggtaggtggataacacctgcttttcaaatacataagaatagagtggatgaaatgaaaatattgcctgttttgggatcacaaacaggaaaaatatgaacatgatattttatagcttgggaagaaacttgcagatgatatgtgctgcctttgcttcttatcattcatggcagattgtttgtgctttcaacatttcatttgaaatgggagaagataaaatcacttgatgtaacctggaaactatgctttacatggcaatcaaagccttttgatcatgtacattttatttgatattaaaatcttttataaccaga

SEQ ID NO: 1619 - DNA, 1172 bp, Homo sapiens
cagtcagatccatcatgtggccactgacagcccttctgctcctggctactctggagaagcccatattgtctctacatccaccttggaccaccatcttcaaaggggagcgggtaactttgaagtgtgatggataccacccactgctcctggagctccagcccatcagcactctctggtatttgggccacctacttctgccctctcacaagaagagcattgaggtgcagacaccaggggtgtatcgatgccagacacggggagcacccgtcagtgaccccatccacctctctgtatccaatgattggctgattctgcaagtgccctatgcgccagtgttcgagggtgagccgctagtcctgcgctgccgcggctggtacgacaaggtggtctacaagcttcactactaccacgacggccaggccgtgcgctacttccactccagcgccaactacactgtgttacaggcgcgtgccagcgacagcgggcgctaccagtgctcgggcaccatgcgcatcccggtggagagcgcgcccatgttctccgctaaggtggctgtgacagtgcaagaagcgcgacacgccgctgcagttcgcgttttacaagtacagccgcgcggtgcgccgcttcgactggggcgccgagtacacagtcccggagcccgaggtcgaggagctcgaatcgtactggtgcgaggcggctaccgccacccgcagtgtccggaaacgcagtccgtggctgcagctcccggggccgggttctcccctggacccggcctccaccaccgccccagctccatgggccgcagccttggctcctggtaataggccgctttccttcagaaagcccccggtgtccagatcggtcccgttggtcacctccgtccggaacaccacctccaccgggctgcagttcccggcgagcggcgccccgactgcggggccacccgcctgcgctccgccgacgcccttggaacaatcggctggagccctgaaacccgacgtggaccttctgctccgagaaatgcagctgctcaaaggccttctgagccgggtggtcctggaattaaaggagccacaggccctccgggagctcaggggaacgcccgagacccccacctctcactttgctgtgagcccgggaaccccagagaccactcctgtggagagctgagg

SEQ ID NO: 1620 - DNA, 1131 bp, Homo sapiens
cagtcagatccatcatgtggccactgacagcccttctgctcctggctactctggagaagcccatattgtctctacatccaccttggaccaccatcttcaaaggggagcgggtaactttgaagtgtgatggataccacccactgctcctggagctccagcccatcagcactctctggtatttgggccacctacttctgccctctcacaagaagagcattgaggtgcagacaccaggggtgtatcgatgccagacacggggagcacccgtcagtgaccccatccacctctctgtatccaatgattggctgattctgcaagtgccctatgcgccagtgttcgagggtgagccgctagtcctgcgctgccgcggctggtacgacaaggtggtctacaagcttcactactaccacgacggccaggccgtgcgctacttccactccagcgccaactacactgtgttacaggcgcgtgccagcgacagcgggcgctaccagtgctcgggcaccatgcgcatcccggtggagagcgcgcccatgttctccgctaaggtggctgtgacagtgcaagccgcgcggtgcgccgcttcgactggggcgccgagtacacagtcccggagcccgaggtcgaggagctcgaatcgtactggtgcgaggcggctaccgccacccgcagtgtccggaaacgcagtccgtggctgcagctcccggggccgggttctcccctggacccggcctccaccaccgccccagctccatgggccgcagccttggctcctggtaataggccgctttccttcagaaagcccccggtgtccagatcggtcccgttggtcacctccgtccggaacaccacctccaccgggctgcagttcccggcgagcggcgccccgactgcggggccacccgcctgcgctccgccgacgcccttggaacaatcggctggagccctgaaacccgacgtggaccttctgctccgagaaatgcagctgctcaaaggccttctgagccgggtggtcctggaattaaaggagccacaggccctccgggagctcaggggaacgcccgagacccccacctctcactttgctgtgagcccgggaaccccagagaccactcctgtggagagctgagg

SEQ ID NO: 1621 - DNA, 1152 bp, Homo sapiens
cagtcagatccatcatgtggccactgacagcccttctgctcctggttccaagcagtgggcaagctgctactctggagaagcccatattgtctctacatccaccttggaccaccatcttcaaaggggagcgggtaactttgaagtgtgatggataccacccactgctcctggagctccagcccatcagcactctctggtatttgggccacctacttctgccctctcacaagaagagcattgaggtgcagacaccaggggtgtatcgatgccagacacggggagcacccgtcagtgaccccatccacctctctgtatccaatgattggctgattctgcaagtgccctatgcgccagtgttcgagggtgagccgctagtcctgcgctgccgcggctggtacgacaaggtggtctacaagcttcactactaccacgacggccaggccgtgcgctacttccactccagcgccaactacactgtgttacaggcgcgtgccagcgacagcgggcgctaccagtgctcgggcaccatgcgcatcccggtggagagcgcgcccatgttctccgctaaggtggctgtgacagtgcaagccgcgcggtgcgccgcttcgactggggcgccgagtacacagtcccggagcccgaggtcgaggagctcgaatcgtactggtgcgaggcggctaccgccacccgcagtgtccggaaacgcagtccgtggctgcagctcccggggccgggttctcccctggacccggcctccaccaccgccccagctccatgggccgcagccttggctcctggtaataggccgctttccttcagaaagcccccggtgtccagatcggtcccgttggtcacctccgtccggaacaccacctccaccgggctgcagttcccggcgagcggcgccccgactgcggggccacccgcctgcgctccgccgacgcccttggaacaatcggctggagccctgaaacccgacgtggaccttctgctccgagaaatgcagctgctcaaaggccttctgagccgggtggtcctggaattaaaggagccacaggccctccgggagctcaggggaacgcccgagacccccacctctcactttgctgtgagcccgggaaccccagagaccactcctgtggagagctgagg

SEQ ID NO: 1622 - DNA, 1977 bp, Homo sapiens
aagatactatcttcctgggagttgacagtacctgataattgatctccttcccatcagatttccaagggatcaaggtgccccggttctaaacaaccacaggtacggtcacatggctcagaaagcacaagaagtagagccccgaggtcagatctgagaggcttctgaggggccgatgcagtgacttctctgctgcagctgctgcagtcagatccatcatgtggccactgacagcccttctgctcctggttccaagcagtgggcaagctgctactctggagaagcccatattgtctctacatccaccttggaccaccatcttcaaaggggagcgggtaactttgaagtgtgatggataccacccactgctcctggagctccagcccatcagcactctctggtatttgggccacctacttctgccctctcacaagaagagcattgaggtgcagacaccaggggtgtatcgatgccagacacggggagcacccgtcagtgaccccatccacctctctgtatccaatgattggctgattctgcaagtgccctatgcgccagtgttcgagggtgagccgctagtcctgcgctgccgcggctggtacgacaaggtggtctacaagcttcactactaccacgacggccaggccgtgcgctacttccactccagcgccaactacactgtgttacaggcgcgtgccagcgacagcgggcgctaccagtgctcgggcaccatgcgcatcccggtggagagcgcgcccatgttctccgctaaggtggctgtgacagtgcaagagctgttccgggcgccggtgctgagggtgatgggtccgcgggaggcccgcggcgcggcgctgggtggggtggtgctgcgctgcgacacgcgcctgcacccgcagaagcgcgacacgccgctgcagttcgcgttttacaagtacagccgcgcggtgcgccgcttcgactggggcgccgagtacacagtcccggagcccgaggtcgaggagctcgaatcgtactggtgcgaggcggctaccgccacccgcagtgtccggaaacgcagtccgtggctgcagctcccggggccgggttctcccctggacccggcctccaccaccgccccagctccatgggccgcagccttggctcctggtaataggccgctttccttcagaaagcccccggtgtccagatcggtcccgttggtcacctccgtccggaacaccacctccaccgggctgcagttcccggcgagcggcgccccgactgcggggccacccgcctgcgctccgccgacgcccttggaacaatcggctggagccctgaaacccgacgtggaccttctgctccgagaaatgcagctgctcaaaggccttctgagccgggtggtcctggaattaaaggagccacaggccctccgggagctcaggggaacgcccgagacccccacctctcactttgctgtgagcccgggaaccccagagaccactcctgtggagagctgagggggcggctaccgtcccctctgcaggctcattcctccttggtctcctgcttcccctcacgcgaatttctttcaaagccatctgtttgcatccttgtgttttgctgtggtttttaaaggagcgcccacgaagtgtagtggctgacgatttcaacctcacacagcagtttgtaaccgcaagcattctctttgaattctcacagaattcagcaagaagtagaaacctgttatttactacattgtgatttaactttggatgtgaatttagtcacccttagcccttcagataagcctagccagtacatatttcagcacaggcagtttttttggtatttaagtacattgaggtaactgagcacttgagaatattttagggtcaaagtgtaattattcataatgaatttactctgttgatattaaaaagacgttcagtcctattactgatgagtttacatcttcaaataaatcctgggttctattta

SEQ ID NO: 1623 - DNA, 574 bp, Homo sapiens
gcaggcgccgagagggcgggccagggccgcactccggagactcgcggttgctacgcgcaccatggctggaggctgtcgcgccccttcctcagcgcccacggtctcgcttcctgaactccgttcactcctagcctccggacgggcccggctcttcgacgtgcgctctcgcgaggaggcggcagctgggaccatcccaggggcgctcaacatcccggtgtccgagttggagagtgctctgcagatggagccagctgccttccaggctttatattctgctgagaagccaaagctggaagatgagcatctcgttttcttctgtcagatgggcaagcggggcctccaggccacgcagctggcccggagtcttggatacactggggctcgcaactacgctggagcctatagagaatggttggagaaagagagttaggcaggaggcagcttactgattgccaccccctggccccttaatggccaccttaactaagggtgtgaacgggctgacttggtgaattgggcaactccttatagtgttgtgcacacaaaagcatcaaataaagaacatttaatcaaa

SEQ ID NO: 1624 - DNA, 457 bp, Homo sapiens
cagctctgggagggaacgggagatgttgcaggcgccgagagggcgggccagggccgcactccggagactcgcggttgctacgcgcaccatggctggagtgtccgagttggagagtgctctgcagatggagccagctgccttccaggctttatattctgctgagaagccaaagctggaagatgagcatctcgttttcttctgtcagatgggcaagcggggcctccaggccacgcagctggcccggagtcttggatacactggggctcgcaactacgctggagcctatagagaatggttggagaaagagagttaggcaggaggcagcttactgattgccaccccctggccccttaatggccaccttaactaagggtgtgaacgggctgacttggtgaattgggcaactccttatagtgttgtgcacacaaaagcatcaaataaagaacatttaatcaaa

SEQ ID NO: 1625 - DNA, 4106 bp, Homo sapiens
agtgtaagatggcggcggcgttggtggtggcagtggacggggcggctgggcctggaacagtcggagcagccgctagcagaaggatgacccaagacgggaagcgggctgctgagcctcgccgattcccgtgcttgtaactgccccagccggacaccccccctcccttgacctacccggtctgtgtctcgttccggctcggcctgcgccccccctcgcttcccagccggtttcccctaaggatgggcctgacccgtatcccaagctcttagcgctcaggtcttttccttccgccgacccgaagtcatcgctgggagtactggttgccctttcctcagtccttcagtgaatctacagacctattttctcaggagctcagcctggccttacttcagtgataaaaggaggaaaggctggctacagcaaacatcattcaagatgtccagcaaagggagcagcacagatggcagaacagacttagctaatggaagcctgtctagcagtccagaggagatgtctggagctgaagaggggagggagacatcctcaggcattgaagtggaggcctcagacctgagtttgagcttgactggggatgatggtggccccaaccgcaccagcacagaaagtcgaggcacagacacagagagctcaggtgaagataaggactctgacagcatggaggacactggtcattactccattaatgatgaaaatcgagtccatgaccgctcagaggaagaggaagaggaggaagaagaggaggaagaagagcagcctcggcgccgtgtacagcgcaagcgggctaaccgtgaccaggactcatcagatgatgagcgggccctagaggactgggtgtcctcagaaacatcagctctaccccgacctcgctggcaagccctccctgcccttcgggagcgggagctgggttcaagtgcccgctttgtctatgaggcctgtggggcaagagtctttgtgcagcgtttccgcctgcagcatgggcttgagggccatactggttgtgtcaataccctgcactttaaccagcgcggcacctggctggccagtggcagcgatgacctgaaggtggtggtgtgggattgggtacggcggcagccagtactggactttgagagtggccacaaaagtaatgtgttccaggccaagtttcttcctaacagtggtgattctactctggccatgtgtgcccgtgacgggcaggttcgagtagcagaactgtctgccacacagtgttgcaagaatacaaaacgtgtggcccagcacaagggagcgtcccacaagttggcactggaaccagactctccctgtacgttcttatctgcaggtgaagatgcagttgttttcaccattgacctgagacaagaccgcccagcgtcgaaactggtggtgacaaaagagaaagagaagaaagtggggctgtatacgatctatgtgaatcctgccaatacccaccagtttgcagtgggtggacgagatcagtttgtaaggatttatgaccagaggaaaattgatgagaatgagaacaatggagtactcaagaagttctgtcctcatcacctggtgaacagtgagtccaaagcaaacatcacctgtcttgtgtacagccacgacggcacagagctcctggccagttacaatgatgaagacatttacctcttcaactcctctcacagtgatggggcccagtatgttaagagatacaagggccacagaaataatgccacagtaaaaggcgtcaatttctatggccccaagagtgagtttgtggtgagcggtagtgactgtgggcacatcttcctctgggagaaatcatcctgccagattattcagttcatggagggggacaagggaggcgtggtaaactgtcttgagccccaccctcacctgcctgtgctggcaaccagtggcctagaccatgatgtgaagatctgggcacccacagctgaagcttccactgagctgacagggttaaaagatgtgattaagaagaacaagcgggagcgggatgaagatagcttgcaccaaactgacctgtttgatagtcacatgctgtggttccttatgcatcacctgagacagagacgccatcaccggcgctggcgagaacctggggttggggccacagacgcggactctgatgagtctcccagctcctcagacacatcggacgaggaggagggccctgaccgggtgcagtgcatgccatcttgaggcctcatacctaggtggggcaggctggggctgccaacctgatcctgcctgggcaaccctttcctgtcccaggccctacattcagcagaaacgcactttggactttttgctttagataaaagaaagacatcccaggagaaggacaaaccagaggagtgaaccaacaaagagtacctaggaatgggagttgagccctggaatggggctctatggagaggtgcataggactcggcagaaatggcctctccccaaagcctctttttgagaggagagggaagcctattttgttaactggtttgggatagggaatggggtttctttttctttaatctcccttgtttcttgggctgggggaggggtggggggaacaactggctattcagtaccaaggggccagagtggagggtaggagtgccactctctctttggtttaggtttttgaccttttcttcctttgttttttaaaagtttatgacagttggctccccccccacccccagcaaccccatcccagaatcctattttcctgggaagtccttaaagcccctaaccatcccacactcttcactttcctttccaccttattcattctctgtacttaccacagtattttgcacttgattacatatccttcactctcttctcttcatcccatcaccccctaaataggtcaggtgagggaggctgggaagaggtgggaggaggggcagaagtgaaggaagaataggaaggatattacctcttctgttatttttttaagaaacattgtttggtggcagcaatctccctgtccctatcactgttagaggcctaattttatatctataaatatattaaaaagcaagtcaaacttggatgtatcaaggtaaaattattgtcaaagtttaaatacctatatattctctgaatgcaataaagggacttaagagtgaacaagagtaatggtgtggaagtgacacctggggtcagtttacctctgtgtatggtcactagagattgggacttaccctttaggttttaggaggcttgagaatggaaggatcctcatttctgcccttcctggttccctgctttggtgtaggggttgggaaaaacaggaaattcctctcagctctgcctcagatctcctacctctccttaagtcttgtagggggttccaaggatggctcttctaaccagaggctggcctgtctttaaaacttaactactttagggtggtgccaccactgcagactattgtggtactttgtgacagaagacatgtacacacacaccacacacatacatacacactctctcactctgtctctcttacctttagctgcttgatcattaagccatccaacttcatgccagttcccttctttatagaagagtgaagggaaagacttcctgggtttgacttaaaccttgtccacctcttgatattttaggattgaggaataagtcattaatctaaggactgattacagtggctggagcttgggcacttgtcttatcactggtcactgagtctgaaagtcccagctgaattcttgcccttaagtgcttttgctgctatttttttgcccccagttccacaagatccaaccaagaattctgtatcctgggacagtcagattcttctaaatcaggccaggaaggaggggaaaagagtgagagaatggtattcccagatacttcttcctcctgccccttttcccagcagctctgagaccagatgttggctgctgtacttactccctgaggtagggaatgtgtggtgatcgagtggtctgtgttcctattgctggtggggtgatagggtgggctaaaaaccatgcactctggaatttgttgtattttctcccagtaaagcttttcttctcccgactgct

SEQ ID NO: 1626 - DNA, 3824 bp, Homo sapiens
gcaggcgcaagcgcagagagcggaggcggtggtggtggcggccgctggccagttccttcagtgaatctacagacctattttctcaggagctcagcctggccttacttcagtgataaaaggaggaaaggctggctacagcaaacatcattcaagatgtccagcaaagggagcagcacagatggcagaacagacttagctaatggaagcctgtctagcagtccagaggagatgtctggagctgaagaggggagggagacatcctcaggcattgaagtggaggcctcagacctgagtttgagcttgactggggatgatggtggccccaaccgcaccagcacagaaagtcgaggcacagacacagagagctcaggtgaagataaggactctgacagcatggaggacactggtcattactccattaatgatgaaaatcgagtccatgaccgctcagaggaagaggaagaggaggaagaagaggaggaagaagagcagcctcggcgccgtgtacagcgcaagcgggctaaccgtgaccaggactcatcagatgatgagcgggccctagaggactgggtgtcctcagaaacatcagctctaccccgacctcgctggcaagccctccctgcccttcgggagcgggagctgggttcaagtgcccgctttgtctatgaggcctgtggggcaagagtctttgtgcagcgtttccgcctgcagcatgggcttgagggccatactggttgtgtcaataccctgcactttaaccagcgcggcacctggctggccagtggcagcgatgacctgaaggtggtggtgtgggattgggtacggcggcagccagtactggactttgagagtggccacaaaagtaatgtgttccaggccaagtttcttcctaacagtggtgattctactctggccatgtgtgcccgtgacgggcaggttcgagtagcagaactgtctgccacacagtgttgcaagaatacaaaacgtgtggcccagcacaagggagcgtcccacaagttggcactggaaccagactctccctgtacgttcttatctgcaggtgaagatgcagttgttttcaccattgacctgagacaagaccgcccagcgtcgaaactggtggtgacaaaagagaaagagaagaaagtggggctgtatacgatctatgtgaatcctgccaatacccaccagtttgcagtgggtggacgagatcagtttgtaaggatttatgaccagaggaaaattgatgagaatgagaacaatggagtactcaagaagttctgtcctcatcacctggtgaacagtgagtccaaagcaaacatcacctgtcttgtgtacagccacgacggcacagagctcctggccagttacaatgatgaagacatttacctcttcaactcctctcacagtgatggggcccagtatgttaagagatacaagggccacagaaataatgccacagtaaaaggcgtcaatttctatggccccaagagtgagtttgtggtgagcggtagtgactgtgggcacatcttcctctgggagaaatcatcctgccagattattcagttcatggagggggacaagggaggcgtggtaaactgtcttgagccccaccctcacctgcctgtgctggcaaccagtggcctagaccatgatgtgaagatctgggcacccacagctgaagcttccactgagctgacagggttaaaagatgtgattaagaagaacaagcgggagcgggatgaagatagcttgcaccaaactgacctgtttgatagtcacatgctgtggttccttatgcatcacctgagacagagacgccatcaccggcgctggcgagaacctggggttggggccacagacgcggactctgatgagtctcccagctcctcagacacatcggacgaggaggagggccctgaccgggtgcagtgcatgccatcttgaggcctcatacctaggtggggcaggctggggctgccaacctgatcctgcctgggcaaccctttcctgtcccaggccctacattcagcagaaacgcactttggactttttgctttagataaaagaaagacatcccaggagaaggacaaaccagaggagtgaaccaacaaagagtacctaggaatgggagttgagccctggaatggggctctatggagaggtgcataggactcggcagaaatggcctctccccaaagcctctttttgagaggagagggaagcctattttgttaactggtttgggatagggaatggggtttctttttctttaatctcccttgtttcttgggctgggggaggggtggggggaacaactggctattcagtaccaaggggccagagtggagggtaggagtgccactctctctttggtttaggtttttgaccttttcttcctttgttttttaaaagtttatgacagttggctccccccccacccccagcaaccccatcccagaatcctattttcctgggaagtccttaaagcccctaaccatcccacactcttcactttcctttccaccttattcattctctgtacttaccacagtattttgcacttgattacatatccttcactctcttctcttcatcccatcaccccctaaataggtcaggtgagggaggctgggaagaggtgggaggaggggcagaagtgaaggaagaataggaaggatattacctcttctgttatttttttaagaaacattgtttggtggcagcaatctccctgtccctatcactgttagaggcctaattttatatctataaatatattaaaaagcaagtcaaacttggatgtatcaaggtaaaattattgtcaaagtttaaatacctatatattctctgaatgcaataaagggacttaagagtgaacaagagtaatggtgtggaagtgacacctggggtcagtttacctctgtgtatggtcactagagattgggacttaccctttaggttttaggaggcttgagaatggaaggatcctcatttctgcccttcctggttccctgctttggtgtaggggttgggaaaaacaggaaattcctctcagctctgcctcagatctcctacctctccttaagtcttgtagggggttccaaggatggctcttctaaccagaggctggcctgtctttaaaacttaactactttagggtggtgccaccactgcagactattgtggtactttgtgacagaagacatgtacacacacaccacacacatacatacacactctctcactctgtctctcttacctttagctgcttgatcattaagccatccaacttcatgccagttcccttctttatagaagagtgaagggaaagacttcctgggtttgacttaaaccttgtccacctcttgatattttaggattgaggaataagtcattaatctaaggactgattacagtggctggagcttgggcacttgtcttatcactggtcactgagtctgaaagtcccagctgaattcttgcccttaagtgcttttgctgctatttttttgcccccagttccacaagatccaaccaagaattctgtatcctgggacagtcagattcttctaaatcaggccaggaaggaggggaaaagagtgagagaatggtattcccagatacttcttcctcctgccccttttcccagcagctctgagaccagatgttggctgctgtacttactccctgaggtagggaatgtgtggtgatcgagtggtctgtgttcctattgctggtggggtgatagggtgggctaaaaaccatgcactctggaatttgttgtattttctcccagtaaagcttttcttctcccgactgct

SEQ ID NO: 1627 - DNA, 756 bp, Homo sapiens
gagttacttggctcggagcgggcgaggggacgcgtgggcggagcggggctggccagcctcggcccccatgacccgctgtcctgtgccctttcccagcgatgggcgtgcagccccccaacttctcctgggtgcttccgggccggctggcgggactggcgctgccgcggctccccgcccactaccagttcctgttggacctgggcgtgcggcacctggtgtccctgacggagcgcgggccccctcacagcgacagctgccccggcctcaccctgcaccgcctgcgcatccccgacttctgcccgccggcccccgaccagatcgaccgcttcgtgcagatcgtggacgaggccaacgcacggggagaggctgtgggagtgcactgtgctctgggctttggccgcactggcaccatgctggcctgttacctggtgaaggagcggggcttggctgcaggagatgccattgctgaaatccgacgactacgacccggctccatcgagacctatgagcaggagaaagcagtcttccagttctaccagcgaacgaaataaggggccttagtacccttctaccaggccctcactccccttccccatgttgtcgatggggccagagatgaagggaagtggactaaagtattaaaccctctagctcccattggctgaagacactgaagtagcccacccctgcaggcaggtcctgattgaaggggaggcttgtactgctttgttgaataaatgagttttacgaaccagg

SEQ ID NO: 1628 - DNA, 694 bp, Homo sapiens
gcagaccacgtggcccgggaggcgccgaggccagcgatgggcgtgcagccccccaacttctcctgggtgcttccgggccggctggcgggactggcgctgccgcggctccccgcccactaccagttcctgttggacctgggcgtgcggcacctggtgtccctgacggagcgcgggccccctcacagcgacagctgccccggcctcaccctgcaccgcctgcgcatccccgacttctgcccgccggcccccgaccagatcgaccgcttcgtgcagatcgtggacgaggccaacgcacggggagaggctgtgggagtgcactgtgctctgggctttggccgcactggcaccatgctggcctgttacctggtgaaggagcggggcttggctgcaggagatgccattgctgaaatccgacgactacgacccggctccatcgagacctatgagcaggagaaagcagtcttccagttctaccagcgaacgaaataaggggccttagtacccttctaccaggccctcactccccttccccatgttgtcgatggggccagagatgaagggaagtggactaaagtattaaaccctctagctcccattggctgaagacactgaagtagcccacccctgcaggcaggtcctgattgaaggggaggcttgtactgctttgttgaataaatgagttttacgaaccagg

SEQ ID NO: 1629 - DNA, 729 bp, Homo sapiens
gggcagagcgacccgagggcggcgccctgcagaccacgtggcccgggaggcgccgaggccaggtaggtgcgatgggcgtgcagccccccaacttctcctgggtgcttccgggccggctggcgggactggcgctgccgcggctccccgcccactaccagttcctgttggacctgggcgtgcggcacctggtgtccctgacggagcgcgggccccctcacagcgacagctgccccggcctcaccctgcaccgcctgcgcatccccgacttctgcccgccggcccccgaccagatcgaccgcttcgtgcagatcgtggacgaggccaacgcacggggagaggctgtgggagtgcactgtgctctgggctttggccgcactggcaccatgctggcctgttacctggtgaaggagcggggcttggctgcaggagatgccattgctgaaatccgacgactacgacccggctccatcgagacctatgagcaggagaaagcagtcttccagttctaccagcgaacgaaataaggggccttagtacccttctaccaggccctcactccccttccccatgttgtcgatggggccagagatgaagggaagtggactaaagtattaaaccctctagctcccattggctgaagacactgaagtagcccacccctgcaggcaggtcctgattgaaggggaggcttgtactgctttgttgaataaatgagttttacgaaccagg

SEQ ID NO: 1630 - DNA, 5558 bp, Homo sapiens
gctactcccaccccgccccgccccgtcattgtccccgtcggtctcttttctcttccgtcctaaaagctctgcgagccgctcccttctcccggtgccccgcgtctgtccatcctcagtgggtcagacgagcaggatggagggctgcatgggggaggagtcgtttcagatgtgggagctcaatcggcgcctggaggcctacctggcccgggtcaaggcgctggaggagcagaatgagctgctcagcgcggagctcggggggctccgggcacaatccgcggacacctcctggcgggcgcatgccgacgacgagctggcggccctgcgggccctcgttgaccaacgctggcgggagaagcacgcggccgaggtggcgcgcgacaacctggctgaagagctggagggcgtggcaggccgatgccagcagctgcggctggcccgggagcggacgacggaggaggtagcccgcaaccggcgcgccgtcgaggcagagaaatgcgcccgggcctggctgagtagccaggtggcagagctggagcgcgagctagaggctctacgcgtggcgcacgaggaggagcgcgtcggcctgaacgcgcaggctgcctgtgccccccgctgccccgcgccgccccgcgggcctcccgcgccggccccggaggtagaggagctggcaaggcgactgggcgaggcgtggcgcggggcagtgcgcggctaccaggagcgcgtggcacacatggagacgtcgctgggccaggcccgcgagcggctgggccgggcggtgcagggtgcccgcgagggccgcctggagctgcagcagctccaggctgagcgcggaggcctcctggagcgcagggcagcgttggaacagaggttggagggccgctggcaggagcggctgcgggctactgaaaagttccagctggctgtggaggccctggagcaggagaaacagggcctacagagccagatcgctcaggtcctggaaggtcggcagcagctggcgcacctcaagatgtccctcagcctggaggtggccacgtacaggaccctcctggaggctgagaactcccggctgcaaacacctggcggtggctccaagacttccctcagctttcaggaccccaagctggagctgcaattccctaggaccccagagggccggcgtcttggatctttgctcccagtcctgagcccaacttccctcccctcacccttgcctgctacccttgagacacctgtgccagcctttcttaagaaccaagaattcctccaggcccgtacccctaccttggccagcacccccatcccccccacacctcaggcaccctctcctgctgtagatgcagagatcagagcccaggatgctcctctctctctgctccagacacagggtgggaggaaacaggctccagagcccctgcgggctgaagccagggtggccattcctgccagcgtcctgcctggaccagaggagcctgggggccagcggcaagaggccagtacaggccagtccccagaggaccatgcctccttggcaccacccctcagccctgaccactccagtttagaggctaaggatggagaatccggtgggtctagagtgttcagcatatgccgaggggaaggtgaagggcaaatctgggggttggtagagaaagaaacagccatagagggcaaagtggtaagcagcttgcagcaggaaatatgggaagaagaggatctaaacaggaaggaaatccaggactcccaggttcctttggaaaaagaaaccctgaagtctctgggagaggagattcaagagtcactgaagactctggaaaaccagagccatgagacactagaaagggagaatcaagaatgtccgaggtctttagaagaagacttagaaacactaaaaagtctagaaaaggaaaataaagagctattaaaggatgtggaggtagtgagacctctagaaaaagaggctgtaggccaacttaagcctacaggaaaagaggacacacagacattgcaatccctgcaaaaggagaatcaagaactaatgaaatctcttgaaggtaatctagagacatttttatttccaggaacggaaaatcaagaattagtaagttctctgcaagagaacttagagtcattgacagctctggaaaaggagaatcaagagccactgagatctccagaagtaggggatgaggaggcactgagacctctgacaaaggagaatcaggaacccctgaggtctcttgaagatgagaacaaagaggcctttagatctctagaaaaagagaaccaggagccactgaagactctagaagaagaggaccagagtattgtgagacctctagaaacagagaatcacaaatcactgaggtctttagaagaacaggaccaagagacattgagaactcttgaaaaagagactcaacagcgacggaggtctctaggggaacaggatcagatgacattaagacccccagaaaaagtggatctagaaccactgaagtctcttgaccaggagatagctagacctcttgaaaatgagaatcaagagttcttaaagtcactcaaagaagagagcgtagaggcagtaaaatctttagaaacagagatcctagaatcactgaagtctgcgggacaagagaacctggaaacactgaaatctccagaaactcaagcaccactgtggactccagaagaaataaatcagggggcaatgaatcctctagaaaaggaaattcaagaaccactggagtctgtggaagtgaaccaagagacattcagactcctggaagaggagaatcaggaatcattgagatctctgggagcatggaacctggagaatttgagatctccagaggaggtagacaaggaaagtcaaaggaatctggaagaggaagagaacctgggaaagggagagtaccaagagtcactgaggtctctggaggaggagggacaggagctgccgcagtctgcagatgtgcagaggtgggaagatacggtggagaaggaccaagaactggctcaggaaagccctcctgggatggctggagtggaaaatgaggatgaggcagagctgaatctgagggagcaggatggcttcactgggaaggaggaggtggtagagcagggagagctgaatgccacagaggaggtctggatcccaggcgaggggcacccagagagccctgagcccaaagagcagagaggcctggttgagggagccagtgtgaagggaggggctgagggcctccaggaccctgaagggcaatcacaacaggtgggggccccaggcctccaggctccccaggggctgccagaggcgatagagcccctggtggaagatgatgtggccccagggggtgaccaagcctccccagaggtcatgttggggtcagagcctgccatgggtgagtctgctgcgggagctgagccaggcccggggcagggggtgggagggctgggggacccaggccatctgaccagggaagaggtgatggaaccacccctggaagaggagagtttggaggcaaagagggttcagggcttggaagggcctagaaaggacctagaggaggcaggtggtctggggacagagttctccgagctgcctgggaagagcagagacccttgggagcctcccagggagggtagggaggagtcagaggctgaggcccccaggggagcagaggaggcgttccctgctgagaccctgggccacactggaagtgatgccccttcaccttggcctctggggtcagaggaagctgaggaggatgtaccaccagtgctggtctcccccagcccaacgtacaccccgatcctggaagatgcccctgggcctcagcctcaggctgaagggagtcaggaggctagctggggggtgcaggggagggctgaagccctggggaaagtagagagcgagcaggaggagttgggttctggggagatccccgagggcccccaggaggaaggggaggagagcagagaagagagcgaggaggatgagctcggggagacccttccagactccactcccctgggcttctacctcaggtcccccacctcccccaggtgggaccccactggagagcagaggccaccccctcaaggggagactggaaaggagggctgggatcctgctgtcctggcttccgagggccttgaggccccaccctcagaaaaggaggagggggaggagggagaagaggagtgtggccgtgactctgacctgtcagaagaatttgaggacctggggactgaggcaccttttcttcctggggtccctggggaggtggcagaacctctgggccaggtgccccagctgctactggatcctgcagcctgggatcgagatggggagtccgatgggtttgcagatgaggaagaaagtggggaggagggagaggaggatcaggaggaggggagggagccaggggctgggcggtgggggccagggtcttctgttggcagcctccaggccctgagtagctcccagagaggggaattcctggagtctgattctgtgagtgtcagtgtcccctgggatgacagcttgaggggtgcagtggctggtgcccccaagactgccctggaaacggagtcccaggacagtgctgagccttctggctcagaggaagagtctgaccctgtttccttggagagggaggacaaagtccctggccctctagagatccccagtgggatggaggatgcaggcccaggggcagacatcattggtgttaatggccagggtcccaacttggaggggaagtcacagcatgtgaatgggggagtgatgaacgggctggagcagtctgaggaagtggggcaaggaatgccgctagtctctgagggagaccgagggagcccctttcaggaggaggaggggagtgctctgaagacctcttgggcaggggctcctgttcacctgggccagggtcagttcctgaagttcactcagagggaaggagatagagagtcctggtcctcaggggaggactaggaaaagaccatctgcccggcactggggacttaggggtgcggggaggggaaggacgcctccaagcccgctccctgctcaggagcagcactcttaacttacgatctcttgacatatggtttctggctgagaggcctggcccgctaaggtgaaaaggggtgtggcaaaggagcctactccaagaatggaggctgtaggaatataacctcccaccctgcaaagggaatctcttgcctgctccatctcataggctaagtcagctgaatcccgatagtactaggtccccttccctccgcatcccgtcagctggaaaaggcctgtggcccagaggcttctccaaagggagggtgacatgctggcttttgtgcccaagctcaccagccctgcgccacctcactgcagtagtgcaccatctcactgcagtagcacgccctcctgggccgtctggcctgtggctaatggaggtgacggcactcccatgtgctgactccccccatccctgccacgctgtggccctgcctggctagtccctgcctgaataaagtaatgcctccgcttcaaa

SEQ ID NO: 1631 - DNA, 438 bp, Homo sapiens
tgaggctgtgagcagtaccggagggcaccacacctgttggtgttcagatggagcggcacactagtcatcctaacagaaaagttccagccaaagaggaagctaatgctgtgcctctctgtagagcaaaaccctcccccagctatattaatcttcaagcaagttccccaccagccacttttctgaacatccagacaacaaagctgccctcggttgatcacaagcccaaggaatgcctaggactcctggaatgtatgtatgcaaacctccagcttcagacccagctcgcccaacaacagatggctgttttggaacatttacaggcatctgtgacacaactggctcctgggaggggaagcaataactcttctctcccagccttatctcctaatccattgttaaatcacctgccccaattcagtaaatgaattgtggaacaaa

SEQ ID NO: 1632 - DNA, 491 bp, Homo sapiens
agccttagcaacaggtggactagagaggcgggactccagccagcacatgggggaaagacctgccggcttggcgcagggcaccacacctgttggtgttcagatggagcggcacactagtcatcctaacagaaaagttccagccaaagaggaagctaatgctgtgcctctctgtagagcaaaaccctcccccagctatattaatcttcaagcaagttccccaccagccacttttctgaacatccagacaacaaagctgccctcggttgatcacaagcccaaggaatgcctaggactcctggaatgtatgtatgcaaacctccagcttcagacccagctcgcccaacaacagatggctgttttggaacatttacaggcatctgtgacacaactggctcctgggaggggaagcaataactcttctctcccagccttatctcctaatccattgttaaatcacctgccccaattcagtaaatgaattgtggaacaaa

SEQ ID NO: 1633 - DNA, 448 bp, Homo sapiens
gtgctggggttgcggctttcggttaacaccgcaggcaccacacctgttggtgttcagatggagcggcacactagtcatcctaacagaaaagttccagccaaagaggaagctaatgctgtgcctctctgtagagcaaaaccctcccccagctatattaatcttcaagcaagttccccaccagccacttttctgaacatccagacaacaaagctgccctcggttgatcacaagcccaaggaatgcctaggactcctggaatgtatgtatgcaaacctccagcttcagacccagctcgcccaacaacagatggctgttttggaacatttacaggcatctgtgacacaactggctcctgggaggggaagcaataactcttctctcccagccttatctcctaatccattgttaaatcacctgccccaattcagtaaatgaattgtggaacaaa

SEQ ID NO: 1634 - DNA, 598 bp, Homo sapiens
ggcagttggccagcacaccactacgcatgtgtgtcaactctagggttgggtgctggggttgcggctttcggttaacaccgcagattggaacaggctgagatctgctggagacaacttaggaaattatcatagtgaaaatactaacatggattgttgatcatctgatgctatgattctttcccaggcaccacacctgttggtgttcagatggagcggcacactagtcatcctaacagaaaagttccagccaaagaggaagctaatgctgtgcctctctgtagagcaaaaccctcccccagctatattaatcttcaagcaagttccccaccagccacttttctgaacatccagacaacaaagctgccctcggttgatcacaagcccaaggaatgcctaggactcctggaatgtatgtatgcaaacctccagcttcagacccagctcgcccaacaacagatggctgttttggaacatttacaggcatctgtgacacaactggctcctgggaggggaagcaataactcttctctcccagccttatctcctaatccattgttaaatcacctgccccaattcagtaaatgaattgtggaacaaa

SEQ ID NO: 1635 - DNA, 751 bp, Homo sapiens
aggaggatcgcttgaacctgggaggcagaggttgcagtgaacagagatcgcgccactgcaacccagcctgggtgacagagcgagactttgtctcaaaatataaaaagaaaaaaaataagggatcttccaaaaggaaaaggtgaccagtcgagaaatctgggaaaacccaactggttagtgggaaagagtacaacgccggggacacggagggaacgattacatctaagatcagtgagattggaacaggctgagatctgctggagacaacttaggaaattatcatagtgaaaatactaacatggattgttgatcatctgatgctatgattctttcccaggcaccacacctgttggtgttcagatggagcggcacactagtcatcctaacagaaaagttccagccaaagaggaagctaatgctgtgcctctctgtagagcaaaaccctcccccagctatattaatcttcaagcaagttccccaccagccacttttctgaacatccagacaacaaagctgccctcggttgatcacaagcccaaggaatgcctaggactcctggaatgtatgtatgcaaacctccagcttcagacccagctcgcccaacaacagatggctgttttggaacatttacaggcatctgtgacacaactggctcctgggaggggaagcaataactcttctctcccagccttatctcctaatccattgttaaatcacctgccccaattcagtaaatgaattgtggaacaaa

SEQ ID NO: 1636 - DNA, 884 bp, Homo sapiens
caacttcaacatggccgaagcaagtagcgccaatctaggcagcggctgtgaggaaaaaaggcatgaggggtcgtcttcggaatctgtgccacccggcactaccatttcgagggtgaagctcctcgacaccatggtggacacttttcttcagaagctggtcgccgccggcagctctccactccttcattgggacggaagtgctggtccccgcctgccctctggtggacagtctgtgaaacaggccttcagttgggcggcgtgcaggttaccacaggggaggaaggaggaaatctctgacatcaaagaggaggggaacctagaagctgtcttgaatgccttggataaaattgtggaagaaggcaaagtccgcaaagagccagcctggcgccccagcgggatcccagagaaggatctgcacagtgttatggcaccctacttcctgcagcaacgggacaccctgcggcgccatgtgcagaaacaggaggccgagaaccagcagctggcagatgccgtcctggcagggcggaggcaggtggaggagctgcagctacaggtccaggcccagcagcaggcctggcaggctctacacagagaacagagggagctggttgctgtgctgagggagcctgagtgaggagaccgccagccccagaagcagagggcagtcaaggtcaagagcctgtggtccagcatgcctggcctgggcgggctacctctgagaacggctgaaatggtgcccagtccatcagcagtgatggaatttgctggaggactaggccagagcaagcctcactgccactgtgcctttggggcacccttggggttggacatacaccccctttagattcctctgtttcttctacctggataattcttggccatgt

SEQ ID NO: 1637 - DNA, 1068 bp, Homo sapiens
aacttcaacatggccgaagcaagtagcgccaatctaggcagcggctgtgaggaaaaaaggcatgaggggtcgtcttcggaatctgtgccacccggcactaccatttcgagggtgaagctcctcgacaccatggtggacacttttcttcagaagctggtcgccgccggcagctaccagagattcactgactgctataagtgcttctaccagttgcagcctgcgatgacacagcaaatctatgacaagtttatagctcagttgcagacatctatccgggaggaaatctctgacatcaaagaggaggggaacctagaagctgtcttgaatgccttggataaaattgtggaagaaggcaaagtccgcaaagagccagcctggcgccccagcgggatcccagagaaggatctgcacagtgttatggcaccctacttcctgcagcaacgggacaccctgcggcgccatgtgcagaaacaggaggccgagaaccagcagctggcagatgccgtcctggcagggcggaggcaggtggaggagctgcagctacaggtccaggcccagcagcaggcctggcaggctctacacagagaacagagggagctggttgctgtgctgagggagcctgagtgaggagaccgccagccccagaagcagagggcagtcaaggtcaagagcctgtggtccagcatgcctggcctgggcgggctacctctgagaacggctgaaatggtgcccagtccatcagcagtgatggaatttgctggaggactaggccagagcaagcctcactgccactgtgcctttggggcacccttggggttggacatacaccccctttagattcctctgtttcttctacctggataattcttggccatgttctctcttctctaggttcaggtcagctctgcccctccgcccccctcctgctggttccccagcccttttccctggccctggcttggagaatctgttttcaatctccactgattgcccccttgctggccagcccaggggcctttaccatgttctctccacatccgtaaataaacttccttcactacactgtaa

SEQ ID NO: 1638 - DNA, 1019 bp, Homo sapiens
agatttggaggttcaacttcaacatggccgaagcaagtagcgccaatctaggcagcggctgtgaggaaaaaaggcatgaggggtcgtcttcggaatctgtgccacccggcactaccatttcgagggtgaagctcctcgacaccatggtggacacttttcttcagaagctggtcgccgccggcagctaccagagattcactgactgctataagtgcttctaccagttgcagcctgcgatgacacagcaaatctatgacaagtttatagctcagttgcagacatctatccgggaggaaatctctgacatcaaagaggaggggaacctagaagctgtcttgaatgccttggataaaattgtggaagaaggcaaagtccgcaaagagccagcctgcaacgggacaccctgcggcgccatgtgcagaaacaggaggccgagaaccagcagctggcagatgccgtcctggcagggcggaggcaggtggaggagctgcagctacaggtccaggcccagcagcaggcctggcaggctctacacagagaacagagggagctggttgctgtgctgagggagcctgagtgaggagaccgccagccccagaagcagagggcagtcaaggtcaagagcctgtggtccagcatgcctggcctgggcgggctacctctgagaacggctgaaatggtgcccagtccatcagcagtgatggaatttgctggaggactaggccagagcaagcctcactgccactgtgcctttggggcacccttggggttggacatacaccccctttagattcctctgtttcttctacctggataattcttggccatgttctctcttctctaggttcaggtcagctctgcccctccgcccccctcctgctggttccccagcccttttccctggccctggcttggagaatctgttttcaatctccactgattgcccccttgctggccagcccaggggcctttaccatgttctctccacatccgtaaataaacttccttcactacactgt

SEQ ID NO: 1639 - DNA, 2555 bp, Homo sapiens
cctcgatcccctcgccgcggtcccatggaggaggaggcgagccgcagcgccgcggcgacgaacccagggagaaaaggaagcaaatgagctgatggaagatctgtttgaaactttccaagatgagatgggattctccaacatggaagatgatggcccagaagaggaggagcgtgtggctgagcctcaagctaactttaacacccctcaagctctacggtttgaggaactactggccaacctactaaatgaacaacatcagatagcgaaggaactatttgaacagctgaagatgaagaaaccttcagccaaacagcagaaggaggtagagaaggttaaaccccagtgtaaggaagttcatcagaccctgattctggacccagcacaaaggaagagactccagcagcagatgcagcagcatgttcagctcttgacacaaatccaccttcttgccacctgcaaccccaatctcaatccggaggccagtagcaccaggatatgtcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgccaatgaatttccctgtttgccaaagcaagtggcttggatcctggccacaagcaaggttttcatgtatccagagttacttccagtgtgttccctgaaggcaaagaatccccaggataagatcctcttcaccaaggctgaggacaatttgttagctttaggactgaagcattttgaagggactgagtttcttaaccctctaatcagcaagtaccttctaacctgcaagactgcccgccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcaaggcctagaaaaagacaactcagagttggggagtgaaactcggtacccactgctattgcctaagggtgtagtcctgaaactgaagccagttgccgaccgtttccccaagaaggcttggagacagaagcgttcatcagtcctgaaacccctccttatccaacccagcccctctctccagcccagcttcaaccctgggaaaacaccagcccaatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctatgccccctgaggccaggacaagcttccctctgtctgagtcccagactttgctctcttctgcccctgtgcccaaggtaatgatgccctcccctgcctcttccatgtttcgaaagccatatgtgagacggagaccctcaaaaagaaggggagccagggcctttcgctgtatcaaacctgcccctgttatccaccctgcatctgttatcttcactgttcctgctaccactgtgaagattgtgagccttggcggtggctgtaacatgatccagcctgtcaatgcggctgtggcccagagtccccagactattcccatcgccaccctcttggttaaccctacttccttcccctgtccattgaaccagccccttgtggcctcctctgtctcacccttaattgtttctggcaattctgtgaatcttcctataccatccacccctgaagataaggcccacatgaatgtggacattgcttgtgctgtggctgatggggaaaatgcctttcagggcctagaacccaaattagagccccaggaactatctcctctctctgctactgttttccccaaagtggaacatagcccagggcctccaccagtcgataaacagtgccaagaaggattgtcagagaacagtgcctatcgctggaccgttgtgaaaacagaggagggaaggcaagctctggagccgctccctcagggcatccaggagtctctaaacaactcttcccctggggatttagaggaagttgtcaagatggaacctgaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccactctgtggaatatacttttgcttcaataaatctgtgcttttattgcttcattgtttca

SEQ ID NO: 1640 - DNA, 2874 bp, Homo sapiens
gctacatggccggagtcgggcgaagcgggggaccgtggggaagaacgcgaggagggaggagtgggaggttgggggtgtcgctaggcgcccttagctccctccctctggaggagctgccgcggccactctgctgccgccgctgccgccgccattttgggttcgctttgcgaggggaaacgatcccagtgtcggttgcgggatccgcctcctctcagtttgcccctttagccctccacctttcccttctcctctctcgcatttccgccagtcggcttacccgctggccgcctcctgacaagcgggagggatccgcggtggacccagggaagcggaggagcctggcggccaccccctcttcctcacttccctgtactctcatcgctctcggcctccgacacgaaaaggaagcaaatgagctgatggaagatctgtttgaaactttccaagatgagatgggattctccaacatggaagatgatggcccagaagaggaggagcgtgtggctgagcctcaagctaactttaacacccctcaagctctacggtttgaggaactactggccaacctactaaatgaacaacatcagatagcgaaggaactatttgaacagctgaagatgaagaaaccttcagccaaacagcagaaggaggtagagaaggttaaaccccagtgtaaggaagttcatcagaccctgattctggacccagcacaaaggaagagactccagcagcagatgcagcagcatgttcagctcttgacacaaatccaccttcttgccacctgcaaccccaatctcaatccggaggccagtagcaccaggatatgtcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgccaatgaatttccctgtttgccaaagcaagtggcttggatcctggccacaagcaaggttttcatgtatccagagttacttccagtgtgttccctgaaggcaaagaatccccaggataagatcctcttcaccaaggctgaggacaatttgttagctttaggactgaagcattttgaagggactgagtttcttaaccctctaatcagcaagtaccttctaacctgcaagactgcccgccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcaaggcctagaaaaagacaactcagagttggggagtgaaactcggtacccactgctattgcctaagggtgtagtcctgaaactgaagccagttgccgaccgtttccccaagaaggcttggagacagaagcgttcatcagtcctgaaacccctccttatccaacccagcccctctctccagcccagcttcaaccctgggaaaacaccagcccaatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctatgccccctgaggccaggacaagcttccctctgtctgagtcccagactttgctctcttctgcccctgtgcccaaggtaatgatgccctcccctgcctcttccatgtttcgaaagccatatgtgagacggagaccctcaaaaagaaggggagccagggcctttcgctgtatcaaacctgcccctgttatccaccctgcatctgttatcttcactgttcctgctaccactgtgaagattgtgagccttggcggtggctgtaacatgatccagcctgtcaatgcggctgtggcccagagtccccagactattcccatcgccaccctcttggttaaccctacttccttcccctgtccattgaaccagccccttgtggcctcctctgtctcacccttaattgtttctggcaattctgtgaatcttcctataccatccacccctgaagataaggcccacatgaatgtggacattgcttgtgctgtggctgatggggaaaatgcctttcagggcctagaacccaaattagagccccaggaactatctcctctctctgctactgttttccccaaagtggaacatagcccagggcctccaccagtcgataaacagtgccaagaaggattgtcagagaacagtgcctatcgctggaccgttgtgaaaacagaggagggaaggcaagctctggagccgctccctcagggcatccaggagtctctaaacaactcttcccctggggatttagaggaagttgtcaagatggaacctgaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccactctgtggaatatacttttgcttcaataaatctgtgcttttattgcttc

SEQ ID NO: 1641 - DNA, 2927 bp, Homo sapiens
cgcgtacgggatggctggctcgcaggacggccgaaggtggtggttggtgggagcagccagcgacgagcccgtagacactcgtacgcgtgcgggctgacgtgcgcgctacatggccggagtcgggcgaagcgggggaccgtggggaagaacgcgaggagggaggagtgggaggttgggggtgtcgctaggcgcccttagctccctccctctggaggagctgccgcggccactctgctgccgccgctgccgccgccattttgggttcgctttgcgaggggaaacgatcccagtgtcggttgcgggatccgcctcctctcagtttgcccctttagccctccacctttcccttctcctctctcgcatttccgccagtcggcttacccgctggccgcctcctgacaagcgggagggatccgcggtggacccagggaagcggaggagcctggcggccaccccctcttcctcacttccctgtactctcatcgctctcggcctccgacacgaaaaggaagcaaatgagctgatggaagatctgtttgaaactttccaagatgagatgggattctccaacatggaagatgatggcccagaagaggaggagcgtgtggctgagcctcaagctaactttaacacccctcaagctctacggtttgaggaactactggccaacctactaaatgaacaacatcagatagcgaaggaactatttgaacagctgaagatgaagaaaccttcagccaaacagcagaaggaggtagagaaggttaaaccccagtgtaaggaagttcatcagaccctgattctggacccagcacaaaggaagagactccagcagcagatgcagcagcatgttcagctcttgacacaaatccaccttcttgccacctgcaaccccaatctcaatccggaggccagtagcaccaggatatgtcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgccaatgaatttccctgtttgccaaagcaagtggcttggatcctggccacaagcaaggttttcatgtatccagagttacttccagtgtgttccctgaaggcaaagaatccccaggataagatcctcttcaccaaggctgaggacaacaagtaccttctaacctgcaagactgcccgccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcaaggcctagaaaaagacaactcagagttggggagtgaaactcggtacccactgctattgcctaagggtgtagtcctgaaactgaagccagttgccgaccgtttccccaagaaggcttggagacagaagcgttcatcagtcctgaaacccctccttatccaacccagcccctctctccagcccagcttcaaccctgggaaaacaccagcccaatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctatgccccctgaggccaggacaagcttccctctgtctgagtcccagactttgctctcttctgcccctgtgcccaaggtaatgatgccctcccctgcctcttccatgtttcgaaagccatatgtgagacggagaccctcaaaaagaaggggagccagggcctttcgctgtatcaaacctgcccctgttatccaccctgcatctgttatcttcactgttcctgctaccactgtgaagattgtgagccttggcggtggctgtaacatgatccagcctgtcaatgcggctgtggcccagagtccccagactattcccatcgccaccctcttggttaaccctacttccttcccctgtccattgaaccagccccttgtggcctcctctgtctcacccttaattgtttctggcaattctgtgaatcttcctataccatccacccctgaagataaggcccacatgaatgtggacattgcttgtgctgtggctgatggggaaaatgcctttcagggcctagaacccaaattagagccccaggaactatctcctctctctgctactgttttccccaaagtggaacatagcccagggcctccaccagtcgataaacagtgccaagaaggattgtcagagaacagtgcctatcgctggaccgttgtgaaaacagaggagggaaggcaagctctggagccgctccctcagggcatccaggagtctctaaacaactcttcccctggggatttagaggaagttgtcaagatggaacctgaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccactctgtggaatatacttttgcttcaataaatctgtgcttttattgcttcattgtttca

SEQ ID NO: 1642 - DNA, 2245 bp, Homo sapiens
agcgcagtatggcgggcggggcccgggaggtgctcacactgcagttgggacattttgccggtttcgtgggcgcgcactggtggaaccagcaggatgctgcgctgggccgagcgaccgattccaaggagcccccgggagagctgtgccccgacgtcctgtatcgtacgggccggacgctgcacggccaggagacctacacgccgcgactcatcctcatggatctgaagggtagtttgagctccctaaaagaggaaggtggactctacagggacaaacagttggatgctgcaatagcatggcaggggaagctcaccacacacaaaggttcctcaccactccccaccgctacaactccaaaaccacttatccctacagaggccagcatcagggtctggtcagacttcctcagagtccatctccatccccggagcatctgtatgattcagaagtacaaccacgatggggaagcaggtcggctggaggcttttggccaaggggaaagtgtcctaaaggaacccaagtaccaggaagagctggaggacaggctgcatttctacgtggaggaatgtgactacttgcagggcttccagatcctgtgtgacctgcacgatggcttctctggggtaggcgcgaaggcggcagagctgctacaagatgaatattcagggcggggaataataacctggggcctgctacctggtccctaccatcgtggggaggcccagagaaacatctatcgtctattaaacacagcttttggtctcgtgcacctgactgctcacagctctcttgtctgccccttgtccttgggtgggagcctgggcctgcgacccgagccacctgtcagcttcccttacctgcattatgatgccactctgcccttccactgcagtgccatcctggctacagccctggacacagtcactgttccttatcgcctgtgttcctctccagtttccatggttcatctggctgacatgctgagcttctgtgggaaaaaggtggtgacagcaggagcaatcatccctttccccttggctccaggccagtcccttcctgattccctgatgcagtttggaggagccaccccatggaccccactgtctgcatgtggggagccttctggaacacgttgctttgcccagtcagtggtgctgaggggtatagacagagcatgccacacaagccagctcaccccagggacacctccaccctctgcccttcatgcatgtaccactggggaagaaatcttggctcagtatttacaacagcagcagcctggagtcatgagttcttcccatctgctgctgactccctgcagggtggctcctccttacccccacctcttctcaagctgcagtccaccggcagtggagagcatcccagtgtttggggcactgtgttcctcttcgtccctgcaccagaccctggaagccttggccagagacctcaccaaactcgacttgcggcgctgggccagcttcatggatgctggagtggagcacgatgacgtagcagagctgctgcaggagctacaaagcctggcccagtgctaccagggtggtgacagcctcgtggactaaagttcccagtgtgggagaaaggagctagtttgcaataaaaacagctggatgcaggagcccagtgtcttcatgcagaggagctcaatgtcgcgggactagctacaccaacatatgcactttttacatttagaaacactgtgattagaccacagaacaataaatatgtgccatcagaccaaaaaaaagtagagaaaggagctgaactccactctcgatgctacttacagaggacatctgtaaagtcttcataaaagaccttgaatgatgcctaggatggcagagcccctgggtcctactccatcctccagcctttgtccttgtcctggcctcctgctctccagatctgtaaactgggctcaaggactgtacaagcagagtacaactacccgcctccccggtgccagggcgcctgttgggtttggtcctgtgtagatgattcccagagtctcattcatccagctcctcttcagacagaaggtccccatggtcagacagctggtctgcattgctggtactggttgcatcatcctcatcctcagagctggcttcacaggcagtgtggaagagctgcatgagttctcgaaaatggtgggaaacctaagaaaggaggagggctgtattcactgatccttagtaacatgttaacatttatgaagcactat

SEQ ID NO: 1643 - DNA, 2503 bp, Homo sapiens
gccgactccaagcaagtttgtcggccttggggagtctggccccgttcctagtgctggagggggaagttgttgcctttcctgctccgtgggccggccccctctccctccagacccacctgggcatagtggacgcgggcttacccagcctccatgccaagtctagggggtcccagcgagtctgttgttaggggctttgggtcacaccctctgtggaattccttggcctgtgcagctcgggcctgccccccgaccttgctagggaggggtggagggtgaagctcccgggagctcattggcactagaggttctggccacgccctctccgcgagtccagtcccacgcgggatgaagagggcaccctccgccaagaggctgctgcgggacccgggtttcccctttccggcgccttccagcctcccaatcctcgggtctcgcctccctccgtctcctccctttcccctgtctgtctttccattggtccatgccgcccacgtgctccccggggctccgcaggcaggactgggccccggggcggtgcgctgggctacacctccctccccgcgccccgtcctctcccgccctacaggccctagcagggcaggcgggagtccgtagttcgtggtccttcgccggtgtccccggagcccagcggctgtggatggcagaagcccagagtgggactggtcagctgcaggagcagaagaaaggtcttctgatagccgtcagcgtctccgttgataaaatcatctcgcatttcggggccgcccggaacttggtgcagaaggcccagttgggtgatagccggctgagcccggatgtggggcacctggtgctgaccaccctctgcccggccctccacgccctggtggcggacgggctgaagcctttccggaaggacctcatcaccgggcagcgcaggagcagcccctggagcgtggtggaggcgtcggtgaagccaggctccagcacccgctcccttggaaccctgtatagccaggtcagccgtctagccccgctgagcagcagccgtagccgcttccatgcctttatcctgggcctcctcaacaccaagcagttggagctgtggttttccagtctccaggaagatgcaggcctgctctccctcctgtacctgccaacaggatttttctccctggcccgcggtggttgtccctccctgtccacagagctgctgctcctgctgcagccattgtcggtgctcactttccacctggacctgctctttgagcaccaccaccacctgcccctgggcccacctcaggcccctgcccctccaggcccacctccagctctgcagcagactatgcaagccatgctgcactttgggggccggctggcccagagccttcgggggacttccaaggaagctgcttcagacccctctgactctccaaaccttcccacaccagggagctggtgggagcagttgacccaggcctcccgggtctatgcctctgggggcactgagggctttcctctttcccgatgggcaccggggcgtcatgggactgcagctgaagaaggtgcacaggagagacccctgcccacagatgagatggcaccaggcaggggcctctggttgggaagactatttggagtgcctgggggccccgcagaaaatgagaatggagccctaaagtccaggagaccatctagctggctgcccccgacagtgagtgtgttggctcttgtgaagcggggggcacctcccgagatgccttctcctcaggagcttgaggcctcagcacccaggatggtgcaaacccatagggcagtgcgggctctctgtgatcacactgctgcaagacctgaccagttgagcttccggcgtggggaagtgctgcgtgtcatcaccacagtggatgaggactggctccgctgtgggcgggatggcatggagggtctggtgcctgtggggtatacctcccttgttctgtagccctgggaccctttcctgcgtatgtgtctccttcctgtcacctgggaatggaatggccagtgaacaccatcccagaagcattttccctctgcaaaatgacgtttcttcccacgtctgtttctgctaatatttaaaataaactttccttcttccctcctatacccacctgtaaggtgaaatctgctcttcttccaaatatataaaaaaggaattgccctccaggtaatccctttcctttttcccgtctatataagggaatgtcttccttcctatctatctgcaaaatggaaatctagacctccttcttcatccataagtggactgtgccagtacaatacatgcctcagcccccaagcctagaaggacctctagtctccttcctgtgtggaatcttccccactccatccctcccaagttgcctgtattgataatgtactcactcatgctgtactaggtgctgaagcctggacacccttggtgggtgggcctgtggtgatggtttgcatccttcctcctttgtcccaataaagtatgggagttgaa

SEQ ID NO: 1644 - DNA, 1968 bp, Homo sapiens
cgccctacaggccctagcagggcaggcgggaggtgagcgcggccatcccgctcccggagttccgggatcctggagtccgtagttcgtggtccttcgccggtgtccccggagcccagcggctgtggatggcagaagcccagagtgggactggtcagctgcaggagcagaagaaaggtcttctgatagccgtcagcgtctccgttgataaaatcatctcgcatttcggggccgcccggaacttggtgcagaaggcccagttgggtgatagccggctgagcccggatgtggggcacctggtgctgaccaccctctgcccggccctccacgccctggtggcggacgggctgaagcctttccggaaggacctcatcaccgggcagcgcaggagcagcccctggagcgtggtggaggcgtcggtgaagccaggctccagcacccgctcccttggaaccctgtatagccaggtcagccgtctagccccgctgagcagcagccgtagccgcttccatgcctttatcctgggcctcctcaacaccaagcagttggagctgtggttttccagtctccaggaagatgcaggcctgctctccctcctgtacctgccaacaggatttttctccctggcccgcggtggttgtccctccctgtccacagagctgctgctcctgctgcagccattgtcggtgctcactttccacctggacctgctctttgagcaccaccaccacctgcccctgggcccacctcaggcccctgcccctccaggcccacctccagctctgcagcagactatgcaagccatgctgcactttgggggccggctggcccagagccttcgggggacttccaaggaagctgcttcagacccctctgactctccaaaccttcccacaccagggagctggtgggagcagttgacccaggcctcccgggtctatgcctctgggggcactgagggctttcctctttcccgatgggcaccggggcgtcatgggactgcagctgaagaaggtgcacaggagagacccctgcccacagatgagatggcaccaggcaggggcctctggttgggaagactatttggagtgcctgggggccccgcagaaaatgagaatggagccctaaagtccaggagaccatctagctggctgcccccgacagtgagtgtgttggctcttgtgaagcggggggcacctcccgagatgccttctcctcaggagcttgaggcctcagcacccaggatggtgcaaacccatagggcagtgcgggctctctgtgatcacactgctgcaagacctgaccagttgagcttccggcgtggggaagtgctgcgtgtcatcaccacagtggatgaggactggctccgctgtgggcgggatggcatggagggtctggtgcctgtggggtatacctcccttgttctgtagccctgggaccctttcctgcgtatgtgtctccttcctgtcacctgggaatggaatggccagtgaacaccatcccagaagcattttccctctgcaaaatgacgtttcttcccacgtctgtttctgctaatatttaaaataaactttccttcttccctcctatacccacctgtaaggtgaaatctgctcttcttccaaatatataaaaaaggaattgccctccaggtaatccctttcctttttcccgtctatataagggaatgtcttccttcctatctatctgcaaaatggaaatctagacctccttcttcatccataagtggactgtgccagtacaatacatgcctcagcccccaagcctagaaggacctctagtctccttcctgtgtggaatcttccccactccatccctcccaagttgcctgtattgataatgtactcactcatgctgtactaggtgctgaagcctggacacccttggtgggtgggcctgtggtgatggtttgcatccttcctcctttgtcccaataaagtatgggagttg

SEQ ID NO: 1645 - DNA, 3403 bp, Homo sapiens
cgccgggcggggaccgtgggagccgcggacaagcccaaggccggagcggttccaggaggaccctggtctgcacctgtggttgccaggtaggtggatgtgagagaccctacccttctggttctctagaagccatcccatcgccgctagcatcatgctgtcccctcagagagctttactctgcaacctcaaccacatccacctccagcacgtctccctgggcctgcacttgtcccgccgtcctgagctacaggaggggcctttgagcacaccccctcctccaggagacactgggggcaaggagagcaggggcccctgcagtggcaccctggtggacgccaattccaacagcccagctgtgccctgccggtgctgccaggagcacggtccgggcctagaaaaccggcaggacccgtcacaggaggaagagggggctgcctctccctcagacccaggctgctcctcctcactcagctcctgctcagatcttagccccgatgagtcccctgtctcagtctacttgcgggacctccctggtgatgaggatgcccaccctcagcccagtatcatccccctggagcagggctccccactggcttcagcaggccctggcacctgctcaccggacagcttctgctgctctcctgattcctgctccggagcttcttcttcacccgatcctggcctggactcgaactgcaacgccctgaccacctgccaggacgtcccttccccaggcttggaggaagaggacgagagggcggagcaggatctccctacctctgagctcttagaggcggatgatgggaaaatcgacgctgggaaaacggagcccagttggaagattaacccaatttggaaaattgacacagagaaaactaaagctgaatggaaaaccactgaaaacaataacactggttggaaaaacaacgggaatgttaactctagctggaaaagtgaacctgaaaaattcgactctggttggaaaaccaacacaagaataactgattctggctcgaaaacagatgcagggaaaattgatggaggatggagaagtgacgtcagcgaggagccggtgccccaccggacaatcacgtccttccacgagctggcccagaagcgcaagcggggcccagggctgccccttgtcccgcaggcgaagaaagatcgcagtgactggctcatagtcttctcgcccgacaccgagctccccccctcggggtcgccgggcggctcctcggcacctcctcgggaagtcaccaccttcaaggaactccggtcccgaagccgggccccagccccgccagtcccgcctcgagaccccccagttggctgggctttggtcccgccccggcccccacccccgcctgtccctccccgaaggaagaagaaccgacctggactgcagcccatagcggaggggcagtccgaggagggccgggctgtcagcccagcggctggcgaggaggccccagccgcgaaggagccgggcgcgcaggccggcctggaggtccgtagttcgtggtccttcgccggtgtccccggagcccagcggctgtggatggcagaagcccagagtgggactggtcagctgcaggagcagaagaaaggtcttctgatagccgtcagcgtctccgttgataaaatcatctcgcatttcggggccgcccggaacttggtgcagaaggcccagttgggtgatagccggctgagcccggatgtggggcacctggtgctgaccaccctctgcccggccctccacgccctggtggcggacgggctgaagcctttccggaaggacctcatcaccgggcagcgcaggagcagcccctggagcgtggtggaggcgtcggtgaagccaggctccagcacccgctcccttggaaccctgtatagccaggtcagccgtctagccccgctgagcagcagccgtagccgcttccatgcctttatcctgggcctcctcaacaccaagcagttggagctgtggttttccagtctccaggaagatgcaggcctgctctccctcctgtacctgccaacaggatttttctccctggcccgcggtggttgtccctccctgtccacagagctgctgctcctgctgcagccattgtcggtgctcactttccacctggacctgctctttgagcaccaccaccacctgcccctgggcccacctcaggcccctgcccctccaggcccacctccagctctgcagcagactatgcaagccatgctgcactttgggggccggctggcccagagccttcgggggacttccaaggaagctgcttcagacccctctgactctccaaaccttcccacaccagggagctggtgggagcagttgacccaggcctcccgggtctatgcctctgggggcactgagggctttcctctttcccgatgggcaccggggcgtcatgggactgcagctgaagaaggtgcacaggagagacccctgcccacagatgagatggcaccaggcaggggcctctggttgggaagactatttggagtgcctgggggccccgcagaaaatgagaatggagccctaaagtccaggagaccatctagctggctgcccccgacagtgagtgtgttggctcttgtgaagcggggggcacctcccgagatgccttctcctcaggagcttgaggcctcagcacccaggatggtgcaaacccatagggcagtgcgggctctctgtgatcacactgctgcaagacctgaccagttgagcttccggcgtggggaagtgctgcgtgtcatcaccacagtggatgaggactggctccgctgtgggcgggatggcatggagggtctggtgcctgtggggtatacctcccttgttctgtagccctgggaccctttcctgcgtatgtgtctccttcctgtcacctgggaatggaatggccagtgaacaccatcccagaagcattttccctctgcaaaatgacgtttcttcccacgtctgtttctgctaatatttaaaataaactttccttcttccctcctatacccacctgtaaggtgaaatctgctcttcttccaaatatataaaaaaggaattgccctccaggtaatccctttcctttttcccgtctatataagggaatgtcttccttcctatctatctgcaaaatggaaatctagacctccttcttcatccataagtggactgtgccagtacaatacatgcctcagcccccaagcctagaaggacctctagtctccttcctgtgtggaatcttccccactccatccctcccaagttgcctgtattgataatgtactcactcatgctgtactaggtgctgaagcctggacacccttggtgggtgggcctgtggtgatggtttgcatccttcctcctttgtcccaataaagtatgggagttgaa

SEQ ID NO: 1646 - DNA, 3114 bp, Homo sapiens
gctagtgcccctcccctcccgctctgtgccccgccgggcggggaccgtgggagccgcggacaagcccaaggccggagcggttccaggaggaccctggtctgcacctgtggttgccaggtaggtggatgtgagagaccctacccttctggttctctagaagccatcccatcgccgctagcatcatgctgtcccctcagagagctttactctgcaacctcaaccacatccacctccagcacgtctccctgggcctgcacttgtcccgccgtcctgagctacaggaggggcctttgagcacaccccctcctccaggagacactgggggcaaggagagcaggggcccctgcagtggcaccctggtggacgccaattccaacagcccagctgtgccctgccggtgctgccaggagcacggtccgggcctagaaaaccggcaggacccgtcacaggaggaagagggggctgcctctccctcagacccaggctgctcctcctcactcagctcctgctcagatcttagccccgatgagtcccctgtctcagtctacttgcgggacctccctggtgatgaggatgcccaccctcagcccagtatcatccccctggagcagggctccccactggcttcagcaggccctggcacctgctcaccggacagcttctgctgctctcctgattcctgctccggagcttcttcttcacccgatcctggcctggactcgaactgcaacgccctgaccacctgccaggacgtcccttccccaggcttggaggaagaggacgagagggcggagcaggatctccctacctctgagctcttagaggcggatgatgggaaaatcgacgctgggaaaacggagcccagttggaagattaacccaatttggaaaattgacacagagaaaactaaagctgaatggaaaaccactgaaaacaataacactggttggaaaaacaacgggaatgttaactctagctggaaaagtgaacctgaaaaattcgactctggttggaaaaccaacacaagaataactgattctggctcgaaaacagatgcagggaaaattgatggaggatggagaagtgacgtcagcgaggagccggtgccccaccggacaatcacgtccttccacgagctggcccagaagcgcaagcggggcccagggctgccccttgtcccgcaggcgaagaaagatcgcagtgactggctcatagtcttctcgcccgacaccgagctccccccctcggggtcgccgggcggctcctcggcacctcctcgggaagtcaccaccttcaaggaactccggtcccgaagccgggccccagccccgccagtcccgcctcgagaccccccagttggctgggctttggtcccgccccggcccccacccccgcctgtccctccccgaaggaagaagaaccgacctggactgcagcccatagcggaggggcagtccgaggagggccgggctgtcagcccagcggctggcgaggaggccccagccgcgaaggagccgggcgcgcaggccggcctggaggtccgtagttcgtggtccttcgccggtgtccccggagcccagcggctgtggatggcagaagcccagagtgggactggtcagctgcaggagcagaagaaaggtcttctgatagccgtcagcgtctccgttgataaaatcatctcgcatttcggggccgcccggaacttggtgcagaaggcccagttgggtgatagccggctgagcccggatgtggggcacctggtgctgaccaccctctgcccggccctccacgccctggtggcggacgggctgaagcctttccggaaggacctcatcaccgggcagcgcaggagcagcccctggagcgtggtggaggcgtcggtgaagccaggctccagcacccgctcccttggaaccctgtatagccaggtcagccgtctagccccgctgagcagcagccgtagccgcttccatgcctttatcctgggcctcctcaacaccaagcagttggagctgtggttttccagtctccaggaagatgcagggagctggtgggagcagttgacccaggcctcccgggtctatgcctctgggggcactgagggctttcctctttcccgatgggcaccggggcgtcatgggactgcagctgaagaaggtgcacaggagagacccctgcccacagatgagatggcaccaggcaggggcctctggttgggaagactatttggagtgcctgggggccccgcagaaaatgagaatggagccctaaagtccaggagaccatctagctggctgcccccgacagtgagtgtgttggctcttgtgaagcggggggcacctcccgagatgccttctcctcaggagcttgaggcctcagcacccaggatggtgcaaacccatagggcagtgcgggctctctgtgatcacactgctgcaagacctgaccagttgagcttccggcgtggggaagtgctgcgtgtcatcaccacagtggatgaggactggctccgctgtgggcgggatggcatggagggtctggtgcctgtggggtatacctcccttgttctgtagccctgggaccctttcctgcgtatgtgtctccttcctgtcacctgggaatggaatggccagtgaacaccatcccagaagcattttccctctgcaaaatgacgtttcttcccacgtctgtttctgctaatatttaaaataaactttccttcttccctcctatacccacctgtaaggtgaaatctgctcttcttccaaatatataaaaaaggaattgccctccaggtaatccctttcctttttcccgtctatataagggaatgtcttccttcctatctatctgcaaaatggaaatctagacctccttcttcatccataagtggactgtgccagtacaatacatgcctcagcccccaagcctagaaggacctctagtctccttcctgtgtggaatcttccccactccatccctcccaagttgcctgtattgataatgtactcactcatgctgtactaggtgctgaagcctggacacccttggtgggtgggcctgtggtgatggtttgcatccttcctcctttgtcccaataaagtatgggagttg

SEQ ID NO: 1647 - DNA, 1513 bp, Homo sapiens
gaagtgggggaggaggaggaggagttggaaggggaggaggaagagggggagcaggaagaggggcagaaggaagaagaagagggggaggagaaagagatagaagagtaagaggagggggaagaaagacaaggggaaggggaggaggaggaggacggggaggagcttcgccgcggcctgctccgcccagccggggtcggtggccgcatggcttcggtctcctctgcgaccttctcgggccacggggctcggtccctactgcagttcctgcggctggtagggcagctcaagagagtcccacgaactggctgggtatacagaaatgtccagaggccggagagcgtttcagatcacatgtaccggatggcagttatggctatggtgatcaaagatgaccgtcttaacaaagaccgagaagctatgaagcagataacccagctcctaccagaggacctcagaaaggagctctatgaactttgggaagagtacgagacccaatctagtgcagaagccaaatttgtgaagcagctagaccaatgtgaaatgattcttcaagcatctgaatatgaagaccttgaacacaaacctgggagactgcaagacttctatgattccacagcaggaaaattcaatcaccctgagatagtccagcttgtttctgaacttgaggcagaaagaagcactaacatagctgcagctgccagtgagccacactcctgagacactctctaaattgctgcactcctgtaacaaacattatttttccatttcattgtattgtgttttgccattgttggtctgttgatttccctagatgtgagtctgtttgttttcaattgtctgaacttcagcaagaaatgtgatacaacttgggcactaaaagaagccacagaacaggaagcggtcatgaaagtgccatggatgaacactggaggtggcagtgcctgtttatgaactaaataaataaatattaaacacctaaaatattagaatatttattggagatttaaaatcatcttattctgacttaattaccgatatccccgaaggctaggttcattgaataatagaaaatttcattatgattgcttttaagaacagattcttcagctgatttagtgataagaatccagaaaagaaaatgtactagtgatgtattctctccccagatgaaattgctgccttattcagatttactctcttgagccagattttgaatttcactgcagactgcttcagacttctaatcataggcttgtaaacctactaataggctctgcccctcttcccaatactttttgtcatttagagatataaaccggggcatataaaaatgcaacttgtattcctttgtatatttttccctgtctgacttataaatcttgagacctttattgtaaaagcatgtatcatcaggtgagaaatataaataggaactggggtcattgagcctcaggtagggaatatatcaacccgatttcttcctctcttttcccttttataggataaataatcc

SEQ ID NO: 1648 - DNA, 2147 bp, Homo sapiens
aggtaaccagaagcggctagtggcggctgcctgcgtccccaaccccctccgcgcagcgctcgcgacacgcgtgccaggagtgggagcgagcggcggggccagctgcgttctgagcctgggcgcagctgccatctgctctgggaagcaccagggtgtccccgccgccctcagctcgaagtcagccaccatggaggcgcaggcacaaggtttgttggagactgaaccgttgcaaggaacagacgaagatgcagtagccagtgctgacttctctagcatgctctctgaggaggaaaaggaagagttaaaagcagagttagttcagctagaagacgaaattacaacactacgacaagttttgtcagcgaaagaaaggcatctagttgagataaaacaaaaactcggcatgaacctgatgaatgaattaaaacagaacttcagcaaaagctggcatgacatgcagactaccactgcctacaagaaaacacatgaaaccctgagtcacgcagggcaaaaggcaactgcagctttcagcaacgttggaacggccatcagcaagaagttcggagacatgagacgaaagtaggcggtacgaaccctaatggaggcagttttgaggaggtcctcagctccacggcccatgccagtgcccagagcttggcaggaggctcccggcggaccaaggaggaggagctgcagtgctaagtccagccagcgtgcagctgcatccagaaaccggccactacccagcccatctctgcctgtgcttatccagataagaagaccaaaatcccgctgggaaaaacccaggccttgacattgttattcaaatggcccctccagaaagtttaatgatttccatttgtatttgtgttgatgatggaccacttgaccatcacatttcagtattcatagatgactgtcacattttaaaatgttcccacttgagcaggtacacaactggtcataattcctgtctgtgtaattcgatgtatatttttccaaacatgtagctattgtttgctttgatttttgcttggcctcctttatgatgtgcatgtccttgaaggctgaatgaacagtccctttcagttcagcagatcaacaggatggagctcttcatgactgtctccagcaataggatgatttactataaatttcatccaactacttgtgatctctctcacctacatcaattatgtatgttaatttcagcaattaaaagaattgattttaatgactttgaattcttaatttctttgtcttaaaagttgctagttatgattttacagatgcaattttaaatcaacttttagccaggtgcggcggctcacacctgtaatcccaactattttggatgccaaggtgagaggattgcttgaggccaggagttaaagatcagcctgggcaacacagaccctgtctctacaaaaaaagaaaaaaattagccagacatagtgttgcttgcctgtagtcccagctactctagaggctgaggcaggaggattgcatgagcctaggagttcgaaactgcagtgagctatgattgcaccactgcactactccagcctgggtgacagagtgggacactgtctccaaaaatagtaataataagtagtcaacttttactgctaatttggtgaacatgagagaggatatgaaaataaatattacctcagctatcctaggatgttaaaataatctccaattttaaaattctctccaatctacatacagtagtagttagtcagataaaggatatccaaaaaagagatagctagaaaatgggagaagcagagttctgcaacccctttcagtttgtaaattgttcacatgtatgaaaataactggtatttatcaatccactcagatttctgcactaacttttatcttatatatcatatgtatctcttttctttttctaaatgggaacatatatttgttattaggtggcagagatatagccttaagatatatttgtaaaatgcacactgaatagacatccaacctaaaaaaaatcactatttaaaaagcccatataatatatacatatttgttagcatgctaattgttcatgttttgtgtttattaaatagaagtgatatatatgacattttgaagtaaagcacatctgaaaaattctactcaaa

SEQ ID NO: 1649 - DNA, 1308 bp, Homo sapiens
ttggtttgggccaggtggactggaaggggcggaggtaaccagaagcggctagtggcggctgcctgcgtccccaaccccctccgcgcagcgctcgcgacacgcgtgccaggagtgggagcgagcggcggggccagctgcgttctgagcctgggcgcagctgccatctgctctgggaagcaccagggtgtccccgccgccctcagctcgaagtcagccaccatggaggcgcaggcacaaggtttgttggagactgaaccgttgcaaggaacagacgaagatgcagtagccagtgctgacttctctagcatgctctctgaggaggaaaaggaagagttaaaagcagagttagttcagctagaagacgaaattacaacactacgacaagttttgtcagcgaaagaaaggcatctagttgagataaaacaaaaactcggcatgaacctgatgaatgaattaaaacagaacttcagcaaaagctggcatgacatgcagactaccactgcctacaagaaaacacatgaaaccctgagtcacgcagggcaaaaggcaactgcagctttcagcaacgttggaacggccatcagcaagaagttcggagacatgagttactccattcgccattccataagtatgcctgctatgagacgaaagtaggcggtacgaaccctaatggaggcagttttgaggaggtcctcagctccacggcccatgccagtgcccagagcttggcaggaggctcccggcggaccaaggaggaggagctgcagtgctaagtccagccagcgtgcagctgcatccagaaaccggccactacccagcccatctctgcctgtgcttatccagataagaagaccaaaatcccgctgggaaaaacccaggccttgacattgttattcaaatggcccctccagaaagtttaatgatttccatttgtatttgtgttgatgatggaccacttgaccatcacatttcagtattcatagatgactgtcacattttaaaatgttcccacttgagcaggtacacaactggtcataattcctgtctgtgtaattcgatgtatatttttccaaacatgtagctattgtttgctttgatttttgcttggcctcctttatgatgtgcatgtccttgaaggctgaatgaacagtccctttcagttcagcagatcaacaggatggagctcttcatgactgtctccagcaataggatgatttactataaatttcatccaactacttgtgatctctctcacctacatcaattatgtatgttaatttcagcaattaaaagaattgattttaatga

SEQ ID NO: 1650 - DNA, 1175 bp, Homo sapiens
ctgcaacaagttaagctgaagaccgaagcaagagctggttcaggtggcagccacagcagcctcagggacctcagcaactatggcctcctgcccagactctgataatagctgggtgcttgctggctccgagagcctgccagtggagacactgggcccggcatccaggatggacccagaatctgagagagccctgcaggcccctcacagcccctccaagacagatgggaaagaattagctgggaccatggatggagaagggacgctcttccagactgaaagccctcagtctggcagcattctaacagaggagactgaggtcaagggcaccctggaaggtgatgtttgtggtgtggagcctcctggcccaggagacacagtagtccagggagacctgcaggagaccaccgtggtgacaggcctgggaccagacacacaggacctggaaggccagagccctccacagagcctgccttcaacccccaaagcagcttggatcagggaggagggccgctgctccagcagtgacgatgacaccgacgtggacatggagggtctgcggagacggcggggccgggaggccggcccacctcagcccatggtgcccctggctgtggagaaccaggctgggggtggcctctcagagtctgagactgggcccatggaggaagtggagcggcaggtcctcccagaccccgaggtgctggaagctgtgggggacaggcaggatgggctaagggaacagctgcaggccccagtgcctcctgacagtgtccccagcctgcaaaacatgggtcttctgctggacaagctggccaaggagaaccaggacatccggctgctgcaggcccagctgcaggtgggcacaggcaggaggggctgggctagggtaacccacctaggccaggcgtctgtcctagcatcctcccccaaaaggaatgtttcctatttacccacacatcctgaccctcccctctcccactatagtcagggcgtcttcccagttcttggttcacatcccttgtgctaaggtttgggccagggctggcatacctgttccacatggtacatgaaacatacatggtatcacctgtgattgattggtgtggtctgcctggagcactgtgtggaaaaggatttaaagaacatgccaggtgccatgatcagttaacactgtt

SEQ ID NO: 1651 - DNA, 3212 bp, Homo sapiens
aagttaagctgaagaccgaagcaagagctggttcaggtggcagccacagcagcctcagggacctcagcaactatggcctcctgcccagactctgataatagctgggtgcttgctggctccgagagcctgccagtggagacactgggcccggcatccaggatggacccagaatctgagagagccctgcaggcccctcacagcccctccaagacagatgggaaagaattagctgggaccatggatggagaagggacgctcttccagactgaaagccctcagtctggcagcattctaacagaggagactgaggtcaagggcaccctggaaggtgatgtttgtggtgtggagcctcctggcccaggagacacagtagtccagggagacctgcaggagaccaccgtggtgacaggcctgggaccagacacacaggacctggaaggccagagccctccacagagcctgccttcaacccccaaagcagcttggatcagggaggagggccgctgctccagcagtgacgatgacaccgacgtggacatggagggtctgcggagacggcggggccgggaggccggcccacctcagcccatggtgcccctggctgtggagaaccaggctgggggtgagggtgcaggcggggagctgggcatctccctcaacatgtgcctccttggggccctggttctgcttggcctgggggtcctcctcttctcaggtggcctctcagagtctgagactgggcccatggaggaagtggagcggcaggtcctcccagaccccgaggtgctggaagctgtgggggacaggcaggatgggctaagggaacagctgcaggccccagtgcctcctgacagtgtccccagcctgcaaaacatgggtcttctgctggacaagctggccaaggagaaccaggacatccggctgctgcaggcccagctgcaggcccaaaaggaagagcttcagagcctgatgcaccagcccaaagggctagaggaggagaatgcccagctccggggggctctgcagcagggcgaagccttccagcgggctctggagtcagagctgcagcagctgcgggcccggctccaggggctggaggccgactgtgtccggggcccagatggggtgtgcctcagtgggggtagaggcccacagggtgacaaggccatcagggagcaaggccccagggagcaggagccagaactcagcttcctgaagcagaaggaacagctggaggctgaggcacaggcattaaggcaagagttagagaggcagcgacggctgctggggtctgtacagcaggatctggagaggagcttgcaggatgccagccgcggggacccagctcatgctggcttggctgagctgggccacagattggcccagaaactgcagggcctggagaactggggccaggaccctggggtctctgccaatgcctcaaaggcctggcaccagaagtcccacttccagaattctagggagtggagtggaaaggaaaagtggtgggatgggcagagagaccggaaggctgagcactggaaacataagaaggaagaatctggccgggaaaggaagaagaactggggaggtcaggaggacagggagccagcaggaaggtggaaggagggcaggccaagggtggaggagtcggggagcaagaaggagggcaagcgacagggcccgaaggaacccccaaggaaaagtggtagcttccactcctctggagaaaagcagaagcaacctcggtggagggaagggactaaggacagccatgaccccctgccatcctgggcagagctgttgaggcccaagtaccgggcaccccagggctgctcaggtgtggacgagtgtgcccggcaggagggcctgactttctttggcacagagctagccccagtgcggcaacaggagctggcctctctgctaagaacatacttggcacggctgccctgggctgggcagctgaccaaggagctacccctctcacctgctttctttggtgaggatggcatcttccgtcatgaccgcctccgcttccgggattttgtggatgccctggaggacagcttggaggaggtggctgtgcaacagacaggtgatgatgatgaagtagatgactttgaggacttcatcttcagccacttctttggagacaaagcactgaagaagaggtcagggaagaaggacaagcactcacagagcccaagagctgcggggcccagggaggggcacagccatagccaccaccaccaccaccggggctgacaccctgccccacagggaatggccttggcctggcccagcccaagatcccagcgttatctaactcctggagggtggactctgtcctggcttgtttggtgtcctcagatatctttcacacagtagagcaaaatcaccagccctgcactgatgtcactttatgtagaaaaaggccttagctggacctgcgttgccgtctatgcaaatgcatgcaaatactccaggccctgggatgtgggcttgtgttttgtcactgtgaagggggagatgggagaggagcctgttttggggtggggtctggggaaggcaatctgattctgaagctaaagagctttcatcctcttgagtgtatgtccccatagtgggccccttgacccacatgctgaccggtgccttgggatttgactagagttgctggctcgaggcccagcacgaggacttaccctggggttttgttaggtttggaagcagctgtccctagggggtgaagtcccccccctttttttttttacccctgcttctcccacggcttcacctccctatgtgaactgtagactcagatcccaataaagtgctgttgcagctatgatgctaggtggtttctaagcacaggggacaccccacaccccctgcctgaatggatgggtccatcccaggcactggtacttgcccccttgttctgtatccccctttgcccttgccttgcccttccaacaaaccctaggcccttgagaagctgatacttctccttttgctcacagctgccttggccccacccctgggagatgtagcaaattgagtgtgggttttggagtctgagcctcaggctcaaatccaggccaagtgatcttgggcaagttaatctctgggaactttgggtttcttatcctcaaaaaaggcgatggaagggctggggaagtgattaaataaaagcaacgcaagaaaaa

SEQ ID NO: 1652 - DNA, 3144 bp, Homo sapiens
aaagggaagcctgcaacaagttaagctgaagaccgaagcaagagctggttcagcctgccagtggagacactgggcccggcatccaggatggacccagaatctgagagagccctgcaggcccctcacagcccctccaagacagatgggaaagaattagctgggaccatggatggagaagggacgctcttccagactgaaagccctcagtctggcagcattctaacagaggagactgaggtcaagggcaccctggaaggtgatgtttgtggtgtggagcctcctggcccaggagacacagtagtccagggagacctgcaggagaccaccgtggtgacaggcctgggaccagacacacaggacctggaaggccagagccctccacagagcctgccttcaacccccaaagcagcttggatcagggaggagggccgctgctccagcagtgacgatgacaccgacgtggacatggagggtctgcggagacggcggggccgggaggccggcccacctcagcccatggtgcccctggctgtggagaaccaggctgggggtgagggtgcaggcggggagctgggcatctccctcaacatgtgcctccttggggccctggttctgcttggcctgggggtcctcctcttctcaggtggcctctcagagtctgagactgggcccatggaggaagtggagcggcaggtcctcccagaccccgaggtgctggaagctgtgggggacaggcaggatgggctaagggaacagctgcaggccccagtgcctcctgacagtgtccccagcctgcaaaacatgggtcttctgctggacaagctggccaaggagaaccaggacatccggctgctgcaggcccagctgcaggcccaaaaggaagagcttcagagcctgatgcaccagcccaaagggctagaggaggagaatgcccagctccggggggctctgcagcagggcgaagccttccagcgggctctggagtcagagctgcagcagctgcgggcccggctccaggggctggaggccgactgtgtccggggcccagatggggtgtgcctcagtgggggtagaggcccacagggtgacaaggccatcagggagcaaggccccagggagcaggagccagaactcagcttcctgaagcagaaggaacagctggaggctgaggcacaggcattaaggcaagagttagagaggcagcgacggctgctggggtctgtacagcaggatctggagaggagcttgcaggatgccagccgcggggacccagctcatgctggcttggctgagctgggccacagattggcccagaaactgcagggcctggagaactggggccaggaccctggggtctctgccaatgcctcaaaggcctggcaccagaagtcccacttccagaattctagggagtggagtggaaaggaaaagtggtgggatgggcagagagaccggaaggctgagcactggaaacataagaaggaagaatctggccgggaaaggaagaagaactggggaggtcaggaggacagggagccagcaggaaggtggaaggagggcaggccaagggtggaggagtcggggagcaagaaggagggcaagcgacagggcccgaaggaacccccaaggaaaagtggtagcttccactcctctggagaaaagcagaagcaacctcggtggagggaagggactaaggacagccatgaccccctgccatcctgggcagagctgttgaggcccaagtaccgggcaccccagggctgctcaggtgtggacgagtgtgcccggcaggagggcctgactttctttggcacagagctagccccagtgcggcaacaggagctggcctctctgctaagaacatacttggcacggctgccctgggctgggcagctgaccaaggagctacccctctcacctgctttctttggtgaggatggcatcttccgtcatgaccgcctccgcttccgggattttgtggatgccctggaggacagcttggaggaggtggctgtgcaacagacaggtgatgatgatgaagtagatgactttgaggacttcatcttcagccacttctttggagacaaagcactgaagaagaggtcagggaagaaggacaagcactcacagagcccaagagctgcggggcccagggaggggcacagccatagccaccaccaccaccaccggggctgacaccctgccccacagggaatggccttggcctggcccagcccaagatcccagcgttatctaactcctggagggtggactctgtcctggcttgtttggtgtcctcagatatctttcacacagtagagcaaaatcaccagccctgcactgatgtcactttatgtagaaaaaggccttagctggacctgcgttgccgtctatgcaaatgcatgcaaatactccaggccctgggatgtgggcttgtgttttgtcactgtgaagggggagatgggagaggagcctgttttggggtggggtctggggaaggcaatctgattctgaagctaaagagctttcatcctcttgagtgtatgtccccatagtgggccccttgacccacatgctgaccggtgccttgggatttgactagagttgctggctcgaggcccagcacgaggacttaccctggggttttgttaggtttggaagcagctgtccctagggggtgaagtcccccccctttttttttttacccctgcttctcccacggcttcacctccctatgtgaactgtagactcagatcccaataaagtgctgttgcagctatgatgctaggtggtttctaagcacaggggacaccccacaccccctgcctgaatggatgggtccatcccaggcactggtacttgcccccttgttctgtatccccctttgcccttgccttgcccttccaacaaaccctaggcccttgagaagctgatacttctccttttgctcacagctgccttggccccacccctgggagatgtagcaaattgagtgtgggttttggagtctgagcctcaggctcaaatccaggccaagtgatcttgggcaagttaatctctgggaactttgggtttcttatcctcaaaaaaggcgatggaagggctggggaagtgattaaataaaagcaacgcaagaaaaatgcc

SEQ ID NO: 1653 - DNA, 7118 bp, Homo sapiens
gcctatcatttgaagacgttccttgaggaggtttgaaaaaaaacagctgacccttggctaacattacatgatttggagaaataattggaagtctaccacagggagactaaatgtaaaactccaatcagataaattacaacacggatgtggcccagattattcatcagcatggctacctgctaatgaatcattgtggcaggccacaactgttccatctaaccatcgaaataaccatatcaggagacacagtatagcttctgacagtggagacactggcattggaacttcctgttctgatagcgtggaagatcattcaacttcaagtggcacattatcttttaagcctagtcaatcattgattactcttcctactgcccatgtgatgccgtctaattccagcgcttcaatttccaaacttagggaatcattgacaccagatggctcaaaatggagtacaagcctcatgcaaacattgggaaaccacagtaggggggagcaggactcttccctagacatgaaggacttccggccacttcggaaatggtcatctttatccaaactcactgccccggataactgtggccagggtggcactgtatgcagagaagagtcaaggaatggtttggagaagatagggaaggctaaggctttaacatcacaactgaggacaattgggcctagctgtttacatgatagtatggagatgcttaggttagaggacaaggaaataaataaaaaacggtcatcaactctggactgcaagtataaatttgagagctgtagcaaggaggactttagagcctcttcctctactcttaggagacagcctgtagacatgacatatagtgccttacctgaaagcaagcccattatgacaagctcagaggcttttgaacctccaaaatatttaatgcttggtcaacaggcagtaggtggagttcccattcagccttccgtaaggactcagatgtggcttacagagcagctgcggacaaatcctttggaaggtagaaatacagaggattcttacagtttagctccttggcaacagcagcaaattgaagactttcgacaaggaagtgaaacaccaatgcaggttttgactggatcatctcgtcaaagttattcacctggctatcaggatttcagtaagtgggaatcaatgttgaaaataaaagaaggacttctaaggcagaaagaaattgtaatcgatcggcagaagcaacaaattacccacctgcatgagaggataagggataatgaattacgggctcaacatgccatgttaggacattatgtaaattgtgaggattcttatgtggctagtttgcagccacaatatgagaacacttcactccagacaccattttcagaggaatcagtttcccattcccaacaaggggaatttgagcaaaagcttgcatctactgagaaagaagttttacagcttaatgagtttctcaaacaaagactaagcctatttagtgaagagaagaagaaactagaggaaaaacttaaaactagagatcgatacatcagtagtctgaaaaagaaatgccagaaggaatctgaacaaaacaaagaaaagcagagaagaattgagaccttggaaaagtatctggctgatcttccaactctagatgatgtacagagtcagagtctacagctgcagattctggaagaaaaaaataagaatttacaagaggctttgatagatacagaaaaaaaacttgaagagatcaaaaagcagtgtcaagataaagagacacagttaatatgccagaaaaagaaagaaaaggagttagtaactaccgttcagagtttgcaacaaaaagtagaaagatgccttgaagatggaatccgccttcccatgttagatgcaaaacagcttcagaatgaaaatgataatctcagacaacaaaatgagactgctagtaagataatagacagccaacaagatgagattgacagaatgattttagaaattcagtctatgcaaggaaagctttctaaagagaaactgaccactcaaaagatgatggaagagctggaaaagaaagaaagaaatgtacagagattaacaaaagcattgcttgaaaaccaaagacaaacagatgagacatgctctttattggatcagggccaggaacctgaccaatctaggcagcagacagttctttccaaacggccactatttgatttgactgtgattgatcagctgttcaaggaaatgtcctgttgtttgtttgacttgaaagcattgtgtagtattcttaatcagcgtgctcagggcaaggagcctaatctttcattattactgggaataagatcaatgaactgttcagctgaagagactgagaatgaccacagcacagaaacactcactaaaaagctgtcagatgtgtgccagttacgaagagacattgatgaattaaggactacaatatcagaccgctatgctcaggacatgggagacaactgcattactcagtgatcaagtgttagtcccacagcaataatgacctgttgtttaaatgctgctgtgttatggagccataatggaaggttgcaagtgacatgacttgcacttagggattttttttctgtggatttgttttgttgaaggggagaagggaagtgaagagattttgaaggggcttatctaatcaggcaaaaagaaaaaaaatcaaattacctttggaaaatatgataaaatctacaaggaaaaaaatgtctatattctcaaactactgattgtaggaccaagctgtgaagagtacccttcacatgaaggagtaggattccttttaatcctatagctttgtgtgtttgtgtgtgcatgtatgtgtgttgttgtgtgtgtgtgcacgtgctttattcacaaatttataagggtttctagggtcagagcagagcttctgagaaaggcacacgctgtttattcttatatttctttcatatagaagcttgtgttgtactttgggattttcagtggctggctgaacaagagttcaaacagcaggcaagtgttgtcatggtagtacaggaggcaaaaccatttatattttgaacacttactgcactgataggatgtttgtggttgagctgattttagtactgtagataggtcagctgtttttccagagtgattgtggatttcccaagaggtgtgaaattttgacgtgatgctctttttccttagcattgtaatgtatgtgttacaagaaaggttaacataacttgaactaattttaacatgttccttactatttacaattttttatttatatgttttatatatatacatatataaatgtaaacaaagccatatataattaataaaggcattggatcattattataaaaggaagattaacaaagttaccctggaacaatagcttacttatccaaatctcaacatttacattttaacagttttgtatgtttcaaagttgaaactactgtaagagaaagccaatactatttatatctgaatcaacagtagcataaacattttttaattgagattgtattttaatcccttttgttaaagtacattaacaacagtttttcacaggatatgaacttggcgaaattagttcttaatctgaattacagggtattactatgaaatgcagttgattttgcagtagacgtacagtcatttaaacttccaaatgagtgttgtccatgtttctgttggtattttggaaggattatacattttattgccttcagcattgattatgttcttttgaatatacttagttttggcgaaagccttgtcctttgtaagttggtttgatcttgtgatgcaaccaagtctcatttaggtcaagactaaataagagatggaggggtagagggtgtgactcaagcaggataatattgatttgataaagagcatatcacatgcctgttttcttgccagataaagggcatagcacatgcctgttttcttatatactagaataaaggctctcctaggaaagatttttcttaaatatttaaaagtgaaaatgtgagacaaggccttcaaggagactacccaggaagatacacagtttaaaatgttggctatacagctctcaatagattattttatagttatagttgaataatcagttataatacactgtaaagaaatcagattttccttctgtttggtgtctgagtccttcctgctcttcttacttctgagaatctgggcactaagaaatcagtaagtacattgtagtgctcctgcatcccagagtccttaacctaaggagggtcttagtcactggtaagaacttggctttctaattatattcacttggtttttaacattagtagcttgacgataatcagggtatagtaaatttccaccaaaaatgtgatgcgaagaattctgccttggtcctttatggtaaaacagataataacgtctaaaatagatcagccacaagtgcagcaaatatttttacactctctttgaatagaatcccaaccaccctcccccatgattttagaaataaaggcttcctaaaataatagaacaaattggcaaacaatcactaattggaccagtaggttcttacttaaatatctctcctagatttttagtgtatgttttgggattttatgggtttatttatttttttttttttaagcagacgttacagtttgttttaatctactatagatacgtttttgttttttggcttagttggggataaaataatttatttgtaagttagctttctaaaacttagagaaagtaatttaattcacgtatcttaaaaataaaattccaaagttaaaaaatttctgacttagtaggaagttaacaaaactactgctgatgcatttcagtttccaaaatctgtaccctccccccataaaaaagggagttaagatgtgctagtttaagtagttagctgaattatagattgatcctcttaaaatctggagtttgtaaaggggcctacataaacagtagatagacttggagggattttgtgggggaattgaaactaatagtattctatctagtttgtcagtatttactttttgatttttatttttcagaaaattttcctttcccaggacaccctcttgtattagaatatcctcttctgtatcacattaaaaacagattttactgttagaccaaataagatgggcaaatagcaacactagagcatctcacccagtttgaactaggatgttcgtggaagttatgacaccaatatattcctgaaatgaaaattaacctaaattttaaagtgaatctatttgaaaatttacttagataatgaaacctcgttttaattgtgctttttgtgaatccaacacttgtttgcttagaaagtatcttatccagtattaatattttgttcttttgggttttaaagttgagcttattcagcctcaatcacattacagcaagcataaagtaacagttgactcaatgaaagacccaaattgcctgtacagataaaattcactgaatcaaaggcacaatagctatcttttcacttgagctcagaaaagtaaaatggcttaatttgaactattaattttcagtggcctctaattaaacaaaaacaaaaaaccacaaatactggctaggtaagatattcctgaggtcattttaaaagaagtgtggcacctaggattcaatatttaatgctaacagtattatattttagtgaaatttattttggtggtgacagtttattaaacctaattagacttctttcaatagcttgttgtagagacaatctcaagggctggaaagtgttgctaaaatgaatgtcatacatttctgatatactaaggagcttataaagtaattctttcatagtgcaagaattattaatttcttagaggatgtttttaaaggagctacttaattgggaaaatgttctttaaatatcagtaatagttcattaagtaacatagtagctaagaacatggactatattttcacagcatagttcagcttaggcacacctttagtttggattattggcattctcttacgtaggaattatatcattgtagatatgtaattatggtaataagcaattttcataaccatgctcactcagactatatcatttgaaactgccatgtttccatttttgacaattcatgttcacaaaacaacaggaacaatttcctatttggtataaagagcaaaatttccaactttgccccaaaatgccatgggtggcatattgccatatgattatatcatatatttaatcatgtatgggaaagattttggattttttttcttatttaaaaaagtgctaaatataagaatatagttttaaatcagcaagtctaataacactattgcagctgtacacagagagaaccttttgtgcctttttgcctgcagtaagcatttatttctattttacatgagttctaagaatgttgatgattattgcaccttgttcttctgtatataaacttgattaaggaatttttttttttaaagcaaggagccgttttttgttactaggtggataccttagtaaacatgaggggaattatcagatagatgtctttggagcccagccttccctgtgtagtgagctggaaactcctttagattgtattcattggtgtgtatgtatatgtacatatatgtataaatagttaaatacataaacataaaacttaacatcgcattgttgtgatgacaagaagtagtaaggtgctaggtggttacattaaaaagcacagcacagtgtataatcagtcactatgactggtggttttgtaagctgggttcagtttttgaaccacccagaatacctcatgtgtaaatacagtgttcatgacttaattgaaatacagttattgtttaaaaaaaaaaaaaaagaatgtgaagccactggttggcttatgccttctgatctatcattcttgcctctttttttgtaaaggggttttcttcttgttgttctgttttttaatagggtttacagctagaattttgaatgccaaagttctatttattaaattaagaaaaaagttttcaatgttaatggctagtatttttccactggactattgtttgttgatgttggaatttgtatttacagagaaataaatttttt

SEQ ID NO: 1654 - DNA, 7673 bp, Homo sapiens
gggagggcgtgagggattacccaagggaggggcgagtatcgcaaaataggccaagtcgctgccctctactcaactcgcagggcgggaggatggagacagagggatgcggcgggagggcgggacagcccagtcgccgccaaggaggcgaagcggggtcggggtagctcacccgccccccgcagtccccgccccccgcagtccccgccccgcgcggcgccgcgcacgcctgaagtcattgcccgaggccccgccccctcgcggccccagccccggctctggctctgccggcggagggggcggagagaacccgcagctgcaacttcgcctggagcctttgagcctgggctcagccggggatctagcagccgtcaccgccgagtcgccgcttccccggcgcgggcctcagcccagccggcttggccatggcaggcgccggcagtgcggcgaatctggcccctgcgctccccgcccgtagctgagcagccgttaaccagccatcccgcctttcctcctgcccgtgtcgccgaggcccacgctccgcgcaagtttccgccgccgaagaagcaggaggacggacgtgaggagtcgggcgtccctggcccacccggccctctcgcccgcgatgtgggggcgcttcctggctccggaggccagcggccgggatagccccggcggagcccgcagcttccctgccggcccagattattcatcagcatggctacctgctaatgaatcattgtggcaggccacaactgttccatctaaccatcgaaataaccatatcaggagacacagtatagcttctgacagtggagacactggcattggaacttcctgttctgatagcgtggaagatcattcaacttcaagtggcacattatcttttaagcctagtcaatcattgattactcttcctactgcccatgtgatgccgtctaattccagcgcttcaatttccaaacttagggaatcattgacaccagatggctcaaaatggagtacaagcctcatgcaaacattgggaaaccacagtaggggggagcaggactcttccctagacatgaaggacttccggccacttcggaaatggtcatctttatccaaactcactgccccggataactgtggccagggtggcactgtatgcagagaagagtcaaggaatggtttggagaagatagggaaggctaaggctttaacatcacaactgaggacaattgggcctagctgtttacatgatagtatggagatgcttaggttagaggacaaggaaataaataaaaaacggtcatcaactctggactgcaagtataaatttgagagctgtagcaaggaggactttagagcctcttcctctactcttaggagacagcctgtagacatgacatatagtgccttacctgaaagcaagcccattatgacaagctcagaggcttttgaacctccaaaatatttaatgcttggtcaacaggcagtaggtggagttcccattcagccttccgtaaggactcagatgtggcttacagagcagctgcggacaaatcctttggaaggtagaaatacagaggattcttacagtttagctccttggcaacagcagcaaattgaagactttcgacaaggaagtgaaacaccaatgcaggttttgactggatcatctcgtcaaagttattcacctggctatcaggatttcagtaagtgggaatcaatgttgaaaataaaagaaggacttctaaggcagaaagaaattgtaatcgatcggcagaagcaacaaattacccacctgcatgagaggataagggataatgaattacgggctcaacatgccatgttaggacattatgtaaattgtgaggattcttatgtggctagtttgcagccacaatatgagaacacttcactccagacaccattttcagaggaatcagtttcccattcccaacaaggggaatttgagcaaaagcttgcatctactgagaaagaagttttacagcttaatgagtttctcaaacaaagactaagcctatttagtgaagagaagaagaaactagaggaaaaacttaaaactagagatcgatacatcagtagtctgaaaaagaaatgccagaaggaatctgaacaaaacaaagaaaagcagagaagaattgagaccttggaaaagtatctggctgatcttccaactctagatgatgtacagagtcagagtctacagctgcagattctggaagaaaaaaataagaatttacaagaggctttgatagatacagaaaaaaaacttgaagagatcaaaaagcagtgtcaagataaagagacacagttaatatgccagaaaaagaaagaaaaggagttagtaactaccgttcagagtttgcaacaaaaagtagaaagatgccttgaagatggaatccgccttcccatgttagatgcaaaacagcttcagaatgaaaatgataatctcagacaacaaaatgagactgctagtaagataatagacagccaacaagatgagattgacagaatgattttagaaattcagtctatgcaaggaaagctttctaaagagaaactgaccactcaaaagatgatggaagagctggaaaagaaagaaagaaatgtacagagattaacaaaagcattgcttgaaaaccaaagacaaacagatgagacatgctctttattggatcagggccaggaacctgaccaatctaggcagcagacagttctttccaaacggccactatttgatttgactgtgattgatcagctgttcaaggaaatgtcctgttgtttgtttgacttgaaagcattgtgtagtattcttaatcagcgtgctcagggcaaggagcctaatctttcattattactgggaataagatcaatgaactgttcagctgaagagactgagaatgaccacagcacagaaacactcactaaaaagctgtcagatgtgtgccagttacgaagagacattgatgaattaaggactacaatatcagaccgctatgctcaggacatgggagacaactgcattactcagtgatcaagtgttagtcccacagcaataatgacctgttgtttaaatgctgctgtgttatggagccataatggaaggttgcaagtgacatgacttgcacttagggattttttttctgtggatttgttttgttgaaggggagaagggaagtgaagagattttgaaggggcttatctaatcaggcaaaaagaaaaaaaatcaaattacctttggaaaatatgataaaatctacaaggaaaaaaatgtctatattctcaaactactgattgtaggaccaagctgtgaagagtacccttcacatgaaggagtaggattccttttaatcctatagctttgtgtgtttgtgtgtgcatgtatgtgtgttgttgtgtgtgtgtgcacgtgctttattcacaaatttataagggtttctagggtcagagcagagcttctgagaaaggcacacgctgtttattcttatatttctttcatatagaagcttgtgttgtactttgggattttcagtggctggctgaacaagagttcaaacagcaggcaagtgttgtcatggtagtacaggaggcaaaaccatttatattttgaacacttactgcactgataggatgtttgtggttgagctgattttagtactgtagataggtcagctgtttttccagagtgattgtggatttcccaagaggtgtgaaattttgacgtgatgctctttttccttagcattgtaatgtatgtgttacaagaaaggttaacataacttgaactaattttaacatgttccttactatttacaattttttatttatatgttttatatatatacatatataaatgtaaacaaagccatatataattaataaaggcattggatcattattataaaaggaagattaacaaagttaccctggaacaatagcttacttatccaaatctcaacatttacattttaacagttttgtatgtttcaaagttgaaactactgtaagagaaagccaatactatttatatctgaatcaacagtagcataaacattttttaattgagattgtattttaatcccttttgttaaagtacattaacaacagtttttcacaggatatgaacttggcgaaattagttcttaatctgaattacagggtattactatgaaatgcagttgattttgcagtagacgtacagtcatttaaacttccaaatgagtgttgtccatgtttctgttggtattttggaaggattatacattttattgccttcagcattgattatgttcttttgaatatacttagttttggcgaaagccttgtcctttgtaagttggtttgatcttgtgatgcaaccaagtctcatttaggtcaagactaaataagagatggaggggtagagggtgtgactcaagcaggataatattgatttgataaagagcatatcacatgcctgttttcttgccagataaagggcatagcacatgcctgttttcttatatactagaataaaggctctcctaggaaagatttttcttaaatatttaaaagtgaaaatgtgagacaaggccttcaaggagactacccaggaagatacacagtttaaaatgttggctatacagctctcaatagattattttatagttatagttgaataatcagttataatacactgtaaagaaatcagattttccttctgtttggtgtctgagtccttcctgctcttcttacttctgagaatctgggcactaagaaatcagtaagtacattgtagtgctcctgcatcccagagtccttaacctaaggagggtcttagtcactggtaagaacttggctttctaattatattcacttggtttttaacattagtagcttgacgataatcagggtatagtaaatttccaccaaaaatgtgatgcgaagaattctgccttggtcctttatggtaaaacagataataacgtctaaaatagatcagccacaagtgcagcaaatatttttacactctctttgaatagaatcccaaccaccctcccccatgattttagaaataaaggcttcctaaaataatagaacaaattggcaaacaatcactaattggaccagtaggttcttacttaaatatctctcctagatttttagtgtatgttttgggattttatgggtttatttatttttttttttttaagcagacgttacagtttgttttaatctactatagatacgtttttgttttttggcttagttggggataaaataatttatttgtaagttagctttctaaaacttagagaaagtaatttaattcacgtatcttaaaaataaaattccaaagttaaaaaatttctgacttagtaggaagttaacaaaactactgctgatgcatttcagtttccaaaatctgtaccctccccccataaaaaagggagttaagatgtgctagtttaagtagttagctgaattatagattgatcctcttaaaatctggagtttgtaaaggggcctacataaacagtagatagacttggagggattttgtgggggaattgaaactaatagtattctatctagtttgtcagtatttactttttgatttttatttttcagaaaattttcctttcccaggacaccctcttgtattagaatatcctcttctgtatcacattaaaaacagattttactgttagaccaaataagatgggcaaatagcaacactagagcatctcacccagtttgaactaggatgttcgtggaagttatgacaccaatatattcctgaaatgaaaattaacctaaattttaaagtgaatctatttgaaaatttacttagataatgaaacctcgttttaattgtgctttttgtgaatccaacacttgtttgcttagaaagtatcttatccagtattaatattttgttcttttgggttttaaagttgagcttattcagcctcaatcacattacagcaagcataaagtaacagttgactcaatgaaagacccaaattgcctgtacagataaaattcactgaatcaaaggcacaatagctatcttttcacttgagctcagaaaagtaaaatggcttaatttgaactattaattttcagtggcctctaattaaacaaaaacaaaaaaccacaaatactggctaggtaagatattcctgaggtcattttaaaagaagtgtggcacctaggattcaatatttaatgctaacagtattatattttagtgaaatttattttggtggtgacagtttattaaacctaattagacttctttcaatagcttgttgtagagacaatctcaagggctggaaagtgttgctaaaatgaatgtcatacatttctgatatactaaggagcttataaagtaattctttcatagtgcaagaattattaatttcttagaggatgtttttaaaggagctacttaattgggaaaatgttctttaaatatcagtaatagttcattaagtaacatagtagctaagaacatggactatattttcacagcatagttcagcttaggcacacctttagtttggattattggcattctcttacgtaggaattatatcattgtagatatgtaattatggtaataagcaattttcataaccatgctcactcagactatatcatttgaaactgccatgtttccatttttgacaattcatgttcacaaaacaacaggaacaatttcctatttggtataaagagcaaaatttccaactttgccccaaaatgccatgggtggcatattgccatatgattatatcatatatttaatcatgtatgggaaagattttggattttttttcttatttaaaaaagtgctaaatataagaatatagttttaaatcagcaagtctaataacactattgcagctgtacacagagagaaccttttgtgcctttttgcctgcagtaagcatttatttctattttacatgagttctaagaatgttgatgattattgcaccttgttcttctgtatataaacttgattaaggaatttttttttttaaagcaaggagccgttttttgttactaggtggataccttagtaaacatgaggggaattatcagatagatgtctttggagcccagccttccctgtgtagtgagctggaaactcctttagattgtattcattggtgtgtatgtatatgtacatatatgtataaatagttaaatacataaacataaaacttaacatcgcattgttgtgatgacaagaagtagtaaggtgctaggtggttacattaaaaagcacagcacagtgtataatcagtcactatgactggtggttttgtaagctgggttcagtttttgaaccacccagaatacctcatgtgtaaatacagtgttcatgacttaattgaaatacagttattgtttaaaaaaaaaaaaaaagaatgtgaagccactggttggcttatgccttctgatctatcattcttgcctctttttttgtaaaggggttttcttcttgttgttctgttttttaatagggtttacagctagaattttgaatgccaaagttctatttattaaattaagaaaaaagttttcaatgttaatggctagtatttttccactggactattgtttgttgatgttggaatttgtatttacagagaaataaattttttataaaaaga

SEQ ID NO: 1655 - DNA, 2685 bp, Homo sapiens
ctggtggggtctgtcggcttctcttcagtgcgatatatttaaatggataaaaatatgttagttcccaaagaattgtattatgtctattacgtcaagataccgttgttgaaatattttcaaaaaatacattagtgatgtggaaatgttatttctttactaatggaccaaataaaatctggtataatgggcacctttaaagaaagcaccttcacacttgaagtgcgtaaatgatgtttgaagttgttcagatgatgacgtggagatgtctggtttctgtcaatgttggccccgcctaccccacacgagcatcattttgggtgtcagggccccacgcaccccacacgagcatcattttgttgcctgggctcatcatggaaggaaatgctaaattccaaaaagaggtgggtgcagataaagacaaatcagtttcccacctatctctgcggaccgtacattctccctgagcccaggttaaatactccgttccagagcgaggtttgtaggtttgttggttttcttttttttttttttctttttttttttgaggcagagtctcgctccattgccaggctggagtgcagtggcatgatctcggctcgctgcaacccccacctcccaggttcaagcgattcccctgccttaacctcccaagtagctgggactacaggtgcacaccaccacgcccagctgattttttgtattttagtagagacggggtttcactgtgttggccaggatggtcttgatctcttgacttcgtgatctgcccacctcagcctcccaaagtgctggggttacaggcgtgagccactgtgcccggcccctaggttcgttttagccgagaagtgttggggttacaggcgtgagccaccgtgcccggcccctaggttcgttttagcccacagttgagaagtaactggtagattaggctcggcccttgtggaacgttacttggaagtgtgctggcctctgttaatgtccctgcgcgctgccggcctggagaagtgtcgcctgcctcaggcgcccttgctttgcctgtgaccgaagcgctccctgtggttttagtgagtttatggtcgaggagcacgagctgcggaaggagaggatccaggaggattacaacgacaagtactgggaccagcggtacaccatcgtccagcagcagatcccgtccttcctgcagaaaatggcggacaagatcctcagcacaggaaaatatctaaatgtggtcagagagtgtggccatgacgtcacctgcccggtggctaaagagatcatctacacgttaaaagagcgggcgtatgtggagcagatcgagaaggcgtttaactacgccagcaaggtgctgctggacttcctgatggaggagaaggagctggtggctcacctcaggtccatcaagcgctacttcctcatggaccagggcgacttcttcgtgcacttcatggacctcgcggaggaggagctccggaagccggtggaggacatcacgccccctcgcctggaagcgctcctggagctggcgctgcgcatgagcacggccaacactgaccccttcaaggacgacctcaagatcgacctgatgccccatgacctcatcactcagctcttgcgcgtcctggccatcgagaccaagcaggagaaggcgatggcgcacgccgaccccacggagctggcgctgagcggcctggaggccttctctttcgactacatcgtcaagtggcccctttcgctcatcatcaacaggaaagccctcactcgctaccagatgctcttcaggcacatgttctactgcaagcacgtggagcggcagctctgcagcgtctggatcagcaacaaaaccgccaagcagcactcgctgcactccgcccagtggtttgctggggctttcactctgcggcagcgaatgctcaacttcgtccagaatattcaatactacatgatgtttgaagtgatggaaccgacctggcacatcctggagaaaaacctgaaatccgcctccaacattgacgacgtccttggccaccacacaggcttcctggacacctgcctgaaggactgcatgctcaccaaccccgagctgctgaaggtcttctccaagctcatgtctgtgtgcgtcatgttcaccaactgcatgcagaaatttacacagagcatgaaattagatggcgagctgggcgggcagacgctggagcacagcaccgtcctggggctgcccgcaggggccgaggagcgggcccggaaggagctcgccaggaagcacctggctgagcacgcagacactgtgcagctggtgtccggcttcgaggccaccatcaacaagtttgacaagaacttctcagcccacctgctggacctcctggcccggctgagcatctatagcaccagtgactgtgagcacggcatggccagcgtcatctccaggcttgacttcaatggtttctacacggagcgcctggagcgcctgtctgcagagaggagccagaaggccaccccccaagtgcctgtcctgcgggggcccccggctcctgcacccagggtcgcagtcaccgcacagtgagccctggctgtgacaggaaggaagggtgtggggtcagcagggactggtgcaaatgggtccagaattttcaaatcgaatgctctgtgttctgtctttgcagtttaaatataaagcaggaatgattg

SEQ ID NO: 1656 - DNA, 3198 bp, Homo sapiens
ccactggatcctacaactactttttccctcttttgctcacgcacctcgaagaactggtgctcccgcgggaagcgcacggggcgcgcaacgaagcgaaagggcgcggccccagccgcgggatcccgctctacaggcagcggctccgccgccccgggccccgcagcgaggcgggcgcacagcgcggggggcaactgcatcaccccgggcgcgggcgggcgcagcctgtcggccaccgtccgcgagccgagccggacgtgacgtcacgctcacttccgccgccgtcgggggctgcgcgggggctgtggctccgggactgcggagaacatattgtgatgttcgtgcctcagagctaaaactatgagtgaatttcggattcaccatgacgtcaatgaactgcttagcctgctgcgtgtccacggaggagatggggctgaggtctacattgacctgcttcaaaagaacaggaccccgtacgtcactaccactgtctctgctcacagtgccaaggttaaaattgcagagttttctcgtactccagaagactttctaaagaaatatgatgaactgaaatctaaaaatacaaggaaccttgacccgctggtgtacctgttgtcaaagctcacggaagacaaagagactctgcagtacttacaacagaatgcaaaagaaagagctgagcttgcagccgctgctgtgggcagcagtaccaccagcatcaacgtccctgccgcggcctccaagatctccatgcaggagcttgaggaactgaggaagcagcttggcagcgtggccacaggctccacgctgcagcagtctctggaacttaaaagaaagatgcttcgagacaagcagaacaaaaaaaattcaggccagcacctccccatcttcccagcatgggtgtatgagagacctgccctgatcggggatttcctgattggtgctggcatcagcacagacaccgctttgccgataggcacgttgcccctggcctcgcaggagtcggccgtggtggaggacctgctgtacgtgctggtgggcgtggacgggaggtacgtcagtgctcagcccctggctgggaggcagagccggaccttcctcgtggaccccaacctggacctgtccatcagggagctggtgcacaggatcctcccagtggccgccagctactccgctgtgaccaggttcattgaagagaagtcttccttcgagtacgggcaggtgaaccacgccctggcggccgccatgcgcaccctggtgaaggagcacctgattctggtgtcacagctggagcagctgcacaggcagggcctcctttcgctgcagaagctctggttctacatccagccagccatgcgcaccatggacatcctggcctccctcgccacctcggtggacaaaggcgaatgtcttggggggtccacgctgagcctgctccacgacaggagcttcagctacacaggggacagccaggcgcaggagctatgcctgtacctaaccaaggcggccagtgctccctacttcgaggttctggagaagtggatctacaggggcatcatccacgacccatacagtgagtttatggtcgaggagcacgagctgcggaaggagaggatccaggaggattacaacgacaagtactgggaccagcggtacaccatcgtccagcagcagatcccgtccttcctgcagaaaatggcggacaagatcctcagcacaggaaaatatctaaatgtggtcagagagtgtggccatgacgtcacctgcccggtggctaaagagatcatctacacgttaaaagagcgggcgtatgtggagcagatcgagaaggcgtttaactacgccagcaaggtgctgctggacttcctgatggaggagaaggagctggtggctcacctcaggtccatcaagcgctacttcctcatggaccagggcgacttcttcgtgcacttcatggacctcgcggaggaggagctccggaagccggtggaggacatcacgccccctcgcctggaagcgctcctggagctggcgctgcgcatgagcacggccaacactgaccccttcaaggacgacctcaagatcgacctgatgccccatgacctcatcactcagctcttgcgcgtcctggccatcgagaccaagcaggagaaggcgatggcgcacgccgaccccacggagctggcgctgagcggcctggaggccttctctttcgactacatcgtcaagtggcccctttcgctcatcatcaacaggaaagccctcactcgctaccagatgctcttcaggcacatgttctactgcaagcacgtggagcggcagctctgcagcgtctggatcagcaacaaaaccgccaagcagcactcgctgcactccgcccagtggtttgctggggctttcactctgcggcagcgaatgctcaacttcgtccagaatattcaatactacatgatgtttgaagtgatggaaccgacctggcacatcctggagaaaaacctgaaatccgcctccaacattgacgacgtccttggccaccacacaggcttcctggacacctgcctgaaggactgcatgctcaccaaccccgagctgctgaaggtcttctccaagctcatgtctgtgtgcgtcatgttcaccaactgcatgcagaaatttacacagagcatgaaattagatggcgagctgggcgggcagacgctggagcacagcaccgtcctggggctgcccgcaggggccgaggagcgggcccggaaggagctcgccaggaagcacctggctgagcacgcagacactgtgcagctggtgtccggcttcgaggccaccatcaacaagtttgacaagaacttctcagcccacctgctggacctcctggcccggctgagcatctatagcaccagtgactgtgagcacggcatggccagcgtcatctccaggcttgacttcaatggtttctacacggagcgcctggagcgcctgtctgcagagaggagccagaaggccaccccccaagtgcctgtcctgcgggggcccccggctcctgcacccagggtcgcagtcaccgcacagtgagccctggctgtgacaggaaggaagggtgtggggtcagcagggactggtgcaaatgggtccagaattttcaaatcgaatgctctgtgttctgtctttgcagtttaaatataaagcaggaatgattgactcagc

SEQ ID NO: 1657 - DNA, 5089 bp, Homo sapiens
ggagaaggggcgcaggtggccgccatcttggattgcgaactgggtcgctacgcttcacgccaggggcggagtggcggcccttctgttacccgccacacacgtcgccgctggggactgggaaatcagggcatcggagagtgccacattaatggatgccatggctagtccagggaaagataactatagaatgaaaagttataagaataaagccctaaatcctcaagagatgcgtagacgaagagaagaagaaggaatacagcttagaaaacaaaaaagagaagaacagttgttcaaacgcagaaatgtctatttgcccagaaatgatgaatctatgcttgaaagtcctatacaggatccagatattagttccactgtacccattccagaggaagaagttgttactacagatatggttcagatgattttttctaataatgctgatcaacagctaacagcaacacagaaatttagaaagctgctttctaaagaacctaatccaccaatagatcaagttatacagaaaccaggagttgtacagagatttgtgaaatttcttgaaagaaatgaaaattgcactttacaatttgaagctgcatgggcattaacaaatatagcatctggaacttttctgcataccaaggtagtgattgaaactggggctgttccgatttttatcaaacttcttaattctgaacatgaagatgttcaggaacaggctgtttgggcacttggtaatattgctggtgacaatgcagaatgcagagattttgttttgaattgtgaaatacttccacctcttttagagttattaacaaattcaaacagactcacaacaacaagaaatgccgtgtgggccctctcaaatttatgtagaggcaaaaaccctcctccaaactttagtaaggtttcaccttgcttaaatgtcctgtcacgactgttgtttagcagtgacccagatgtgttagcagacgtgtgttgggccctttcttatctctccgatggacccaatgataaaattcaagcagtcattgattctggagtctgtcgaagattggtggaacttttgatgcacaatgattataaagttgtatcacctgcattaagggcagttggtaatattgtgactggtgatgatattcaaacacaggtaattttgaattgttctgcattaccctgtctcttacatttattgagtagcccaaaggagtcaattagaaaagaagcctgctggactgtttctaacatcactgctggaaatagagctcagattcaggctgttatagatgcaaatatttttcctgttttgattgagattcttcagaaagcagagtttcgtaccagaaaagaagcagcttgggctataactaatgcaacatcaggaggtactccagagcaaataaggtatttggtagctttaggctgcattaaaccactttgtgatcttttgactgttatggactccaaaatagtccaagtggctttaaatggacttgaaaatattttacgtcttggagaacaagaatctaagcagaatggaataggcattaatccatactgtgctctcattgaagaagcatatggtctggataaaattgagtttttgcaaagccatgaaaatcaggaaatttaccagaaggcatttgatctgattgaacattactttggtgtagaagaagatgaccccagcattgtacctcaggtggatgaaaaccaacaacagtttatatttcagcagcaggaagcaccaatggatggatttcaactttaacttactggaggaaaaaaaatttatggctaaaaagggtagcttcaggtaactcctctttgttgccaatgtaagaatgtttgtttttttacatagaacagtaaagagaatttgatgcacttttagaaagcaaaatgaaacaaaaatttccattcagatgcaacctttcattgtagtttgttgttgttttagttttgttgttgtgcctgtatttatatcttctattgtttggatttttgtatctatttgtgaataattgaatatgcaattatttagtaatttaagcttgaaaaggagaattttggtgaagcattacttagtaattctgaattttttcaagcattcttggaaactgcacattagcagtaaacctattgataattgcattttggcagtaagtcttacacatctaatctctactaaatctacctctatcttgaagcagaaataaaaacaaaaaagcttcagaagcatgaaataatgcaaatgctaaattagaatgtgaaaatatttattaccttaaattatacatatcactgtgctgtaggttatactttgcaaaaaattgcaacagaaaacctataaaatttatttataaaacagaagaaatattatactgataatccattaaaatgtggcaattgtgaagggagaagctgtttttcatgttgaacacattaaaaagattactttataaaatgtttaaatatttctgtttttaacatataagtgctatgtatattagtatattttgtatttcaaccaaatatgctaccatttttgaaatagtgttttattgtttttcactcattgttttaaagagcatcatgacagagatgtcatcatgaatctaaagtagtgctgcatatctaaaataataactaattatttctctgatttttcagagcagtaattgaaaagtttcattttctgtataatagtactagtttaagtttaagtacaagtacaagtttaggtactcgaatgacaaaattaccctgaagaaataaccttattatgtgttaaattgtattaaatgcatttaacatttggatgctaaatgataatgaaaattgctaaaggttctttaatatggttcaaatctataagacttttttcttttagtaatactcagagggtcattctgctgcttgttatgaatcatagattacattcatgtcagattgatcaatatgtatgttttatgatttaacagcaaaaacctcttcaaacggaaaatttgaaagaaaggtttcaatagaaaaattatatatatatttatacatatatatgtgtgtgtgttactctcacagttcaactactgttgaactcaatcttttaatttatagttatacgtaggctatttatgtgtccaattgtatacctagaatacttacttaaaacttagtttacaactctttttaagatgagaactaaggcaattttgatatgattcatggtctattctttaaaaaaagatttcatttatgatagtatttgtaatgtttctgctggaaatcagaggcacgttccaagaggaaaatgtatataggagtacttttaaagaatatgtcactttgtaaattacatatcatgaaactaagcttttgacaagatacttaaaacctacagctgtaaaatacaggtttaaatggtgttcgtaatgctgagtgcatctgccagcccttttttattattaagtagaagattgtatctgtgccccttttttcgtagtggaaggtatatagccgagtataaaatggttttcttttgcattatctgtattcaaaaaacagggtagttatattaaagcttaccaaattgatggtgaatttatcagattaacctttttgtggtgcagatggttctaagtatcaggtgacagggtattctactctttctagtcaattaaaattgataatgcagcatgattcataaactaaccagctgtgcctccttttattttgaggaccctgtagtcactataataaatttctaagccaaatttttcaaacaagatagttcttatagaaggagaaataataaatatgtgtgtgttgatgcatgcacacagaatgacctgtgaaaggaaacttaaattttgccggtaaaacaaacatatctctacagactgtgattatacttcataagcatttaaatacagttttatttatttccttaaatatattacttgggtaattaattttagatttgattgcaaagagcactgtatagcagttgggaccagctcttggcttggcttggcttggcttattgttaagagtttattggatcaagactaacaaataactttgtgatgaaaattcttcaaaaatatagctactcttttcaagtataccatttaaaatatttcatcaggcagagccctgaccaggaaaaaaaaaaaaaaagaaagaaagaaaagaaaaaaataaataaaatgctccaaaaagtgttttcagtagtcttcactggcccttgtgggaggaaaaatacttttttaacttgcttttctaagatttgttatatttaaatccaagagaaactatgccgaaaaaaagtgttataaagaggaatgcatgtagcattaatgcaaatatcaagaaaatacttgaaagagtccttttcatttatttaattaaatttggtgttttattttgtctgaatctgaatttctcctatttaatctatgcaattatgcttgttttatatttataagcacttgactcactgggtgtggtctttttactgtgttttatttcaaaacgttgttttaagtgatagtgtccttaaattttagtgtcatttggtcaacttactggtaacaccagaacaagaaagcaaaaaagtaataaattctgctggcacagaactaacatatcatttggtaactgtaaaacctatttgcagttaaaggttgatttattggataagggactaaaagaagcatatattacctttgcctttatattttttcttcttttaagaaggagcattatggaaaaataaatataaagtcttagtgaatttttgttatggttctcaattcagcaatctactggctgcttgcgaaactgtgaaatcaaattgttcttaacctttattcagtttagtttatagcattactgttttatgaaatgtgacattttaggagccaatataatagagctctaaaaggatagtatatctttaaattctgactggggagtaagaagagaagatattcttaccctactaaataaaccaacttttgagtagtatgcaatattatgaaatgttacaacactatattaaaaataataaaatattttaaaattgcattta

SEQ ID NO: 1658 - DNA, 726 bp, Homo sapiens
tctgctactcagaggaaggggcggttggtgcggcctccattgttcgtgttttaaggcgccatgaggggtgacagaggccgtggtcgtggtgggcgctttggttccagaggaggcccaggaggagggttcaggccctttgtaccacatatcccatttgacttctatttgtgtgaaatggcctttccccgggtcaagccagcacctgatgaaacttccttcagtgaggccttgctgaagaggaatcaggacctggctcccaattctgctgaacaggcatctatcctttctctggtgacaaaaataaacaatgtgattgataatctgattgtggctccagggacatttgaagtgcaaattgaagaagttcgacaggtgggatcctataaaaaggggacaatgactacaggacacaatgtggctgacctggtggtgatactcaagattctgccaacgtgtgagtgtgcctgtttctggtcatgggaacagaacatagcacttggattaggggtttaggtatctttttttgttttgagacaaattctccctccgttggccaggctggagtgcagtggtaccattgtagctcactgcagccttgacctccactacagcaagtgatcttcccgccttagcctcccgagtagctgggactacagatgtgtgctaccacacccagctaatttttgtattttttgtagatacagggtttcaccgtgttgctcgggc

SEQ ID NO: 1659 - DNA, 476 bp, Homo sapiens
aggggtgacagaggccgtggtcgtggtgggcgctttggttccagaggaggcccaggaggagggttcaggccctttgtaccacatatcccatttgacttctatttgttgtttacttctggtttagtgtgaaatggcctttccccgggtcaagccagcacctgatgaaacttccttcagtgaggccttgctgaagaggaatcaggacctggctcccaattctgctgaacaggcatctatcctttctctggtgacaaaaataaacaatgtgattgataatctgattgtggctccagggacatttgaagtgcaaattgaagaagttcgacaggtgggatcctataaaaaggggacaatgactacaggacacaatgtggctgacctggtggtgatactcaagattctgccaacgttggaagctgttgctgccctggggaacaaagtcgtggaaagcctaagagcacaggatccttctgaag

SEQ ID NO: 1660 - DNA, 947 bp, Homo sapiens
ctctgttccccttttcctgccaccttcttctccagggaccagaaacaagggccccgccagcaggcgaagcagggagatgtcagactgctacacggagctggagaaggcagtcattgtcctggtggaaaacttctacaaatatgtgtctaagtacagcctggtcaagaacaagatcagcaagagcagcttccgcgagatgctccagaaagagctgaaccacatgctgtcggacacagggaaccggaaggctgcggataagctcatccagaacctggatgccaatcatgatgggcgcatcagcttcgatgagtactggaccttgataggcggcatcaccggccccatcgccaaactcatccatgagcaggagcagcagagcagcagctagagacccctttggccacaccttccaggcactggcctgatgccccgccctggtgctctccccaggctccctcctcagcctcctgcccacccagggccctttactctcttctccctccagaccttcctctgacccttgctgaactggggtccctttgtgagtgtctcagtctagaggtacctccctccctggggggtctcagctcctggagtcgcaggcccttggggcccctctgtgagatctcaatgctgtctggggaccctaagagttttctcacctgttcagtctcatctaaccttccaatgtctgatgttcctgccaaattcctgcctgattctgggtccgtcctgacctccaaaggtcagcttggtgcttgaggtctccctgctcttggtggcagtggtagcagcaacagcagcagcagcagcagcagcagcagcagagacctctccactttcccttagcccctctgctgggtagagaggcactttcagggacttccctccagctgcctcttcatctgggaatgagctaagcaaggctgagcctcctcctgttgctt

SEQ ID NO: 1661 - DNA, 1146 bp, Homo sapiens
aatggccacaagtggccaacggaaagcaggtggcaggacaggaggctgtggtggggcctgaccgagcagcctttccttccaaatctgactgtggcttgctcaggcccctatggtggctgtgaccctgttttgtccatctcctttcaccaggacccgccgggccccgccagcaggcgaagcagggagatgtcagactgctacacggagctggagaaggcagtcattgtcctggtggaaaacttctacaaatatgtgtctaagtacagcctggtcaagaacaagatcagcaagagcagcttccgcgagatgctccagaaagagctgaaccacatgctgtcggacacagggaaccggaaggctgcggataagctcatccagaacctggatgccaatcatgatgggcgcatcagcttcgatgagtactggaccttgataggcggcatcaccggccccatcgccaaactcatccatgagcaggagcagcagagcagcagctagagacccctttggccacaccttccaggcactggcctgatgccccgccctggtgctctccccaggctccctcctcagcctcctgcccacccagggccctttactctcttctccctccagaccttcctctgacccttgctgaactggggtccctttgtgagtgtctcagtctagaggtacctccctccctggggggtctcagctcctggagtcgcaggcccttggggcccctctgtgagatctcaatgctgtctggggaccctaagagttttctcacctgttcagtctcatctaaccttccaatgtctgatgttcctgccaaattcctgcctgattctgggtccgtcctgacctccaaaggtcagcttggtgcttgaggtctccctgctcttggtggcagtggtagcagcaacagcagcagcagcagcagcagcagcagcagagacctctccactttcccttagcccctctgctgggtagagaggcactttcagggacttccctccagctgcctcttcatctgggaatgagctaagcaaggctgagcctcctcctgttgcttgaaataatgatgatataaaggctggatttggagtttgtatcccctggtccctctgggatgctcattaaaaccttcccactccttggaaa

SEQ ID NO: 1662 - DNA, 1443 bp, Homo sapiens
agccggcatgggagtaggaatggccacaagtggccaacggaaagcaggtggcaggacaggaggctgtggtggggcctgaccgagcagcctttccttccaaatctgactgtggcttgctcaggcccctatggtggctgtgaccctgttttgtccatctcctttcaccaggacccgccgggtgagggtgactggagcacattcctgggcttgggggtgggaagggagtctgatttgcctggggttgatgtgggggggttttgggcatgggccgtgactcacagagtagatccagatccgcctgctcccctcatatcctgttattcagaaggctgtatccgcttagaaagtgtcttttgtcctggggtgagagggtgacgcatgtgccctctggcagtctgctgctgtgtccagagtccgactccagctgggctgtaactgggcttggcccccgccttaggccccgccagcaggcgaagcagggagatgtcagactgctacacggagctggagaaggcagtcattgtcctggtggaaaacttctacaaatatgtgtctaagtacagcctggtcaagaacaagatcagcaagagcagcttccgcgagatgctccagaaagagctgaaccacatgctgtcggacacagggaaccggaaggctgcggataagctcatccagaacctggatgccaatcatgatgggcgcatcagcttcgatgagtactggaccttgataggcggcatcaccggccccatcgccaaactcatccatgagcaggagcagcagagcagcagctagagacccctttggccacaccttccaggcactggcctgatgccccgccctggtgctctccccaggctccctcctcagcctcctgcccacccagggccctttactctcttctccctccagaccttcctctgacccttgctgaactggggtccctttgtgagtgtctcagtctagaggtacctccctccctggggggtctcagctcctggagtcgcaggcccttggggcccctctgtgagatctcaatgctgtctggggaccctaagagttttctcacctgttcagtctcatctaaccttccaatgtctgatgttcctgccaaattcctgcctgattctgggtccgtcctgacctccaaaggtcagcttggtgcttgaggtctccctgctcttggtggcagtggtagcagcaacagcagcagcagcagcagcagcagcagcagagacctctccactttcccttagcccctctgctgggtagagaggcactttcagggacttccctccagctgcctcttcatctgggaatgagctaagcaaggctgagcctcctcctgttgcttgaaataatgatgatataaaggctggatttggagtttgtatcccctggtccctctgggatgctcattaaaaccttcccactccttggaaa

SEQ ID NO: 1663 - DNA, 1203 bp, Homo sapiens
tttaacaagggcccaaccccagggccaagtcaagaaggagctcagccactatctccccaccgagccagctcagcgggcagggctgggagggagtgggacagattctgggagtgcagcggggaggagtcccggctgggctgagcgcagggagctgcttggcagtgccagagcccaggccccagagccctgctggagaggaggcagactgaggcagcaggccccgccagcaggcgaagcagggagatgtcagactgctacacggagctggagaaggcagtcattgtcctggtggaaaacttctacaaatatgtgtctaagtacagcctggtcaagaacaagatcagcaagagcagcttccgcgagatgctccagaaagagctgaaccacatgctgtcggacacagggaaccggaaggctgcggataagctcatccagaacctggatgccaatcatgatgggcgcatcagcttcgatgagtactggaccttgataggcggcatcaccggccccatcgccaaactcatccatgagcaggagcagcagagcagcagctagagacccctttggccacaccttccaggcactggcctgatgccccgccctggtgctctccccaggctccctcctcagcctcctgcccacccagggccctttactctcttctccctccagaccttcctctgacccttgctgaactggggtccctttgtgagtgtctcagtctagaggtacctccctccctggggggtctcagctcctggagtcgcaggcccttggggcccctctgtgagatctcaatgctgtctggggaccctaagagttttctcacctgttcagtctcatctaaccttccaatgtctgatgttcctgccaaattcctgcctgattctgggtccgtcctgacctccaaaggtcagcttggtgcttgaggtctccctgctcttggtggcagtggtagcagcaacagcagcagcagcagcagcagcagcagcagagacctctccactttcccttagcccctctgctgggtagagaggcactttcagggacttccctccagctgcctcttcatctgggaatgagctaagcaaggctgagcctcctcctgttgcttgaaataatgatgatataaaggctggatttggagtttgtatcccctggtccctctgggatgctcattaaaaccttcccactccttggaaa

SEQ ID NO: 1664 - DNA, 4295 bp, Homo sapiens
gcttggggtgcagggcagcccaggctggctactggctggaagatctgctttggaaagctttttgaaagcaaagatgagcaacactcaagctgagaggtccataataggcatgatcgacatgtttcacaaatacaccggacgtgatggcaagattgagaagccaagcctgctgacgatgatgaaggagaacttccccaatttcctcagtgcctgtgacaaaaagggcatacattacctcgccactgtctttgagaaaaaggacaagaatgaggataagaagattgatttttctgagtttctgtccttgctgggagacatagccgcagactaccacaagcagagccatggagcggcgccctgttctgggggaagccagtgatccagccccaccaaggggcctccagagaccccaggaacaataagtgtctcctcccaccagacacttgccttatttcttcttctctttggtgacctacattgtcaaaactaccaattccaggttaactttgttggagaatttcccccacccccatccagtgggtcacccaggagtaatgtccctccagcaacgttccccctatggcctccagcagagctgatctgcctctcacacaggtcctggtgtctgcctctgcaccgttccctaaatgcagccaccttggcaggttccaggtggaagttggtagaaggcccctgccaggtcacagcaatgctctccttgtcaaggcatggaccagggtcattcagacacattcagatactgcactgagaaggagctggcatctctcagtgtgctcctgccctcccactcctgccccagctgttctccagggcttggggaaacagaaaccactcacatagggattcctggatggcttcaggttcagcgcccttggggctatgaatgggaggctcagcagtgccctgaggatgggcttccttgtcctgtggcctctgctccaggggcagtgtcctttccctgtgctgtgtgcttgtgtgcatgtgcctatgtgggtgaccctgtggaagtgagaaggagtcactgtgatgcttagctgtcctaaatgatggtttgctcaatgccaggactgggtttctggtgatgaatgaatattccagattttgaggagctctaagtggtccaggagtccaagtaagcagtctggctggaataaggcagcatcacggaaattctgtaaggactgacacagagagctcatgctgactgtgatgagaaattgcagcacctctatctcgcaggtaatggagtagtttgttattggtagtctactccaggccaggcagtgtgttatgggctgaggatgcagaaacaggcaggacacagtgctgtcctagcagtgcactggcgggtctctccatgcaggccacaacacagggtcagtgttcacctggtgtcacttccaggcaatgttctgtgcagccgctcttagtattcttccttgaggctcacatcatgtgtccctatcactcttactactctggtcagtctccagctaacctctcaatcaggcaaacattcttcttggaggaatcaggcaaacatctcaaaaattctctttccatcctaccagcagcagtgtgtaagatgggctatttgttctttggaatgactgctccactccacactcacacctctattcacagaccagcatctcctctccttatcaggaacattccttcctgaacatattctgcacctcgtcagccttcaggactgatctgccattttcacctctaaatccccatgtctgaccattagttttcttctctttccttctctccctttctcattctcattccacctgttcttggaactcacggagacctacagtccctgggctttcattttctcctcccagccccctgctgccttctctatgcagcctgccctccatcatccaccccagaattgctctctttcctctcttagctctgttgcccactttccttgggccataccttccctgcagatctccagcccagaaccatcttcccctgttgtcctcctctctcctccaccgggactgctggtcactgcttagaaccgtcatgccagggtcccaaaagtgtgggtgcctgacttcctctctgtgcagcactctctgaatccctcctattcaccttgctgctgttattccccgaatgcgcaacataccccccatcaatatatctcagtatttcatgtctcaataccaatcttttaaactactgcctctaccagaaatgtcttttaatacttcttctgtctcattaacattacatttcaaggctgagctttaatgtcagtgtctcttagacattcagagggtgaaccaccatcccttcaccccaaagaaatgatctctgcttcatttgtgcctccctcaccatgaccccactcttaccatagtggctacattacttcagattcccctaatgtctttccagccagacttggaatcatggagggaaaacattgttacctcggatctcctggttacccagcacatagtagtactggattccagctcataataagtactctatatcatttttcaatataaaatgtatttgtgcaaattctagtcaatactactttatgtaaacagcagtgtaaaatccaaaaacttccagtcctggaggcaggttgtgcagcttaggggaggaccccagaatctggaccccagagtctggaagcaggccagaaaggataaggcaaatgactgaacagttccctcaggactcacgtactgatctcccaaaagaagagagggtctccctggggtggggttgctggaccttcaatccatcgctacagtccagaaggcaattggccactcctaatgtgggcctgccctccctttatttttccagttcttatttcacctgataatattccgtccaattggcaatggcacataaaaattaggatggagtgtgtggacaaatacttcttcatcttcttgtctaggttttagaaatcaccttctcaagggagccttgtctaatgttcctgagactatttcacactctccatgcttatgtcaatgcaggactcatcacatctattcggatattctgtttacacacccatgtcatcccagagaggtgatcacagggcagggacacatgtgtggcatacagttcctagttaagatcccaaatcctgagatattgctgatttgctatggcaggtcgtcaagagaactgtgtcattccaaactcaccaaggtggcttatagaacagaagcagatggatatgaagaggagaggggaccagaccatctccgcaaccacagcccagagctccagtcaccagatagaaaattgatttgatttcatccaatattccttcgaaagagtgtcaaggaatagggtggggcaatgtgtcattctgcattggaaggaggacattttagagcaaggcctaagggcacaggtattagtgtcatattgatcagaattcaacctttgttctaacacatactagagcaagaatttacttgatttggaataattaatagctactggacattatattggtactaaagagaaagaatacttgacagctctatgcccacactcacattacagctgatgtgaaagagattctggaaatccaaatgttccccagaaattctgatatcaaaacattccaataacttttttttttcaggcgcagtctcactctgtcgcccgggctggagtgctgtgagctgtccgtggtgctgaattcactgtgacgtcactcctgtctctctttgctttcttctgactgacatttattcagccttctctacaggaatctcttatgttcccccacatgcaggtggtttttcagtaggctcctgaagagtgatctcaactttccaggaagaaaagagggcaaagggaacaatgtgaaaagaagcagaaaatcataaaagaccatgtgtttgataaacaaccagattgtttctggttccctgccactataaaaacaccatgagagcatactcatacatgttcccttataaatctgcgaggtagtttctttggtattcttgcccaggaaatgggttgattcatcacagattttatatatatacttttttttaactaagtgtgagataatatcttattgtttttgtaacttgcattttacaagagttctgaccagcaccagataagcttcagtgctctcctttctttggccttaatattattggattaaagaattactgcctctcactaggagcatcatttatttaccattattttcaatttcatattaaaactcaatttctagtagagtc

SEQ ID NO: 1665 - DNA, 4334 bp, Homo sapiens
gtgggaagagccaggctgagccttataaaggactgctctttgtccaaacacacacatctcactcatccttctactcgtgacacttcccagttctggctttttgaaagcaaagatgagcaacactcaagctgagaggtccataataggcatgatcgacatgtttcacaaatacaccggacgtgatggcaagattgagaagccaagcctgctgacgatgatgaaggagaacttccccaatttcctcagtgcctgtgacaaaaagggcatacattacctcgccactgtctttgagaaaaaggacaagaatgaggataagaagattgatttttctgagtttctgtccttgctgggagacatagccgcagactaccacaagcagagccatggagcggcgccctgttctgggggaagccagtgatccagccccaccaaggggcctccagagaccccaggaacaataagtgtctcctcccaccagacacttgccttatttcttcttctctttggtgacctacattgtcaaaactaccaattccaggttaactttgttggagaatttcccccacccccatccagtgggtcacccaggagtaatgtccctccagcaacgttccccctatggcctccagcagagctgatctgcctctcacacaggtcctggtgtctgcctctgcaccgttccctaaatgcagccaccttggcaggttccaggtggaagttggtagaaggcccctgccaggtcacagcaatgctctccttgtcaaggcatggaccagggtcattcagacacattcagatactgcactgagaaggagctggcatctctcagtgtgctcctgccctcccactcctgccccagctgttctccagggcttggggaaacagaaaccactcacatagggattcctggatggcttcaggttcagcgcccttggggctatgaatgggaggctcagcagtgccctgaggatgggcttccttgtcctgtggcctctgctccaggggcagtgtcctttccctgtgctgtgtgcttgtgtgcatgtgcctatgtgggtgaccctgtggaagtgagaaggagtcactgtgatgcttagctgtcctaaatgatggtttgctcaatgccaggactgggtttctggtgatgaatgaatattccagattttgaggagctctaagtggtccaggagtccaagtaagcagtctggctggaataaggcagcatcacggaaattctgtaaggactgacacagagagctcatgctgactgtgatgagaaattgcagcacctctatctcgcaggtaatggagtagtttgttattggtagtctactccaggccaggcagtgtgttatgggctgaggatgcagaaacaggcaggacacagtgctgtcctagcagtgcactggcgggtctctccatgcaggccacaacacagggtcagtgttcacctggtgtcacttccaggcaatgttctgtgcagccgctcttagtattcttccttgaggctcacatcatgtgtccctatcactcttactactctggtcagtctccagctaacctctcaatcaggcaaacattcttcttggaggaatcaggcaaacatctcaaaaattctctttccatcctaccagcagcagtgtgtaagatgggctatttgttctttggaatgactgctccactccacactcacacctctattcacagaccagcatctcctctccttatcaggaacattccttcctgaacatattctgcacctcgtcagccttcaggactgatctgccattttcacctctaaatccccatgtctgaccattagttttcttctctttccttctctccctttctcattctcattccacctgttcttggaactcacggagacctacagtccctgggctttcattttctcctcccagccccctgctgccttctctatgcagcctgccctccatcatccaccccagaattgctctctttcctctcttagctctgttgcccactttccttgggccataccttccctgcagatctccagcccagaaccatcttcccctgttgtcctcctctctcctccaccgggactgctggtcactgcttagaaccgtcatgccagggtcccaaaagtgtgggtgcctgacttcctctctgtgcagcactctctgaatccctcctattcaccttgctgctgttattccccgaatgcgcaacataccccccatcaatatatctcagtatttcatgtctcaataccaatcttttaaactactgcctctaccagaaatgtcttttaatacttcttctgtctcattaacattacatttcaaggctgagctttaatgtcagtgtctcttagacattcagagggtgaaccaccatcccttcaccccaaagaaatgatctctgcttcatttgtgcctccctcaccatgaccccactcttaccatagtggctacattacttcagattcccctaatgtctttccagccagacttggaatcatggagggaaaacattgttacctcggatctcctggttacccagcacatagtagtactggattccagctcataataagtactctatatcatttttcaatataaaatgtatttgtgcaaattctagtcaatactactttatgtaaacagcagtgtaaaatccaaaaacttccagtcctggaggcaggttgtgcagcttaggggaggaccccagaatctggaccccagagtctggaagcaggccagaaaggataaggcaaatgactgaacagttccctcaggactcacgtactgatctcccaaaagaagagagggtctccctggggtggggttgctggaccttcaatccatcgctacagtccagaaggcaattggccactcctaatgtgggcctgccctccctttatttttccagttcttatttcacctgataatattccgtccaattggcaatggcacataaaaattaggatggagtgtgtggacaaatacttcttcatcttcttgtctaggttttagaaatcaccttctcaagggagccttgtctaatgttcctgagactatttcacactctccatgcttatgtcaatgcaggactcatcacatctattcggatattctgtttacacacccatgtcatcccagagaggtgatcacagggcagggacacatgtgtggcatacagttcctagttaagatcccaaatcctgagatattgctgatttgctatggcaggtcgtcaagagaactgtgtcattccaaactcaccaaggtggcttatagaacagaagcagatggatatgaagaggagaggggaccagaccatctccgcaaccacagcccagagctccagtcaccagatagaaaattgatttgatttcatccaatattccttcgaaagagtgtcaaggaatagggtggggcaatgtgtcattctgcattggaaggaggacattttagagcaaggcctaagggcacaggtattagtgtcatattgatcagaattcaacctttgttctaacacatactagagcaagaatttacttgatttggaataattaatagctactggacattatattggtactaaagagaaagaatacttgacagctctatgcccacactcacattacagctgatgtgaaagagattctggaaatccaaatgttccccagaaattctgatatcaaaacattccaataacttttttttttcaggcgcagtctcactctgtcgcccgggctggagtgctgtgagctgtccgtggtgctgaattcactgtgacgtcactcctgtctctctttgctttcttctgactgacatttattcagccttctctacaggaatctcttatgttcccccacatgcaggtggtttttcagtaggctcctgaagagtgatctcaactttccaggaagaaaagagggcaaagggaacaatgtgaaaagaagcagaaaatcataaaagaccatgtgtttgataaacaaccagattgtttctggttccctgccactataaaaacaccatgagagcatactcatacatgttcccttataaatctgcgaggtagtttctttggtattcttgcccaggaaatgggttgattcatcacagattttatatatatacttttttttaactaagtgtgagataatatcttattgtttttgtaacttgcattttacaagagttctgaccagcaccagataagcttcagtgctctcctttctttggccttaatattattggattaaagaattactgcctctcactaggagcatcatttatttaccattattttcaatttcatattaaaactcaatttctagtagagtc

SEQ ID NO: 1666 - DNA, 568 bp, Homo sapiens
agatctttgaagactctgattctctgagactgaggagagatgtcttaccagcagcagcagtgcaagcagccctgccagccacctcctgtgtgccccacgccaaagtgcccagagccatgtccacccccgaagtgccctgagccttacctgcctcctccttgtccacctgagcattgcccacctccaccatgccaggataaatgccctcctgtgcaaccatacccaccctgccagcagaagtatccacccaagagcaagtaacatcactagaattcatcaggaccatgaaacaacaagatccagtggctcttcttactcccaggactccatcatcttcccttcagctgtagtgggaggctgcatcttccctaacctctgtctggcttgagcgttgacagagaaaaggcttagttctgaaaaccgatatgttgttggaagatgagcagccagatcactgcctaatctcgctttgctgtctgtgatgtagatggtggttcctatcctgagagcaagtgtgtttattcttttgcttctccccaataaagcacatgtttcatggtcaagccca

SEQ ID NO: 1667 - DNA, 678 bp, Homo sapiens
aaactcctggtacttgagcactgatctgctttggagaacctgattctgagactccagcaggatgtcttatcaacagcagcagtgcaagcagccctgccagccacctcctgtgtgccccacgccaaagtgcccagagccatgtccacccccgaagtgccctgagccctgcccaccaccaaagtgtccacagccctgcccacctcagcagtgccagcaaaaatgtcctcctgtgacaccttccccaccctgccagccaaagtgtccacccaagagcaagtaacagcttcagaattcatcaggagcatgaaaggataaggataattggctcaccttgttccacagcttcacctgcatcttctcatcaaagcctaccatggatacacagttagcttctttcctcttagccagtgatctgcccatgatgatccctgatagcaaaaggtttcctttctgaggctgccatattgccactgtccaggtggagactgagaaaggaagtcctcagcagtgtcagttcccagagctttggaagaaggaccagcagctctgtccctgggaaccatcaaaaaatgctgttgatgttttctgtgtctgtctgtcacctgggcatgggcttctaacacctgtgcaattgtcacttttctttcactccctgaataaaatatctttgcatacgta

SEQ ID NO: 1668 - DNA, 692 bp, Homo sapiens
gaaagtgtctgttcttgtcttttgttcacttttcaaaggggctgtttatttttcatattctgagactccagcaggatgtcttatcaacagcagcagtgcaagcagccctgccagccacctcctgtgtgccccacgccaaagtgcccagagccatgtccacccccgaagtgccctgagccctgcccaccaccaaagtgtccacagccctgcccacctcagcagtgccagcaaaaatgtcctcctgtgacaccttccccaccctgccagccaaagtgtccacccaagagcaagtaacagcttcagaattcatcaggagcatgaaaggataaggataattggctcaccttgttccacagcttcacctgcatcttctcatcaaagcctaccatggatacacagttagcttctttcctcttagccagtgatctgcccatgatgatccctgatagcaaaaggtttcctttctgaggctgccatattgccactgtccaggtggagactgagaaaggaagtcctcagcagtgtcagttcccagagctttggaagaaggaccagcagctctgtccctgggaaccatcaaaaaatgctgttgatgttttctgtgtctgtctgtcacctgggcatgggcttctaacacctgtgcaattgtcacttttctttcactccctgaataaaatatctttgcatacgta

SEQ ID NO: 1669 - DNA, 788 bp, Homo sapiens
ctgtagtacacatccttgatggcaccaagtagcaaacgtgctgtggagactagatctcactctcaaatctgtcctgggatgcaagtgcctctacgaatgtggtgcagaagctacaaatgtggtgcagaagacagcttcaaagaggaaaggaatataggtgccaagagcctgcaatccttcccaaacagccctttgttctgtgctcaagtcaacccactgggactttactacagataatgataagagaaatggcttgtgagattgctcatgatcctgagactccagcaggatgtcttatcaacagcagcagtgcaagcagccctgccagccacctcctgtgtgccccacgccaaagtgcccagagccatgtccacccccgaagtgccctgagccctgcccatcaccaaagtgtccacagccctgcccacctcagcagtgccagcagaaatatcctcctgtgacaccttccccaccctgccagccaaagtgtccacccaagagcaagtaacagcttcaggattcatcaggagcatgagaggataaggataattggctcacctcgttccacagctccacttgcatcttctcaccaaagccttccatggatgcacagggagcttctttctccttaacctgtggcctgcctgtgatgatctgtgacagcaaaagattccctttctgaggctgccatactgccactgtccaggtggagctaagaaaaggaagtcctcagctgtgccagctcccagagcttcggaagaaagagcagcagctctctccctgggaac

SEQ ID NO: 1670 - DNA, 800 bp, Homo sapiens
aggctgtagtacacatccttgatggcaccaagtagcaaacgtgctgtggagactagatctcactctcaaatctgtcctgggatgcaagtgcctctacgaatgtggtgcagaagctacaaatgtggtgcagaagacagcttcaaagaggaaaggaatataggtaaaaatctgaggttttatctgagaaaaaggtggcaaagaaaatttcagtcttgaacagggtcagcagatagcacaatgtggtcagcctgcaaacccagagatcctgagactccagcaggatgtcttatcaacagcagcagtgcaagcagccctgccagccacctcctgtgtgccccacgccaaagtgcccagagccatgtccacccccgaagtgccctgagccctgcccatcaccaaagtgtccacagccctgcccacctcagcagtgccagcagaaatatcctcctgtgacaccttccccaccctgccagccaaagtgtccacccaagagcaagtaacagcttcaggattcatcaggagcatgagaggataaggataattggctcacctcgttccacagctccacttgcatcttctcaccaaagccttccatggatgcacagggagcttctttctccttaacctgtggcctgcctgtgatgatctgtgacagcaaaagattccctttctgaggctgccatactgccactgtccaggtggagctaagaaaaggaagtcctcagctgtgccagctcccagagcttcggaagaaagagcagcagctctctccctgggaaccatcagacaattctgttgat

SEQ ID NO: 1671 - DNA, 782 bp, Homo sapiens
aggctgtagtacacatccttgatggcaccaagtagcaaacgtgctgtggagactagatctcactctcaaatctgtcctgggatgcaagtgcctctacgaatgtggtgcagaagctacaaatgtggtgcagaagacagcttcaaagaggaaaggaatatagatcctgagactccagcaggatgtcttatcaacagcagcagtgcaagcagccctgccagccacctcctgtgtgccccacgccaaagtgcccagagccatgtccacccccgaagtgccctgagccctgcccatcaccaaagtgtccacagccctgcccacctcagcagtgccagcagaaatatcctcctgtgacaccttccccaccctgccagccaaagtgtccacccaagagcaagtaacagcttcaggattcatcaggagcatgagaggataaggataattggctcacctcgttccacagctccacttgcatcttctcaccaaagccttccatggatgcacagggagcttctttctccttaacctgtggcctgcctgtgatgatctgtgacagcaaaagattccctttctgaggctgccatactgccactgtccaggtggagctaagaaaaggaagtcctcagctgtgccagctcccagagcttcggaagaaagagcagcagctctctccctgggaaccatcagacaattctgttgatgtgttctgtgtctgtctgtcacctggtcatgagcttctaccacctttgcaattgtcatttatctttcactccctgaataaagta

SEQ ID NO: 1672 - DNA, 9623 bp, Homo sapiens
accctgaaagctgtttctgtctctaccctacttgttcctctggtgagctaggttactcaaacttgcaaaaaaaaaaatgcctaaactcctacaaggcgtcatcactgtcatcgatgttttctaccaatatgccacccagcatggggagtatgatacgttgaacaaggcagagctgaaagaacttctggaaaatgagtttcatcaaattctgaagaatccaaacgatccagatactgtggatatcatcttgcaaagtctggatcgagaccataacaagaaagtggattttactgagtatcttctgatgatattcaagctggttcaggctcgtaataaaatcattggcaaagattactgccaagtttcagggtcaaagctgagagatgacactcaccagcaccaagaggaacaagaagaaactgaaaaagaggagaacaaacggcaagaatcctcttttagtcattcaagttggagtgcaggagagaatgattcctattccagaaacgtcagaggaagtcttaaacctgggactgaatccatatccagaagactgagttttcaaagagacttttctggccaacataactcctactcaggtcagtcttccagctatggtgagcaaaactccgactcccatcagtcttcaggccgcggccaatgtgggtctgggtcagggcagtctcccaactatggccaacacggctctggctccggacagtcttccagcaatgacacacatgggtctggctcaggccagtcttctggctttagtcaacacaagtctagctcagggcagtcctctggttacagtcagcatggatctggctcaggtcactcctctggctacggacaacacggctctaggtcaggacagtcatctaggggtgaacgacacagatctagctcaggttcgtcttccagctatggtcagcatgggtctggttcccgtcagtctttgggccacggccgacaagggtctggatctcgccagtctcctagccacgtccgacatgggtccggttcggggcactcctccagccacggccaacacgggtctggctcaagttactcttacagccgtggccattatgagtctggctcaggccagacttctggctttgggcaacatgagtctggctcaggacagtcctctggctatagtaagcatggttctggctcaggtcactcctctagccagggacaacatggatctacgtcagggcaggcatcaagctctggccaacatggctccagctcacgtcagtcttccagctatggtcagcatgagtctgcctcccgtcactcttcaggccgcggccaacacagctctggatctggccagtctccaggccacggccagcgtgggtctgggtcagggcagtctcccagctccggccaacatgggactggctttggtcgatcttccagcagtggcccatatgtgtctggttcaggctactcttctggctttggtcaccacgagtctagctcagagcattcctctggttacactcagcatggatctggctcaggtcactcctccggccacggacaacacggctctaggtcaggacagtcatctaggggtgaacgacaaggatctagtgcaggttcatcttccagctatggtcagcatgggtctggctcccgtcaatctttgggacacagccgacatgggtctggatctggccagtctcctagccctagccgtggccgacatgagtctggttccaggcagtcttccagctatggcccacatgggtatggctcagggaggtcttcaagccgtggcccatatgagtctggctccggtcactcttctggcttaggtcaccaagagtctcgctcaggacagtcctctggctacggtcaacacggatctagctcgggtcattcctctacccatgggcaacatggttctacatcaggacagtcatcgagctgtggccaacatggagctacctcaggtcagtcttccagccacggtcagcatggctctggctcaagtcagtcttctcgctatggccaacagggctctggatctggccagtctcctagtcgcggccgacatgggtccgattttgggcactcttccagctacggccaacatgggtctggctccggttggtcttcaagcaatggcccacatgggtctgtctcaggccagtcttccggctttggtcacaagtctggctcagggcagtcctctggttacagtcagcatggatctggctcaagtcactcctccggctacagaaaacacggctctaggtcaggacagtcatctaggagtgaacaacacggatctagctcaggtttgtcttccagctatggtcagcatgggtcgggctcccatcaatcttcgggccacggccgacaagggtctggatctggccactctcctagccgtgtccgacatgggtccagttcagggcactcctccagccacggccaacacgggtctggcacaagttgttcttccagctgtggccattatgagtctggctcaggccaggcttctggttttgggcaacacgagtctggctcaggacagggctatagtcagcatggttctgcctcaggtcacttctctagccagggacgacatggatctacgtcagggcagtcatcaagctccggccaacatgactctagctcaggtcaatcttccagctatggtcagcatgagtctgcctcccatcacgcttcgggccgcggccgacatggctctggatctggccagtctccaggccacggccagcgtgggtctgggtcagggcagtctcccagctatggccgacatgggtctggctccggtcggtcttccagcagtggccgacatgggtctggctcaggccagtcttctggctttggtcacaagtctagctcagggcagtcctctggttacactcagcatggatctggctcaggtcactcctccagctacgaacaacacggctctaggtcaggacagtcatctaggagcgaacaacatggatctagctcaggttcgtcttccagctatggtcagcatgggtctggctcccgtcagtctttgggccacggccaacatgggtctggatctggccagtctcctagccctagccgtggccgacatgggtctggttccgggcagtcttccagctatggcccatataggtctggctcagggtggtcttcaagccgtggcccatatgagtctggctccggtcactcttctggcttaggtcaccgagagtctcgctcaggacagtcctctggctacggtcaacatggatctagctcaggtcattcctctacccatgggcaacacggttctacatcaggacagtcatcgagctgtggccaacatggagctagctcaggtcagtcttccagccacggtcagcatggctctggctcaagtcagtcttctggctatggccgacagggctctggatctggccagtctccaggccacggccagcgtgggtctgggtcaaggcagtctcccagctacggccgacatgggtctggctccggtcggtcttccagcagtggccaacatgggtctggcttaggcgagtcttctggctttggtcaccacgagtctagctcagggcagtcctctagttacagtcagcatgggtctggctcaggtcactcctctggctacggacaacacggctctagatcaggacagtcatctaggggtgaacgacacggatctagctcaggttcgtcttcccactatggtcagcatgggtctggctcccgtcagtcttcgggccacggccgacaagggtctggatctggccattcccctagccgcggccgacatgggtccggtttggggcactcctccagccacggccaacatgggtctggctcaggtcgttcttccagccgtggcccatatgagtctcgctcgggtcactcttctgtctttggtcaacatgagtctggctcaggacattcctctgcttacagtcagcatggtagtggctcagggcacttctgtagccaaggacagcatggttctacatcaggacagtcatcaacctttgaccaggagggatctagcacaggccagtcttccagctatggccaccgtggctctggctccagtcagtcttctggctatggccgacatggggctggatctggccagtctcctagtcgcggccgacatgggtccggttctgggcactcttccagctacggccaacatgggtctggctccggttggtcttccagcagtggccgacatgggtctggctcaggtcagtcttctggatttggtcaccacgagtctagctcatggcagtcctctggttgcactcagcatggatctggctcaggtcactcctccagctacgaacaacacggctctaggtcaggacagtcatctaggggtgaacgacacggatctagctcaggttcatcttccagctatggtcagcatgggtctggctcccgtcagtctttgggccacggccaacatgggtctggatctggccagtctcctagccctagccgtggccgacatgggtctggttctgggcagtcttccagctacagcccatatgggtctggctcagggtggtcttccagccgtggcccatatgagtctggctccagtcactcttctggcttaggtcaccgagagtctcgctcaggacagtcctctggctacggtcaacatggatctagctcaggtcattcctctacccatgggcaacatggttctacatcaggacagtcatcgagctgtggccaacatggagctagctcaggtcagtcttccagccacggtcagcatggctctggctcaagtcagtcttctggctatggccgacagggctctggatctggccagtctccaggccacggccagcgtgggtctgggtcaaggcagtctcccagctacggccgacatgggtctggctccggtcggtcttccagcagtggccaacatgggtctggcttaggcgagtcttctggctttggtcaccacgagtctagctcagggcagtcctctagttacagtcagcatgggtctggctcaggtcactcctctggctacggacaacacggctctagatcaggacagtcatctaggggtgaacgacacggatctagctcacgttcgtcttcccgctatggtcagcatgggtctggctcccgtcagtcttcgggccacggccgacaagggtctggatctggccagtcccctagccgcggccgacatgggtccggtttggggcactcctccagccacggccaacatgggtctggctcaggtcgttcttccagccgtggcccatatgagtctcgctcgggtcactcttctgtctttggtcaacatgagtctggctcaggacattcctctgcttacagtcagcatggtagtggctcagggcacttctgtagccaaggacagcatggttctacatcaggacagtcatcaacctttgaccaggagggatctagcacaggtcagtcttccagccacggtcagcatggctctggctcaagtcagtcttctagctatggccaacagggctctggatctggccagtctcctagtcgcggccgacatgggtccggttccgggcactcttccagctacggccaacatgggtctggctccggttggtcttccagcagtggccgacatgggtctggctcaggtcagtcttctggatttggtcaccatgagtctagctcatggcagtcctctggttacactcagcatggatctggctcaggtcactcctccagctacgaacaacacggctctaggtcaggacagtcatctaggggtgaacaacacggatctagctcaggttcatcttccagctatggtcagcatgggtctggctcccgtcagtctttgggccacggccaacatgggtctggatctggccagtctcctagccctagccgtggccgacatgggtctggttctgggcagtcttccagctacggcccatatgggtctggctcagggtggtcttccagccgtggcccatatgagtctggctccggtcactcttctggcttaggtcaccgagagtctcgctcaggacagtcctctggctacggtcaacatggatctagctcaggtcattcctctacccatgggcaacatggttctgcatcaggacagtcatcgagctgtggccaacatggagctagctcaggtcagtcttccagccacggtcagcatggctctggctcaagtcagtcttctggctatggccgacagggctctggatctggccagtctccaggccacggccagcgtgggtctgggtcaaggcagtctcccagctatggccgacatgggtctggctccggtcggtcttccagcagtggccaacatgggcctggcttaggcgagtcttctggctttggtcaccacgagtctagctcagggcagtcctctagttacagtcagcatgggtctggctcaggtcactcctctggctacggacaacacggctctagatcaggacagtcatctaggggtgaacgacacggatctagctcaggttcgtcttcccgctatggtcagcatgggtctggctcccgtcagtcttcgggccacggccgacaagggtctggatctggccattcccctagccgcggccgacatgggtccggttcggggcactcctccagccacggccaacatgggtctggctcaggtcgttcttccagccgtggcccatatgagtctcgctcgggtcactcttctgtctttggtcaacatgagtctggctcaggacattcctctgcttacagtcagcatggtagtggctcagggcacttctgtagccaaggacagcatggttctacatcaggacagtcatcaacctttgaccaggagggatctagcacaggtcagtcttccagccacggtcagcatggctctggctcaagtcagtcttctagctatggccaacagggctctggatctggccagtctcctagtcgcggccgacatgggtccggttccgggcactcttccagctacggccaacatgggtctggctccggttggtcttccagcagtggccgacatgggtctggctcaggtcagtcttctggatttggtcaccacgagtctagctcatggcagtcctctggttacactcagcatggatctggctcaggtcactcctccagctacgaacaacacggctctaggtcaggacagtcatctaggggtgaacgacacggatctagctcaggttcatcttccagctatggtcagcatgggtctggctcccgtcagtctttgggccacggccaacatgggtctggatctggccagtctcctagccctagccgtggccgacatgggtctggttctgggcagtcttccagctacagcccatatgggtctggctcagggtggtcttccagccgtggcccatatgagtctggctccggtcactcttctggcttaggtcaccgagagtctcgctcaggacagtcctctggctacggtcaacatggatctagctcaggtcattcctctacccatgggcaacatggttctacatcaggacagtcatcgagctgtggccaacatggagctagctcaggtcagtcttccagccacggtcagcatggctctggctcaagtcagtcttctggctatggccgacagggctctggatctggccagtctccaggccacggccagcgtgggtctgggtcaaggcagtctcccagctacggccgacatgggtctggctccggtcggtcttccagcagtggccaacatgggtctggcttaggcgagtcttctggctttggtcaccacgagtctagctcagggcagtcctctagttacagtcagcatgggtctggctcaggtcactcctctggctacggacaacacggctctagatcaggacagtcatctaggggtgaacgacacggatctagctcaggttcgtcttcccactatggtcagcatgggtctggctcccgtcagtcttcgggccacggccgacaagggtctggatctggccagtcccctagccgcggccgacatgggtccggtttggggcactcctccagccacggccaacatgggtctggctcaggtcgttcttccagccgtggcccatatgagtctcgcttgggtcactcttctgtctttggtcaacatgagtctggctcaggacattcctctgcttacagtcagcatggtagtggctcagggcacttctgtagccaaggacagcatggttctacatcaggacagtcatcaacctttgaccaggagggatctagcacaggccagtcttccagctatggccaccgtggctctggctccagtcagtcttctggctatggccgacatggggctggatctggccagtctcttagccacggccgacacgggtctggttcagggcagtcttccagctacggccaacatgggtctggctcaggacagtcctctggttatagtcagcatggaagtggctcagggcaagatgggtattcttattgcaaaggaggaagtaaccatgatgggggaagttctggctcatattttctcagttttcctagtagcacttcaccctatgaatatgtccaagagcagaggtgctacttttatcagtgaataataaacataaatgcaatttactcaagtagcaatttaagaaataggaaagtcatctatgaattcatcatgaaagacaagcaatccatcatgaaattcgttctaaaagtgaatcaatgcatttctgtctctttctttagagcctaaaactgtagcatatatcttgttatggggttccttccaaagactgttaggcatttgtgctactttgttagaaaatactgagtggaataacttgttagaatgagggttaaactttgaggaataatgaaaagcttttaaagagctttgggtttagttggagttgtctttttgagagctcatcattcatttatagatggtgccaaagctaaccttacatttcttagaagcaaaatattacaaatgcattaccagtcctagatacaaagctttgttttacagcaattagtgtaccctaatttttagtgtgccccaagtttggtgtgtcccaatttttggtattgtggcagaaggtgaaggctctgaaagcaaagatgcagcagcggtagtgtctttacttatcaaaaccatcaagtcctttttcttgggtatatatttaatcagtaagttaattagtggcataaaaaagtagcatcagggtcttttcccaagccagtgagcaagagcattatttcataaagaatagggatttatcatttcaggaaaaaaaaaaacattcaaatgtgggctttagcttgttttcagcagaaagatcttgctccctatttctaagaggctgctcaatattgggaaatatattgaggagttattccatggaaatacaatgctttccacctactactgtagttcaataacgtttccacctgaaaaaatatcatccatgcccagatgaaaaggaagagtatctgtcactgctacatagttccttaatttgactgtaacacatttgtttcaagtctttggattcaaacaaccggattgtattaaaattgacaataaataaatgttgatt

SEQ ID NO: 1673 - DNA, 1462 bp, Homo sapiens
atggcggccccaacggccgtccaggacgtggagcgaaatgagctcgggcgctgacggcggcggtggcgctgcggtggcggcgcggtcggacaagggcagtcccggggaggacggtttcgtcccgtcggcgctggggacccgcgagcattgggatgctgtctatgagagagaactgcaaactttccgagaatatggagatacaggtgaaatctggtttggagaagagagtatgaatcgactaataaggtggatgcagaaacacaagattccactggatgcttcagtgcttgatattggaactggaaatggtgttttcctggttgaacttgcaaaatttggtttctctaatattactggaattgattactctccttctgcaattcagctttctggaagtattatagaaaaagaaggtttatctaacattaagttaaaggtagaagactttttgaatctctccacacagctgtctggatttcatatttgtattgacaaagggacttttgatgccataagccttaatcctgacaatgcaattgagaagaggaagcaatatgtgaaatctctctccagggtgttgaaagtaaaaggcttttttctaataacgtcatgtaattggaccaaggaagagttgctaaatgaattcagtgaaggttggagtacagtggcaggattttggctcactgcagccttgacttcctgggctcaagcgatcttttccacttcagcctcccgagtaggtggaactacaggcacacatcatcatgcctggataatttttgtatttttagcagagacgaggttttgccatgttgtccaggctggtctggaactcctgggctcaagtgattctcccacctggcctcccaaagtgctgggattataccatgccaggccctcgttggcattttagatttgaacttctcgaagagctaccaacacccaagttcagctttggaggcagatctggaaacagtgtagcagcattggttttccaaaaaatgtgagactttttcttggacgaattcaggtagctacacagaatctacacagcaaagttaacctgacacagaaaatccttgtgcaaataaatgcttagtaagtacacaggatgcacatgttgaatagagtatactggattggtgaaagaaaataataataatgagcatctaagtggttgggttttagagatcaatcaagaataattttaattttcttttgtatttgaaatgtaaatagttttcttttcgattaaaaaaatttcctataactgctaaacagttaaaaactttaaagtagtaaatgagtttatagaaagcatgtattcttgatttttgtgccttggtaaagttgataactatttatgaatatttgaccaaattattccagcatcagaataataagcaaaataactttgttagtgttttgttagactgtttatgaaatataacaagaaatacta

SEQ ID NO: 1674 - DNA, 1522 bp, Homo sapiens
gaggagcagggccgggcgccatggcaccgtggggcaagcggctggctggcgtgcgcggggtgctgcttgacatctcgggcgtgctgtacgacagcggcgcgggcggcggcacggccatcgccggctcggtggaggcggtggccagactgaagcgttcccggctgaaggtgaggttctgcaccaacgagtcgcagaagtcccgggcagagctggtggggcagcttcagaggctgggatttgacatctctgagcaggaggtgaccgccccggcaccagctgcctgccagatcctgaaggagcaaggcctgcgaccatacctgctcatccatgacggagtccgctcagaatttgatcagatcgacacatccaacccaaactgtgtggtaattgcagacgcaggagaaagcttttcttatcaaaacatgaataacgccttccaggtgctcatggagctggaaaaacctgtgctcatatcactgggaaaagggcgttactacaaggagacctctggcctgatgctggacgttggtccctacatgaaggcgcttgagtatgcctgtggcatcaaagccgaggtggtggggaagccttctcctgagtttttcaagtctgccctgcaagcgataggagtggaagcccaccaggcccagtgacgagcaccatccggaagtgaaggctgatgggtacgtggacaacctcgcagaggcagtggacctgctgctgcagcacgccgacaagtgatggcctcctgggagagccccgcctcctccacccctgcctctcctccacccctgcctcccctccacccctgcctctcctccacccgcccaggagagccccacctcctccacccctgcctctcctccacccctgcctcccctccacctgccccagtgcccagaccaaccaaggccctgacagccctgccttctgccctctgccctgcatgggcaggcatttgttccctacctgggtggcctgctcccctgcctgggccctgacttcagctccctgtagtgaagtccaggagggtgggacaggcctgtcaggcctctgggaatctcccaaatcccagaactcaccactcaccatgggcctttaaatgcagtaaactccacctaaccagattcaggggcactatgcccactgcctcctcttcagactctttgcatttcagtgaagagcctggaagaaacccaggggcctcctatgcacagatcttgcagcccagaaccaagtcagcctccctgcgactgcccaggcacactgcccaccaccccacccccgaaacaatgccagcccgctgctttttctatcctcccagtcacctttgcagacaaagaccaggggcagctcccgagggcactgtgaaggctcccatgccacacagtgagaactgtagcctctgcgtccaaggcacacagggtactttctggacccactgctggacagacttgaaggtgtcatgcccggtgtgtgcaggaggaaactaacagttcagtaaactctgccttgaccagca

SEQ ID NO: 1675 - DNA, 1622 bp, Homo sapiens
gcggagctgaggagcagggccgggcgccatggcaccgtggggcaagcggctggctggcgtgcgcggggtgctgcttgacatctcgggcgtgctgtacgacagcggcgcgggcggcggcacggccatcgccggctcggtggaggcggtggccagactgaagcgttcccggctgaaggtgaggttctgcaccaacgagtcgcagaagtcccgggcagagctggtggggcagcttcagaggctgggatttgacatctctgagcaggaggtgaccgccccggcaccagctgcctgccagatcctgaaggagcaaggcctgcgaccatacctgctcatccatgacggagtccgctcagaatttgatcagatcgacacatccaacccaaactgtgtggtaattgcagacgcaggagaaagcttttcttatcaaaacatgaataacgccttccaggtgctcatggagctggaaaaacctgtgctcatatcactgggaaaagggcgttactacaaggagacctctggcctgatgctggacgttggtccctacatgaaggcgcttgagtatgcctgtggcatcaaagccgaggtggtggggaagccttctcctgagtttttcaagtctgccctgcaagcgataggagtggaagcccaccaggccgtcatgattggggacgatatcgtgggcgacgtcggcggtgcccagcggtgtggaatgagagcgctgcaggtgcgcaccgggaagttcaggcccagtgacgagcaccatccggaagtgaaggctgatgggtacgtggacaacctcgcagaggcagtggacctgctgctgcagcacgccgacaagtgatggcctcctgggagagccccgcctcctccacccctgcctctcctccacccctgcctcccctccacccctgcctctcctccacccgcccaggagagccccacctcctccacccctgcctctcctccacccctgcctcccctccacctgccccagtgcccagaccaaccaaggccctgacagccctgccttctgccctctgccctgcatgggcaggcatttgttccctacctgggtggcctgctcccctgcctgggccctgacttcagctccctgtagtgaagtccaggagggtgggacaggcctgtcaggcctctgggaatctcccaaatcccagaactcaccactcaccatgggcctttaaatgcagtaaactccacctaaccagattcaggggcactatgcccactgcctcctcttcagactctttgcatttcagtgaagagcctggaagaaacccaggggcctcctatgcacagatcttgcagcccagaaccaagtcagcctccctgcgactgcccaggcacactgcccaccaccccacccccgaaacaatgccagcccgctgctttttctatcctcccagtcacctttgcagacaaagaccaggggcagctcccgagggcactgtgaaggctcccatgccacacagtgagaactgtagcctctgcgtccaaggcacacagggtactttctggacccactgctggacagacttgaaggtgtcatgcccggtgtgtgcaggaggaaactaacagttcagtaaactctgccttgaccagca

SEQ ID NO: 1676 - DNA, 6054 bp, Homo sapiens
agactaccggcggcgacgaccacaggagcatggcggacaccgacctgttcatggaatgtgaggaggaggagttggagccatggcagaaaatcagtgatgtcattgaggactctgtagttgaagattataattcagtggataaaactaccacagtttctgtgagccagcagccagtctcggctccagtgcccatcgctgcccatgcttctgttgctgggcacctctctacatccaccaccgttagtagcagcggggcacagaacagcgacagtacaaagaagactcttgtcacactaattgccaacaacaatgccccaggtacccagtttgttaagccgacagttggagttccacaagtgttctcccagatgacccctgtgaggccaggctccacaatgcctgtgaggcccaccaccaacaccttcaccaccgtcatcccggccactcttaccattcgaagcaccgtcccacagtcccagtcccagcagaccaagtccactcccagcacttctaccactcccactgccacacagccaacctcactggggcaactagctgttcagtctccaggccagtcaaaccagaccacgaatcccaagctagctccctccttcccctctccacctgcagtgagcattgccagctttgtcactgtgaagcgacctggtgttacaggcgaaaatagcaatgaagtggccaaattggtgaatacccttaacaccatcccttccctgggccagagtcctgggccagtggtggtgtccaacaacagctctgctcatggctctcaaagaaccagcggacctgagtcttcaatgaaagtgacctcttccatcccagtatttgacctccaggatggtggacggaaaatatgtccacgatgtaatgctcaatttcgtgttactgaagctttgagaggtcacatgtgttactgttgcccagaaatggttgaataccagaagaaaggaaagtccctggattcagaacccagtgtcccatcagcagcaaagcccccatcccctgagaaaacagctcctgttgcttccacaccctcttctacacctattcctgctctgtcaccgcctaccaaagtaccagaaccaaatgagaacgtgggcgatgccgtccagaccaaactcattatgcttgtagatgacttctactatggacgggatggtggcaaagtagcccagctcacaaatttccctaaggtcgccacatctttccgatgcccacattgtaccaaaaggctaaaaaacaatattcgattcatgaaccatatgaaacaccacgtagaactcgatcagcagaacggtgaggtagatggtcacactatctgccagcactgttaccgccagttttccactcccttccagcttcagtgccacttggaaaatgttcatagtccctatgaatctactaccaagtgcaagatctgtgaatgggcgtttgaaagtgagccactatttctccagcatatgaaggatactcataagcctggagagatgccttatgtttgccaggtgtgtcaatatcgctcctcactctactctgaggtagatgtccattttcggatgatccatgaggatacccggcatctgctctgcccttattgcctgaaggtcttcaaaaatggcaatgcattccaacagcattacatgaggcaccagaagagaaatgtttatcactgcaacaaatgccggctgcagtttctctttgccaaggacaaaattgaacacaagcttcaacaccataaaaccttccgtaaacccaagcagctggagggcttgaaaccaggcaccaaggtgacaatccgggcttcccgagggcagccacgaactgttcctgtatcctctaatgatacacctcccagcgccttgcaggaggcagcaccgctgacctcctcaatggaccctctgcctgtcttcctttatccccctgtccagcgcagcatccagaagagagctgttaggaaaatgagtgtcatgggccggcagacatgcctggagtgcagcttcgagatcccagacttccctaatcatttccctacttacgtacactgctctctgtgtcgctatagcacctgctgttctcgagcttatgccaaccacatgatcaacaatcatgttccacggaagagccccaagtatttggctttgtttaaaaattctgtgagtggaatcaagctggcctgcacttcatgtacctttgttacctctgtgggcgatgctatggccaagcatttggtattcaacccctctcacagatccagcagcatcctgccacggggactcacttggatagctcactcaaggcatggccagactcgtgaccgagtgcatgaccggaacgtgaagaatatgtaccctcctccttccttccccactaacaaagctgccactgtgaaatctgcgggggccaccccagctgagcctgaagagctactaactcccttagccccagcactcccatcaccagcctcaactgcaaccccaccaccaacccccactcacccgcaggctttagcccttccaccgctggctacagagggagccgaatgtctgaatgttgatgatcaggatgaagggagcccagtcacccaagaacctgagctagcatcaggtggtggtggtagtggtggagttggcaaaaaggagcagctgtctgtgaagaagcttcgagtagtactgtttgctctatgctgcaatacagaacaggcagctgaacacttccgaaatccccagcgacgtattcgccgttggcttcgacgtttccaggcctcccagggggagaatctagagggcaaatatctgagctttgaggcagaagagaaactggctgagtgggtgctaacccagcgcgaacaacagctacctgtaaatgaggagaccttgttccagaaggccaccaaaataggacgttctttggaaggggggtttaagatctcctatgagtgggctgtgcgtttcatgctgcggcaccacctgactccccatgcccggcgagctgtggcccacaccctacctaaggatgtagcagagaatgcaggactcttcattgattttgtacaacggcagattcacaaccaggacttacccttgtctatgattgtggctattgatgagatctctttgttcctggatacagaggtgctgagcagtgatgatcgaaaggagaatgccctgcagacagtgggcacaggggaaccttggtgtgatgtagtcctagccattctggcagatggcactgtccttcccaccctggttttctacagagggcagatggatcagcctgctaacatgccagactccatattgctagaggcaaaggagagtggctacagtgatgacgagatcatggagctgtggtcaactcgagtgtggcagaagcacacagcttgccagcgcagcaaaggcatgcttgtgatggactgtcatcgcactcacttgtcagaagaggtactggctatgcttagtgcctctagcactttgcctgcagtggtcccagcaggctgtagctccaaaattcagccattagatgtatgcatcaaaagaactgtcaagaacttcctgcataaaaaatggaaggaacaggctcgggaaatggcagatactgcatgtgattctgatgtcctgcttcagctggtgcttgtctggctgggtgaagtgctaggtgtcattggggactgtccagagctagttcagcgctccttcctggtggctagtgttctgcctggccccgatggcaacattaactcacctacaagaaatgctgacatgcaggaggagctaattgcctccctagaggagcaactgaagctgagtggggaacattctgagtcttccactccacgacccagatcatctcctgaagagacaattgagcctgaaagtcttcaccagctctttgagggtgaaagtgagaccgagtctttctatggctttgaagaagctgacctagatctgatggagatttgagtgttggggtcatgagggggtgtggagtgagggtgggaacatgtgagggagggtaaaggggcttagggaaaagggggcataccaggtggggtatttggtttctattttttaattttataccaccactcccccctgaagttgacttacacttccctgtggatttgtggattaattaggaaaaccaatagtaatcacgtctgagccaaggagctggcccattggtcattcacttctgctaaaaacaggtttttgtgactttttttttttttaaatttaaatcactgtgtttggtatttttctgacaaaattaagaaaaagaaaaaaaattatttgtgggcaaatgttaaatttttttgtttccccttttacctcaattgtatcatagtactgggtttttttgtttgttttattgtgtggccaatgtctttgggcatgatgctatctaatcattgttaatgtgagaacatttctgaagatgggaaagacaaattatgtagctcacaaactggtttattatatatatggataaaaaacttttttcattgtggtcttaacacttttatataaaaatgaaaatggaaaaaaagtcccactgaactctctcttccttctccttttctttccttccctctccagagatgttggtttctacagcaaccctagatataaaattgtggctttaaaaatgcatgaaaccacctttaattatccagaatgaatagatttgtcttttcctcaccaccttccctccaaaacatgacataaacaatattttttgcacttgtgatccttggcccctttccccattctcaacaccatccatccctctggacaaaggatcatacaggtgttattagcaagcaagagatactgaagcgatcaaacagttttagggtggaagccattcccagtttgagtcttcatcctgtaagcccccaggggcagtccctgctttactgaacttcatcctgttagatggagagcatgcctgtttaagggattactggtcctacagccaggagctaattgttcaagaagtgttgaactttaaaaagacaagaccacttgttgaaatccagcgtgctctgtggctttcccctatttctcttaatacttagggaagaatctgacaggaagaagcgcacaggggtgtgcacaaagaaaatgacatgaatctttatttttcactgccagcttcaaggaaagaaaattttttctacaatttgcatgagggatttttttaattgtatgtactcatggttgtaaaccaaaacgtactgtaccgtacagagaaaaggagcaaaaaaccaagtcttctgtttatcctgaggctttccacaatgttcccctcctgtgagccaaggaggcaaactgcacaagcttgtaaatggttcgtctttaaaatgtacataagtggaacatttaataaaatgaggggaaatggatttataaacttgttttttttctaggtgaccctgtttaataggctttcacagactggggaatgctcaagatgtgatgggcctggtggtacaggtgtgacatttgttaccacccatttctcccaccccaccctgcttttttgtttgtttgttttttcatcccccagcacactataatatagtgaactggaaaagtcccttccagaaacagcttggccagctttgtgaacctttgacatctgaaaacaaccaaggatccatctgggcttctcttccccagctttttgcctgatgccattttattgacagacaatggactttgaagtcagcctttgcctttgagaaagttcaagaactatggttggtcacgtctatctacaacctaatcctactctttggtagtctctgcagcagccacagccttagcagagctggggttcctgtcttctgcacacgattgactttcttgatgggtaattttttttaagattataccaacagtggatcagctgggttttggccaggaagttgtctttgtggactctgcctgcatggcttagtagtagaaggaaatttttttttggttttgttttttataattcagtttaatcaataaacatgtatttattgactgt

SEQ ID NO: 1677 - DNA, 3331 bp, Homo sapiens
cgcagccggggcctggtgcagcctccgcggccgctgtcagggaagcgcaggcggccaatggaacccgggagcggtcgctgctgctgaggcggcagtgtcggcagtccaaccgcgactgcccgcaccccctccgcgggggtcccccagaggatcaactaaaccttgaactaagaagaaaaatgtgttgtgagcagggggagcctcagctgcctcaggccgttcaggacagaagggtgtttctgaaggccggagcaagttttgaagaagtccctatcagattacacttggttgactactccggagcagccactaagagggatgaacaggcctgcgtggaaattgaatgagattagttgagtccacgctccatgagaatgctgaacaccatccaaagcagcaaattgagattccttgatttggggaagaggtttgggaggaacccttcaataattggcatgggacaagaggggacccagtccaagtgtatttgggactcgcagtagggaggaacaattcagagagagcttggaagctcgaagtctggctgtggccatgggagatacagtagtggagcctgcccccttgaagccaacttctgagcccacttctggcccaccagggaataatggggggtccctgctaagtgtcatcacggagggggtcggggaactatcagtgattgaccctgaggtggcccagaaggcctgccaggaggtgttggagaaagtcaagcttttgcatggaggcgtggcagtctctagcagaggcaccccactggagttggtcaatggggatggtgtggacagtgagatccgttgcctagatgatccacctgcccagatcagggaggaggaagatgagatgggggccgctgtggcctcaggcacagccaaaggagcaagaagacggcggcagaacaactcagctaaacagtcttggctgctgaggctgtttgagtcaaaactgtttgacatctccatggccatttcatacctgtataactccaaggagcctggagtacaagcctacattggcaaccggctcttctgctttcgcaacgaggacgtggacttctatctgccccagttgcttaacatgtacatccacatggatgaggatgtgggtgatgccattaagccctacatagtccaccgttgccgccagagcattaacttttccctccagtgtgccctgttgcttggggcctattcttcagacatgcacatttccactcaacgacactcccgtgggaccaagctacggaagctgatcctctcagatgagctaaagccagctcacaggaagagggagctgccctccttgagcccggcccctgacacagggctgtctccctccaaaaggactcaccagcgctctaagtcagatgccactgccagcataagtctcagcagcaacctgaaacgaacagccagcaaccctaaagtggagaatgaggatgagcctgttcgactggctcctgagagagaattcatcaagtccctgatggcgatcggcaagcggctggccacgctccccaccaaagagcagaaaacacagaggctgatctcagagctctccctgctcaaccataagctccctgcccgagtctggctgcccactgctggctttgaccaccacgtggtccgtgtaccccacacacaggctgttgtcctcaactccaaggacaaggctccctacctgatttatgtggaagtccttgaatgtgaaaactttgacaccaccagtgtccctgcccggatccccgagaaccgaattcggagtacgaggtccgtagaaaacttgcccgaatgtggtattacccatgagcagcgagctggcagcttcagcactgtgcccaactatgacaacgatgatgaggcctggtcggtggatgacataggcgagctgcaagtggagctccccgaagtgcataccaacagctgtgacaacatctcccagttctctgtggacagcatcaccagccaggagagcaaggagcctgtgttcattgcagcaggggacatccgccggcgcctttcggaacagctggctcataccccgacagccttcaaacgagacccagaagatccttctgcagttgctctcaaagagccctggcaggagaaagtacggcggatcagagagggctccccctacggccatctccccaattggcggctcctgtcagtcattgtcaagtgtggggatgaccttcggcaagagcttctggcctttcaggtgttgaagcaactgcagtccatttgggaacaggagcgagtgcccctttggatcaagccatacaagattcttgtgatttcggctgatagtggcatgattgaaccagtggtcaatgctgtgtccatccatcaggtgaagaaacagtcacagctctccttgctcgattacttcctacaggagcacggcagttacaccactgaggcattcctcagtgcacagcgcaattttgtgcaaagttgtgctgggtactgcttggtctgctacctgctgcaagtcaaggacagacacaatgggaatatccttttggacgcagaaggccacatcatccacatcgactttggcttcatcctctccagctcaccccgaaatctgggctttgagacgtcagcctttaagctgaccacagagtttgtggatgtgatgggcggcctggatggcgacatgttcaactactataagatgctgatgctgcaagggctgattgccgctcggaaacacatggacaaggtggtgcagatcgtggagatcatgcagcaaggttctcagcttccttgcttccatggctccagcaccattcgaaacctcaaagagaggttccacatgagcatgactgaggagcagctgcagctgctggtggagcagatggtggatggcagtatgcggtctatcaccaccaaactctatgacggcttccagtacctcaccaacggcatcatgtgacacgctcctcagcccaggagtggtggggggtccagggcaccctccctagagggcccttgtctgagaaaccccaaaccaggaaaccccacctacccaaccatccacccaagggaaatggaaggcaagaaacacgaaggatcatgtggtaactgcgagagcttgctgaggggtgggagagccagctgtggggtccagacttgttggggcttccctgcccctcctggtctgtgtcagtattaccaccagactgactccaggactcactgccctccagaaaacagaggtgacaaatgtgagggacactggggcctttcttctccttgtaggggtctctcagaggttctttccacaggccatcctcttattccgttct

SEQ ID NO: 1678 - DNA, 3340 bp, Homo sapiens
gggcctggtgcagcctccgcggccgctgtcagggaagcgcaggcggccaatggaacccgggagcggtcgctgctgctgaggcggcagtgtcggcagtccaaccgcgactgcccgcaccccctccgcgggggtcccccagagcttggaagctcgaagtctggctgtggccatgggagatacagtagtggagcctgcccccttgaagccaacttctgagcccacttctggcccaccagggaataatggggggtccctgctaagtgtcatcacggagggggtcggggaactatcagtgattgaccctgaggtggcccagaaggcctgccaggaggtgttggagaaagtcaagcttttgcatggaggcgtggcagtctctagcagaggcaccccactggagttggtcaatggggatggtgtggacagtgagatccgttgcctagatgatccacctgcccagatcagggaggaggaagatgagatgggggccgctgtggcctcaggcacagccaaaggagcaagaagacggcggcagaacaactcagctaaacagtcttggctgctgaggctgtttgagtcaaaactgtttgacatctccatggccatttcatacctgtataactccaaggagcctggagtacaagcctacattggcaaccggctcttctgctttcgcaacgaggacgtggacttctatctgccccagttgcttaacatgtacatccacatggatgaggatgtgggtgatgccattaagccctacatagtccaccgttgccgccagagcattaacttttccctccagtgtgccctgttgcttggggcctattcttcagacatgcacatttccactcaacgacactcccgtgggaccaagctacggaagctgatcctctcagatgagctaaagccagctcacaggaagagggagctgccctccttgagcccggcccctgacacagggctgtctccctccaaaaggactcaccagcgctctaagtcagatgccactgccagcataagtctcagcagcaacctgaaacgaacagccagcaaccctaaagtggagaatgaggatgaggagctctcctccagcaccgagagtattgataattcattcagttcccctgttcgactggctcctgagagagaattcatcaagtccctgatggcgatcggcaagcggctggccacgctccccaccaaagagcagaaaacacagaggctgatctcagagctctccctgctcaaccataagctccctgcccgagtctggctgcccactgctggctttgaccaccacgtggtccgtgtaccccacacacaggctgttgtcctcaactccaaggacaaggctccctacctgatttatgtggaagtccttgaatgtgaaaactttgacaccaccagtgtccctgcccggatccccgagaaccgaattcggagtacgaggtccgtagaaaacttgcccgaatgtggtattacccatgagcagcgagctggcagcttcagcactgtgcccaactatgacaacgatgatgaggcctggtcggtggatgacataggcgagctgcaagtggagctccccgaagtgcataccaacagctgtgacaacatctcccagttctctgtggacagcatcaccagccaggagagcaaggagcctgtgttcattgcagcaggggacatccgccggcgcctttcggaacagctggctcataccccgacagccttcaaacgagacccagaagatccttctgcagttgctctcaaagagccctggcaggagaaagtacggcggatcagagagggctccccctacggccatctccccaattggcggctcctgtcagtcattgtcaagtgtggggatgaccttcggcaagagcttctggcctttcaggtgttgaagcaactgcagtccatttgggaacaggagcgagtgcccctttggatcaagccatacaagattcttgtgatttcggctgatagtggcatgattgaaccagtggtcaatgctgtgtccatccatcaggtgaagaaacagtcacagctctccttgctcgattacttcctacaggagcacggcagttacaccactgaggcattcctcagtgcacagcgcaattttgtgcaaagttgtgctgggtactgcttggtctgctacctgctgcaagtcaaggacagacacaatgggaatatccttttggacgcagaaggccacatcatccacatcgactttggcttcatcctctccagctcaccccgaaatctgggctttgagacgtcagcctttaagctgaccacagagtttgtggatgtgatgggcggcctggatggcgacatgttcaactactataagatgctgatgctgcaagggctgattgccgctcggaaacacatggacaaggtggtgcagatcgtggagatcatgcagcaaggttctcagcttccttgcttccatggctccagcaccattcgaaacctcaaagagaggttccacatgagcatgactgaggagcagctgcagctgctggtggagcagatggtggatggcagtatgcggtctatcaccaccaaactctatgacggcttccagtacctcaccaacggcatcatgtgacacgctcctcagcccaggagtggtggggggtccagggcaccctccctagagggcccttgtctgagaaaccccaaaccaggaaaccccacctacccaaccatccacccaagggaaatggaaggcaagaaacacgaaggatcatgtggtaactgcgagagcttgctgaggggtgggagagccagctgtggggtccagacttgttggggcttccctgcccctcctggtctgtgtcagtattaccaccagactgactccaggactcactgccctccagaaaacagaggtgacaaatgtgagggacactggggcctttcttctccttgtaggggtctctcagaggttctttccacaggccatcctcttattccgttctggggcccaggaagtggggaagagtaggttctcggtacttaggacttgatcctgtggttggccactggccatgctgctgcccagctctacccctcccagggacctacccctcccagggaccgacccctggcccaagctccccttgctggcgggcgctgcgtgggccctgcacttgctgaggttccccatcatgggcaaggaagggaattcccacagccctccagtgtactgagggtactggcctagccatgtggaattccctaccctgactccttccccaaacccagggaaaagagctctcaattttttatttttaatttttgtttgaaataaagtccttagttagcc

SEQ ID NO: 1679 - DNA, 3934 bp, Homo sapiens
ccccgcccccttttctatttctgaacaggcatgttccaggcagctcacccgactccttagattactatggaatcggtagggtcctgaccgctggggaagcaggaaagcgtatcctgggaagaaaggcttggcttggactccggagaagaatactacatcgagacctgctggggaattttattttattttattatttttttggtcttggttgtactgagggaggaagaagaggttgtgtggcccggtcgaacttgtggcagcctgaaggccccctcaggcggcgccgcgggcagccccgcagccggggcctggtgcagcctccgcggccgctgtcagggaagcgcaggcggccaatggaacccgggagcggtcgctgctgctgaggcggcagtgtcggcagtccaaccgcgactgcccgcaccccctccgcgggggtcccccagagcttggaagctcgaagtctggctgtggccatgggagatacagtagtggagcctgcccccttgaagccaacttctgagcccacttctggcccaccagggaataatggggggtccctgctaagtgtcatcacggagggggtcggggaactatcagtgattgaccctgaggtggcccagaaggcctgccaggaggtgttggagaaagtcaagcttttgcatggaggcgtggcagtctctagcagaggcaccccactggagttggtcaatggggatggtgtggacagtgagatccgttgcctagatgatccacctgcccagatcagggaggaggaagatgagatgggggccgctgtggcctcaggcacagccaaaggagcaagaagacggcggcagaacaactcagctaaacagtcttggctgctgaggctgtttgagtcaaaactgtttgacatctccatggccatttcatacctgtataactccaaggagcctggagtacaagcctacattggcaaccggctcttctgctttcgcaacgaggacgtggacttctatctgccccagttgcttaacatgtacatccacatggatgaggatgtgggtgatgccattaagccctacatagtccaccgttgccgccagagcattaacttttccctccagtgtgccctgttgcttggggcctattcttcagacatgcacatttccactcaacgacactcccgtgggaccaagctacggaagctgatcctctcagatgagctaaagccagctcacaggaagagggagctgccctccttgagcccggcccctgacacagggctgtctccctccaaaaggactcaccagcgctctaagtcagatgccactgccagcataagtctcagcagcaacctgaaacgaacagccagcaaccctaaagtggagaatgaggatgagcctgttcgactggctcctgagagagaattcatcaagtccctgatggcgatcggcaagcggctggccacgctccccaccaaagagcagaaaacacagaggctgatctcagagctctccctgctcaaccataagctccctgcccgagtctggctgcccactgctggctttgaccaccacgtggtccgtgtaccccacacacaggctgttgtcctcaactccaaggacaaggctccctacctgatttatgtggaagtccttgaatgtgaaaactttgacaccaccagtgtccctgcccggatccccgagaaccgaattcggagtacgaggtccgtagaaaacttgcccgaatgtggtattacccatgagcagcgagctggcagcttcagcactgtgcccaactatgacaacgatgatgaggcctggtcggtggatgacataggcgagctgcaagtggagctccccgaagtgcataccaacagctgtgacaacatctcccagttctctgtggacagcatcaccagccaggagagcaaggagcctgtgttcattgcagcaggggacatccgccggcgcctttcggaacagctggctcataccccgacagccttcaaacgagacccagaagatccttctgcagttgctctcaaagagccctggcaggagaaagtacggcggatcagagagggctccccctacggccatctccccaattggcggctcctgtcagtcattgtcaagtgtggggatgaccttcggcaagagcttctggcctttcaggtgttgaagcaactgcagtccatttgggaacaggagcgagtgcccctttggatcaagccatacaagattcttgtgatttcggctgatagtggcatgattgaaccagtggtcaatgctgtgtccatccatcaggtgaagaaacagtcacagctctccttgctcgattacttcctacaggagcacggcagttacaccactgaggcattcctcagtgcacagcgcaattttgtgcaaagttgtgctgggtactgcttggtctgctacctgctgcaagtcaaggacagacacaatgggaatatccttttggacgcagaaggccacatcatccacatcgactttggcttcatcctctccagctcaccccgaaatctgggctttgagacgtcagcctttaagctgaccacagagtttgtggatgtgatgggcggcctggatggcgacatgttcaactactataagatgctgatgctgcaagggctgattgccgctcggaaacacatggacaaggtggtgcagatcgtggagatcatgcagcaaggttctcagcttccttgcttccatggctccagcaccattcgaaacctcaaagagaggttccacatgagcatgactgaggagcagctgcagctgctggtggagcagatggtggatggcagtatgcggtctatcaccaccaaactctatgacggcttccagtacctcaccaacggcatcatgtgacacgctcctcagcccaggagtggtggggggtccagggcaccctccctagagggcccttgtctgagaaaccccaaaccaggaaaccccacctacccaaccatccacccaagggaaatggaaggcaagaaacacgaaggatcatgtggtaactgcgagagcttgctgaggggtgggagagccagctgtggggtccagacttgttggggcttccctgcccctcctggtctgtgtcagtattaccaccagactgactccaggactcactgccctccagaaaacagaggtgacaaatgtgagggacactggggcctttcttctccttgtaggggtctctcagaggttctttccacaggccatcctcttattccgttctggggcccaggaagtggggaagagtaggttctcggtacttaggacttgatcctgtggttggccactggccatgctgctgcccagctctacccctcccagggacctacccctcccagggaccgacccctggcccaagctccccttgctggcgggcgctgcgtgggccctgcacttgctgaggttccccatcatgggcaaggaagggaattcccacagccctccagtgtactgagggtactggcctagccatgtggaattccctaccctgactccttccccaaacccagggaaaagagctctcaattttttatttttaatttttgtttgaaataaagtccttagttagccacttgtgtcatttccaggttttctgggggagtgcagggggagatgggtgatgaggtatgaacggatgcctcagtgtccaagatacaaaaggcactacatagaagtttgctttttccctgcctgtcttggtcactaccacctcttccctgagaagggcgggccttccatgttctctcacccgcttcaactccacattgtccaagtcacagaaaaagagaggcctgaatggagattcgaccacaaacagttttaatggtctggttttctccctagttccccaactgtttgttagtattattattactacaagaataaaggattcctgagagcctgtc

SEQ ID NO: 1680 - DNA, 3983 bp, Homo sapiens
agattactatggaatcggtagggtcctgaccgctggggaagcaggaaagcgtatcctgggaagaaaggcttggcttggactccggagaagaatactacatcgagacctgctggggaattttattttattttattatttttttggtcttggttgtactgagggaggaagaagaggttgtgtggcccggtcgaacttgtggcagcctgaaggccccctcaggcggcgccgcgggcagccccgcagccggggcctggtgcagcctccgcggccgctgtcagggaagcgcaggcggccaatggaacccgggagcggtcgctgctgctgaggcggcagtgtcggcagtccaaccgcgactgcccgcaccccctccgcgggggtcccccagaggatcaactaaaccttgaactaagaagaaaaatgtgttgtgagcagggggagcctcagctgcctcaggccgttcaggacagaagggtgtttctgaaggccggagcaagttttgaagaagtccctatcagattacacttggttgactactccggagcagccactaagagggatgaacaggcctgcgtggaaattgaatgagattcttggaagctcgaagtctggctgtggccatgggagatacagtagtggagcctgcccccttgaagccaacttctgagcccacttctggcccaccagggaataatggggggtccctgctaagtgtcatcacggagggggtcggggaactatcagtgattgaccctgaggtggcccagaaggcctgccaggaggtgttggagaaagtcaagcttttgcatggaggcgtggcagtctctagcagaggcaccccactggagttggtcaatggggatggtgtggacagtgagatccgttgcctagatgatccacctgcccagatcagggaggaggaagatgagatgggggccgctgtggcctcaggcacagccaaaggagcaagaagacggcggcagaacaactcagctaaacagtcttggctgctgaggctgtttgagtcaaaactgtttgacatctccatggccatttcatacctgtataactccaaggagcctggagtacaagcctacattggcaaccggctcttctgctttcgcaacgaggacgtggacttctatctgccccagttgcttaacatgtacatccacatggatgaggatgtgggtgatgccattaagccctacatagtccaccgttgccgccagagcattaacttttccctccagtgtgccctgttgcttggggcctattcttcagacatgcacatttccactcaacgacactcccgtgggaccaagctacggaagctgatcctctcagatgagctaaagccagctcacaggaagagggagctgccctccttgagcccggcccctgacacagggctgtctccctccaaaaggactcaccagcgctctaagtcagatgccactgccagcataagtctcagcagcaacctgaaacgaacagccagcaaccctaaagtggagaatgaggatgaggagctctcctccagcaccgagagtattgataattcattcagttcccctgttcgactggctcctgagagagaattcatcaagtccctgatggcgatcggcaagcggctggccacgctccccaccaaagagcagaaaacacagaggctgatctcagagctctccctgctcaaccataagctccctgcccgagtctggctgcccactgctggctttgaccaccacgtggtccgtgtaccccacacacaggctgttgtcctcaactccaaggacaaggctccctacctgatttatgtggaagtccttgaatgtgaaaactttgacaccaccagtgtccctgcccggatccccgagaaccgaattcggagtacgaggtccgtagaaaacttgcccgaatgtggtattacccatgagcagcgagctggcagcttcagcactgtgcccaactatgacaacgatgatgaggcctggtcggtggatgacataggcgagctgcaagtggagctccccgaagtgcataccaacagctgtgacaacatctcccagttctctgtggacagcatcaccagccaggagagcaaggagcctgtgttcattgcagcaggggacatccgccggcgcctttcggaacagctggctcataccccgacagccttcaaacgagacccagaagatccttctgcagttgctctcaaagagccctggcaggagaaagtacggcggatcagagagggctccccctacggccatctccccaattggcggctcctgtcagtcattgtcaagtgtggggatgaccttcggcaagagcttctggcctttcaggtgttgaagcaactgcagtccatttgggaacaggagcgagtgcccctttggatcaagccatacaagattcttgtgatttcggctgatagtggcatgattgaaccagtggtcaatgctgtgtccatccatcaggtgaagaaacagtcacagctctccttgctcgattacttcctacaggagcacggcagttacaccactgaggcattcctcagtgcacagcgcaattttgtgcaaagttgtgctgggtactgcttggtctgctacctgctgcaagtcaaggacagacacaatgggaatatccttttggacgcagaaggccacatcatccacatcgactttggcttcatcctctccagctcaccccgaaatctgggctttgagacgtcagcctttaagctgaccacagagtttgtggatgtgatgggcggcctggatggcgacatgttcaactactataagatgctgatgctgcaagggctgattgccgctcggaaacacatggacaaggtggtgcagatcgtggagatcatgcagcaaggttctcagcttccttgcttccatggctccagcaccattcgaaacctcaaagagaggttccacatgagcatgactgaggagcagctgcagctgctggtggagcagatggtggatggcagtatgcggtctatcaccaccaaactctatgacggcttccagtacctcaccaacggcatcatgtgacacgctcctcagcccaggagtggtggggggtccagggcaccctccctagagggcccttgtctgagaaaccccaaaccaggaaaccccacctacccaaccatccacccaagggaaatggaaggcaagaaacacgaaggatcatgtggtaactgcgagagcttgctgaggggtgggagagccagctgtggggtccagacttgttggggcttccctgcccctcctggtctgtgtcagtattaccaccagactgactccaggactcactgccctccagaaaacagaggtgacaaatgtgagggacactggggcctttcttctccttgtaggggtctctcagaggttctttccacaggccatcctcttattccgttctggggcccaggaagtggggaagagtaggttctcggtacttaggacttgatcctgtggttggccactggccatgctgctgcccagctctacccctcccagggacctacccctcccagggaccgacccctggcccaagctccccttgctggcgggcgctgcgtgggccctgcacttgctgaggttccccatcatgggcaaggaagggaattcccacagccctccagtgtactgagggtactggcctagccatgtggaattccctaccctgactccttccccaaacccagggaaaagagctctcaattttttatttttaatttttgtttgaaataaagtccttagttagccacttgtgtcatttccaggttttctgggggagtgcagggggagatgggtgatgaggtatgaacggatgcctcagtgtccaagatacaaaaggcactacatagaagtttgctttttccctgcctgtcttggtcactaccacctcttccctgagaagggcgggccttccatgttctctcacccgcttcaactccacat

SEQ ID NO: 1681 - DNA, 1333 bp, Homo sapiens
gagcgacgggccaattggaggagttgttgttaggccgtcccggagacccggtcgggagggaggaaggtggcaagatggtgttggaaagcactatggtgtgtgtggacaacagtgagtatatgcggaatggagacttcttacccaccaggctgcaggcccagcaggatgctgtcaacatagtttgtcattcaaagacccgcagcaaccctgagaacaacgtgggccttatcacactggctaatgactgtgaagtgctgaccacactcaccccagacactggccgtatcctgtccaagctacatactgtccaacccaagggcaagatcaccttctgcacgggcatccgcgtggcccatctggctctgaagcaccgacaaggcaagaatcacaagatgcgcatcattgcctttgtgggaagcccagtggaggacaatgagaaggatctggtgaaactggctaaacgcctcaagaaggagaaagtaaatgttgacattatcaattttggggaagaggaggtgaacacagaaaagctgacagcctttgtaaacacgttgaatggcaaagatggaaccggttctcatctggtgacagtgcctcctgggcccagtttggctgatgctctcatcagttctccgattttggctggtgaaggtggtgccatgctgggtcttggtgccagtgactttgaatttggagtagatcccagtgctgatcctgagctggccttggcccttcgtgtatctatggaagagcagcggcagcggcaggaggaggaggcccggcgggcagctgcagcttctgctgctgaggccgggattgctacgactgggactgaaggtgaaagagactcagacgatgccctgctgaagatgaccatcagccagcaagagtttggccgcactgggcttcctgacctaagcagtatgactgaggaagagcagattgcttatgccatgcagatgtccctgcagggagcagagtttggccaggcggaatcagcagacattgatgccagctcagctatggacacatctgagccagccaaggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagtgagactggagggaaagggtagctgagtctgcttaggggactgcatgggaagcacggaatatagggttagatgtgtgttatctgtaaccattacagcctaaataaagcttggcaacttt

SEQ ID NO: 1682 - DNA, 1350 bp, Homo sapiens
ggtgaagagcgacgggccaattggaggagttgttgttaggccgtcccggagacccggtcgggagggaggaaggtggcaagatggtgttggaaagcactatggtgtgtgtggacaacagtgagtatatgcggaatggagacttcttacccaccaggctgcaggcccagcaggatgctgtcaacatagtttgtcattcaaagacccgcagcaaccctgagaacaacgtgggccttatcacactggctaatgactgtgaagtgctgaccacactcaccccagacactggccgtatcctgtccaagctacatactgtccaacccaagggcaagatcaccttctgcacgggcatccgcgtggcccatctggctctgaagcaccgacaaggcaagaatcacaagatgcgcatcattgcctttgtgggaagcccagtggaggacaatgagaaggatctggtgaaactggctaaacgcctcaagaaggagaaagtaaatgttgacattatcaattttggggaagaggaggtgaacacagaaaagctgacagcctttgtaaacacgttgaatggcaaagatggaaccggttctcatctggtgacagtgcctcctgggcccagtttggctgatgctctcatcagttctccgattttggctggtgaaggtggtgccatgctgggtcttggtgccagtgactttgaatttggagtagatcccagtgctgatcctgagctggccttggcccttcgtgtatctatggaagagcagcggcagcggcaggaggaggaggcccggcgggcagctgcagcttctgctgctgaggccgggattgctacgactgggactgaagactcagacgatgccctgctgaagatgaccatcagccagcaagagtttggccgcactgggcttcctgacctaagcagtatgactgaggaagagcagattgcttatgccatgcagatgtccctgcagggagcagagtttggccaggcggaatcagcagacattgatgccagctcagctatggacacatctgagccagccaaggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagtgagactggagggaaagggtagctgagtctgcttaggggactgcatgggaagcacggaatatagggttagatgtgtgttatctgtaaccattacagcctaaataaagcttggcaactttttttccttttttgcttcaaa

SEQ ID NO: 1683 - DNA, 1953 bp, Homo sapiens
ctctgtctctcagggcatgagaccagccaggcactgggaaacaaggtttggtgccagagattttggtggcttccaagactgctttttcagagacaggctcatggacacagcacggattgcagttgtcggggcaggtgtggtggggctctccacggctgtgtgcatctccaaactggtgccccgatgctccgttaccatcatttcagacaagtttactccagataccaccagtgatgtggcagccggaatgcttattcctcacacttatccagatacacccattcacacgcagaagcagtggttcagagaaacctttaatcacctctttgcaattgccaattctgcagaagctggagatgctggtgttcatttggtatcagggataaagggaagtggaggctggacactcactcggcgaatagaagacctgtgggaacttcatccgtcctttgacatcgtggtcaactgttcaggccttggaagcagacagcttgcaggagactcaaagattttccctgtaaggggccaagtcctccaagttcaggctccctgggtggagcattttatccgagatggcagtgggctgacatatatttatcctggtacatcccatgtaaccctaggtggaactaggcaaaaaggggactggaatctgtccccggatgcagaaaatagcagagagattctttcccgatgctgtgctctggagccctccctccacggagcctgcaacatcagggagaaggtgggcttgaggccctacaggccaggcgtgcgactgcagacagagctccttgcgcgagatggacagaggctgcctgtagtccaccactatggccatgggagtgggggcatctcagtgcactggggcactgctctggaggccgccaggctggtgagcgagtgtgtccatgccctcaggacccccattcccaagtcaaacctgtagatgacataaaatgacagcaaagagactgagagactgttgatcaaagcacagaacaggttcaaataacttttccactgcatgaaagtttaattagacatttctttgttttcaacattagaagtggtgtaacatgtaagctgagcacggtggcatgcctatagtcccagctacttgagaggctgaggcaggaggattgttgagcccaggagtttgagtgcaatctgggtaacattttttagaggtgccagttcccacctctaaaaaaaacaccaacaacaaaagaaatgatgcaacatgtaggcttacttaggaagtccagcattaatggcatagggcataaagctctattttttgttaaaaatacttcttatagagtaaaatttatttagaactgatgtccaaggacctatgcagatttatatgaatgttggaagctatagagattttgatatcatttggcttataaatccacaggaggagataatgtatggaaaacatttaaatcactgtcaattgcagagctgcctgtgatcttcttaggttatagccaagtcagcaacataattcctctaaataaaattacattgtgctcacacagtgctggattattacatttaattgaagacaaagcatgcttgctcctagtactagcagcaagcttttcctcccctcagctggtaatgatggtaggagacagagatgaagttgcctatgtatgtcatatcaattcaatagctgcctggggtcaaacacctaggggttgtacattccattactgtaaatgattgagagctggtttgtggtatggttggctttgcctaagcatttttgaagatgaacagcatgtgcagccaaagaactaatttgctaattaaggtggaacaatcattctgaatgaaatataatcagagtactccgcagtttgttaagaagtattggggaggaggggaatgtgtctcacaataaaatgagttggaattgttgagttaaatgaatttaacctg

SEQ ID NO: 1684 - DNA, 2130 bp, Homo sapiens
ctctgtctctcagggcatgagaccagccaggcactgggaaacaaggtttggtgccagagattttggtggcttccaagactgctttttcagagacaggctcatggacacagcacggattgcagttgtcggggcaggtgtggtggggctctccacggctgtgtgcatctccaaactggtgccccgatgctccgttaccatcatttcagacaagtttactccagataccaccagtgatgtggcagccggaatgcttattcctcacacttatccagatacacccattcacacgcagaagcagtggttcagagaaacctttaatcacctctttgcaattgccaattctgcagaagctggagatgctggtgttcatttggtatcaggttggcagatatttcagagcactccgactgaagaagtgccattctgggctgacgtggttctgggatttcgaaagatgactgaggctgagctgaagaaattcccccagtatgtgtttggtcaggcttttacaaccctgaaatgtgaatgccctgcctacctcccgtggttggagaaaaggataaagggaagtggaggctggacactcactcggcgaatagaagacctgtgggaacttcatccgtcctttgacatcgtggtcaactgttcaggccttggaagcagacagcttgcaggagactcaaagattttccctgtaaggggccaagtcctccaagttcaggctccctgggtggagcattttatccgagatggcagtgggctgacatatatttatcctggtacatcccatgtaaccctaggtggaactaggcaaaaaggggactggaatctgtccccggatgcagaaaatagcagagagattctttcccgatgctgtgctctggagccctccctccacggagcctgcaacatcagggagaaggtgggcttgaggccctacaggccaggcgtgcgactgcagacagagctccttgcgcgagatggacagaggctgcctgtagtccaccactatggccatgggagtgggggcatctcagtgcactggggcactgctctggaggccgccaggctggtgagcgagtgtgtccatgccctcaggacccccattcccaagtcaaacctgtagatgacataaaatgacagcaaagagactgagagactgttgatcaaagcacagaacaggttcaaataacttttccactgcatgaaagtttaattagacatttctttgttttcaacattagaagtggtgtaacatgtaagctgagcacggtggcatgcctatagtcccagctacttgagaggctgaggcaggaggattgttgagcccaggagtttgagtgcaatctgggtaacattttttagaggtgccagttcccacctctaaaaaaaacaccaacaacaaaagaaatgatgcaacatgtaggcttacttaggaagtccagcattaatggcatagggcataaagctctattttttgttaaaaatacttcttatagagtaaaatttatttagaactgatgtccaaggacctatgcagatttatatgaatgttggaagctatagagattttgatatcatttggcttataaatccacaggaggagataatgtatggaaaacatttaaatcactgtcaattgcagagctgcctgtgatcttcttaggttatagccaagtcagcaacataattcctctaaataaaattacattgtgctcacacagtgctggattattacatttaattgaagacaaagcatgcttgctcctagtactagcagcaagcttttcctcccctcagctggtaatgatggtaggagacagagatgaagttgcctatgtatgtcatatcaattcaatagctgcctggggtcaaacacctaggggttgtacattccattactgtaaatgattgagagctggtttgtggtatggttggctttgcctaagcatttttgaagatgaacagcatgtgcagccaaagaactaatttgctaattaaggtggaacaatcattctgaatgaaatataatcagagtactccgcagtttgttaagaagtattggggaggaggggaatgtgtctcacaataaaatgagttggaattgttgagttaaatgaatttaacctg

SEQ ID NO: 1685 - DNA, 2090 bp, Homo sapiens
ggagcaggtggtcagcagtctcttgaaaccaaagtttactgctttttcagagacaggctcatggacacagcacggattgcagttgtcggggcaggtgtggtggggctctccacggctgtgtgcatctccaaactggtgccccgatgctccgttaccatcatttcagacaagtttactccagataccaccagtgatgtggcagccggaatgcttattcctcacacttatccagatacacccattcacacgcagaagcagtggttcagagaaacctttaatcacctctttgcaattgccaattctgcagaagctggagatgctggtgttcatttggtatcaggttggcagatatttcagagcactccgactgaagaagtgccattctgggctgacgtggttctgggatttcgaaagatgactgaggctgagctgaagaaattcccccagtatgtgtttggtcaggcttttacaaccctgaaatgtgaatgccctgcctacctcccgtggttggagaaaaggataaagggaagtggaggctggacactcactcggcgaatagaagacctgtgggaacttcatccgtcctttgacatcgtggtcaactgttcaggccttggaagcagacagcttgcaggagactcaaagattttccctgtaaggggccaagtcctccaagttcaggctccctgggtggagcattttatccgagatggcagtgggctgacatatatttatcctggtacatcccatgtaaccctaggtggaactaggcaaaaaggggactggaatctgtccccggatgcagaaaatagcagagagattctttcccgatgctgtgctctggagccctccctccacggagcctgcaacatcagggagaaggtgggcttgaggccctacaggccaggcgtgcgactgcagacagagctccttgcgcgagatggacagaggctgcctgtagtccaccactatggccatgggagtgggggcatctcagtgcactggggcactgctctggaggccgccaggctggtgagcgagtgtgtccatgccctcaggacccccattcccaagtcaaacctgtagatgacataaaatgacagcaaagagactgagagactgttgatcaaagcacagaacaggttcaaataacttttccactgcatgaaagtttaattagacatttctttgttttcaacattagaagtggtgtaacatgtaagctgagcacggtggcatgcctatagtcccagctacttgagaggctgaggcaggaggattgttgagcccaggagtttgagtgcaatctgggtaacattttttagaggtgccagttcccacctctaaaaaaaacaccaacaacaaaagaaatgatgcaacatgtaggcttacttaggaagtccagcattaatggcatagggcataaagctctattttttgttaaaaatacttcttatagagtaaaatttatttagaactgatgtccaaggacctatgcagatttatatgaatgttggaagctatagagattttgatatcatttggcttataaatccacaggaggagataatgtatggaaaacatttaaatcactgtcaattgcagagctgcctgtgatcttcttaggttatagccaagtcagcaacataattcctctaaataaaattacattgtgctcacacagtgctggattattacatttaattgaagacaaagcatgcttgctcctagtactagcagcaagcttttcctcccctcagctggtaatgatggtaggagacagagatgaagttgcctatgtatgtcatatcaattcaatagctgcctggggtcaaacacctaggggttgtacattccattactgtaaatgattgagagctggtttgtggtatggttggctttgcctaagcatttttgaagatgaacagcatgtgcagccaaagaactaatttgctaattaaggtggaacaatcattctgaatgaaatataatcagagtactccgcagtttgttaagaagtattggggaggaggggaatgtgtctcacaataaaatgagttggaattgttgagttaaatgaatttaacctg

SEQ ID NO: 1686 - DNA, 2143 bp, Homo sapiens
gaagatgaggttacctcccttccacacctccctccttggaggcaagagctacaacagctgagacagaaaagaggtaaggaagtgttgggggctgggacaaccagctccccaacaactcctaggtgtttaaagaaggaggcaggaagacttgtgaagatgggaactatacaagaggcaggaaaaaagacagatgttggggtcagggagattgcagaagcaccagaactaggagcagccctgagacatggggagttggagctgaaggaggaatggcaggatgaagaattccctagattgcttcctgaggaggctggcacttctgaagatcctgaagaccctaaaggagattcacaggcagctgcaggtacccccagcactttagccctgtgtggccagcgccccatgcgcaagcgtctttctgccccagagttgcggctgagtctgactaaggggcctggaaatgatggagcttcacccacccagtctgcaccttcctctcctgatggcagttctgacctggagatagacgaattggagacaccttcagactcggagcagctggacagtggacatgaatttgaatgggaagatgaactaccccgggcagagggtctgggcaccagtgagacagctgaaaggctgggccgaggttgtatgtgggatgtgactggagaagatggacatcactggagggtgttccgaatgggaccacgggagcagcgcgtagacatgactgtcattgagccctataagaaagtcctgtctcatggaggttaccacggtgatggcctcaatgctgtcatcctttttgcttcctgttatctacccagaagcagcatccccaactacacctatgtcatggaacacttgtttaggtatatggtgggaactctggagctgctagtagctgaaaattacctgcttgttcatttgagtggaggcacaagcagggcccaagttccacctctaagctggatacgtcagtgttaccgtaccctggatcggcggctacggaaaaacctgcgagccctggtggttgtccatgctacatggtatgtgaaagcatttctggcactgcttcggcccttcatcagttccaaattcacacgaaaaatccgttttctggacagcctgggggagctggcccaactcatatccctggatcaagtccacatccctgaagctgtcagacagctggaccgggatctccatggctcaggagggacatagcacaggactggataaaaggccttagaaccagttagtgatctgcctacacctgaatccctgaaacatctgaactgttttgtaaatcatcttatccccaacctcagtaccaccggatcttcacttctcagtgggattttgtcctttgcatgaccctactttcagcagggctttgaggctgggaaactgatctgctgggtgactttcattccagttgctgggacggaaggctgaatgtagggtcattttgtatgggatatgcagagctctgggtttttttgttttttgttttttgagacggagtctcgctctgtcgccaggctggagtgcagtggtgcgatctcggctcactgcaacctccgcctcccggttcaagccattcttctgcctcagcctcagcgagtagctgagactaccggcgcacgccaccacgcccagctaattgttttgtatttttagtagagacggggtttcaccatgttggccaggatggtctcgatctcttgacctcgtgatctgcccgcctcggcctcccaaagtgccgagattacaggtgtgagccaccgcgctcggccagagctctgggttttaatcctactttagctgtagaaccttgggcaaataacttcatctttttgggtcctaattttcctcctgtctaactggagggactgtgatccttccaccttggatggaagaggcttacctgacagccagcctgcctgctgggagccaggagagtcagctcattaaatcttgaagaaccgctgtatgccctttttccttctaagtcatgtctgctgcctgtgagcctgggaaggagtgctttcaaaacctgtatttttgccctctttagtaaatttagaactgtagaggctaataaactgcgatgagacatttaagctctgctccaaag

SEQ ID NO: 1687 - DNA, 1998 bp, Homo sapiens
attgtggggtggcggcggcggccgcgctagcgacgcggggccgggcggctgagcgttcgcggggccgaggccatggctttctgggcggggggttcgcccagcgtcgtggactatttccctagcgaggacttctaccgctgcggctactgcaagaacgagtcgggcagccgctccaatggtgccgacctttacaatttcagccttcaaaatctcacaagaaggttttgaaaaaaatgttgaaatttctagctaaaggggaggttcccaaaggaagttgtgaggatgagcccatggattccacaatggatgatgctgttgcgggtgactttgcattgataaataaactggatatacagtgtgatcttaaaacactcagtgatgacatcaaagagagtttagagagtgaaggaaaaaattcaaagaaagaagaacctcaggaattacttcagtcacaagatttcgtaggagagaagttgggctctggtgaaccgtcacattcagttaaagttcacacagttcctaagccaggcaaaggggctgatttgagtaagcctccatgtcgaaaagcaaaggaaatccggaaagaaaggaaaaggttaaaactaatgcagcagaacccagctggagaacttgagggtttccaggctcaaggtcacccaccatctttgtttccaccaaaggctaaatccaaccagccaaaatcactcgaagatttaatttttgagtctttaccagagaatgcatcacacaagttagaggtgaggttagtacctgtctcctttgaggacccagagttcaagtcgtctttcagccagtccttttctttgtatgtcaagtatcaagtggccatacaccaggatccacccgatgaatgtgggaagactgagttcacaagattcctttgcagttcacccttggaggcagagactccccctaatgggccagattgtggctatggctcctttcaccagcagtactggcttgacggaaagatcattgctgtgggggtgattgacatcctcccaaactgtgtatcatctgtgtatttgtactacgatcctgattattcgtttttgtctttgggcgtctactctgcactacgagaaattgcttttactaggcagcttcatgagaaaacttctcaactcagctattattatatgggtttctacattcattcatgtcccaagatgaaatataagggtcagtatagaccttctgatttgctgtgccctgagacatatgtttgggtacccattgagcaatgcctgccttcacttgaaaactccaagtactgccgtttcaaccaggacccagaagcagtggatgaggatcgcagtacggaacctgaccgattgcaggtgtttcacaagagagccatcatgccttacggtgtttataagaaacagcagaaagacccaagtgaggaggctgctgttctgcagtacgccagcctggtggggcagaagtgctccgagcggatgctgctgttcagaaactgacctgttcacctctgccgggaagttcctgtgttgtgctgatgatttgtgccaggatacatattcagtacctgtggggaaataactgtcaccacccacaaattagacattttttattttgactatctatggcttttaaaaaatattttgtggcaatgtatctgtgagaatctcatagttaatataaagattttaaaactgcattatgacctagcccccataattgggatttatcattttggaggattctttctagagcaagatacgctcaaattctcctgtttgtattttgtaaaatgaagaagtgaatctaagtaacttaatcacagttgtgcattttttttggttctgttagagaaattaaaacagactgtttcctcaggcccattttaaactgaacttatgctaggaaaccttaagtatggggaaggtagaaagttcatttcatcacttagaaaatatgtcttctcaagaacaaaactgtgctgttacaactcag

SEQ ID NO: 1688 - DNA, 4900 bp, Homo sapiens
cgggcggcgcgctgcattgtggggtggcggcggcggccgcgctagcgacgcggggccgggcggctgagcgttcgcggggccgaggccatggctttctgggcggggggttcgcccagcgtcgtggactatttccctagcgaggacttctaccgctgcggctactgcaagaacgagtcgggcagccgctccaatggcatgtgggcacattccatgacagtacaggattatcaggatctcatagaccgaggatggcgaagaagtggaaaatatgtgtacaaacctgtcatgaatcaaacatgttgtcctcagtacacaataaggtgccgacctttacaatttcagccttcaaaatctcacaagaaggttttgaaaaaaatgttgaaatttctagctaaaggggaggttcccaaaggaagttgtgaggatgagcccatggattccacaatggatgatgctgttgcgggtgactttgcattgataaataaactggatatacagtgtgatcttaaaacactcagtgatgacatcaaagagagtttagagagtgaaggaaaaaattcaaagaaagaagaacctcaggaattacttcagtcacaagatttcgtaggagagaagttgggctctggtgaaccgtcacattcagttaaagttcacacagttcctaagccaggcaaaggggctgatttgagtaagcctccatgtcgaaaagcaaaggaaatccggaaagaaaggaaaaggttaaaactaatgcagcagaacccagctggagaacttgagggtttccaggctcaaggtcacccaccatctttgtttccaccaaaggctaaatccaaccagccaaaatcactcgaagatttaatttttgagtctttaccagagaatgcatcacacaagttagaggtgaggttagtacctgtctcctttgaggacccagagttcaagtcgtctttcagccagtccttttctttgtatgtcaagtatcaagtggccatacaccaggatccacccgatgaatgtgggaagactgagttcacaagattcctttgcagttcacccttggaggcagagactccccctaatgggccagattgtggctatggctcctttcaccagcagtactggcttgacggaaagatcattgctgtgggggtgattgacatcctcccaaactgtgtatcatctgtgtatttgtactacgatcctgattattcgtttttgtctttgggcgtctactctgcactacgagaaattgcttttactaggcagcttcatgagaaaacttctcaactcagctattattatatgggtttctacattcattcatgtcccaagatgaaatataagggtcagtatagaccttctgatttgctgtgccctgagacatatgtttgggtacccattgagcaatgcctgccttcacttgaaaactccaagtactgccgtttcaaccaggacccagaagcagtggatgaggatcgcagtacggaacctgaccgattgcaggtgtttcacaagagagccatcatgccttacggtgtttataagaaacagcagaaagacccaagtgaggaggctgctgttctgcagtacgccagcctggtggggcagaagtgctccgagcggatgctgctgttcagaaactgacctgttcacctctgccgggaagttcctgtgttgtgctgatgatttgtgccaggatacatattcagtacctgtggggaaataactgtcaccacccacaaattagacattttttattttgactatctatggcttttaaaaaatattttgtggcaatgtatctgtgagaatctcatagttaatataaagattttaaaactgcattatgacctagcccccataattgggatttatcattttggaggattctttctagagcaagatacgctcaaattctcctgtttgtattttgtaaaatgaagaagtgaatctaagtaacttaatcacagttgtgcattttttttggttctgttagagaaattaaaacagactgtttcctcaggcccattttaaactgaacttatgctaggaaaccttaagtatggggaaggtagaaagttcatttcatcacttagaaaatatgtcttctcaagaacaaaactgtgctgttacaactcagtgttcaatgtgaaattgctgccaaatgttatgtagtttaatagagaacttgaaaaaataaaacattaaaatggagcttgtgttagcatcaggtatccatttgttcaggacagtcctgttcatgtctgttgtcttggcatagttttttcccctagaatatagtactcccttttactctaaaaaatatcccagtttggacaataaaatacataattactctagttatattatttgctttacttctaaaaatgtaagaaattgaatttttttaaagaaaaatgttggttcctgccttgatctaagtctcatccaaaggaaataaatagtcactagttttttatcttacaactcaggacatttgtctttggttattaatggaaattagtatgtgattactttcatagttatgccacaaatcacattgaagaaggaatcattccgacctctgttccaggacaagagctagaacaatccatttcttgtcctttgatttgagagtcacagtcagggtggcttctgccacccttagtaactcagagcagaggccagccccctccttccctcactttcttttgctgagtcctttgcccacctgtcaaggtggcaggcactgtgctgggtacaggaggacagtcagacatgtcccttcttagctatagtcgagctgtctgggaaacaggatgaaaaacaggagggttattttcttgtgccctctttgtcagctgatcccctcttctgctaccagctatttggccagcaagccgtttttagtccccactttgcccatttttctgttttggttcatcgtttcttaaaagccatgttataaaacatggtagtttgaatcctgttgctaattttaaactttcctctaaaatgtactgaattttgacaaaaatttgaaaatatcctcagctaactagaataaaaaggatcataaaacaatgattttaaaactgaaatctctagaaactcaacatccaagtcagccgcatttcttcattcagagtgtgtgtgtcacacctgccaaggtgctgcgtactctgctaaccgagctagagtagtgagcaaagccattttctctgatcacaagattttacatttttctgggattttgacctgcaaagtagtctcgtaagagcatttgagagacttacttggaactgccttcagaatctatagagccttttttctctttttcctctaaaatgaaaagagcttcattttatgattataacaaaagtgacactgtaagcagttagaacattaagaagtataaataaaaagtaaaaatcatctacaaccctaccatactcagaaggagaaaagaactgtcatgtatgtatacacacatacctatgtaattttaatataaatagaattatgttctacatgctgttttatttcctcaacagtaaattatggacatgtctgaaatgtgaaataaatttcaaaataaggcttcagaaagtgtagtaagtaatctctgcattattaaaaataagcagggtagggctggtacttggctcgcttagcatttgaatgtccaacttggtgttatcactgtatcttccctccatttgtctttgtgattagcatgtaaaatggtattcataaagatcacaacccttgaatatcagatgaagagaaaacttgactccaacatcttaccacaactctggtttcttcctgcagaattcattttcagaggaaaatgatgaatcatccctgtctgtgaaccactgtgctttccttgagggtggcattgtaggttgacaccagcaaagactcagagtgacttgagcattggagatccttctacttggctgctgtattcatgcattatgttggtttgagaatagctagtgtattgatccaagtagtcaaagtgtcttaaaaggacacctatttgtccttttgagccccagctgagtgaatactgatagtggactagaaaagcatagtcaagaaaagtgacccaccttgttacttgaccagcagtctagctgagagatctgattttatgttcgtaactttctgtaaagaaagacacaaggacttttcaaagacagtttatatctttccaaggcaggaagctttgcatttgcaatcttagtgttgtgtccctttctgattttcaaatacatcacacctgccttcctgttttgggagcaaagatgtaatttcaattccccttgctaccgtccttatttaaattatttccattctaagagatttttgttatttttttaaatgtaatctgagcacttttttgtattctaaaagatagatgatatcagataaatatgttgtacatttgattaaaattatttagataaatattactatgttgacttttaaatagctttatcctatttttcattcattttgcaaatatttgttgtgtgtagtttcttaacgtgtcagaatctattatgtaaaagaacctttccagatttctgaacagtatatgctttgattttataggctttatattatttcagtatgaataaagataaggaatatgaaacagttaactaaaatgtatctgtcgttgctaacttgaaaaatgaagtagaaacagttggaaaatgtttgaattagaagttattcaagtgcacactcttttctaaaagaaagccaatgactataaggcaaaagaagtttgactgcatgtggtattttttgctcttgtatatgctttttgaacaagctatttgataaagcctgaatggaaaaaataaagctgtttctatctgca

SEQ ID NO: 1689 - DNA, 4656 bp, Homo sapiens
gcgtgatcggtttccggtcagtggtgtggtaccgggtacccggagacgtgtatcggacggtgggccgcagccatggccgagagaaaacctaacggtggcagcggcggcgcctccacttcctcatcgggcactaacttacttttctcctcctcggccacggagttcagcttcaatgtgcccttcatcccagtcacccaggcctccgcttctccggcctccctgctcttaccgggagaggattccacagatgttggtgaggaggacagcttccttggtcagacttctattcacacatctgccccacagacatttagttacttctctcaggtatcaagcagcagtgatccttttgggaatattggacagtcaccattaacaactgcagcaacctcagttggacaatcaggattccccaagcccctgactgctctcccttttacaactggatcccaagatgtctcgaatgcattttcaccatccatttcgaaggctcaacctggtgctccaccttcctcactgatgggaataaattcttatctgccttctcagccaagtagtctccctccttcatattttgggaaccaaccccaaggaattccccaaccaggatacaatccatatcgccatacccctggcagcagcagggctaatccttacattgcaccaccccagctgcagcagtgccaaacaccaggccctcctgctcatcctccaccttctggaccccctgttcagatgtaccagatgcctccaggatctttgccaccggttccttcttcagtgcagtcaccggcacagcagcaggtacctgccagacctggggctccctctgttcaagtgccatctccttttctacttcaaaaccaatatgagcctgttcagccccactggttttactgcaaggaggtagaatacaaacaactgtggatgccttttagtgtgttcgactctttgaatcttgaagaaatctataattcagttcagccagatccggagagcgtggttcttggcacggatggagggcgctacgatgtttacctctatgaccgaataaggaaggctgcctactgggaagaggagccagccgaagtgagacgctgtacttggttttacaagggggacacagatagtcgatttattccctatactgaggagttcagtgaaaaactagaggctgaatataaaaaagctgtaaccactaatcagtggcaccgaagattagagtttccaagtggagagacaattgttatgcacaatccaaaggttattgttcagttccagccctcctcagtgccagatgaatggggcaccacgcaagatggacagacaaggcccagggttgtaaagcgtggaattgatgataaccttgatgaaattcccgacggggagatgcctcaagttgaccatttggtgtttgtggtgcatggcattggacctgtgtgtgacttacgctttaggagcattattgagtgtgtggatgattttagggtggtttctctcaaattgctgcggacacatttcaagaaatctttagatgacgggaaagtaagcagagtggagttccttccagttcattggcatagttctttgggtggggacgccacaggtgtggacaggaatattaagaaaatcactttgccaagtattggtcgatttcgtcactttaccaatgaaactttgctagatattttattttataacagccccacctactgtcagacaattgtggaaaaagtaggaatggagataaaccatctgcatgcactctttatgagtcggaacccagacttcaaaggaggtgtctctgttgctggtcacagtttaggttctttaatattgtttgacatcctgtctaatcaaaaagatttgaatttatcaaagtgccctggacctcttgctgttgctaatggagttgtgaagcagctacattttcaggaaaagcagatgcctgaagagccaaagctgactttggatgagtcgtatgaccttgttgttgaaaataaagaagtcctaactttgcaagaaactctggaagcacttagcctctctgaatattttagcacttttgaaaaggaaaagattgatatggagtccctgcttatgtgtacagttgatgacctgaaggaaatggggataccccttggacccagaaagaagatagctaactttgtagaacataaagcagccaaactgaaaaaagcagcgtcagaaaagaaggcagtggcggccacttctacaaaaggacaagagcaaagtgcccagaagactaaagacatggcttccctcccctcagaatccaatgagccaaagaggaaacttccagttggtgcttgcgtgtcttctgtgtgtgtgaattatgaatcttttgaagttggcgccggacaggtttctgttgcttacaactcattagattttgaaccagagatattctttgccttggggtctccaattgctatgtttctcactattcgaggagttgataggatagatgagaattacagccttcctacctgtaaagggttcttcaatatttatcatccgcttgatccagtggcatatagattagaacctatgattgttccagatttggacctaaaagctgttctcattccacatcacaaaggcagaaaaagacttcatttagaattgaaagagagtctctctcgtatgggatctgatttgaagcagggttttattagctctctcaaaagtgcttggcagacattaaatgagtttgcccgtgctcatacgtcttcaacccagttgcaagaagaattggagaaggtggccaatcagatcaaagaagaagaagaaaagcaagtagttgaagcagaaaaggttgttgaaagtccagatttttccaaggatgaggactacttaggaaaggttggaatgttaaatggaggccgccgaattgactacgttctccaagaaaaaccaatagagagttttaatgaataccttttcgctcttcagagtcacttatgctattgggaatctgaagatactgctctgttactacttaaagaaatttatcgaacaatgaacattagtccagaacagccccagcattgatcaaacttcagttttactgtactttcttgtctgcacagaaagtcccagtacaacttccattgctgagaaaatcctcagaggactttcccacttcgctcctgtgatggatgacagaagagtgattcattaacaattgctcagccacaattctcggatatagggattcaaaagacaggacacagaactaacacagtgaaaaaaatcagtaccacatttggacagtataggtgagaaaacataattataaaaatgatgccatgaaaaattccacagatcagtttagttgtatagttgtcaaagttatatgtgatatcaatgaagaaatatttgtagcatgtaaacggttatttctgtttcttaaaaagtattgttagtgggctattaaacttggatttttctttttattaatgcagtatgttctttttattcaagtatgaacttgttgagaaactatagtaatatgatttttaagagatttatgttctacttaaaatgtgaattgtacttctgagctgccttaatgcaaggtcatttatatttgttaagaggaaataatcaagatcactcatatcccaactgaatctgaggttttataaatccctcaaacgattgctgagagcctgattgtggaaagaagtgagatgcaccttattttcaagaagtcctgggaagcgctctcctagcacgtccatttccaggaggagaagcaagcagatgagaggttttccattttgtcatccaaggtagctgtgcacttgccttgttgctgaagttccaataatgtgaaaaccaaagtagaggtttttttcttcttctttttgttttctattaatttcacttataccaaagtgtttgaaagtatgaaatgtgttgcttctgagttatataaggctacttcatgacaagactgctttgtaatatttcactttgttttactacaaattcagatcactttgttttactataaattcagattatccaaatattttcctaatactatgtgggaatgctgattttcttttgttacgtagtggaaacattttgcattgtttacatagttctcatggaacatggaaatttttgaaagtgatatatgatacacattttttgtgtatgtattctaattagtgtgaataaagcagtaacattaatgcattttttaagcagcaaacttatgtatttctcttgtcttccttaaaagtgtccccatgaactcagtgtttattcccttttcattttgagtacctgcttatatggtcagtatgtaacgttagcattggctcctaatggtagaattagaacagcaagattgtagagctgtaattgactccagacaacatagatttcagccacctcattctacagctgaggccaggacaataaatgcctttcccagactgggtagtggcagatctgggatggaatatggttttcttgattccctttcagccttcatttctctctctcaggactactactttttaattacttttcacttaatttcccaatactgatgaaataaagaaaaatgagggttatttatatacatttcaataaaatccaatttgatttttcaactta

SEQ ID NO: 1690 - DNA, 785 bp, Homo sapiens
actataaagacagtaaaaagatcagtggttatctttgcagacgccaccatcactgtgagccctgtactatcagccatggtcaactccgtcgtcttttttgacatcaccgtcgacggcaagcccttgggccgcatctccatcaaactgtttgcagacaagattctaaagacagcggaaaactttcgtgctctgagcactggagagaaaggatttcgttataagggttcctgctttcacagaattattccagggtttatgtgtcagggtggtgacttcacacgccataatggcactggtgacaagtccatctatggggagaaatttgatgatgagaacctcatccgaaagcatacaggttctggcatcttgtccatggcaaatgctggacccaacacaaatggttcccagtttttcatctgtgctgccaagactgagtggttggatggcaagcatgtggcctttggcaaggtgaaagaacgtgtgaatattgtggaagccatggagcactttgggtacaggaatagcaagaccagcaagaagatcaccattgctgactgtggacaattctaatgagtttgacttgtgttttattttcaccaccagacccattccttctgtagctcaggagagcacccctccaccacatttgcttgcaatatcctagaatcttggtgctcttgctgcagttccctttgggttccatgttttccttgttcccttccatgcctagctggattgcagagttgagttaagtttatgattatgaaataaaaactaagtaacaa

SEQ ID NO: 1691 - DNA, 646 bp, Homo sapiens
cagccaggaaaacctttgttggggatgaagattcttgacgttggctgtggtggtgggctgttaactgaacccggtggttctttattcattactacaatcaacaaaacacaactttcctatgccttgggaattgttttttcagagcaaattgcaagtattgtaccaaaaggtactcatacatgggagaagtttgtttcacctgaaacactagagagcattctggaatcaaatggtctgtcagttcaaacagtggtaggaatgctctataaccccttctcaggttactggcattggagtgaaaataccagccttaactatgcagcttatgctgtgaaatccagggtccaggaacacccagcctctgctgagtttgttttaaagggagaaacagaagagctccaagctaatgcctgcaccaatccagctgtgcatgaaaagctgaagaaatgaattgtttctgagaactatagtaatatggcttggatatctgatgttttcaaatacaaaaatgtacaatttatcctttgagagagaatcatgaagaaaagaaggtcaataaaaagggctaaaaccttggacaaaagtttttgttatttcgtctaatagctactttcaagggattctgtgaataaaaagttttgtcaag

SEQ ID NO: 1692 - DNA, 1092 bp, Homo sapiens
aaaagaggtgggatcgtttgtcgcgatgtggagtggccgtaagctgggctcctccgggggttggtttttaagagtgctggggcctggaggctgtaatacaaaagctgcgcgtcccttaatttcctcggcggtttatgtgaagaaccagctcagtgggactctacagattaaaccaggggttttcaatgaatacagaaccatatggttcaaatcctacaggacgatcttttcctgtttgaacagaataaagagtttcaggtacccttgggcgagactgtacagtacttcccaaaccactgtcgacagcggtgaggtaaaaaccttcttggccctggctcacaaatggtgggatgaacaaggagtatatgcacctcttcattccatgaatgacctgagggtgccatttattagggacaatcttctgaaaacaattcctaatcaccagccaggaaaacctttgttggggatgaagattcttgacgttggctgtggtggtgggctgttaactgaacccggtggttctttattcattactacaatcaacaaaacacaactttcctatgccttgggaattgttttttcagagcaaattgcaagtattgtaccaaaaggtactcatacatgggagaagtttgtttcacctgaaacactagagagcattctggaatcaaatggtctgtcagttcaaacagtggtaggaatgctctataaccccttctcaggttactggcattggagtgaaaataccagccttaactatgcagcttatgctgtgaaatccagggtccaggaacacccagcctctgctgagtttgttttaaagggagaaacagaagagctccaagctaatgcctgcaccaatccagctgtgcatgaaaagctgaagaaatgaattgtttctgagaactatagtaatatggcttggatatctgatgttttcaaatacaaaaatgtacaatttatcctttgagagagaatcatgaagaaaagaaggtcaataaaaagggctaaaaccttggacaaaagtttttgttatttcgtctaatagctactttcaagggattctgtgaataaaaagttttgtcaagatat

SEQ ID NO: 1693 - DNA, 7606 bp, Homo sapiens
gtcattgagctgatgtgcttttgcaaggggtctctttagaagtggtaggggcagggtcgagagaagaaggggatgcagaatctgtacatgaggaaggagccagagtcactcaggaaactcctcattcttcctgcgctggctgtggcacacccaccggtggcacacccctccctcgggtccagttcagcccacagactcctgggaggagagccagggccccagcctctcctttgaggagtgttgcagcctttctgtgtgccagatgcctagtgaagaaaagctgaaaccctggagctttgtgcatgttaatgaccttggaaatgactgagctcacggaccctcatcacaccatgggagactacaaagtggcccaccctcaggaccctcaccacccatcagagaagcctgtcattcactgccataaatgtggggagccttgcaagggtgaagtgcttcgggtccagaccaaacatttccacatcaagtgtttcacctgcaaagtgtgtggctgtgacctggcacaagggggcttcttcataaagaacggagagtatctctgcaccctggactaccagcggatgtacgggacacgctgccatggctgtggggagttcgtggagggcgaagtggtgactgctctgggcaagacctaccatcccaattgctttgcttgtactatctgcaagcgcccgtttccacccggagaccgagtcacattcaatgggagagactgcctttgtcaactctgtgcacagccgatgtcgtccagtccgaaagaaaccaccttctccagcaattgtgccggctgcggaagagatatcaagaatgggcaggcgctgctggcgctggataagcagtggcacttggggtgctttaaatgcaagtcctgcgggaaggtcctcaccggggagtacatcagcaaggatggtgctccgtactgtgaaaaggactaccagggactctttggggtgaaatgtgaggcgtgtcaccagtttatcacagggaaagtcctggaggcaggtgacaaacattaccaccccagctgtgcacgatgcagcagatgcaaccagatgttcacagaaggagaggaaatgtatcttcaaggctccaccgtttggcatcccgactgtaagcaatctacgaagaccgaggaaaagctgcggcctaccaggacatcctcggaaagtatttattctaggccaggctccagtattcctggctcaccaggtcatactatctatgcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctggcaatgagccgtccagcggccggaactcccctctcccttaccggccagacagccgccctctaactccaacttacgctcaggcccctaaacatttccatgttccagatcaaggaatcaacatttaccgaaagccacccatctacaaacagcatgctgccttggcagcccagagcaagtcctcagaagatatcatcaagttttccaagttcccagcagcccaggcaccagaccccagcgagacaccaaagattgagacggaccactggcctggtcccccctcatttgctgtcgtaggacctgacatgaaacgcagatctagtggcagagaggaagatgatgaggaacttctgagacgtcggcagcttcaagaagagcaattaatgaagcttaactcaggcctgggacagttgatcttgaaagaagagatggagaaagagagccgggaaaggtcatctctgttagccagtcgctacgattctcccatcaactcagcttcacatattccatcatctaaaactgcatctctccctggctatggaagaaatgggcttcaccggcctgtttctaccgacttcgctcagtataacagctatggggatgtcagcgggggagtgcgagattaccagacactcccagatggccacatgcctgcaatgagaatggaccgaggagtgtctatgcccaacatgttggaaccaaagatatttccatatgaaatgctcatggtgaccaacagagggcgaaacaaaatcctcagagaggtggacagaaccaggctggagcgccacttagcccctgaagtgtttcgggaaatctttggaatgtccatacaggagtttgacaggttacctctttggagacgcaacgacatgaagaaaaaagcaaaactcttctaagtcccactcgtgaatggcaattagagaaaggactgacagtggcggtgccccataggatgtcatattgaggcccaaacttgattggagaatttgcaaactaccgtcgctcagcaacaccaaaaagagaaagtctggttaaaacaccatgagtcaaatgtcgggccagccaacagtaacacttgccaagaagcatggcgtagaaatttctatgttccgaaacacagagtagtgtccacatgtgagcttttcacattaccttatgtatacaacaggagctgcgttgttttcttctttttcttttcctttatctgttgtccaacaacagtgctgactgtccggataagagctggcaagtgcccttaggatgccgcatgggaaaaatcggttatcataatttcaaagtataaatatatttattaagtagcgctgcggctaagaaggaagagtgaggggtctgtccatggggtggcagtgatttcacacccgcctttcttgaatggcttcgtgttactcagccgtgccctggcaggaatggaactccatcagggaacagggcagctctgtttgaatggggtgaaaaacagcaaaattaattcttagcaagctccttgttctctactgttcaccgggacctggctggcaaatgacttagctattagtatatttaaaaactgttcaaaagcaaaagagaaggaacaggaatgaaaggaaaccttcccttaactctttctgcttcccatagcaggtctggttcctgctccccgcctaggacaggagctgtctggagctccacctttgcaaagaaaggaaaaacacaaattgcccccagattggcccagtggcatgccattaggtgattttgcataggggccatatcattcatggccaaaaaaaaccaaaaagcaaaaaacaaaaacaagtcccatgtcctactgactctagttcttccagtcgttatcctctgctgtctctctggcatcctatgaatcagatcaagcccatgctgttgttggtttttaaggtttctttcaataataggctaaggaaagacatgtttttctcttttaaatctctgcaactccaaagtagactccttcgaacgtatttaatttggccttttcagctttcttcttgcccagctctgtcgaattcatgggtgtgtgtgcacatgttggtttcactcacccagagtaattttgtgagcatgcatgtgctttttaatttctgcttgaatgtttgtcctgctgtgttgcagcttctaaagacattgtcaccgagtgtgtgtgactcaaagatcaagagtgaggctaaactgcgaccccaacatcacttccttcatggaaaggtgttggcgctgatgtagctcatggaaggatcagactgggaaccacagaggaaggatgaggtgggatgtggaggtcagagcatctcacgagagtccctcaggctctgcaacactagattcgaatatgagcctagggtttccccaacacgtgcgtgcatatgaaaccacatcatgattcccgacgtgagttagatgagggagagtttgtgtaactccacacccaggagggtaagccactttattatcatgctttggggctgtgcttaagaatttaagctctgttttaaagccgaagaagaaaacatttgaatttaccttcatatgccactaagaacaaaagctctgaagttcttcctgctggcaccaaatattaggattacaagctgtctctctgacaccagtggtaaaaaagcaagtagaatagtttctgagtctgtgttgcagcctctgacacgtggctcaccgctgtcatttgggggatggaatgaacagtcactgttctatagcatcctcctgtgctcttacctaaggaatctaaattgtcctagccttccattgctatgcactgaatgaggactactctcgtgtgtgtgtgtgtgtgtgtgtgtgtgtgtgtgtgtgtgtgtgtgtgtgttggatctactaacatgtttagcaaatggctctgacagggtggccatgagcagatgagaccagctcttgcttggttggaagccacactgcagtttgcagtttagcctttggtgtctcagtggcttcttgcttattccatgctttttctatcccatcctctctctgtgccctcctgcaatggcagccttggcacaatgcctgggtgtcctcatccttgctttactctggaaagtgtggggatggagaggatggtgcatttccagtgcttccttacctgtcaataacaatggtggccacctgggtcccagcacttggctggtggagagatttttttcattatggagctaataaagggtccctacgttttacattgattaatgaattatcacccagacatgtgcagatgaaatgtcaatataagaaaaatcaaggtatttgggaaacatgggcataatcaggtagttttgctaaaattcctcttccttggtctacataaagaagacatgggtctgtcatagaatggggacattagactgaaaactgggacaacccccttccttattttatagagactaggagttaaggggcctgcctaagattgcagtgataaagaactgaaccctaaatcagctcccactaatgaaaccctgctttccttgtatcttttaaactcagttctgcatccaacttgagaagaaaaaaagcttctttccatatcaagtaccatatgagttcatttaaactgcaccttgcagaaatgcattgccagaaagcaccagtagcctcctatctgcaagcagagtagtgctctgctctggggaggggtcattggaaaccataatgcagagtgggccccctactccatttcccagcaaaaggctccagctggagggatgggttgtggggcaacctggttcctgctaactgccagattgaatgtgtgggctagaatgcctgcacatttagttaaactgggctcagcatgcttgtcctcaaaatgtccatcctggtcacagcacacaagatggctattggtctgcttttaccctaccctgtactatacatgaaaattccagttattaacacactcaaactggtggagcttgttcaccctaggaaggggattgtatatatggcaggcttccctggtgccgatgtaaagggctacatttgggaacatttgacttccttgggactcttaagtgcataatgatggcatgaagtaaaaggggcctcaatgatgataggaaaatcagttcttttaaaatttcttcaagaaaatccaggctatcacatagtctttctgtgtgacttattaggagataggaagagcattgggaaacttgcacagctagctatgcatctacattttggtttggggttagttatgaaatgttcttaatatgacgtgttcaataacttcacataaacttcctgttctccaaaacctcaaagagatagagttaatgagttgttgtttttttttaaatgggggtagttttctatctgtcatgggctctagcatctactccgctacccaattctgtcatctccaagctgagtttcctcttctgaggcagaggctggagcagttctttttcagttctcatcctctccatcccaatccagtatatcaatcaactctaactcggagacgtctagctggcaatgtttctaaaactttcactggatttctttagacattgaagcaaacatttttttctaagaattgcttctcagatgatgatatcaaatgtatatgcttttgcaagtttgaaaagttcaaattaaccacttttgactaggtaagtctttctaaaaaccatttaaagctaactgggtcttagcatcctcctgtgtatggaagagacaggtgaccgctccaggttgggtgctcacagaacccttttcctgactctcatggaagatggtggaaggaaaatagactgtctcatcaaccctcctgtgtcctctgaagcaatctcagtttttattaaccacctcttctgtgtttctggtagctatttaacctgtatttaatctgtacttcctatgccagcctcaattttatttgatttttacaattattctcttctaaccaatgaagtgtttgtcagtatgccccaaagcttgctcttttgtgctcccttttgaataactttctatccagaaaaagagattatttgggacttgagatttgcagtgataccaacttatagcaatgatgtactttaagggaactacccaactatgttgtgatagaagaaagagaaaccttcactttggcatttttttttaatcactgtttatttttctgtttgcggcccaggaagcagtgggaggtggtggcagatatgctttgcatatggattgttatgtttttatttgggcaagtttaatcatggaaaactcaaaaagaaggggggaaatggtcagtttaagccaaaagaaactttctaaacaatgtataggtacacagcaaaattaaacaaatccaacaatttctgaagcttagtgtaattgagtggtggttgttattcaataaaattattcccaaaagtgtttctcctaagagtgcagttcccatgagtcacttcctgaacccattgaccaaaggtggacagagacaatcctgtagaccttgacattcagaaagatgtgagctgcttactgatcatatatgcatacgtttctttacagcagaggaaaccattgtccacaaaactgatgttcttttggggttttatgtacagacttgtccaatcatgtgtgtggttcctgcgagttgctgatgactccgcattgaagctctctgagttctttgattttaagttgggtttatggaattttttcaaatgttggaaggtgtgtggttcttcctgccctccctccccttttggaaatatgaaagcaaatgtttagaagaattccttttgaaaagctgtgtcgtgttccctgtgaaactgagcaggtgtgtgttggcgcgctaagtgccacatgcttgtgtgtagaggaggaggtggccctgccggctccgcgctgctgtgcctgtgatccctacctgctccccgctcctgttgccagcagcactcactgcactcctttgtcatatactctgcatcactgtcatactcacaacttcgtgaataaagttgtgtgctttattcgt

SEQ ID NO: 1694 - DNA, 1747 bp, Homo sapiens
gcacaaaccatcgcactttggccatagcaggtgacaaacattaccaccccagctgtgcacgatgcagcagatgcaaccagatgttcacagaaggagaggaaatgtatcttcaaggctccaccgtttggcatcccgactgtaagcaatctacgaagaccgaggaaaagctgcggctgccaaacattcggcgttcttcatccgatttcttttattccaaaagtctgattcgacgcacaggacggtctccgtctctgcagcctaccaggacatcctcggaaagtatttattctaggccaggctccagtattcctggctcaccaggtcatactatctatgcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctgagcttttgtctcctggtgtgcagaggttgtcgtacctgcgcaccagcagcctcagccccacccacagcgactcccgccccaacccccctttccgacaccacttcattccccatatcaaaggcaatgagccgtccagcggccggaactcccctctcccttaccggccagacagccgccctctaactccaacttacgctcaggcccctaaacatttccatgttccagatcaaggaatcaacatttaccgaaagccacccatctacaaacagcatgctgccttggcagcccagagcaagtcctcagaagatatcatcaagttttccaagttcccagcagcccaggcaccagaccccagcgagacaccaaagattgagacggaccactggcctggtcccccctcatttgctgtcgtaggacctgacatgaaacgcagatctagtggcagagaggaagatgatgaggaacttctgagacgtcggcagcttcaagaagagcaattaatgaagcttaactcaggcctgggacagttgatcttgaaagaagagatggagaaagagagccgggaaaggtcatctctgttagccagtcgctacgattctcccatcaactcagcttcacatattccatcatctaaaactgcatctctccctggctatggaagaaatgggcttcaccggcctgtttctaccgacttcgctcagtataacagctatggggatgtcagcgggggagtgcgagattaccagacactcccagatggccacatgcctgcaatgagaatggaccgaggagtgtctatgcccaacatgttggaaccaaagatatttccatatgaaatgctcatggtgaccaacagagggcgaaacaaaatcctcagagaggtggacagaaccaggctggagcgccacttagcccctgaagtgtttcgggaaatctttggaatgtccatacaggagtttgacaggttacctctttggagacgcaacgacatgaagaaaaaagcaaaactcttctaagtcccactcgtgaatggcaattagagaaaggactgacagtggcggtgccccataggatgtcatattgaggccca

SEQ ID NO: 1695 - DNA, 3983 bp, Homo sapiens
gcttccactcccagagtttattcctcgttccttcttcagtcctgctcgtcggaggacccggttgccatggtgaaggaaaaagtggcccaccctcaggaccctcaccacccatcagagaagcctgtcattcactgccataaatgtggggagccttgcaagggtgaagtgcttcgggtccagaccaaacatttccacatcaagtgtttcacctgcaaagtgtgtggctgtgacctggcacaagggggcttcttcataaagaacggagagtatctctgcaccctggactaccagcggatgtacgggacacgctgccatggctgtggggagttcgtggagggcgaagtggtgactgctctgggcaagacctaccatcccaattgctttgcttgtactatctgcaagcgcccgtttccacccggagaccgagtcacattcaatgggagagactgcctttgtcaactctgtgcacagccgatgtcgtccagtccgaaagaaaccaccttctccagcaattgtgccggctgcggaagagatatcaagaatgggcaggcgctgctggcgctggataagcagtggcacttggggtgctttaaatgcaagtcctgcgggaaggtcctcaccggggagtacatcagcaaggatggtgctccgtactgtgaaaaggactaccagggactctttggggtgaaatgtgaggcgtgtcaccagtttatcacagggaaagtcctggaggcaggtgacaaacattaccaccccagctgtgcacgatgcagcagatgcaaccagatgttcacagaaggagaggaaatgtatcttcaaggctccaccgtttggcatcccgactgtaagcaatctacgaagaccgaggaaaagctgcggcctaccaggacatcctcggaaagtatttattctaggccaggctccagtattcctggctcaccaggtcatactatctatgcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctggcaatgagccgtccagcggccggaactcccctctcccttaccggccagacagccgccctctaactccaacttacgctcaggcccctaaacatttccatgttccagatcaaggaatcaacatttaccgaaagccacccatctacaaacagcatgctgccttggcagcccagagcaagtcctcagaagatatcatcaagttttccaagttcccagcagcccaggcaccagaccccagcgagacaccaaagattgagacggaccactggcctggtcccccctcatttgctgtcgtaggacctgacatgaaacgcagatctagtggcagagaggaagatgatgaggaacttctgagacgtcggcagcttcaagaagagcaattaatgaagcttaactcaggcctgggacagttgatcttgaaagaagagatggagaaagagagccgggaaaggtcatctctgttagccagtcgctacgattctcccatcaactcagcttcacatattccatcatctaaaactgcatctctccctggctatggaagaaatgggcttcaccggcctgtttctaccgacttcgctcagtataacagctatggggatgtcagcgggggagtgcgagattaccagacactcccagatggccacatgcctgcaatgagaatggaccgaggagtgtctatgcccaacatgttggaaccaaagatatttccatatgaaatgctcatggtgaccaacagagggcgaaacaaaatcctcagagaggtggacagaaccaggctggagcgccacttagcccctgaagtgtttcgggaaatctttggaatgtccatacaggagtttgacaggttacctctttggagacgcaacgacatgaagaaaaaagcaaaactcttctaagtcccactcgtgaatggcaattagagaaaggactgacagtggcggtgccccataggatgtcatattgaggcccaaacttgattggagaatttgcaaactaccgtcgctcagcaacaccaaaaagagaaagtctggttaaaacaccatgagtcaaatgtcgggccagccaacagtaacacttgccaagaagcatggcgtagaaatttctatgttccgaaacacagagtagtgtccacatgtgagcttttcacattaccttatgtatacaacaggagctgcgttgttttcttctttttcttttcctttatctgttgtccaacaacagtgctgactgtccggataagagctggcaagtgcccttaggatgccgcatgggaaaaatcggttatcataatttcaaagtataaatatatttattaagtagcgctgcggctaagaaggaagagtgaggggtctgtccatggggtggcagtgatttcacacccgcctttcttgaatggcttcgtgttactcagccgtgccctggcaggaatggaactccatcagggaacagggcagctctgtttgaatggggtgaaaaacagcaaaattaattcttagcaagctccttgttctctactgttcaccgggacctggctggcaaatgacttagctattagtatatttaaaaactgttcaaaagcaaaagagaaggaacaggaatgaaaggaaaccttcccttaactctttctgcttcccatagcaggtctggttcctgctccccgcctaggacaggagctgtctggagctccacctttgcaaagaaaggaaaaacacaaattgcccccagattggcccagtggcatgccattaggtgattttgcataggggccatatcattcatggccaaaaaaaaccaaaaagcaaaaaacaaaaacaagtcccatgtcctactgactctagttcttccagtcgttatcctctgctgtctctctggcatcctatgaatcagatcaagcccatgctgttgttggtttttaaggtttctttcaataataggctaaggaaagacatgtttttctcttttaaatctctgcaactccaaagtagactccttcgaacgtatttaatttggccttttcagctttcttcttgcccagctctgtcgaattcatgggtgtgtgtgcacatgttggtttcactcacccagagtaattttgtgagcatgcatgtgctttttaatttctgcttgaatgtttgtcctgctgtgttgcagcttctaaagacattgtcaccgagtgtgtgtgactcaaagatcaagagtgaggctaaactgcgaccccaacatcacttccttcatggaaaggtgttggcgctgatgtagctcatggaaggatcagactgggaaccacagaggaaggatgaggtgggatgtggaggtcagagcatctcacgagagtccctcaggctctgcaacactagattcgaatatgagcctagggtttccccaacacgtgcgtgcatatgaaaccacatcatgattcccgacgtgagttagatgagggagagtttgtgtaactccacacccaggagggtaagccactttattatcatgctttggggctgtgcttaagaatttaagctctgttttaaagccgaagaagaaaacatttgaatttaccttcatatgccactaagaacaaaagctctgaagttcttcctgctggcaccaaatattaggattacaagctgtctctctgacaccagtggtaaaaaagcaagtagaatagtttctgagtctgtgttgcagcctctgacacgtggctcac

SEQ ID NO: 1696 - DNA, 6583 bp, Homo sapiens
cgagcttcggagagaagcctgatatgtaacccaggcaggtgggagcctcagtctgtcgggctgaggtctggcatctacaaagcctcttggccgtgttctgaacttgaagcctggaggagttctctgctcagcacagccaaggaacagaattagaagaaaaggaaccctggcctgaggcaggtgacaaacattaccaccccagctgtgcacgatgcagcagatgcaaccagatgttcacagaaggagaggaaatgtatcttcaaggctccaccgtttggcatcccgactgtaagcaatctacgaagaccgaggaaaagctgcgggcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctgatcaaggaatcaacatttaccgaaagccacccatctacaaacagcatgctgccttggcagcccagagcaagtcctcagaagatatcatcaagttttccaagttcccagcagcccaggcaccagaccccagcgagacaccaaagattgagacggaccactggcctggtcccccctcatttgctgtcgtaggacctgacatgaaacgcagatctagtggcagagaggaagatgatgaggaacttctgagacgtcggcagcttcaagaagagcaattaatgaagcttaactcaggcctgggacagttgatcttgaaagaagagatggagaaagagagccgggaaaggtcatctctgttagccagtcgctacgattctcccatcaactcagcttcacatattccatcatctaaaactgcatctctccctggctatggaagaaatgggcttcaccggcctgtttctaccgacttcgctcagtataacagctatggggatgtcagcgggggagtgcgagattaccagacactcccagatggccacatgcctgcaatgagaatggaccgaggagtgtctatgcccaacatgttggaaccaaagatatttccatatgaaatgctcatggtgaccaacagagggcgaaacaaaatcctcagagaggtggacagaaccaggctggagcgccacttagcccctgaagtgtttcgggaaatctttggaatgtccatacaggagtttgacaggttacctctttggagacgcaacgacatgaagaaaaaagcaaaactcttctaagtcccactcgtgaatggcaattagagaaaggactgacagtggcggtgccccataggatgtcatattgaggcccaaacttgattggagaatttgcaaactaccgtcgctcagcaacaccaaaaagagaaagtctggttaaaacaccatgagtcaaatgtcgggccagccaacagtaacacttgccaagaagcatggcgtagaaatttctatgttccgaaacacagagtagtgtccacatgtgagcttttcacattaccttatgtatacaacaggagctgcgttgttttcttctttttcttttcctttatctgttgtccaacaacagtgctgactgtccggataagagctggcaagtgcccttaggatgccgcatgggaaaaatcggttatcataatttcaaagtataaatatatttattaagtagcgctgcggctaagaaggaagagtgaggggtctgtccatggggtggcagtgatttcacacccgcctttcttgaatggcttcgtgttactcagccgtgccctggcaggaatggaactccatcagggaacagggcagctctgtttgaatggggtgaaaaacagcaaaattaattcttagcaagctccttgttctctactgttcaccgggacctggctggcaaatgacttagctattagtatatttaaaaactgttcaaaagcaaaagagaaggaacaggaatgaaaggaaaccttcccttaactctttctgcttcccatagcaggtctggttcctgctccccgcctaggacaggagctgtctggagctccacctttgcaaagaaaggaaaaacacaaattgcccccagattggcccagtggcatgccattaggtgattttgcataggggccatatcattcatggccaaaaaaaaccaaaaagcaaaaaacaaaaacaagtcccatgtcctactgactctagttcttccagtcgttatcctctgctgtctctctggcatcctatgaatcagatcaagcccatgctgttgttggtttttaaggtttctttcaataataggctaaggaaagacatgtttttctcttttaaatctctgcaactccaaagtagactccttcgaacgtatttaatttggccttttcagctttcttcttgcccagctctgtcgaattcatgggtgtgtgtgcacatgttggtttcactcacccagagtaattttgtgagcatgcatgtgctttttaatttctgcttgaatgtttgtcctgctgtgttgcagcttctaaagacattgtcaccgagtgtgtgtgactcaaagatcaagagtgaggctaaactgcgaccccaacatcacttccttcatggaaaggtgttggcgctgatgtagctcatggaaggatcagactgggaaccacagaggaaggatgaggtgggatgtggaggtcagagcatctcacgagagtccctcaggctctgcaacactagattcgaatatgagcctagggtttccccaacacgtgcgtgcatatgaaaccacatcatgattcccgacgtgagttagatgagggagagtttgtgtaactccacacccaggagggtaagccactttattatcatgctttggggctgtgcttaagaatttaagctctgttttaaagccgaagaagaaaacatttgaatttaccttcatatgccactaagaacaaaagctctgaagttcttcctgctggcaccaaatattaggattacaagctgtctctctgacaccagtggtaaaaaagcaagtagaatagtttctgagtctgtgttgcagcctctgacacgtggctcaccgctgtcatttgggggatggaatgaacagtcactgttctatagcatcctcctgtgctcttacctaaggaatctaaattgtcctagccttccattgctatgcactgaatgaggactactctcgtgtgtgtgtgtgtgtgtgtgtgtgtgtgtgtgtgtgtgtgtgtgtgtgttggatctactaacatgtttagcaaatggctctgacagggtggccatgagcagatgagaccagctcttgcttggttggaagccacactgcagtttgcagtttagcctttggtgtctcagtggcttcttgcttattccatgctttttctatcccatcctctctctgtgccctcctgcaatggcagccttggcacaatgcctgggtgtcctcatccttgctttactctggaaagtgtggggatggagaggatggtgcatttccagtgcttccttacctgtcaataacaatggtggccacctgggtcccagcacttggctggtggagagatttttttcattatggagctaataaagggtccctacgttttacattgattaatgaattatcacccagacatgtgcagatgaaatgtcaatataagaaaaatcaaggtatttgggaaacatgggcataatcaggtagttttgctaaaattcctcttccttggtctacataaagaagacatgggtctgtcatagaatggggacattagactgaaaactgggacaacccccttccttattttatagagactaggagttaaggggcctgcctaagattgcagtgataaagaactgaaccctaaatcagctcccactaatgaaaccctgctttccttgtatcttttaaactcagttctgcatccaacttgagaagaaaaaaagcttctttccatatcaagtaccatatgagttcatttaaactgcaccttgcagaaatgcattgccagaaagcaccagtagcctcctatctgcaagcagagtagtgctctgctctggggaggggtcattggaaaccataatgcagagtgggccccctactccatttcccagcaaaaggctccagctggagggatgggttgtggggcaacctggttcctgctaactgccagattgaatgtgtgggctagaatgcctgcacatttagttaaactgggctcagcatgcttgtcctcaaaatgtccatcctggtcacagcacacaagatggctattggtctgcttttaccctaccctgtactatacatgaaaattccagttattaacacactcaaactggtggagcttgttcaccctaggaaggggattgtatatatggcaggcttccctggtgccgatgtaaagggctacatttgggaacatttgacttccttgggactcttaagtgcataatgatggcatgaagtaaaaggggcctcaatgatgataggaaaatcagttcttttaaaatttcttcaagaaaatccaggctatcacatagtctttctgtgtgacttattaggagataggaagagcattgggaaacttgcacagctagctatgcatctacattttggtttggggttagttatgaaatgttcttaatatgacgtgttcaataacttcacataaacttcctgttctccaaaacctcaaagagatagagttaatgagttgttgtttttttttaaatgggggtagttttctatctgtcatgggctctagcatctactccgctacccaattctgtcatctccaagctgagtttcctcttctgaggcagaggctggagcagttctttttcagttctcatcctctccatcccaatccagtatatcaatcaactctaactcggagacgtctagctggcaatgtttctaaaactttcactggatttctttagacattgaagcaaacatttttttctaagaattgcttctcagatgatgatatcaaatgtatatgcttttgcaagtttgaaaagttcaaattaaccacttttgactaggtaagtctttctaaaaaccatttaaagctaactgggtcttagcatcctcctgtgtatggaagagacaggtgaccgctccaggttgggtgctcacagaacccttttcctgactctcatggaagatggtggaaggaaaatagactgtctcatcaaccctcctgtgtcctctgaagcaatctcagtttttattaaccacctcttctgtgtttctggtagctatttaacctgtatttaatctgtacttcctatgccagcctcaattttatttgatttttacaattattctcttctaaccaatgaagtgtttgtcagtatgccccaaagcttgctcttttgtgctcccttttgaataactttctatccagaaaaagagattatttgggacttgagatttgcagtgataccaacttatagcaatgatgtactttaagggaactacccaactatgttgtgatagaagaaagagaaaccttcactttggcatttttttttaatcactgtttatttttctgtttgcggcccaggaagcagtgggaggtggtggcagatatgctttgcatatggattgttatgtttttatttgggcaagtttaatcatggaaaactcaaaaagaaggggggaaatggtcagtttaagccaaaagaaactttctaaacaatgtataggtacacagcaaaattaaacaaatccaacaatttctgaagcttagtgtaattgagtggtggttgttattcaataaaattattcccaaaagtgtttctcctaagagtgcagttcccatgagtcacttcctgaacccattgaccaaaggtggacagagacaatcctgtagaccttgacattcagaaagatgtgagctgcttactgatcatatatgcatacgtttctttacagcagaggaaaccattgtccacaaaactgatgttcttttggggttttatgtacagacttgtccaatcatgtgtgtggttcctgcgagttgctgatgactccgcattgaagctctctgagttctttgattttaagttgggtttatggaattttttcaaatgttggaaggtgtgtggttcttcctgccctccctccccttttggaaatatgaaagcaaatgtttagaagaattccttttgaaaagctgtgtcgtgttccctgtgaaactgagcaggtgtgtgttggcgcgctaagtgccacatgcttgtgtgtagaggaggaggtggccctgccggctccgcgctgctgtgcctgtgatccctacctgctccccgctcctgttgccagcagcactcactgcactcctttgtcatatactctgcatcactgtcatactcacaacttcgtgaataaagttgtgtgctttattcgt

SEQ ID NO: 1697 - DNA, 2803 bp, Homo sapiens
gcaatcatttatcagactgtgggagggggccagcgttcgggagcttttcatagcccgtcctcggtgcgaggaatacaaggtggtgtcagtgaccagagattaggacagtagaattttgcatttgttacagcagcagctgtagcgagtggtttcagccgcagggcagagtccccgagctgggcgcggctgcagctcggcgggcgggcggagaagagcgcgggggcgatagcggggcgggcatgggagcggggcccgccgaggcggggcgggactcgagaccacagccccggacctcacaagcggatgccggggcttctcctggctgccccagcgcccgcggatctgtctgccgaggcgcgcttccactcccagagtttattcctcgttccttcttcagtcctgctcgtcggaggacccggttgccatggtgaaggaaaaagtggcccaccctcaggaccctcaccacccatcagagaagcctgtcattcactgccataaatgtggggagccttgcaagggtgaagtgcttcgggtccagaccaaacatttccacatcaagtgtttcacctgcaaagtgtgtggctgtgacctggcacaagggggcttcttcataaagaacggagagtatctctgcaccctggactaccagcggatgtacgggacacgctgccatggctgtggggagttcgtggagggcgaagtggtgactgctctgggcaagacctaccatcccaattgctttgcttgtactatctgcaagcgcccgtttccacccggagaccgagtcacattcaatgggagagactgcctttgtcaactctgtgcacagccgatgtcgtccagtccgaaagaaaccaccttctccagcaattgtgccggctgcggaagagatatcaagaatgggcaggcgctgctggcgctggataagcagtggcacttggggtgctttaaatgcaagtcctgcgggaaggtcctcaccggggagtacatcagcaaggatggtgctccgtactgtgaaaaggactaccagggactctttggggtgaaatgtgaggcgtgtcaccagtttatcacagggaaagtcctggaggcaggtgacaaacattaccaccccagctgtgcacgatgcagcagatgcaaccagatgttcacagaaggagaggaaatgtatcttcaaggctccaccgtttggcatcccgactgtaagcaatctacgaagaccgaggaaaagctgcggcctaccaggacatcctcggaaagtatttattctaggccaggctccagtattcctggctcaccaggtcatactatctatgcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctggcaatgagccgtccagcggccggaactcccctctcccttaccggccagacagccgccctctaactccaacttacgctcaggcccctaaacatttccatgttccagatcaaggaatcaacatttaccgaaagccacccatctacaaacagcatggacctgacatgaaacgcagatctagtggcagagaggaagatgatgaggaacttctgagacgtcggcagcttcaagaagagcaattaatgaagcttaactcaggcctgggacagttgatcttgaaagaagagatggagaaagagagccgggaaaggtcatctctgttagccagtcgctacgattctcccatcaactcagcttcacatattccatcatctaaaactgcatctctccctggctatggaagaaatgggcttcaccggcctgtttctaccgacttcgctcagtataacagctatggggatgtcagcgggggagtgcgagatttccagacactcccagatggccacatgcctgcaatgagaatggaccgaggagtgtctatgcccaacatgttggaaccaaagatatttccatatgaaatgctcatggtgaccaacagagggcgaaacaaaatcctcagagaggtggacagaaccaggctggagcgccacttagcccctgaagtgtttcgggaaatctttggaatgtccatacaggagtttgacaggttacctctttggagacgcaacgacatgaagaaaaaagcaaaactcttctaagtcccactcgtgaatggcaattagagaaaggactgacagtggcggtgccccataggatgtcatattgaggcccaaacttgattggagaatttgcaaactaccgtcgctcagcaacaccaaaaagagaaagtctggttaaaacaccatgagtcaaatgtcgggccagccaacagtaacacttgccaagaagcatggcgtagaaatttctatgttccgaaacacagagtagtgtccacatgtgagcttttcacattaccttatgtatacaacaggagctgcgttgttttcttctttttcttttcctttatctgttgtccaacaacagtgctgactgtccggataagagctggcaagtgcccttaggatgccgcatgggaaaaatcggttatcataatttcaaagtataaatat

SEQ ID NO: 1698 - DNA, 7688 bp, Homo sapiens
atgcctgccttccttggtctaaagtgtctggggaaattgtgcagctctgagaaaagcaaagtcacctcatctgagagaaccagtgccaggggctcgaacagaaagagactgattgttgaggaccggagggtctctgggacctccttcaccgctcataggcgtgccactatcactcatttgctgtatctctgtcccaaggactactgcccacgtgggcgtgtatgtaacagcgttgatccttttgtggcccaccctcaggaccctcaccacccatcagagaagcctgtcattcactgccataaatgtggggagccttgcaagggtgaagtgcttcgggtccagaccaaacatttccacatcaagtgtttcacctgcaaagtgtgtggctgtgacctggcacaagggggcttcttcataaagaacggagagtatctctgcaccctggactaccagcggatgtacgggacacgctgccatggctgtggggagttcgtggagggcgaagtggtgactgctctgggcaagacctaccatcccaattgctttgcttgtactatctgcaagcgcccgtttccacccggagaccgagtcacattcaatgggagagactgcctttgtcaactctgtgcacagccgatgtcgtccagtccgaaagaaaccaccttctccagcaattgtgccggctgcggaagagatatcaagaatgggcaggcgctgctggcgctggataagcagtggcacttggggtgctttaaatgcaagtcctgcgggaaggtcctcaccggggagtacatcagcaaggatggtgctccgtactgtgaaaaggactaccagggactctttggggtgaaatgtgaggcgtgtcaccagtttatcacagggaaagtcctggaggcaggtgacaaacattaccaccccagctgtgcacgatgcagcagatgcaaccagatgttcacagaaggagaggaaatgtatcttcaaggctccaccgtttggcatcccgactgtaagcaatctacgaagaccgaggaaaagctgcggctgccaaacattcggcgttcttcatccgatttcttttattccaaaagtctgattcgacgcacaggacggtctccgtctctgcagcctaccaggacatcctcggaaagtatttattctaggccaggctccagtattcctggctcaccaggtcatactatctatgcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctgagcttttgtctcctggtgtgcagaggttgtcgtacctgcgcaccagcagcctcagccccacccacagcgactcccgccccaacccccctttccgacaccacttcattccccatatcaaaggcaatgagccgtccagcggccggaactcccctctcccttaccggccagacagccgccctctaactccaacttacgctcaggcccctaaacatttccatgttccagatcaaggaatcaacatttaccgaaagccacccatctacaaacagcatgctgccttggcagcccagagcaagtcctcagaagatatcatcaagttttccaagttcccagcagcccaggcaccagaccccagcgagacaccaaagattgagacggaccactggcctggtcccccctcatttgctgtcgtaggacctgacatgaaacgcagatctagtggcagagaggaagatgatgaggaacttctgagacgtcggcagcttcaagaagagcaattaatgaagcttaactcaggcctgggacagttgatcttgaaagaagagatggagaaagagagccgggaaaggtcatctctgttagccagtcgctacgattctcccatcaactcagcttcacatattccatcatctaaaactgcatctctccctggctatggaagaaatgggcttcaccggcctgtttctaccgacttcgctcagtataacagctatggggatgtcagcgggggagtgcgagaatatcagacactcccagatggccacatgcctgcaatgagaatggaccgaggagtgtctatgcccaacatgttggaaccaaagatatttccatatgaaatgctcatggtgaccaacagagggcgaaacaaaatcctcagagaggtggacagaaccaggctggagcgccacttagcccctgaagtgtttcgggaaatctttggaatgtccatacaggagtttgacaggttacctctttggagacgcaacgacatgaagaaaaaagcaaaactcttctaagtcccactcgtgaatggcaattagagaaaggactgacagtggcggtgccccataggatgtcatattgaggcccaaacttgattggagaatttgcaaactaccgtcgctcagcaacaccaaaaagagaaagtctggttaaaacaccatgagtcaaatgtcgggccagccaacagtaacacttgccaagaagcatggcgtagaaatttctatgttccgaaacacagagtagtgtccacatgtgagcttttcacattaccttatgtatacaacaggagctgcgttgttttcttctttttcttttcctttatctgttgtccaacaacagtgctgactgtccggataagagctggcaagtgcccttaggatgccgcatgggaaaaatcggttatcataatttcaaagtataaatatatttattaagtagcgctgcggctaagaaggaagagtgaggggtctgtccatggggtggcagtgatttcacacccgcctttcttgaatggcttcgtgttactcagccgtgccctggcaggaatggaactccatcagggaacagggcagctctgtttgaatggggtgaaaaacagcaaaattaattcttagcaagctccttgttctctactgttcaccgggacctggctggcaaatgacttagctattagtatatttaaaaactgttcaaaagcaaaagagaaggaacaggaatgaaaggaaaccttcccttaactctttctgcttcccatagcaggtctggttcctgctccccgcctaggacaggagctgtctggagctccacctttgcaaagaaaggaaaaacacaaattgcccccagattggcccagtggcatgccattaggtgattttgcataggggccatatcattcatggccaaaaaaaaccaaaaagcaaaaaacaaaaacaagtcccatgtcctactgactctagttcttccagtcgttatcctctgctgtctctctggcatcctatgaatcagatcaagcccatgctgttgttggtttttaaggtttctttcaataataggctaaggaaagacatgtttttctcttttaaatctctgcaactccaaagtagactccttcgaacgtatttaatttggccttttcagctttcttcttgcccagctctgtcgaattcatgggtgtgtgtgcacatgttggtttcactcacccagagtaattttgtgagcatgcatgtgctttttaatttctgcttgaatgtttgtcctgctgtgttgcagcttctaaagacattgtcaccgagtgtgtgtgactcaaagatcaagagtgaggctaaactgcgaccccaacatcacttccttcatggaaaggtgttggcgctgatgtagctcatggaaggatcagactgggaaccacagaggaaggatgaggtgggatgtggaggtcagagcatctcacgagagtccctcaggctctgcaacactagattcgaatatgagcctagggtttccccaacacgtgcgtgcatatgaaaccacatcatgattcccgacgtgagttagatgagggagagtttgtgtaactccacacccaggagggtaagccactttattatcatgctttggggctgtgcttaagaatttaagctctgttttaaagccgaagaagaaaacatttgaatttaccttcatatgccactaagaacaaaagctctgaagttcttcctgctggcaccaaatattaggattacaagctgtctctctgacaccagtggtaaaaaagcaagtagaatagtttctgagtctgtgttgcagcctctgacacgtggctcaccgctgtcatttgggggatggaatgaacagtcactgttctatagcatcctcctgtgctcttacctaaggaatctaaattgtcctagccttccattgctatgcactgaatgaggactactctcgtgtgtgtgtgtgtgtgtgtgtgtgtgtgtgtgtgtgtgtgtgtgtgtgttggatctactaacatgtttagcaaatggctctgacagggtggccatgagcagatgagaccagctcttgcttggttggaagccacactgcagtttgcagtttagcctttggtgtctcagtggcttcttgcttattccatgctttttctatcccatcctctctctgtgccctcctgcaatggcagccttggcacaatgcctgggtgtcctcatccttgctttactctggaaagtgtggggatggagaggatggtgcatttccagtgcttccttacctgtcaataacaatggtggccacctgggtcccagcacttggctggtggagagatttttttcattatggagctaataaagggtccctacgttttacattgattaatgaattatcacccagacatgtgcagatgaaatgtcaatataagaaaaatcaaggtatttgggaaacatgggcataatcaggtagttttgctaaaattcctcttccttggtctacataaagaagacatgggtctgtcatagaatggggacattagactgaaaactgggacaacccccttccttattttatagagactaggagttaaggggcctgcctaagattgcagtgataaagaactgaaccctaaatcagctcccactaatgaaaccctgctttccttgtatcttttaaactcagttctgcatccaacttgagaagaaaaaaagcttctttccatatcaagtaccatatgagttcatttaaactgcaccttgcagaaatgcattgccagaaagcaccagtagcctcctatctgcaagcagagtagtgctctgctctggggaggggtcattggaaaccataatgcagagtgggccccctactccatttcccagcaaaaggctccagctggagggatgggttgtggggcaacctggttcctgctaactgccagattgaatgtgtgggctagaatgcctgcacatttagttaaactgggctcagcatgcttgtcctcaaaatgtccatcctggtcacagcacacaagatggctattggtctgcttttaccctaccctgtactatacatgaaaattccagttattaacacactcaaactggtggagcttgttcaccctaggaaggggattgtatatatggcaggcttccctggtgccgatgtaaagggctacatttgggaacatttgacttccttgggactcttaagtgcataatgatggcatgaagtaaaaggggcctcaatgatgataggaaaatcagttcttttaaaatttcttcaagaaaatccaggctatcacatagtctttctgtgtgacttattaggagataggaagagcattgggaaacttgcacagctagctatgcatctacattttggtttggggttagttatgaaatgttcttaatatgacgtgttcaataacttcacataaacttcctgttctccaaaacctcaaagagatagagttaatgagttgttgtttttttttaaatgggggtagttttctatctgtcatgggctctagcatctactccgctacccaattctgtcatctccaagctgagtttcctcttctgaggcagaggctggagcagttctttttcagttctcatcctctccatcccaatccagtatatcaatcaactctaactcggagacgtctagctggcaatgtttctaaaactttcactggatttctttagacattgaagcaaacatttttttctaagaattgcttctcagatgatgatatcaaatgtatatgcttttgcaagtttgaaaagttcaaattaaccacttttgactaggtaagtctttctaaaaaccatttaaagctaactgggtcttagcatcctcctgtgtatggaagagacaggtgaccgctccaggttgggtgctcacagaacccttttcctgactctcatggaagatggtggaaggaaaatagactgtctcatcaaccctcctgtgtcctctgaagcaatctcagtttttattaaccacctcttctgtgtttctggtagctatttaacctgtatttaatctgtacttcctatgccagcctcaattttatttgatttttacaattattctcttctaaccaatgaagtgtttgtcagtatgccccaaagcttgctcttttgtgctcccttttgaataactttctatccagaaaaagagattatttgggacttgagatttgcagtgataccaacttatagcaatgatgtactttaagggaactacccaactatgttgtgatagaagaaagagaaaccttcactttggcatttttttttaatcactgtttatttttctgtttgcggcccaggaagcagtgggaggtggtggcagatatgctttgcatatggattgttatgtttttatttgggcaagtttaatcatggaaaactcaaaaagaaggggggaaatggtcagtttaagccaaaagaaactttctaaacaatgtataggtacacagcaaaattaaacaaatccaacaatttctgaagcttagtgtaattgagtggtggttgttattcaataaaattattcccaaaagtgtttctcctaagagtgcagttcccatgagtcacttcctgaacccattgaccaaaggtggacagagacaatcctgtagaccttgacattcagaaagatgtgagctgcttactgatcatatatgcatacgtttctttacagcagaggaaaccattgtccacaaaactgatgttcttttggggttttatgtacagacttgtccaatcatgtgtgtggttcctgcgagttgctgatgactccgcattgaagctctctgagttctttgattttaagttgggtttatggaattttttcaaatgttggaaggtgtgtggttcttcctgccctccctccccttttggaaatatgaaagcaaatgtttagaagaattccttttgaaaagctgtgtcgtgttccctgtgaaactgagcaggtgtgtgttggcgcgctaagtgccacatgcttgtgtgtagaggaggaggtggccctgccggctccgcgctgctgtgcctgtgatccctacctgctccccgctcctgttgccagcagcactcactgcactcctttgtcatatactctgcatcactgtcatactcacaacttcgtgaataaagttgtgtgctttattcgt

SEQ ID NO: 1699 - DNA, 7256 bp, Homo sapiens
atggtgccagaccctgtggcccaccctcaggaccctcaccacccatcagagaagcctgtcattcactgccataaatgtggggagccttgcaagggtgaagtgcttcgggtccagaccaaacatttccacatcaagtgtttcacctgcaaagtgtgtggctgtgacctggcacaagggggcttcttcataaagaacggagagtatctctgcaccctggactaccagcggatgtacgggacacgctgccatggctgtggggagttcgtggagggcgaagtggtgactgctctgggcaagacctaccatcccaattgctttgcttgtactatctgcaagcgcccgtttccacccggagaccgagtcacattcaatgggagagactgcctttgtcaactctgtgcacagccgatgtcgtccagtccgaaagaaaccaccttctccagcaattgtgccggctgcggaagagatatcaagaatgggcaggcgctgctggcgctggataagcagtggcacttggggtgctttaaatgcaagtcctgcgggaaggtcctcaccggggagtacatcagcaaggatggtgctccgtactgtgaaaaggactaccagggactctttggggtgaaatgtgaggcgtgtcaccagtttatcacagggaaagtcctggaggcaggtgacaaacattaccaccccagctgtgcacgatgcagcagatgcaaccagatgttcacagaaggagaggaaatgtatcttcaaggctccaccgtttggcatcccgactgtaagcaatctacgaagaccgaggaaaagctgcggcctaccaggacatcctcggaaagtatttattctaggccaggctccagtattcctggctcaccaggtcatactatctatgcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctggcaatgagccgtccagcggccggaactcccctctcccttaccggccagacagccgccctctaactccaacttacgctcaggcccctaaacatttccatgttccagatcaaggaatcaacatttaccgaaagccacccatctacaaacagcatgctgccttggcagcccagagcaagtcctcagaagatatcatcaagttttccaagttcccagcagcccaggcaccagaccccagcgagacaccaaagattgagacggaccactggcctggtcccccctcatttgctgtcgtaggacctgacatgaaacgcagatctagtggcagagaggaagatgatgaggaacttctgagacgtcggcagcttcaagaagagcaattaatgaagcttaactcaggcctgggacagttgatcttgaaagaagagatggagaaagagagccgggaaaggtcatctctgttagccagtcgctacgattctcccatcaactcagcttcacatattccatcatctaaaactgcatctctccctggctatggaagaaatgggcttcaccggcctgtttctaccgacttcgctcagtataacagctatggggatgtcagcgggggagtgcgagaatatcagacactcccagatggccacatgcctgcaatgagaatggaccgaggagtgtctatgcccaacatgttggaaccaaagatatttccatatgaaatgctcatggtgaccaacagagggcgaaacaaaatcctcagagaggtggacagaaccaggctggagcgccacttagcccctgaagtgtttcgggaaatctttggaatgtccatacaggagtttgacaggttacctctttggagacgcaacgacatgaagaaaaaagcaaaactcttctaagtcccactcgtgaatggcaattagagaaaggactgacagtggcggtgccccataggatgtcatattgaggcccaaacttgattggagaatttgcaaactaccgtcgctcagcaacaccaaaaagagaaagtctggttaaaacaccatgagtcaaatgtcgggccagccaacagtaacacttgccaagaagcatggcgtagaaatttctatgttccgaaacacagagtagtgtccacatgtgagcttttcacattaccttatgtatacaacaggagctgcgttgttttcttctttttcttttcctttatctgttgtccaacaacagtgctgactgtccggataagagctggcaagtgcccttaggatgccgcatgggaaaaatcggttatcataatttcaaagtataaatatatttattaagtagcgctgcggctaagaaggaagagtgaggggtctgtccatggggtggcagtgatttcacacccgcctttcttgaatggcttcgtgttactcagccgtgccctggcaggaatggaactccatcagggaacagggcagctctgtttgaatggggtgaaaaacagcaaaattaattcttagcaagctccttgttctctactgttcaccgggacctggctggcaaatgacttagctattagtatatttaaaaactgttcaaaagcaaaagagaaggaacaggaatgaaaggaaaccttcccttaactctttctgcttcccatagcaggtctggttcctgctccccgcctaggacaggagctgtctggagctccacctttgcaaagaaaggaaaaacacaaattgcccccagattggcccagtggcatgccattaggtgattttgcataggggccatatcattcatggccaaaaaaaaccaaaaagcaaaaaacaaaaacaagtcccatgtcctactgactctagttcttccagtcgttatcctctgctgtctctctggcatcctatgaatcagatcaagcccatgctgttgttggtttttaaggtttctttcaataataggctaaggaaagacatgtttttctcttttaaatctctgcaactccaaagtagactccttcgaacgtatttaatttggccttttcagctttcttcttgcccagctctgtcgaattcatgggtgtgtgtgcacatgttggtttcactcacccagagtaattttgtgagcatgcatgtgctttttaatttctgcttgaatgtttgtcctgctgtgttgcagcttctaaagacattgtcaccgagtgtgtgtgactcaaagatcaagagtgaggctaaactgcgaccccaacatcacttccttcatggaaaggtgttggcgctgatgtagctcatggaaggatcagactgggaaccacagaggaaggatgaggtgggatgtggaggtcagagcatctcacgagagtccctcaggctctgcaacactagattcgaatatgagcctagggtttccccaacacgtgcgtgcatatgaaaccacatcatgattcccgacgtgagttagatgagggagagtttgtgtaactccacacccaggagggtaagccactttattatcatgctttggggctgtgcttaagaatttaagctctgttttaaagccgaagaagaaaacatttgaatttaccttcatatgccactaagaacaaaagctctgaagttcttcctgctggcaccaaatattaggattacaagctgtctctctgacaccagtggtaaaaaagcaagtagaatagtttctgagtctgtgttgcagcctctgacacgtggctcaccgctgtcatttgggggatggaatgaacagtcactgttctatagcatcctcctgtgctcttacctaaggaatctaaattgtcctagccttccattgctatgcactgaatgaggactactctcgtgtgtgtgtgtgtgtgtgtgtgtgtgtgtgtgtgtgtgtgtgtgtgtgttggatctactaacatgtttagcaaatggctctgacagggtggccatgagcagatgagaccagctcttgcttggttggaagccacactgcagtttgcagtttagcctttggtgtctcagtggcttcttgcttattccatgctttttctatcccatcctctctctgtgccctcctgcaatggcagccttggcacaatgcctgggtgtcctcatccttgctttactctggaaagtgtggggatggagaggatggtgcatttccagtgcttccttacctgtcaataacaatggtggccacctgggtcccagcacttggctggtggagagatttttttcattatggagctaataaagggtccctacgttttacattgattaatgaattatcacccagacatgtgcagatgaaatgtcaatataagaaaaatcaaggtatttgggaaacatgggcataatcaggtagttttgctaaaattcctcttccttggtctacataaagaagacatgggtctgtcatagaatggggacattagactgaaaactgggacaacccccttccttattttatagagactaggagttaaggggcctgcctaagattgcagtgataaagaactgaaccctaaatcagctcccactaatgaaaccctgctttccttgtatcttttaaactcagttctgcatccaacttgagaagaaaaaaagcttctttccatatcaagtaccatatgagttcatttaaactgcaccttgcagaaatgcattgccagaaagcaccagtagcctcctatctgcaagcagagtagtgctctgctctggggaggggtcattggaaaccataatgcagagtgggccccctactccatttcccagcaaaaggctccagctggagggatgggttgtggggcaacctggttcctgctaactgccagattgaatgtgtgggctagaatgcctgcacatttagttaaactgggctcagcatgcttgtcctcaaaatgtccatcctggtcacagcacacaagatggctattggtctgcttttaccctaccctgtactatacatgaaaattccagttattaacacactcaaactggtggagcttgttcaccctaggaaggggattgtatatatggcaggcttccctggtgccgatgtaaagggctacatttgggaacatttgacttccttgggactcttaagtgcataatgatggcatgaagtaaaaggggcctcaatgatgataggaaaatcagttcttttaaaatttcttcaagaaaatccaggctatcacatagtctttctgtgtgacttattaggagataggaagagcattgggaaacttgcacagctagctatgcatctacattttggtttggggttagttatgaaatgttcttaatatgacgtgttcaataacttcacataaacttcctgttctccaaaacctcaaagagatagagttaatgagttgttgtttttttttaaatgggggtagttttctatctgtcatgggctctagcatctactccgctacccaattctgtcatctccaagctgagtttcctcttctgaggcagaggctggagcagttctttttcagttctcatcctctccatcccaatccagtatatcaatcaactctaactcggagacgtctagctggcaatgtttctaaaactttcactggatttctttagacattgaagcaaacatttttttctaagaattgcttctcagatgatgatatcaaatgtatatgcttttgcaagtttgaaaagttcaaattaaccacttttgactaggtaagtctttctaaaaaccatttaaagctaactgggtcttagcatcctcctgtgtatggaagagacaggtgaccgctccaggttgggtgctcacagaacccttttcctgactctcatggaagatggtggaaggaaaatagactgtctcatcaaccctcctgtgtcctctgaagcaatctcagtttttattaaccacctcttctgtgtttctggtagctatttaacctgtatttaatctgtacttcctatgccagcctcaattttatttgatttttacaattattctcttctaaccaatgaagtgtttgtcagtatgccccaaagcttgctcttttgtgctcccttttgaataactttctatccagaaaaagagattatttgggacttgagatttgcagtgataccaacttatagcaatgatgtactttaagggaactacccaactatgttgtgatagaagaaagagaaaccttcactttggcatttttttttaatcactgtttatttttctgtttgcggcccaggaagcagtgggaggtggtggcagatatgctttgcatatggattgttatgtttttatttgggcaagtttaatcatggaaaactcaaaaagaaggggggaaatggtcagtttaagccaaaagaaactttctaaacaatgtataggtacacagcaaaattaaacaaatccaacaatttctgaagcttagtgtaattgagtggtggttgttattcaataaaattattcccaaaagtgtttctcctaagagtgcagttcccatgagtcacttcctgaacccattgaccaaaggtggacagagacaatcctgtagaccttgacattcagaaagatgtgagctgcttactgatcatatatgcatacgtttctttacagcagaggaaaccattgtccacaaaactgatgttcttttggggttttatgtacagacttgtccaatcatgtgtgtggttcctgcgagttgctgatgactccgcattgaagctctctgagttctttgattttaagttgggtttatggaattttttcaaatgttggaaggtgtgtggttcttcctgccctccctccccttttggaaatatgaaagcaaatgtttagaagaattccttttgaaaagctgtgtcgtgttccctgtgaaactgagcaggtgtgtgttggcgcgctaagtgccacatgcttgtgtgtagaggaggaggtggccctgccggctccgcgctgctgtgcctgtgatccctacctgctccccgctcctgttgccagcagcactcactgcactcctttgtcatatactctgcatcactgtcatactcacaacttcgtgaataaagttgtgtgctttattcgt

SEQ ID NO: 1700 - DNA, 6836 bp, Homo sapiens
gaggagaggaggcgtgagagagcgtgcctgcccgccgcacacggggctggtttccggagtgcgtctctagagggatgcacgttgccttagccgagcttcggagagaagcctgatatgtaacccaggcaggtgggagcctcagtctgtcgggctgaggtctggcatctacaaagcctcttggccgtgttctgaacttgaagcctggaggagttctctgctcagcacagccaaggaacagaattagaagaaaaggaaccctggcctgaggcaggtgacaaacattaccaccccagctgtgcacgatgcagcagatgcaaccagatgttcacagaaggagaggaaatgtatcttcaaggctccaccgtttggcatcccgactgtaagcaatctacgaagaccgaggaaaagctgcggctgccaaacattcggcgttcttcatccgatttcttttattccaaaagtctgattcgacgcacaggacggtctccgtctctgcagcctaccaggacatcctcggaaagtatttattctaggccaggctccagtattcctggctcaccaggtcatactatctatgcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctgatcaaggaatcaacatttaccgaaagccacccatctacaaacagcatgctgccttggcagcccagagcaagtcctcagaagatatcatcaagttttccaagttcccagcagcccaggcaccagaccccagcgagacaccaaagattgagacggaccactggcctggtcccccctcatttgctgtcgtaggacctgacatgaaacgcagatctagtggcagagaggaagatgatgaggaacttctgagacgtcggcagcttcaagaagagcaattaatgaagcttaactcaggcctgggacagttgatcttgaaagaagagatggagaaagagagccgggaaaggtcatctctgttagccagtcgctacgattctcccatcaactcagcttcacatattccatcatctaaaactgcatctctccctggctatggaagaaatgggcttcaccggcctgtttctaccgacttcgctcagtataacagctatggggatgtcagcgggggagtgcgagatttccagacactcccagatggccacatgcctgcaatgagaatggaccgaggagtgtctatgcccaacatgttggaaccaaagatatttccatatgaaatgctcatggtgaccaacagagggcgaaacaaaatcctcagagaggtggacagaaccaggctggagcgccacttagcccctgaagtgtttcgggaaatctttggaatgtccatacaggagtttgacaggttacctctttggagacgcaacgacatgaagaaaaaagcaaaactcttctaagtcccactcgtgaatggcaattagagaaaggactgacagtggcggtgccccataggatgtcatattgaggcccaaacttgattggagaatttgcaaactaccgtcgctcagcaacaccaaaaagagaaagtctggttaaaacaccatgagtcaaatgtcgggccagccaacagtaacacttgccaagaagcatggcgtagaaatttctatgttccgaaacacagagtagtgtccacatgtgagcttttcacattaccttatgtatacaacaggagctgcgttgttttcttctttttcttttcctttatctgttgtccaacaacagtgctgactgtccggataagagctggcaagtgcccttaggatgccgcatgggaaaaatcggttatcataatttcaaagtataaatatatttattaagtagcgctgcggctaagaaggaagagtgaggggtctgtccatggggtggcagtgatttcacacccgcctttcttgaatggcttcgtgttactcagccgtgccctggcaggaatggaactccatcagggaacagggcagctctgtttgaatggggtgaaaaacagcaaaattaattcttagcaagctccttgttctctactgttcaccgggacctggctggcaaatgacttagctattagtatatttaaaaactgttcaaaagcaaaagagaaggaacaggaatgaaaggaaaccttcccttaactctttctgcttcccatagcaggtctggttcctgctccccgcctaggacaggagctgtctggagctccacctttgcaaagaaaggaaaaacacaaattgcccccagattggcccagtggcatgccattaggtgattttgcataggggccatatcattcatggccaaaaaaaaccaaaaagcaaaaaacaaaaacaagtcccatgtcctactgactctagttcttccagtcgttatcctctgctgtctctctggcatcctatgaatcagatcaagcccatgctgttgttggtttttaaggtttctttcaataataggctaaggaaagacatgtttttctcttttaaatctctgcaactccaaagtagactccttcgaacgtatttaatttggccttttcagctttcttcttgcccagctctgtcgaattcatgggtgtgtgtgcacatgttggtttcactcacccagagtaattttgtgagcatgcatgtgctttttaatttctgcttgaatgtttgtcctgctgtgttgcagcttctaaagacattgtcaccgagtgtgtgtgactcaaagatcaagagtgaggctaaactgcgaccccaacatcacttccttcatggaaaggtgttggcgctgatgtagctcatggaaggatcagactgggaaccacagaggaaggatgaggtgggatgtggaggtcagagcatctcacgagagtccctcaggctctgcaacactagattcgaatatgagcctagggtttccccaacacgtgcgtgcatatgaaaccacatcatgattcccgacgtgagttagatgagggagagtttgtgtaactccacacccaggagggtaagccactttattatcatgctttggggctgtgcttaagaatttaagctctgttttaaagccgaagaagaaaacatttgaatttaccttcatatgccactaagaacaaaagctctgaagttcttcctgctggcaccaaatattaggattacaagctgtctctctgacaccagtggtaaaaaagcaagtagaatagtttctgagtctgtgttgcagcctctgacacgtggctcaccgctgtcatttgggggatggaatgaacagtcactgttctatagcatcctcctgtgctcttacctaaggaatctaaattgtcctagccttccattgctatgcactgaatgaggactactctcgtgtgtgtgtgtgtgtgtgtgtgtgtgtgtgtgtgtgtgtgtgtgtgtgttggatctactaacatgtttagcaaatggctctgacagggtggccatgagcagatgagaccagctcttgcttggttggaagccacactgcagtttgcagtttagcctttggtgtctcagtggcttcttgcttattccatgctttttctatcccatcctctctctgtgccctcctgcaatggcagccttggcacaatgcctgggtgtcctcatccttgctttactctggaaagtgtggggatggagaggatggtgcatttccagtgcttccttacctgtcaataacaatggtggccacctgggtcccagcacttggctggtggagagatttttttcattatggagctaataaagggtccctacgttttacattgattaatgaattatcacccagacatgtgcagatgaaatgtcaatataagaaaaatcaaggtatttgggaaacatgggcataatcaggtagttttgctaaaattcctcttccttggtctacataaagaagacatgggtctgtcatagaatggggacattagactgaaaactgggacaacccccttccttattttatagagactaggagttaaggggcctgcctaagattgcagtgataaagaactgaaccctaaatcagctcccactaatgaaaccctgctttccttgtatcttttaaactcagttctgcatccaacttgagaagaaaaaaagcttctttccatatcaagtaccatatgagttcatttaaactgcaccttgcagaaatgcattgccagaaagcaccagtagcctcctatctgcaagcagagtagtgctctgctctggggaggggtcattggaaaccataatgcagagtgggccccctactccatttcccagcaaaaggctccagctggagggatgggttgtggggcaacctggttcctgctaactgccagattgaatgtgtgggctagaatgcctgcacatttagttaaactgggctcagcatgcttgtcctcaaaatgtccatcctggtcacagcacacaagatggctattggtctgcttttaccctaccctgtactatacatgaaaattccagttattaacacactcaaactggtggagcttgttcaccctaggaaggggattgtatatatggcaggcttccctggtgccgatgtaaagggctacatttgggaacatttgacttccttgggactcttaagtgcataatgatggcatgaagtaaaaggggcctcaatgatgataggaaaatcagttcttttaaaatttcttcaagaaaatccaggctatcacatagtctttctgtgtgacttattaggagataggaagagcattgggaaacttgcacagctagctatgcatctacattttggtttggggttagttatgaaatgttcttaatatgacgtgttcaataacttcacataaacttcctgttctccaaaacctcaaagagatagagttaatgagttgttgtttttttttaaatgggggtagttttctatctgtcatgggctctagcatctactccgctacccaattctgtcatctccaagctgagtttcctcttctgaggcagaggctggagcagttctttttcagttctcatcctctccatcccaatccagtatatcaatcaactctaactcggagacgtctagctggcaatgtttctaaaactttcactggatttctttagacattgaagcaaacatttttttctaagaattgcttctcagatgatgatatcaaatgtatatgcttttgcaagtttgaaaagttcaaattaaccacttttgactaggtaagtctttctaaaaaccatttaaagctaactgggtcttagcatcctcctgtgtatggaagagacaggtgaccgctccaggttgggtgctcacagaacccttttcctgactctcatggaagatggtggaaggaaaatagactgtctcatcaaccctcctgtgtcctctgaagcaatctcagtttttattaaccacctcttctgtgtttctggtagctatttaacctgtatttaatctgtacttcctatgccagcctcaattttatttgatttttacaattattctcttctaaccaatgaagtgtttgtcagtatgccccaaagcttgctcttttgtgctcccttttgaataactttctatccagaaaaagagattatttgggacttgagatttgcagtgataccaacttatagcaatgatgtactttaagggaactacccaactatgttgtgatagaagaaagagaaaccttcactttggcatttttttttaatcactgtttatttttctgtttgcggcccaggaagcagtgggaggtggtggcagatatgctttgcatatggattgttatgtttttatttgggcaagtttaatcatggaaaactcaaaaagaaggggggaaatggtcagtttaagccaaaagaaactttctaaacaatgtataggtacacagcaaaattaaacaaatccaacaatttctgaagcttagtgtaattgagtggtggttgttattcaataaaattattcccaaaagtgtttctcctaagagtgcagttcccatgagtcacttcctgaacccattgaccaaaggtggacagagacaatcctgtagaccttgacattcagaaagatgtgagctgcttactgatcatatatgcatacgtttctttacagcagaggaaaccattgtccacaaaactgatgttcttttggggttttatgtacagacttgtccaatcatgtgtgtggttcctgcgagttgctgatgactccgcattgaagctctctgagttctttgattttaagttgggtttatggaattttttcaaatgttggaaggtgtgtggttcttcctgccctccctccccttttggaaatatgaaagcaaatgtttagaagaattccttttgaaaagctgtgtcgtgttccctgtgaaactgagcaggtgtgtgttggcgcgctaagtgccacatgcttgtgtgtagaggaggaggtggccctgccggctccgcgctgctgtgcctgtgatccctacctgctccccgctcctgttgccagcagcactcactgcactcctttgtcatatactctgcatcactgtcatactcacaacttcgtgaataaagttgtgtgctttattcgt

SEQ ID NO: 1701 - DNA, 7690 bp, Homo sapiens
gtcattgagctgatgtgcttttgcaaggggtctctttagaagtggtaggggcagggtcgagagaagaaggggatgcagaatctgtacatgaggaaggagccagagtcactcaggaaactcctcattcttcctgcgctggctgtggcacacccaccggtggcacacccctccctcgggtccagttcagcccacagactcctgggaggagagccagggccccagcctctcctttgaggagtgttgcagcctttctgtgtgccagatgcctagtgaagaaaagctgaaaccctggagctttgtgcatgttaatgaccttggaaatgactgagctcacggaccctcatcacaccatgggagactacaaagtggcccaccctcaggaccctcaccacccatcagagaagcctgtcattcactgccataaatgtggggagccttgcaagggtgaagtgcttcgggtccagaccaaacatttccacatcaagtgtttcacctgcaaagtgtgtggctgtgacctggcacaagggggcttcttcataaagaacggagagtatctctgcaccctggactaccagcggatgtacgggacacgctgccatggctgtggggagttcgtggagggcgaagtggtgactgctctgggcaagacctaccatcccaattgctttgcttgtactatctgcaagcgcccgtttccacccggagaccgagtcacattcaatgggagagactgcctttgtcaactctgtgcacagccgatgtcgtccagtccgaaagaaaccaccttctccagcaattgtgccggctgcggaagagatatcaagaatgggcaggcgctgctggcgctggataagcagtggcacttggggtgctttaaatgcaagtcctgcgggaaggtcctcaccggggagtacatcagcaaggatggtgctccgtactgtgaaaaggactaccagggactctttggggtgaaatgtgaggcgtgtcaccagtttatcacagggaaagtcctggaggcaggtgacaaacattaccaccccagctgtgcacgatgcagcagatgcaaccagatgttcacagaaggagaggaaatgtatcttcaaggctccaccgtttggcatcccgactgtaagcaatctacgaagaccgaggaaaagctgcggctgccaaacattcggcgttcttcatccgatttcttttattccaaaagtctgattcgacgcacaggacggtctccgtctctgcagcctaccaggacatcctcggaaagtatttattctaggccaggctccagtattcctggctcaccaggtcatactatctatgcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctggcaatgagccgtccagcggccggaactcccctctcccttaccggccagacagccgccctctaactccaacttacgctcaggcccctaaacatttccatgttccagatcaaggaatcaacatttaccgaaagccacccatctacaaacagcatgctgccttggcagcccagagcaagtcctcagaagatatcatcaagttttccaagttcccagcagcccaggcaccagaccccagcgagacaccaaagattgagacggaccactggcctggtcccccctcatttgctgtcgtaggacctgacatgaaacgcagatctagtggcagagaggaagatgatgaggaacttctgagacgtcggcagcttcaagaagagcaattaatgaagcttaactcaggcctgggacagttgatcttgaaagaagagatggagaaagagagccgggaaaggtcatctctgttagccagtcgctacgattctcccatcaactcagcttcacatattccatcatctaaaactgcatctctccctggctatggaagaaatgggcttcaccggcctgtttctaccgacttcgctcagtataacagctatggggatgtcagcgggggagtgcgagatttccagacactcccagatggccacatgcctgcaatgagaatggaccgaggagtgtctatgcccaacatgttggaaccaaagatatttccatatgaaatgctcatggtgaccaacagagggcgaaacaaaatcctcagagaggtggacagaaccaggctggagcgccacttagcccctgaagtgtttcgggaaatctttggaatgtccatacaggagtttgacaggttacctctttggagacgcaacgacatgaagaaaaaagcaaaactcttctaagtcccactcgtgaatggcaattagagaaaggactgacagtggcggtgccccataggatgtcatattgaggcccaaacttgattggagaatttgcaaactaccgtcgctcagcaacaccaaaaagagaaagtctggttaaaacaccatgagtcaaatgtcgggccagccaacagtaacacttgccaagaagcatggcgtagaaatttctatgttccgaaacacagagtagtgtccacatgtgagcttttcacattaccttatgtatacaacaggagctgcgttgttttcttctttttcttttcctttatctgttgtccaacaacagtgctgactgtccggataagagctggcaagtgcccttaggatgccgcatgggaaaaatcggttatcataatttcaaagtataaatatatttattaagtagcgctgcggctaagaaggaagagtgaggggtctgtccatggggtggcagtgatttcacacccgcctttcttgaatggcttcgtgttactcagccgtgccctggcaggaatggaactccatcagggaacagggcagctctgtttgaatggggtgaaaaacagcaaaattaattcttagcaagctccttgttctctactgttcaccgggacctggctggcaaatgacttagctattagtatatttaaaaactgttcaaaagcaaaagagaaggaacaggaatgaaaggaaaccttcccttaactctttctgcttcccatagcaggtctggttcctgctccccgcctaggacaggagctgtctggagctccacctttgcaaagaaaggaaaaacacaaattgcccccagattggcccagtggcatgccattaggtgattttgcataggggccatatcattcatggccaaaaaaaaccaaaaagcaaaaaacaaaaacaagtcccatgtcctactgactctagttcttccagtcgttatcctctgctgtctctctggcatcctatgaatcagatcaagcccatgctgttgttggtttttaaggtttctttcaataataggctaaggaaagacatgtttttctcttttaaatctctgcaactccaaagtagactccttcgaacgtatttaatttggccttttcagctttcttcttgcccagctctgtcgaattcatgggtgtgtgtgcacatgttggtttcactcacccagagtaattttgtgagcatgcatgtgctttttaatttctgcttgaatgtttgtcctgctgtgttgcagcttctaaagacattgtcaccgagtgtgtgtgactcaaagatcaagagtgaggctaaactgcgaccccaacatcacttccttcatggaaaggtgttggcgctgatgtagctcatggaaggatcagactgggaaccacagaggaaggatgaggtgggatgtggaggtcagagcatctcacgagagtccctcaggctctgcaacactagattcgaatatgagcctagggtttccccaacacgtgcgtgcatatgaaaccacatcatgattcccgacgtgagttagatgagggagagtttgtgtaactccacacccaggagggtaagccactttattatcatgctttggggctgtgcttaagaatttaagctctgttttaaagccgaagaagaaaacatttgaatttaccttcatatgccactaagaacaaaagctctgaagttcttcctgctggcaccaaatattaggattacaagctgtctctctgacaccagtggtaaaaaagcaagtagaatagtttctgagtctgtgttgcagcctctgacacgtggctcaccgctgtcatttgggggatggaatgaacagtcactgttctatagcatcctcctgtgctcttacctaaggaatctaaattgtcctagccttccattgctatgcactgaatgaggactactctcgtgtgtgtgtgtgtgtgtgtgtgtgtgtgtgtgtgtgtgtgtgtgtgtgttggatctactaacatgtttagcaaatggctctgacagggtggccatgagcagatgagaccagctcttgcttggttggaagccacactgcagtttgcagtttagcctttggtgtctcagtggcttcttgcttattccatgctttttctatcccatcctctctctgtgccctcctgcaatggcagccttggcacaatgcctgggtgtcctcatccttgctttactctggaaagtgtggggatggagaggatggtgcatttccagtgcttccttacctgtcaataacaatggtggccacctgggtcccagcacttggctggtggagagatttttttcattatggagctaataaagggtccctacgttttacattgattaatgaattatcacccagacatgtgcagatgaaatgtcaatataagaaaaatcaaggtatttgggaaacatgggcataatcaggtagttttgctaaaattcctcttccttggtctacataaagaagacatgggtctgtcatagaatggggacattagactgaaaactgggacaacccccttccttattttatagagactaggagttaaggggcctgcctaagattgcagtgataaagaactgaaccctaaatcagctcccactaatgaaaccctgctttccttgtatcttttaaactcagttctgcatccaacttgagaagaaaaaaagcttctttccatatcaagtaccatatgagttcatttaaactgcaccttgcagaaatgcattgccagaaagcaccagtagcctcctatctgcaagcagagtagtgctctgctctggggaggggtcattggaaaccataatgcagagtgggccccctactccatttcccagcaaaaggctccagctggagggatgggttgtggggcaacctggttcctgctaactgccagattgaatgtgtgggctagaatgcctgcacatttagttaaactgggctcagcatgcttgtcctcaaaatgtccatcctggtcacagcacacaagatggctattggtctgcttttaccctaccctgtactatacatgaaaattccagttattaacacactcaaactggtggagcttgttcaccctaggaaggggattgtatatatggcaggcttccctggtgccgatgtaaagggctacatttgggaacatttgacttccttgggactcttaagtgcataatgatggcatgaagtaaaaggggcctcaatgatgataggaaaatcagttcttttaaaatttcttcaagaaaatccaggctatcacatagtctttctgtgtgacttattaggagataggaagagcattgggaaacttgcacagctagctatgcatctacattttggtttggggttagttatgaaatgttcttaatatgacgtgttcaataacttcacataaacttcctgttctccaaaacctcaaagagatagagttaatgagttgttgtttttttttaaatgggggtagttttctatctgtcatgggctctagcatctactccgctacccaattctgtcatctccaagctgagtttcctcttctgaggcagaggctggagcagttctttttcagttctcatcctctccatcccaatccagtatatcaatcaactctaactcggagacgtctagctggcaatgtttctaaaactttcactggatttctttagacattgaagcaaacatttttttctaagaattgcttctcagatgatgatatcaaatgtatatgcttttgcaagtttgaaaagttcaaattaaccacttttgactaggtaagtctttctaaaaaccatttaaagctaactgggtcttagcatcctcctgtgtatggaagagacaggtgaccgctccaggttgggtgctcacagaacccttttcctgactctcatggaagatggtggaaggaaaatagactgtctcatcaaccctcctgtgtcctctgaagcaatctcagtttttattaaccacctcttctgtgtttctggtagctatttaacctgtatttaatctgtacttcctatgccagcctcaattttatttgatttttacaattattctcttctaaccaatgaagtgtttgtcagtatgccccaaagcttgctcttttgtgctcccttttgaataactttctatccagaaaaagagattatttgggacttgagatttgcagtgataccaacttatagcaatgatgtactttaagggaactacccaactatgttgtgatagaagaaagagaaaccttcactttggcatttttttttaatcactgtttatttttctgtttgcggcccaggaagcagtgggaggtggtggcagatatgctttgcatatggattgttatgtttttatttgggcaagtttaatcatggaaaactcaaaaagaaggggggaaatggtcagtttaagccaaaagaaactttctaaacaatgtataggtacacagcaaaattaaacaaatccaacaatttctgaagcttagtgtaattgagtggtggttgttattcaataaaattattcccaaaagtgtttctcctaagagtgcagttcccatgagtcacttcctgaacccattgaccaaaggtggacagagacaatcctgtagaccttgacattcagaaagatgtgagctgcttactgatcatatatgcatacgtttctttacagcagaggaaaccattgtccacaaaactgatgttcttttggggttttatgtacagacttgtccaatcatgtgtgtggttcctgcgagttgctgatgactccgcattgaagctctctgagttctttgattttaagttgggtttatggaattttttcaaatgttggaaggtgtgtggttcttcctgccctccctccccttttggaaatatgaaagcaaatgtttagaagaattccttttgaaaagctgtgtcgtgttccctgtgaaactgagcaggtgtgtgttggcgcgctaagtgccacatgcttgtgtgtagaggaggaggtggccctgccggctccgcgctgctgtgcctgtgatccctacctgctccccgctcctgttgccagcagcactcactgcactcctttgtcatatactctgcatcactgtcatactcacaacttcgtgaataaagttgtgtgctttattcgt

SEQ ID NO: 1702 - DNA, 3560 bp, Homo sapiens
tctttggtgctgggaggcgggccgcagggtagctgttggcgccgccgcgtttctgggcctggccaactcacgtgaccgacgcgggctctgaagcggtgggccgcaccgaggcggcggcggcggcgacgactgcagctcgggaggtagcggcctggcgagggacgggccggctgccctctcggacggccgcggcggagggcaaaaatggcggaggcttcggcggccggggcggactcgggcgccgctgtagccgcccaccggtttttctgccacttttgcaagggcgaggtcagccccaaactaccggaatatatatgtcccagatgtgaatcaggctttattgaagaagtgacagatgattccagttttttaggtggtggcggcagtcggatagacaataccacaacaacacattttgcagagctttggggccatttggatcacacgatgttttttcaagattttagaccctttctaagtagcagtccactggaccaagataatagagccaatgaaaggggtcaccagactcacactgacttctggggagcaagacctccacggttgccattgggtcggagatacagatctcgaggaagttctcgtcctgacagatctccagctattgaaggaatactacaacacatctttgcaggattctttgcaaattctgccattcctggatctccacaccctttttcctggagcgggatgctgcactccaaccctggggactatgcctggggtcagacagggcttgatgccattgtaacccagcttttaggacaactggaaaacacaggccctcccccagctgacaaggaaaagatcacatctcttccaacagtgacagtaactcaggaacaagttgatatgggtttagagtgtccagtatgcaaagaagattacacagttgaagaggaagtccggcagttaccttgcaatcacttctttcacagcagttgtattgtgccgtggctagaactgcatgacacatgtcctgtatgtaggaagagcttaaatggtgaggactctactcggcaaagccagagcactgaggcctctgcaagcaacagatttagcaatgacagtcagctacatgaccgatggactttctgaagctaaagaccacacctgaatcagggctgtggtaatcatcttaccatagctgtaaattgtatcaaaacaaaaaattagtagatggatttaggaatatgtaagaaactcaacacataatataaatgcaatgaatgtttttcttctttaaatttaaagttagtatctacagatggaattgtatctacaaccaaatgcctcttatccctgaattcagagtgataattttataagtgtgaaacttaattatgtagggctccccccgtctgaatagaattaattccttaaagtctagttagggtcctgctgtctgtcatgttgccttgtaacggatgtttccacctccttctccaacctctaccccaccattagtgtattttactataaaaacagtggaaccacagccctaaagtcctgctgatataaagtccttttgtcttaattgtatttaaaaaaaaaaaaaaactactcttgatcacattagctatgaggcgaggtcaaattcaggtatctaagactaatgattttgttttgtcttgatccccagagagcaaatcaaagaaaaattacagcaagaagagaaaagtggtttatcattgtgtgctttggttttcttattttaattttttttgttttttttttttgagatggagtctcgctctgtcgcctaggctggagtgcagtggcacgatcttggctcattgcaaactctgcctcctgagttcaagcgattctcctacctcagcctccagagtagctgggaccacaggcatttgttaccatgcccagctaattttttgtatatttagtagagatggggtttcaccgtgttagccaggatggtctcaatctcctgaccttgtgctccgcctgcctcagcctcccaaagtgctgggattacaggcgtgagccactgcgcctggcctcttattttaatttttaaagactacttcagttgatgcagtttcccaagaaacctacataacatatattgggagccttatgttgataggaatctgattcccattcctttttgggaatgagttgggcagcatacaggcacagaaagacagatgtttgagacctttgcttctgagattttaaaaaatgattaccgctgggcgcggtggctcacgcctgtaatcccagcactttgggaggccgaggcaggcggatcacaaggtcaagagatcaagaccagcctggccaacaaggtaaaaccttgtctctactaaaaatataaaattagctgggcctggtggtgcatgcctgtaatcccagctactcatgaggctgaggtgggagaatcgcttgaacccaggaggtggaggttgcggtgagccggatcataccaatgcactccagtctgggcaacaagagcgaaactccatctcaaaaaaaaaaaaaaaatccccaactcactgctttttttgtttgtttctgtcgcctaggctggagtgcagtggcacgatctcagctcaccacagcctcgacctcccaggctcaagtgatcctcccacctcagcctaccaagtggctgggactacaggcgtgtgccaccatgcctgggtaatttttgtatttttgtagagatagggttttgccgtgttgcccaggctggtctcaaactcctgggctcaagtgatctgcctgcctcaacctctcaaagtgctcaactcattgtttactgtcttttttcctagtaatcttaaaataatttgcctcacagaaatagagacagtaagtgtctgcagccagttcactgtttttggtaattcattggtcttcaggagttaagattttacattgtcacattttaatttttaagcctatttttcatctctgaaactttccttttctccttggttctggctatacttggactcaaactgatcagtgtgatcatgtccaaaacagcttggcctggaagaggtaggccttattttttcagcctagtagtgtcccatgcacatgctctttgtagcattcaagtgtttaacattggataaattaagaaggtcaagaatgttgttgaaacttcaaggtctcaaaaggaaatgatggggacatagaacaactgttggtgtaccaaaaaaaggtacagaggggcaccatttgtattgtcacacaacaatgatcagaatgatcagtttagaatgatcagaacaaaaacaccactctttaatgggtctttttcttggctagaagtctttcctcagtttttgttgactatcatacgctgatttgtgggtgacggaagggggctagagataacgtttctctgtactttggtaaaggatgaaggagtcagagagggaacagaaaaagtgagagagtggcctgctgaaataatagcctgcctctaaaagttgtgaccagaaagtatgattcatttgggcccagagggaataaaatatgttttttcatatacctcccatattaca

SEQ ID NO: 1703 - DNA, 5506 bp, Homo sapiens
aatgctgagacagactcccagaagatctgagcgagtcgcgtagctgagcccggcaggggctggggtggtgctgctgctatgagctgcaccatcgagaagatcctgacagacgccaagacgctgctggagaggctacgggagcacgatgcggccgccgagtcgctggtggatcagtcggcggcgctgcaccggcgggtagcagctatgcgggaggcggggacagcgcttccggaccaggtcaggcagaggtatcaagaggatgcatccgatatgaaggacatgtccaaatacaaacctcacattctgctgtcccaagagaacacacagattagagacttgcaacaggaaaacagagagctatggatttccttggaggaacaccaggatgctttggaacttatcatgagcaaatatcggaaacagatgttacagttaatggttgctaaaaaagcggtggatgctgaaccagtcctgaaagctcaccagtctcactctgcagaaattgagagtcagattgacagaatctgtgaaatgggagaagtgatgaggaaagcagttcaggtggatgatgaccagttttgtaagattcaggaaaaattagcccaattagagcttgaaaataaggaacttcgagaattattgtccatcagcagtgagtctcttcaagccagaaaggaaaactcaatggacactgcttcccaagccatcaaataactgaactctgaatgatggctggagattgtctatcaaggaaggaagttactgtcttcccattcaagtactgtccattaagtgtcttgcctcagatttgatttaatcttaattaaaggtatcaggtggcaatttagaattccagtcaatattggctgtccacagttctcagatgtgttaatgtgaatactacatgctgaatttcaccattcctttctcaaagagactacttttaattttcatttctgggaccttgatttatataaactatgttttcagttctttgttatttttcacatctctgaaactttgagcattttttataagccagcaatttattttacatagcattgtaaaatacacttctaggaaattttaggaaagatttaactgtttaaatctatttggcataaaccttgattttttttttccatttgacaaaaataatacaattccacagaactagatcagcagattctctgatttgtaatgtcattcacctgtgacattttaagtctctctggtgctaagaattggcactttatagcctggtgcctttacttttaatttgagagaacctactgctagtcccaggaaacacacttggaaataagtcagctattttttttgcccagtgatgctatagttgtcatattgtccaaagttcatattgttcaaagctgaggagcttgtcctgtgtatgtgaatgcacacatgtgcacttagttcaaatactaaaagtagcttttattaaatataatcagccaaaaacacacacaaaataaaaaaaacaaatataagtagtcagtttttcaatgttatcctactagttctacattctattttaatttttatacaatttccattttatagttaagaaccatcacttacttggattggatgtctttcattcctagcactaatagttggctttctttttttttgtttacatagaagcagggtttttttttatcttttttctttttttttgtttaagctatataaaaaggtgaggaagcagttttgttacctaatgaaaattattacactcataatgctgtgtaggcaacattgagattcaaatgcccagtggtcaactgggttcactcatcaactcattcccgtcccagtttactcacatttcaaatttataaatttcttcatgttatactattctatttagatttgcccagaattagttgaaataatgctaaacctgtcaatattttccagtaacattaagcaccatactgcatgggagagacacagtactaaaaagagttgttagtgctttatgtgagtgatatttctttcgtaatgctataaagaactacagttaaaataacaaaatattttaaagatgtcctaaaagcatctgatcccagtaataactaatggatgtcatctagagcagtgggtgttaatgaataggtatatgtcatttaagaatttttcaaatttctgtttgatatcctgcatagaatttgacaaaaaaaacacttccaagtgtgagcattttttatttcatttcccaagagtaagtaagtaactattagcccagccatctgcctcgaagtataccttaagtgaccccataaatccattcaagaggcaggtactctataccatttggcagccacggccaaacctaccatggccagatttcagtgaaaatgatgaagtaatcaaatcaaggtataatatggtgtccctttatgtgctttatgttcctttagagctgtttataaagttctttatatctcaagtgttaggataaatcgacatactaacttttccccctgcaaaattaaaagcctgaggtacaagtctaagaagcttttagtgctctacataatataaattctggctggtgttaatgctatgaagataatatgtagttagaaaattgagtcggggaggaatgctcttcattttaagtggattttaaagtttctccttgagtggatgaagaacttgcctggtttgcaaaaatcttagttcaaaattatattttctaacaaaaactgcattttgagaagataagctaattttactcagtagtaagtcaaatgaggaagtgcagagggtttttttacatatatatagcaaccttgtcaagtggtcctcacaagagtcataaatactttgtaattagcacagtatattcagcagtgtataactctacaaatagtaccttatattagtgtagtattatatcaatatcttatgtataattcttatattaataccttatgcataattggattcaaacattgaaggtctattttagtgttcttcaaaatgtgcttccctgacctactgaaatagaaacttggtgatgaagttcaagaatttgtattctaatcatctcaaacaattcctaaagacactgattttaaaatatctagtctaggccccattgtgtaatagttagcactctaaaagatgaaaaagaaaatagtctatgtgccaaccacttcattagtacttatgaatttaaaaatgaaaaagtctggtacaggagacaagtatatatataaaattataatgcagtgtgataaatccattatagtatgtataagatacagaagagggactttaaacttgagaattcaatagagataataaatgggtaggagggaaatagaaaactttggtgccacaaaagcaaagtatgtatggtattgccaataatagctaccatctattgagtgctttactacctgtcaggtactgtattatataaactccattttaactgtacctcattttgcagatactcaggcacaaggaggtggttatttgtccaaactggaaccaagattcaaacccagacagagtcttaagcacatttttaatcactaactaacttgagatgcctaaatgccaaatactgttgggagttcaagtggttcttgattagcaaaatctatttttattagtgcaaaagaaacaccacagcttataaagtattatgaattcaataaatggagtcttaactaatgagatattattttctagaatggtgtagctgagagtatgtgtgattcaactgaaaggaataatgtttaatcagtgactcttactatatacaggaaaaggtgcagttctgtctttcaaatctgcctccttaccatattggcttacatccctcatgctgttttcttgtgtttgctagaaagttgttgccaagccaaatgtcatggccatgttgaaggcaaggaagaaaaaatggaaatggcctgtgccagctatatatatcgccttttatgagggaaagcaaagctttctcagaaatcccaaatggattttcccttgacttaattgcctgaccagttaaatggccactggtacctgcaaagaaagcagggtacatagctgtcccaaataaaatcagtattagcaagaagaaagaatattgagaaagcaattaacagtgtctgtgactgtgacatgtctgtgactttatattgtcaagtcctttccccttgaatatagttttggaagaattagctgaaggagtgtgttgacattgaatggccaagagaatgggctgtagcagacatctgtcatttctcttttggctgcccagtatcctaactcctgtgtttaaggaatccctcacctaatgaggcagagcatttcttcctcctaaagaatttgaaagtaccaggtaatgttttctcagcctccttttgcagctaaggaagaaacatctgccttcaattttaaaattagtgatacaaagaaggagggaaccatgcagattcctttgaagatggtgattaacaacactactgcattcatctccacagaggtacagcaaaagtgatttagttagcgataacctctaattctatttttttatttttattttttgagacagtcttgctctgtcaaccaggctggagtgcagtagcactgtcttaactcactgcaacctccacctcctgggttcaagcgattctcctgcctcagcctcccaagtcgctgggattacaagtgcccaccaccatgcacagctaatttttgtgtttttagtagatggggtttctccatgttggccaggctggtctcgaacttatgacttcaggtgatccgcccgccttggcctcccaaagtgctgggattataggcgtgagccactgtgcctggcctgtaacctctaattcttgtttgctggctgtcctagagatcctgagaattacttttaataaaatcatttttttgctgttattaaaactaacctgaattgcctaaaaccaagaactctgcttgataaaataagcatagttttaggaacagccatgcagatataaattttatcaacactttatacataatttgggacttatatttaaatgtaatatttgatgcttataaaagggtaaatggggaatgcaaataaattatcaagcataataactcatcacctaacttaagaataacattatgagtgcttgtattttatctatttgagctcttctcctatctttgccgacccccccgctctctttttaatagatttgttcgaatgtagaaagacctaaaatacatatgtatccctaaagtgacttattttatagttttctttctttttgaacttcaaaaaaattgtatcatactctatgtagtctaaggatttggtttttttcactcaacatgtctctagaattcacaagttttattgttttatagctgtcattttcattgatgtatatttcattgttgggttatacaacatattgttaaggaatacatacatatataataaattatacattttttaaaaaaa

SEQ ID NO: 1704 - DNA, 2883 bp, Homo sapiens
agattgtttcacatcaccagtgtatcctcagctcctaacactgtgtctggtacacattgtttgatggttttgatgtttcagattcgttatatttcacaaacacaaggcttgccagctgaatatcttctcagtgccggaacaaaaacaaccaggtttttcaacagagatcctaatttggggtacccactgtggaggcttaagacacctgaagaacatgaactggagactggaataaaatcaaaagaagctcggaagtacatttttaattgcttagatgacatggctcaggtgaatatgtctacagacctggagggaacagacatgttggcagagaaggcagaccgaagagaatacattgatctgttaaagaaaatgctcacaattgatgcagataagagaattacccctctaaaaactcttaaccatcagtttgtgacaatgactcaccttttggattttccacatagcaatcatgttaagtcttgttttcagaacatggagatctgcaagcggagggttcacatgtatgatacagtgagtcagatcaagagtcccttcactacacatgttgccccaaatacaagcacaaatctaaccatgagcttcagcaatcagctcaatacagtgcacaatcaggccagtgttctagcttccagttctactgcagcagctgctactctttctctggctaattcagatgtctcactactaaactaccagtcagctttgtacccatcatctgctgcaccagttcctggagttgcccagcagggtgtttccttgcagcctggaaccacccagatttgcactcagacagatccattccaacagacatttatagtatgtccacctgcgtttcaaactggactacaagcaacaacaaagcattctggattccctgtgaggatggataatgctgtaccgattgtaccccaggcaccagctgctcagccactacagattcagtcaggagttctcacgcagggaagctgtacaccactaatggtagcaactctccaccctcaagtagccaccatcacaccgcagtatgcggtgccctttactctgagctgcgcagccggccggccggcgctggttgaacagactgccgctgtactgcaggcgtggcctggagggactcagcaaattctcctgccttcaacttggcaacagttgcctggggtagctctacacaactctgtccagcccacagcaatgattccagaggccatggggagtggacagcagctagctgactggaggaatgcccactctcatggcaaccagtacagcactatcatgcagcagccatccttgctgactaaccatgtgacattggccactgctcagcctctgaatgttggtgttgcccatgttgtcagacaacaacaatccagttccctcccttcgaagaagaataagcagtcagctccagtctcttccaagtcctctctagatgttctgccttcccaagtctattctctggttgggagcagtcccctccgcaccacatcttcttataattccttggtccctgtccaagatcagcatcagcccatcatcattccagatactcccagccctcctgtgagtgtcatcactatccgaagtgacactgatgaggaagaggacaacaaatacaagcccagtagctctggactgaagccaaggtctaatgtcatcagttatgtcactgtcaatgattctccagactctgactcttctttgagcagcccttattccactgataccctgagtgctctccgaggcaatagtggatccgttttggaggggcctggcagagttgtggcagatggcactggcacccgcactatcattgtgcctccactgaaaactcagcttggtgactgcactgtagcaacccaggcctcaggtctcctgagcaataagactaagccagtcgcttcagtgagtgggcagtcatctggatgctgtatcacccccacagggtatcgagctcaacgcggggggaccagtgcagcacaaccactcaatcttagccagaaccagcagtcatcggcggctccaacctcacaggagagaagcagcaacccagccccccgcaggcagcaggcgtttgtggcccctctctcccaagccccctacaccttccagcatggcagcccgctacactcgacagggcacccacaccttgccccggcccctgctcacctgccaagccaggctcatctgtatacgtatgctgccccgacttctgctgctgcactgggctcaaccagctccattgctcatcttttctccccacagggttcctcaaggcatgctgcagcctataccactcaccctagcactttggtgcaccaggtccctgtcagtgttgggcccagcctcctcacttctgccagcgtggcccctgctcagtaccaacaccagtttgccacccaatcctacattgggtcttcccgaggctcaacaatttacactggatacccgctgagtcctaccaagatcagccagtattcctacttatagttggtgagcatgagggaggaggaatcatggctaccttctcctggccctgcgttcttaatattgggctatggagagatcctcctttaccctcttgaaatttcttagccagcaacttgttctgcaggggcccactgaagcagaaggtttttctctgggggaacctgtctcagtgttgactgcattgttgtagtcttcccaaagtttgccctatttttaaattcattatttttgtgacagtaattttggtacttggaagagttcagatgcccatcttctgcagttaccaaggaagagagattgttctgaagttaccctctgaaaaatattttgtctctctgacttgatttctataaatgcttttaaaaacaa

SEQ ID NO: 1705 - DNA, 7947 bp, Homo sapiens
gcagagtctgcagtgcggagggggcgggaagtccaggccccgcactcgatccacgctggctccctacggaggcccacctactcgaggcccaccgactcctactgcaatcagtactatgcgatcgtcctagagagtccattcagctgcacttccgcctcagtatggcatcacagctgcaagtgttttcgcccccatcagtgtcgtcgagtgccttctgcagtgcgaagaaactgaaaatagagccctctggctgggatgtttcaggacagagtagcaacgacaaatattatacccacagcaaaaccctcccagccacacaagggcaagccaactcctctcaccaggtagcaaatttcaacatccctgcttacgaccagggcctcctcctcccagctcctgcagtggagcatattgttgtaacagccgctgatagctcgggcagtgctgctacatcaaccttccaaagcagccagaccctgactcacagaagcaacgtttctttgcttgagccatatcaaaaatgtggattgaaacgaaaaagtgaggaagttgacagcaacggtagtgtgcagatcatagaagaacatccccctctcatgctgcaaaacaggactgtggtgggtgctgctgccacaaccaccactgtgaccacaaagagtagcagttccagcggagaaggggattaccagctggtccagcatgagatcctttgctctatgaccaatagctatgaagtcttggagttcctaggccgggggacatttggacaggtggctaagtgctggaagaggagcaccaaggaaattgtggctattaaaatcttgaagaaccacccctcctatgccagacaaggacagattgaagtgagcatcctttcccgcctaagcagtgaaaatgctgatgagtataattttgtccgttcatacgagtgctttcagcataagaatcacacctgccttgtttttgaaatgttggagcagaacttatatgattttctaaagcaaaacaaatttagcccactgccactcaagtacatcagaccaatcttgcagcaggtggccacagccttgatgaagctcaagagtcttggtctgatccacgctgaccttaagcctgaaaacatcatgctggttgatccagttcgccagccctaccgagtgaaggtcattgactttggttctgctagtcacgtttccaaagctgtgtgctcaacctacttacagtcacgttactacagagctcctgaaattattcttgggttaccattttgtgaagctattgatatgtggtcactgggctgtgtgatagctgagctgttcctgggatggcctctttatcctggtgcttcagaatatgatcagattcgttatatttcacaaacacaaggcttgccagctgaatatcttctcagtgccggaacaaaaacaaccaggtttttcaacagagatcctaatttggggtacccactgtggaggcttaagacacctgaagaacatgaactggagactggaataaaatcaaaagaagctcggaagtacatttttaattgcttagatgacatggctcaggtgaatatgtctacagacctggagggaacagacatgttggcagagaaggcagaccgaagagaatacattgatctgttaaagaaaatgctcacaattgatgcagataagagaattacccctctaaaaactcttaaccatcagtttgtgacaatgactcaccttttggattttccacatagcaatcatgttaagtcttgttttcagaacatggagatctgcaagcggagggttcacatgtatgatacagtgagtcagatcaagagtcccttcactacacatgttgccccaaatacaagcacaaatctaaccatgagcttcagcaatcagctcaatacagtgcacaatcaggccagtgttctagcttccagttctactgcagcagctgctactctttctctggctaattcagatgtctcactactaaactaccagtcagctttgtacccatcatctgctgcaccagttcctggagttgcccagcagggtgtttccttgcagcctggaaccacccagatttgcactcagacagatccattccaacagacatttatagtatgtccacctgcgtttcaaactggactacaagcaacaacaaagcattctggattccctgtgaggatggataatgctgtaccgattgtaccccaggcaccagctgctcagccactacagattcagtcaggagttctcacgcagcaggcgtggcctggagggactcagcaaattctcctgccttcaacttggcaacagttgcctggggtagctctacacaactctgtccagcccacagcaatgattccagaggccatggggagtggacagcagctagctgactggaggaatgcccactctcatggcaaccagtacagcactatcatgcagcagccatccttgctgactaaccatgtgacattggccactgctcagcctctgaatgttggtgttgcccatgttgtcagacaacaacaatccagttccctcccttcgaagaagaataagcagtcagctccagtctcttccaagtcctctctagatgttctgccttcccaagtctattctctggttgggagcagtcccctccgcaccacatcttcttataattccttggtccctgtccaagatcagcatcagcccatcatcattccagatactcccagccctcctgtgagtgtcatcactatccgaagtgacactgatgaggaagaggacaacaaatacaagcccagtagctctggactgaagccaaggtctaatgtcatcagttatgtcactgtcaatgattctccagactctgactcttctttgagcagcccttattccactgataccctgagtgctctccgaggcaatagtggatccgttttggaggggcctggcagagttgtggcagatggcactggcacccgcactatcattgtgcctccactgaaaactcagcttggtgactgcactgtagcaacccaggcctcaggtctcctgagcaataagactaagccagtcgcttcagtgagtgggcagtcatctggatgctgtatcacccccacagggtatcgagctcaacgcggggggaccagtgcagcacaaccactcaatcttagccagaaccagcagtcatcggcggctccaacctcacaggagagaagcagcaacccagccccccgcaggcagcaggcgtttgtggcccctctctcccaagccccctacaccttccagcatggcagcccgctacactcgacagggcacccacaccttgccccggcccctgctcacctgccaagccaggctcatctgtatacgtatgctgccccgacttctgctgctgcactgggctcaaccagctccattgctcatcttttctccccacagggttcctcaaggcatgctgcagcctataccactcaccctagcactttggtgcaccaggtccctgtcagtgttgggcccagcctcctcacttctgccagcgtggcccctgctcagtaccaacaccagtttgccacccaatcctacattgggtcttcccgaggctcaacaatttacactggatacccgctgagtcctaccaagatcagccagtattcctacttatagttggtgagcatgagggaggaggaatcatggctaccttctcctggccctgcgttcttaatattgggctatggagagatcctcctttaccctcttgaaatttcttagccagcaacttgttctgcaggggcccactgaagcagaaggtttttctctgggggaacctgtctcagtgttgactgcattgttgtagtcttcccaaagtttgccctatttttaaattcattatttttgtgacagtaattttggtacttggaagagttcagatgcccatcttctgcagttaccaaggaagagagattgttctgaagttaccctctgaaaaatattttgtctctctgacttgatttctataaatgcttttaaaaacaagtgaagcccctctttatttcattttgtgttattgtgattgctggtcaggaaaaatgctgatagaaggagttgaaatctgatgacaaaaaaagaaaaattactttttgtttgtttataaactcagacttgcctattttattttaaaagcggcttacacaatctcccttttgtttattggacatttaaacttacagagtttcagttttgttttaatgtcatattatacttaatgggcaattgttatttttgcaaaactggttacgtattactctgtgttactattgagattctctcaattgctcctgtgtttgttataaagtagtgtttaaaaggcagctcaccatttgctggtaacttaatgtgagagaatccatatctgcgtgaaaacaccaagtattctttttaaatgaagcaccatgaattcttttttaaattattttttaaaagtctttctctctctgattcagcttaaatttttttatcgaaaaagccattaaggtggttattattacatggtggtggtggttttattatatgcaaaatctctgtctattatgagatactggcattgatgagctttgcctaaagattagtatgaattttcagtaatacacctctgttttgctcatctctcccttctgttttatgtgatttgtttggggagaaagctaaaaaaacctgaaaccagataagaacatttcttgtgtatagcttttatacttcaaagtagcttcctttgtatgccagcagcaaattgaatgctctcttattaagacttatataataagtgcatgtaggaattgcaaaaaatattttaaaaatttattactgaatttaaaaatattttagaagttttgtaatggtggtgttttaatattttacataattaaatatgtacatattgattagaaaaatataacaagcaatttttcctgctaacccaaaatgttatttgtaatcaaatgtgtagtgattacacttgaattgtgtacttagtgtgtatgtgatcctccagtgttatcccggagatggattgatgtctccattgtatttaaaccaaaatgaactgatacttgttggaatgtatgtgaactaattgcaattatattagagcatattactgtagtgctgaatgagcaggggcattgcctgcaaggagaggagacccttggaattgttttgcacaggtgtgtctggtgaggagtttttcagtgtgtgtctcttccttccctttcttcctccttcccttattgtagtgccttatatgataatgtagtggttaatagagtttacagtgagcttgccttaggatggaccagcaagcccccgtggaccctaagttgttcaccgggatttatcagaacaggattagtagctgtattgtgtaatgcattgttctcagtttccctgccaacattgaaaaataaaaacagcagcttttctcctttaccaccacctctacccctttccattttggattctcggctgagttctcacagaagcattttccccatgtggctctctcactgtgcgttgctaccttgcttctgtgagaattcaggaagcaggtgagaggagtcaagccaatattaaatatgcattcttttaaagtatgtgcaatcacttttagaatgaatttttttttccttttcccatgtggcagtccttcctgcacatagttgacattcctagtaaaatatttgcttgttgaaaaaaacatgttaacagatgtgtttataccaaagagcctgttgtattgcttaccatgtccccatactatgaggagaagttttgtggtgccgctggtgacaaggaactcacagaaaggtttcttagctggtgaagaatatagagaaggaaccaaagcctgttgagtcattgaggcttttgaggtttcttttttaacagcttgtatagtcttggggcccttcaagctgtgaaattgtccttgtactctcagctcctgcatggatctgggtcaagtagaaggtactggggatggggacattcctgcccataaaggatttggggaaagaagattaatcctaaaatacaggtgtgttccatctgaattgaaaatgatatatttgagatataattttaggactggttctgtgtagatagagatggtgtcaaggaggtgcaggatggagatgggagatttcatggagcctggtcagccagctctgtaccaggttgaacaccgaggagctgtcaaagtatttggagtttcttcattgtaaggagtaagggcttccaagatggggcaggtagtccgtacagcctaccaggaacatgttgtgttttctttattttttaaaatcattatattgagttgtgttttcagcactatattggtcaagatagccaagcagtttgtataatttctgtcactagtgtcatacagttttctggtcaacatgtgtgatctttgtgtctcctttttgccaagcacattctgattttcttgttggaacacaggtctagtttctaaaggacaaattttttgttccttgtcttttttctgtaagggacaagatttgttgtttttgtaagaaatgagatgcaggaaagaaaaccaaatcccattcctgcaccccagtccaataagcagataccacttaagataggagtctaaactccacagaaaaggataataccaagagcttgtattgttaccttagtcacttgcctagcagtgtgtggctttaaaaactagagatttttcagtcttagtctgcaaactggcatttccgattttccagcataaaaatccacctgtgtctgctgaatgtgtatgtatgtgctcactgtggctttagattctgtccctggggttagccctgttggccctgacaggaagggaggaagcctggtgaatttagtgagcagctggcctgggtcacagtgacctgacctcaaaccagcttaaggctttaagtcctctctcagaacttggcatttccaacttcttcctttccgggtgagagaagaagcggagaagggttcagtgtagccactctgggctcatagggacacttggtcactccagagtttttaatagctcccaggaggtgatattattttcagtgctcagctgaaataccaaccccaggaataagaactccatttcaaacagttctggccattctgagcctgcttttgtgattgctcatccattgtcctccactagaggggctaagcttgactgcccttagccaggcaagcacagtaatgtgtgttttgttcagcattattatgcaaaaattcactagttgagatggtttgttttaggataggaaatgaaattgcctctcagtgacaggagtggcccgagcctgcttcctattttgattttttttttttttaactgatagatggtgcagcatgtctacatggttgtttgttgctaaactttatataatgtgtggtttcaattcagcttgaaaaataatctcactacatgtagcagtacattatatgtacattatatgtaatgttagtatttctgctttgaatccttgatattgcaatggaattcctactttattaaatgtatttgatatgctagttattgtgtgcgatttaaactttttttgctttctccctttttttggttgtgcgctttcttttacaacaagcctctagaaacagatagtttctgagaattactgagctatgtttgtaatgcagatgtacttagggagtatgtaaaataatcattttaacaaaagaaatagatatttaaaatttaatactaactatgggaaaagggtccattgtgtaaaacatagtttatctttggattcaatgtttgtctttggttttacaaagtagcttgtattttcagtattttctacataatatggtaaaatgtagagcaattgcaatgcatcaataaaatgggtaaattttctga

SEQ ID NO: 1706 - DNA, 4099 bp, Homo sapiens
gaggcggcggcggcggcggcgggaaggggctgggtggtggagcgggagggaggctgaggaggctccccctgcgggacgggcgcggggacggctccggggggcgggggccggggcccgggccggctcgcgcggggggtatgatgacccggctgcggggccccagatctcgtctcctccgccgcctcctcacggcagccccagctcgcggctgagaaccagacacaccggcggtatggcatcacagctgcaagtgttttcgcccccatcagtgtcgtcgagtgccttctgcagtgcgaagaaactgaaaatagagccctctggctgggatgtttcaggacagagtagcaacgacaaatattatacccacagcaaaaccctcccagccacacaagggcaagccaactcctctcaccaggtagcaaatttcaacatccctgcttacgaccagggcctcctcctcccagctcctgcagtggagcatattgttgtaacagccgctgatagctcgggcagtgctgctacatcaaccttccaaagcagccagaccctgactcacagaagcaacgtttctttgcttgagccatatcaaaaatgtggattgaaacgaaaaagtgaggaagttgacagcaacggtagtgtgcagatcatagaagaacatccccctctcatgctgcaaaacaggactgtggtgggtgctgctgccacaaccaccactgtgaccacaaagagtagcagttccagcggagaaggggattaccagctggtccagcatgagatcctttgctctatgaccaatagctatgaagtcttggagttcctaggccgggggacatttggacaggtggctaagtgctggaagaggagcaccaaggaaattgtggctattaaaatcttgaagaaccacccctcctatgccagacaaggacagattgaagtgagcatcctttcccgcctaagcagtgaaaatgctgatgagtataattttgtccgttcatacgagtgctttcagcataagaatcacacctgccttgtttttgaaatgttggagcagaacttatatgattttctaaagcaaaacaaatttagcccactgccactcaagtacatcagaccaatcttgcagcaggtggccacagccttgatgaagctcaagagtcttggtctgatccacgctgaccttaagcctgaaaacatcatgctggttgatccagttcgccagccctaccgagtgaaggtcattgactttggttctgctagtcacgtttccaaagctgtgtgctcaacctacttacagtcacgttactacagagctcctgaaattattcttgggttaccattttgtgaagctattgatatgtggtcactgggctgtgtgatagctgagctgttcctgggatggcctctttatcctggtgcttcagaatatgatcagattcgttatatttcacaaacacaaggcttgccagctgaatatcttctcagtgccggaacaaaaacaaccaggtttttcaacagagatcctaatttggggtacccactgtggaggcttaagacacctgaagaacatgaactggagactggaataaaatcaaaagaagctcggaagtacatttttaattgcttagatgacatggctcaggtgaatatgtctacagacctggagggaacagacatgttggcagagaaggcagaccgaagagaatacattgatctgttaaagaaaatgctcacaattgatgcagataagagaattacccctctaaaaactcttaaccatcagtttgtgacaatgactcaccttttggattttccacatagcaatcatgttaagtcttgttttcagaacatggagatctgcaagcggagggttcacatgtatgatacagtgagtcagatcaagagtcccttcactacacatgttgccccaaatacaagcacaaatctaaccatgagcttcagcaatcagctcaatacagtgcacaatcaggccagtgttctagcttccagttctactgcagcagctgctactctttctctggctaattcagatgtctcactactaaactaccagtcagctttgtacccatcatctgctgcaccagttcctggagttgcccagcagggtgtttccttgcagcctggaaccacccagatttgcactcagacagatccattccaacagacatttatagtatgtccacctgcgtttcaaactggactacaagcaacaacaaagcattctggattccctgtgaggatggataatgctgtaccgattgtaccccaggcaccagctgctcagccactacagattcagtcaggagttctcacgcagcaggcgtggcctggagggactcagcaaattctcctgccttcaacttggcaacagttgcctggggtagctctacacaactctgtccagcccacagcaatgattccagaggccatggggagtggacagcagctagctgactggaggaatgcccactctcatggcaaccagtacagcactatcatgcagcagccatccttgctgactaaccatgtgacattggccactgctcagcctctgaatgttggtgttgcccatgttgtcagacaacaacaatccagttccctcccttcgaagaagaataagcagtcagctccagtctcttccaagtcctctctagatgttctgccttcccaagtctattctctggttgggagcagtcccctccgcaccacatcttcttataattccttggtccctgtccaagatcagcatcagcccatcatcattccagatactcccagccctcctgtgagtgtcatcactatccgaagtgacactgatgaggaagaggacaacaaatacaagcccagtagctctggactgaagccaaggtctaatgtcatcagttatgtcactgtcaatgattctccagactctgactcttctttgagcagcccttattccactgataccctgagtgctctccgaggcaatagtggatccgttttggaggggcctggcagagttgtggcagatggcactggcacccgcactatcattgtgcctccactgaaaactcagcttggtgactgcactgtagcaacccaggcctcaggtctcctgagcaataagactaagccagtcgcttcagtgagtgggcagtcatctggatgctgtatcacccccacagggtatcgagctcaacgcggggggaccagtgcagcacaaccactcaatcttagccagaaccagcagtcatcggcggctccaacctcacaggagagaagcagcaacccagccccccgcaggcagcaggcgtttgtggcccctctctcccaagccccctacaccttccagcatggcagcccgctacactcgacagggcacccacaccttgccccggcccctgctcacctgccaagccaggctcatctgtatacgtatgctgccccgacttctgctgctgcactgggctcaaccagctccattgctcatcttttctccccacagggttcctcaaggcatgctgcagcctataccactcaccctagcactttggtgcaccaggtccctgtcagtgttgggcccagcctcctcacttctgccagcgtggcccctgctcagtaccaacaccagtttgccacccaatcctacattgggtcttcccgaggctcaacaatttacactggatacccgctgagtcctaccaagatcagccagtattcctacttatagttggtgagcatgagggaggaggaatcatggctaccttctcctggccctgcgttcttaatattgggctatggagagatcctcctttaccctcttgaaatttcttagccagcaacttgttctgcaggggcccactgaagcagaaggtttttctctgggggaacctgtctcagtgttgactgcattgttgtagtcttcccaaagtttgccctatttttaaattcattatttttgtgacagtaattttggtacttggaagagttcagatgcccatcttctgcagttaccaaggaagagagattgttctgaagttaccctctgaaaaatattttgtctctctgacttgatttctataaatgcttttaaaaacaa

SEQ ID NO: 1707 - DNA, 8157 bp, Homo sapiens
gaggcggcggcggcggcggcgggaaggggctgggtggtggagcgggagggaggctgaggaggctccccctgcgggacgggcgcggggacggctccggggggcgggggccggggcccgggccggctcgcgcggggggtatgatgacccggctgcggggccccagatctcgtctcctccgccgcctcctcacggcagccccagctcgcggctgagaaccagacacaccggcggtatggcatcacagctgcaagtgttttcgcccccatcagtgtcgtcgagtgccttctgcagtgcgaagaaactgaaaatagagccctctggctgggatgtttcaggacagagtagcaacgacaaatattatacccacagcaaaaccctcccagccacacaagggcaagccaactcctctcaccaggtagcaaatttcaacatccctgcttacgaccagggcctcctcctcccagctcctgcagtggagcatattgttgtaacagccgctgatagctcgggcagtgctgctacatcaaccttccaaagcagccagaccctgactcacagaagcaacgtttctttgcttgagccatatcaaaaatgtggattgaaacgaaaaagtgaggaagttgacagcaacggtagtgtgcagatcatagaagaacatccccctctcatgctgcaaaacaggactgtggtgggtgctgctgccacaaccaccactgtgaccacaaagagtagcagttccagcggagaaggggattaccagctggtccagcatgagatcctttgctctatgaccaatagctatgaagtcttggagttcctaggccgggggacatttggacaggtggctaagtgctggaagaggagcaccaaggaaattgtggctattaaaatcttgaagaaccacccctcctatgccagacaaggacagattgaagtgagcatcctttcccgcctaagcagtgaaaatgctgatgagtataattttgtccgttcatacgagtgctttcagcataagaatcacacctgccttgtttttgaaatgttggagcagaacttatatgattttctaaagcaaaacaaatttagcccactgccactcaagtacatcagaccaatcttgcagcaggtggccacagccttgatgaagctcaagagtcttggtctgatccacgctgaccttaagcctgaaaacatcatgctggttgatccagttcgccagccctaccgagtgaaggtcattgactttggttctgctagtcacgtttccaaagctgtgtgctcaacctacttacagtcacgttactacagagctcctgaaattattcttgggttaccattttgtgaagctattgatatgtggtcactgggctgtgtgatagctgagctgttcctgggatggcctctttatcctggtgcttcagaatatgatcagattcgttatatttcacaaacacaaggcttgccagctgaatatcttctcagtgccggaacaaaaacaaccaggtttttcaacagagatcctaatttggggtacccactgtggaggcttaagacacctgaagaacatgaactggagactggaataaaatcaaaagaagctcggaagtacatttttaattgcttagatgacatggctcaggtgaatatgtctacagacctggagggaacagacatgttggcagagaaggcagaccgaagagaatacattgatctgttaaagaaaatgctcacaattgatgcagataagagaattacccctctaaaaactcttaaccatcagtttgtgacaatgactcaccttttggattttccacatagcaatcatgttaagtcttgttttcagaacatggagatctgcaagcggagggttcacatgtatgatacagtgagtcagatcaagagtcccttcactacacatgttgccccaaatacaagcacaaatctaaccatgagcttcagcaatcagctcaatacagtgcacaatcaggccagtgttctagcttccagttctactgcagcagctgctactctttctctggctaattcagatgtctcactactaaactaccagtcagctttgtacccatcatctgctgcaccagttcctggagttgcccagcagggtgtttccttgcagcctggaaccacccagatttgcactcagacagatccattccaacagacatttatagtatgtccacctgcgtttcaaactggactacaagcaacaacaaagcattctggattccctgtgaggatggataatgctgtaccgattgtaccccaggcaccagctgctcagccactacagattcagtcaggagttctcacgcagggaagctgtacaccactaatggtagcaactctccaccctcaagtagccaccatcacaccgcagtatgcggtgccctttactctgagctgcgcagccggccggccggcgctggttgaacagactgccgctgtactgcaggcgtggcctggagggactcagcaaattctcctgccttcaacttggcaacagttgcctggggtagctctacacaactctgtccagcccacagcaatgattccagaggccatggggagtggacagcagctagctgactggaggaatgcccactctcatggcaaccagtacagcactatcatgcagcagccatccttgctgactaaccatgtgacattggccactgctcagcctctgaatgttggtgttgcccatgttgtcagacaacaacaatccagttccctcccttcgaagaagaataagcagtcagctccagtctcttccaagtcctctctagatgttctgccttcccaagtctattctctggttgggagcagtcccctccgcaccacatcttcttataattccttggtccctgtccaagatcagcatcagcccatcatcattccagatactcccagccctcctgtgagtgtcatcactatccgaagtgacactgatgaggaagaggacaacaaatacaagcccagtagctctggactgaagccaaggtctaatgtcatcagttatgtcactgtcaatgattctccagactctgactcttctttgagcagcccttattccactgataccctgagtgctctccgaggcaatagtggatccgttttggaggggcctggcagagttgtggcagatggcactggcacccgcactatcattgtgcctccactgaaaactcagcttggtgactgcactgtagcaacccaggcctcaggtctcctgagcaataagactaagccagtcgcttcagtgagtgggcagtcatctggatgctgtatcacccccacagggtatcgagctcaacgcggggggaccagtgcagcacaaccactcaatcttagccagaaccagcagtcatcggcggctccaacctcacaggagagaagcagcaacccagccccccgcaggcagcaggcgtttgtggcccctctctcccaagccccctacaccttccagcatggcagcccgctacactcgacagggcacccacaccttgccccggcccctgctcacctgccaagccaggctcatctgtatacgtatgctgccccgacttctgctgctgcactgggctcaaccagctccattgctcatcttttctccccacagggttcctcaaggcatgctgcagcctataccactcaccctagcactttggtgcaccaggtccctgtcagtgttgggcccagcctcctcacttctgccagcgtggcccctgctcagtaccaacaccagtttgccacccaatcctacattgggtcttcccgaggctcaacaatttacactggatacccgctgagtcctaccaagatcagccagtattcctacttatagttggtgagcatgagggaggaggaatcatggctaccttctcctggccctgcgttcttaatattgggctatggagagatcctcctttaccctcttgaaatttcttagccagcaacttgttctgcaggggcccactgaagcagaaggtttttctctgggggaacctgtctcagtgttgactgcattgttgtagtcttcccaaagtttgccctatttttaaattcattatttttgtgacagtaattttggtacttggaagagttcagatgcccatcttctgcagttaccaaggaagagagattgttctgaagttaccctctgaaaaatattttgtctctctgacttgatttctataaatgcttttaaaaacaagtgaagcccctctttatttcattttgtgttattgtgattgctggtcaggaaaaatgctgatagaaggagttgaaatctgatgacaaaaaaagaaaaattactttttgtttgtttataaactcagacttgcctattttattttaaaagcggcttacacaatctcccttttgtttattggacatttaaacttacagagtttcagttttgttttaatgtcatattatacttaatgggcaattgttatttttgcaaaactggttacgtattactctgtgttactattgagattctctcaattgctcctgtgtttgttataaagtagtgtttaaaaggcagctcaccatttgctggtaacttaatgtgagagaatccatatctgcgtgaaaacaccaagtattctttttaaatgaagcaccatgaattcttttttaaattattttttaaaagtctttctctctctgattcagcttaaatttttttatcgaaaaagccattaaggtggttattattacatggtggtggtggttttattatatgcaaaatctctgtctattatgagatactggcattgatgagctttgcctaaagattagtatgaattttcagtaatacacctctgttttgctcatctctcccttctgttttatgtgatttgtttggggagaaagctaaaaaaacctgaaaccagataagaacatttcttgtgtatagcttttatacttcaaagtagcttcctttgtatgccagcagcaaattgaatgctctcttattaagacttatataataagtgcatgtaggaattgcaaaaaatattttaaaaatttattactgaatttaaaaatattttagaagttttgtaatggtggtgttttaatattttacataattaaatatgtacatattgattagaaaaatataacaagcaatttttcctgctaacccaaaatgttatttgtaatcaaatgtgtagtgattacacttgaattgtgtacttagtgtgtatgtgatcctccagtgttatcccggagatggattgatgtctccattgtatttaaaccaaaatgaactgatacttgttggaatgtatgtgaactaattgcaattatattagagcatattactgtagtgctgaatgagcaggggcattgcctgcaaggagaggagacccttggaattgttttgcacaggtgtgtctggtgaggagtttttcagtgtgtgtctcttccttccctttcttcctccttcccttattgtagtgccttatatgataatgtagtggttaatagagtttacagtgagcttgccttaggatggaccagcaagcccccgtggaccctaagttgttcaccgggatttatcagaacaggattagtagctgtattgtgtaatgcattgttctcagtttccctgccaacattgaaaaataaaaacagcagcttttctcctttaccaccacctctacccctttccattttggattctcggctgagttctcacagaagcattttccccatgtggctctctcactgtgcgttgctaccttgcttctgtgagaattcaggaagcaggtgagaggagtcaagccaatattaaatatgcattcttttaaagtatgtgcaatcacttttagaatgaatttttttttccttttcccatgtggcagtccttcctgcacatagttgacattcctagtaaaatatttgcttgttgaaaaaaacatgttaacagatgtgtttataccaaagagcctgttgtattgcttaccatgtccccatactatgaggagaagttttgtggtgccgctggtgacaaggaactcacagaaaggtttcttagctggtgaagaatatagagaaggaaccaaagcctgttgagtcattgaggcttttgaggtttcttttttaacagcttgtatagtcttggggcccttcaagctgtgaaattgtccttgtactctcagctcctgcatggatctgggtcaagtagaaggtactggggatggggacattcctgcccataaaggatttggggaaagaagattaatcctaaaatacaggtgtgttccatctgaattgaaaatgatatatttgagatataattttaggactggttctgtgtagatagagatggtgtcaaggaggtgcaggatggagatgggagatttcatggagcctggtcagccagctctgtaccaggttgaacaccgaggagctgtcaaagtatttggagtttcttcattgtaaggagtaagggcttccaagatggggcaggtagtccgtacagcctaccaggaacatgttgtgttttctttattttttaaaatcattatattgagttgtgttttcagcactatattggtcaagatagccaagcagtttgtataatttctgtcactagtgtcatacagttttctggtcaacatgtgtgatctttgtgtctcctttttgccaagcacattctgattttcttgttggaacacaggtctagtttctaaaggacaaattttttgttccttgtcttttttctgtaagggacaagatttgttgtttttgtaagaaatgagatgcaggaaagaaaaccaaatcccattcctgcaccccagtccaataagcagataccacttaagataggagtctaaactccacagaaaaggataataccaagagcttgtattgttaccttagtcacttgcctagcagtgtgtggctttaaaaactagagatttttcagtcttagtctgcaaactggcatttccgattttccagcataaaaatccacctgtgtctgctgaatgtgtatgtatgtgctcactgtggctttagattctgtccctggggttagccctgttggccctgacaggaagggaggaagcctggtgaatttagtgagcagctggcctgggtcacagtgacctgacctcaaaccagcttaaggctttaagtcctctctcagaacttggcatttccaacttcttcctttccgggtgagagaagaagcggagaagggttcagtgtagccactctgggctcatagggacacttggtcactccagagtttttaatagctcccaggaggtgatattattttcagtgctcagctgaaataccaaccccaggaataagaactccatttcaaacagttctggccattctgagcctgcttttgtgattgctcatccattgtcctccactagaggggctaagcttgactgcccttagccaggcaagcacagtaatgtgtgttttgttcagcattattatgcaaaaattcactagttgagatggtttgttttaggataggaaatgaaattgcctctcagtgacaggagtggcccgagcctgcttcctattttgattttttttttttttaactgatagatggtgcagcatgtctacatggttgtttgttgctaaactttatataatgtgtggtttcaattcagcttgaaaaataatctcactacatgtagcagtacattatatgtacattatatgtaatgttagtatttctgctttgaatccttgatattgcaatggaattcctactttattaaatgtatttgatatgctagttattgtgtgcgatttaaactttttttgctttctccctttttttggttgtgcgctttcttttacaacaagcctctagaaacagatagtttctgagaattactgagctatgtttgtaatgcagatgtacttagggagtatgtaaaataatcattttaacaaaagaaatagatatttaaaatttaatactaactatgggaaaagggtccattgtgtaaaacatagtttatctttggattcaatgtttgtctttggttttacaaagtagcttgtattttcagtattttctacataatatggtaaaatgtagagcaattgcaatgcatcaataaaatgggtaaattttctgactta

SEQ ID NO: 1708 - DNA, 3424 bp, Homo sapiens
gcagagtctgcagtgcggagggggcgggaagtccaggccccgcactcgatccacgctggctccctacggaggcccacctactcgaggcccaccgactcctactgcaatcagtactatgcgatcgtcctagagagtccattcagctgcacttccgcctcagtatggcatcacagctgcaagtgttttcgcccccatcagtgtcgtcgagtgccttctgcagtgcgaagaaactgaaaatagagccctctggctgggatgtttcaggacagagtagcaacgacaaatattatacccacagcaaaaccctcccagccacacaagggcaagccaactcctctcaccaggtagcaaatttcaacatccctgcttacgaccagggcctcctcctcccagctcctgcagtggagcatattgttgtaacagccgctgatagctcgggcagtgctgctacatcaaccttccaaagcagccagaccctgactcacagaagcaacgtttctttgcttgagccatatcaaaaatgtggattgaaacgaaaaagtgaggaagttgacagcaacggtagtgtgcagatcatagaagaacatccccctctcatgctgcaaaacaggactgtggtgggtgctgctgccacaaccaccactgtgaccacaaagagtagcagttccagcggagaaggggattaccagctggtccagcatgagatcctttgctctatgaccaatagctatgaagtcttggagttcctaggccgggggacatttggacaggtggctaagtgctggaagaggagcaccaaggaaattgtggctattaaaatcttgaagaaccacccctcctatgccagacaaggacagattgaagtgagcatcctttcccgcctaagcagtgaaaatgctgatgagtataattttgtccgttcatacgagtgctttcagcataagaatcacacctgccttgtttttgaaatgttggagcagaacttatatgattttctaaagcaaaacaaatttagcccactgccactcaagtacatcagaccaatcttgcagcaggtggccacagccttgatgaagctcaagagtcttggtctgatccacgctgaccttaagcctgaaaacatcatgctggttgatccagttcgccagccctaccgagtgaaggtcattgactttggttctgctagtcacgtttccaaagctgtgtgctcaacctacttacagtcacgttactacagagctcctgaaattattcttgggttaccattttgtgaagctattgatatgtggtcactgggctgtgtgatagctgagctgttcctgggatggcctctttatcctggtgcttcagaatatgatcagattcgttatatttcacaaacacaaggcttgccagctgaatatcttctcagtgccggaacaaaaacaaccaggtttttcaacagagatcctaatttggggtacccactgtggaggcttaagacacctgaagaacatgaactggagactggaataaaatcaaaagaagctcggaagtacatttttaattgcttagatgacatggctcaggtgaatatgtctacagacctggagggaacagacatgttggcagagaaggcagaccgaagagaatacattgatctgttaaagaaaatgctcacaattgatgcagataagagaattacccctctaaaaactcttaaccatcagtttgtgacaatgactcaccttttggattttccacatagcaatcatgttaagtcttgttttcagaacatggagatctgcaagcggagggttcacatgtatgatacagtgagtcagatcaagagtcccttcactacacatgttgccccaaatacaagcacaaatctaaccatgagcttcagcaatcagctcaatacagtgcacaatcaggccagtgttctagcttccagttctactgcagcagctgctactctttctctggctaattcagatgtctcactactaaactaccagtcagctttgtacccatcatctgctgcaccagttcctggagttgcccagcagggtgtttccttgcagcctggaaccacccagatttgcactcagacagatccattccaacagacatttatagtatgtccacctgcgtttcaaactggactacaagcaacaacaaagcattctggattccctgtgaggatggataatgctgtaccgattgtaccccaggcaccagctgctcagccactacagattcagtcaggagttctcacgcagggaagctgtacaccactaatggtagcaactctccaccctcaagtagccaccatcacaccgcagtatgcggtgccctttactctgagctgcgcagccggccggccggcgctggttgaacagactgccgctgtactgcaggcgtggcctggagggactcagcaaattctcctgccttcaacttggcaacagttgcctggggtagctctacacaactctgtccagcccacagcaatgattccagaggccatggggagtggacagcagctagctgactggaggaatgcccactctcatggcaaccagtacagcactatcatgcagcagccatccttgctgactaaccatgtgacattggccactgctcagcctctgaatgttggtgttgcccatgttgtcagacaacaacaatccagttccctcccttcgaagaagaataagcagtcagctccagtctcttccaagtcctctctagatgttctgccttcccaagtctattctctggttgggagcagtcccctccgcaccacatcttcttataattccttggtccctgtccaagatcagcatcagcccatcatcattccagatactcccagccctcctgtgagtgtcatcactatccgaagtgacactgatgaggaagaggacaacaaatacaagcccagtagctctggactgaagccaaggtctaatgtcatcagttatgtcactgtcaatgattctccagactctgactcttctttgagcagcccttattccactgataccctgagtgctctccgaggcaatagtggatccgttttggaggggcctggcagagttgtggcagatggcactggcacccgcactatcattgtgcctccactgaaaactcagcttggtgactgcactgtagcaacccaggcctcaggtctcctgagcaataagactaagccagtcgcttcagtgagtgggcagtcatctggatgctgtatcacccccacagggtatcgagctcaacgcggggggaccagtgcagcacaaccactcaatcttagccaggtaagtgctatgggctactgccttctgtttgggccctgcactgttgttactttctggagaaccctgcttctggctggatgctgaataaagccaaatgaagccccttttgtgtcaaacaa

SEQ ID NO: 1709 - DNA, 748 bp, Homo sapiens
atcctcgtgggccctgaccttctctctgagagccgggcagaggctccggagccatgcaggccgaaggccagggcacagggggttcgacgggcgatgctgatggcccaggaggccctggcattcctgatggcccagggggcaatgctggcggcccaggagaggcgggtgccacgggcggcagaggtccccggggcgcaggggcagcaagggcctcggggccgagaggaggcgccccgcggggtccgcatggcggtgccgcttctgcgcaggatggaaggtgcccctgcggggccaggaggccggacagccgcctgcttcagttgcacatcacgatgcctttctcgtcgcccatggaagcggagctggtccgcaggatcctgtcccgggatgccgcacctctcccccgaccaggggcggttctgaaggacttcaccgtgtccggcaacctactgtttatccgactgactgctgcagaccaccgccaactgcagctctccatcagctcctgtctccagcagctttccctgttgatgtggatcacgcagtgctttctgcccgtgtttttggctcaggctccctcagggcagaggcgctaagcccagcctggcgccccttcctaggtcatgcctcctcccctagggaatggtcccagcacgagtggccagttcattgtgggggcctgattgtttgtcgctggaggaggacggcttacatgtttgtttctgtagaaaataaagctgagctacga

SEQ ID NO: 1710 - DNA, 1110 bp, Homo sapiens
tcccgaggtgaagcggaggcccaaggctgaggagcccgcctcgccggagacgcccaggcgctggccctggatcccggagccacggccgtctctcagccagagctgagcctcggcggcccggccggcgctggcctccgtgcggcggcggcaaacacggcccgcaggggaccgggtcgggtggggctgggcgccgcgcggctccctgtggagcctgcctgttggagcgcggcggggctccggcggtggtcttggagctggcgtgtggatttccacgtccgaatgatcgagttgtggcgggctttgagatgtcagaggatttagcaaagcagctggcaagctacaaagctcagctccagcaagttgaagctgcattatctggaaatggagaaaatgaagatttgctaaaattgaagaaagatttacaagaagttatagaactaaccaaagaccttctgtcaactcaaccttctgagacgcttgcaagttcagacagttttgcttctactcaacctactcattcatggaaagtaggagacaagtgtatggcagtctggagtgaagatggacagtgttatgaagcggagattgaggagatagatgaagaaaatggcaccgctgcaatcacctttgctggttatggcaatgctgaagtgactccactgttgaacctcaagcctgtagaagaaggaaggaaggcaaaggaggacagtggcaacaaacccatgtcaaaaaaagaaatgattgcccagcagcgtgaatataaaaagaagaaagctttgaaaaaagctcagagaataaaagaacttgagcaggaaagagaggaccagaaagtgaaatggcaacaattcaacaacagagcctattctaaaaacaaaaaaggccaggtaaagaggagtatttttgcttcacctgagagtgtgactggtaaagttggagtaggaacctgtggaattgctgataaacctatgacacaatatcaagatacctctaaatacaatgtcaggcatttgatgcctcaataatcagaaaaactgttggatttcatctctgcagggctttacatttacctttttatccttatatttttctaaaggtaaattatttgttaga

SEQ ID NO: 1711 - DNA, 2031 bp, Homo sapiens
tctctgtcttttcctccttccagtgcccggcgttcctcccttccccctcgccgccgaccgagttcttccttttcagaccgggtcgccttgctgtcgtcgcggtgattttcctgctactgctactgctgctgctgccaccgccactaccactgggctcatttgccccgaccccttcccgccgccccgcccccagccccacacaagatgtcagaggatttagcaaagcagctggcaagctacaaagctcagctccagcaagttgaagctgcattatctggaaatggagaaaatgaagatttgctaaaattgaagaaagatttacaagaagttatagaactaaccaaagaccttctgtcaactcaaccttctgagacgcttgcaagttcagacagttttgcttctactcaacctactcattcatggaaagtaggagacaagtgtatggcagtctggagtgaagatggacagtgttatgaagcggagattgaggagatagatgaagaaaatggcaccgctgcaatcacctttgctggttatggcaatgctgaagtgactccactgttgaacctcaagcctgtagaagaaggaaggaaggcaaaggaggacagtggcaacaaacccatgtcaaaaaaagaaatgattgcccagcagcgtgaatataaaaagaagaaagctttgaaaaaagctcagagaataaaagaacttgagcaggaaagagaggaccagaaagtgaaatggcaacaattcaacaacagagcctattctaaaaacaaaaaaggccaggtaaagaggagtatttttgcttcacctgagagtgtgactggtaaagttggagtaggaacctgtggaattgctgataaacctatgacacaatatcaagatacctctaaatacaatgtcaggcatttgatgcctcaataatcagaaaaactgttggatttcatctctgcagggctttacatttacctttttatccttatatttttctaaaggtaaattatttgttagatgagtaagcaagataccattgtcgtcattggttggcttcagtagaatgaaacgtgaagaaattgcatttgataactgctattcatttaacttttctcattatcagtaccacggttccctcaaagtttgttgaataaagcaacttttgtagatgctgtttcatacagcacttagatgaattattgatcttcctaatatcaggcgcctacttaacctatggtgtgtactttttgtaagttgtaacttgaaattttcagatgctttgaacttgacacatactctagcaattcattggaacaccaaggcaaaaacaccaacctgctaaaagagatcttttcatttttcttattttcagctttaaaacttagctgtcgttcagttaagcttaaagataggttaatttgtaaatggcaaagtttgttttgaggtttttcctcaataacttgtttcccaggcctattaggccatctctaaaattgatctagctgttttatttttatgtactcttagttttatgtaagaaaccttaggatgagctcccttttctaaggtgtttttgttttttgtatgtttgcttttttcctgttttttgttttttccatttacggcagtggtaccatgttttggatgtgtgatgtttatatgggagaacaaaaagctgatgtatagccctgtatacagtgtagatactatttttgtaaaaacacaaggctaaattaatgaacaagaatactgaatatttcatcattaaaaatttcttgtatttcttgtgcattaatctgacgataatttccctgtatattatgttcatttagctgtttgtaatttttgttaattagatcaggttgtctgcatttgttggtgtaagtgaacatcatcacagttatcctgagttgagtttaagccaaatacatgcatagaaaagggtcttcctattaatggaagaaggtaatttttaggatgtgtattatttcagttttgtatgtttaacttttattaaataaagtgtttttaaaatctcca

SEQ ID NO: 1712 - DNA, 2377 bp, Homo sapiens
gacctcagcagtgggggaggaatagaacctcagtgtagttctgaggtgtacttcagggccagggagagaggatgtgaaaatgtggcctggtctcttgggctgcgttcacattgctttctggaagctgagctccatcccctcccttggtttttgccaactaatgtgtgctctcccttaccaggtgctgcccataaactcgtgtgttatttcaccaactgggcacacagtcggccaggccctgcctcgatcttgccccatgacctggacccctttctctgcacccacctgatatttgcctttgcctcaatgaacaacaatcagattgttgctaaggatctccaggatgagaaaattctctacccagagttcaacaaactaaaggagagaatgtggcagcagctgcccaccggagtgaagaacccagctcatcaaccctctctctcacatcataggaacagagagctgaaaacactactgtccatcggcgggtggaactttggcacctcaagattcaccactatgttgtccacatttgccaaccgtgaaaagtttattgcttcagttatatcccttctgaggacacatgactttgatggtcttgaccttttcttcttatatcctggactaagaggcagccccatgcatgaccggtggacttttctcttcttaattgaagagctcctgtttgccttccggaaggaggcactgctcaccatgcgcccgaggctgctgctgtctgctgctgtttctggggtcccacacatcgtccaaacatcctatgatgtgcgctttctaggaagactcctggatttcatcaatgtcttgtcttatgacttacatggaagttgggaaaggttcacaggacataatagccccctcttctctctgcctgaagaccccaaatcttcggcatatgctatgaattattggagaaagcttggggcaccctcagagaagctcatcatggggatccccacctatggacgtacctttcgcctcctcaaagcctctaagaatgggttgcaggccagagcgatcggaccagcatctccagggaagtacaccaagcaagaaggcttcttggcttattttgagatttgttcctttgtctggggagcgaagaagcactggattgattaccagtatgtcccgtatgccaacaaggggaaagagtgggttggctatgacaatgccatcagcttcagttacaaggcatggtttataaggcgagagcattttgggggggccatggtgtggacattggacatggatgacgtcaggggcacgttctgtggcactggccctttcccccttgtctacgtattgaatgatatcctggtgcgggctgagttcagttcaacttctttaccacaattttggctgtcatctgctgtgaattcttcaagcactgaccctgaaaggctggctgtgaccacggcatggaccactgatagtaagattttgcccccaggaggagaggctggggtcactgagatccacggaaagtgtgaaaatatgactataacccctagaggtacaactgtgacccctacaaaggaaactgtatcccttggaaagcacactgtagctctaggagagaagactgagatcactggggcaatgaccatgacttctgtgggtcatcagtccatgacccctggagagaaggccctgacccctgtgggtcatcaatctgtgaccactggacagaagaccctgacctctgtgggttatcagtctgtgacccctggggaaaagaccctgacccctgtgggtcatcagtctgtgacccctgtgagtcatcagtctgtgagccctggaggaacgactatgacccctgtccattttcagactgagacccttagacagaatacagtggcccctagaaggaaggctgtggcccgtgaaaaggtgactgtcccctccagaaacatatcagtcacccctgaagggcagactatgcctttaagaggggagaatttgacttctgaggtgggcactcaccccaggatgggtaacttgggtcttcagatggaagctgaaaacaggatgatgctgtcctccagccccgtcatccagctcccggaacaaactcctctagcttttgacaaccgctttgttcccatctatggaaaccattcctctgtcaactcagtaacccctcaaacaagtcctctttctctaaaaaaagaaatcccagaaaactctgctgtggatgaagaagcctaagcccctctggtgtcagaaaccagggaaaacccttgtcttttcttctaagtgacatgttggaagccttctcatcccggggcaaagcaggcatcaaaaccagaataggccaatctcttttccattaaataaactgtaaacacaagaaccc

SEQ ID NO: 1713 - DNA, 2243 bp, Homo sapiens
agggaagctcctataaagggctgcatctctggactcacagctatcagaccattgagatgtggaagctgttgctgtgggttgggctggttcttgtgctgaaacaccacgatggtgctgcccataaactcgtgtgttatttcaccaactgggcacacagtcggccaggccctgcctcgatcttgccccatgacctggacccctttctctgcacccacctgatatttgcctttgcctcaatgaacaacaatcagattgttgctaaggatctccaggatgagaaaattctctacccagagttcaacaaactaaaggagaggaacagagagctgaaaacactactgtccatcggcgggtggaactttggcacctcaagattcaccactatgttgtccacatttgccaaccgtgaaaagtttattgcttcagttatatcccttctgaggacacatgactttgatggtcttgaccttttcttcttatatcctggactaagaggcagccccatgcatgaccggtggacttttctcttcttaattgaagagctcctgtttgccttccggaaggaggcactgctcaccatgcgcccgaggctgctgctgtctgctgctgtttctggggtcccacacatcgtccaaacatcctatgatgtgcgctttctaggaagactcctggatttcatcaatgtcttgtcttatgacttacatggaagttgggaaaggttcacaggacataatagccccctcttctctctgcctgaagaccccaaatcttcggcatatgctatgaattattggagaaagcttggggcaccctcagagaagctcatcatggggatccccacctatggacgtacctttcgcctcctcaaagcctctaagaatgggttgcaggccagagcgatcggaccagcatctccagggaagtacaccaagcaagaaggcttcttggcttattttgagatttgttcctttgtctggggagcgaagaagcactggattgattaccagtatgtcccgtatgccaacaaggggaaagagtgggttggctatgacaatgccatcagcttcagttacaaggcatggtttataaggcgagagcattttgggggggccatggtgtggacattggacatggatgacgtcaggggcacgttctgtggcactggccctttcccccttgtctacgtattgaatgatatcctggtgcgggctgagttcagttcaacttctttaccacaattttggctgtcatctgctgtgaattcttcaagcactgaccctgaaaggctggctgtgaccacggcatggaccactgatagtaagattttgcccccaggaggagaggctggggtcactgagatccacggaaagtgtgaaaatatgactataacccctagaggtacaactgtgacccctacaaaggaaactgtatcccttggaaagcacactgtagctctaggagagaagactgagatcactggggcaatgaccatgacttctgtgggtcatcagtccatgacccctggagagaaggccctgacccctgtgggtcatcaatctgtgaccactggacagaagaccctgacctctgtgggttatcagtctgtgacccctggggaaaagaccctgacccctgtgggtcatcagtctgtgacccctgtgagtcatcagtctgtgagccctggaggaacgactatgacccctgtccattttcagactgagacccttagacagaatacagtggcccctagaaggaaggctgtggcccgtgaaaaggtgactgtcccctccagaaacatatcagtcacccctgaagggcagactatgcctttaagaggggagaatttgacttctgaggtgggcactcaccccaggatgggtaacttgggtcttcagatggaagctgaaaacaggatgatgctgtcctccagccccgtcatccagctcccggaacaaactcctctagcttttgacaaccgctttgttcccatctatggaaaccattcctctgtcaactcagtaacccctcaaacaagtcctctttctctaaaaaaagaaatcccagaaaactctgctgtggatgaagaagcctaagcccctctggtgtcagaaaccagggaaaacccttgtcttttcttctaagtgacatgttggaagccttctcatcccggggcaaagcaggcatcaaaaccagaataggccaatctcttttccattaaataaactgtaaacacaagaacccac

SEQ ID NO: 1714 - DNA, 3830 bp, Homo sapiens
gcagtcaggccgttgtgcgcaggcgcagaggcggcggcggcggcggcggcggcggatgtttacggcggccgaggttggagcggcgctgctcggccgcggacacacgagggacgcgcccgaggagctgcaggtggcagcccaggcggtccgaacccgtcggccggccgagcctggagtattgcctaagtgtaatcttgaacatgggcggtgctgtgagtgctggtgaagacaatgatgagctgatagataatttgaaagaagcacagtatatccggactgagctggtagagcaggctttcagagctatcgatcgtgcagactattatcttgaagaatttaaagaaaatgcttataaagacttggcatggaagcatggaaacattcacctctcagccccgtgcatctactcggaggtgatggaagccctagatctgcagcctggactctcgtttctgaacctgggcagtggcactgggtatctcagctccatggtgggcctcattctaggtccttttggtgtgaaccatggggtggaacttcactcagatgtgatagagtatgcaaagcagaaactggacttcttcatcagaacaagtgatagttttgacaagtttgacttctgtgaaccttcctttgttactgggaattgcctggagatttctccggattgttctcagtatgatcgtgtatactgtggggctggcgtgcagaaagagcatgaagagtacatgaagaatcttctcaaagtgggagggatccttgtcatgccactggaagagaagccctgccattcagagtcaggaaaatcaagacttgtccagttaccaccagtggcagttcgcagcctccaggacttggctcgcatcgccatccggggcaccattaaaaagattattcatcaggaaactgtgagcaaaaacggaaacggactaaagaacacccccaggtttaaacgaaggagagttcgccgccgtcgaatggaaacgattgtctttttggacaaagaagtctttgccagtcggatttccaacccctcagatgacaacagctgtgaagacttggaagaggaacggagggaagaagaagagaagaccccgccggaaacaaagccagaccccccagtgaacttcctacgccagaaggtcctgagcctccctctgccagatcccctgaaatactacttgctttattacagagaaaaataagtctcctgtttgaaagggggaaataggaagagcagattgctgagtgtgaagttcgtgctgcctgtgtgctgttgaagggtcacctggaggcagacgttgtggggaagggaactgctgggctcatccacaccatggttttcttctagttcctgattgacctctaaaattctattcagttgtatgatttgtttacatagttccacaagaccttcattgcatagaagattgttttcccaaagtggagagaatcttcatagagaaaaagagaaggctgtttctttttcggctctgacgaaacactgaagtctgcgtaagagagactgtttgatgaccgtccctcatgcaacatgcacggtactcactaaaaatgaaaactgaagtggaaactaacctgtgttgcttataaagtgtgaaagcacaagcttataaatgtataaaatcttttctgggtgtgacgcacctgcgtccaagtttgaatttttatgatatgtaccacttaattactggcactgagtatcactgaatttcttagttttctagtggggaaacattattgagaagccctcccttattttaagtaagttgattaaatcttatgtgagttgccagttgtaatttttcaaaggaaaaattttgatggggtggaggaatgaattgccagataatctttctggaattccgagagaattccaaagagggtttttttttttttttttaggacatcttttgatacctttaaaagaaccactgtcaagtaatccttaaaagaatatcttggaaaaggaaacagattttttcctgtgtgtaagcaataagtgaagttacatttgccctaaccctagggatgattctttacccagttttaaagcccatcatggtattctaaggtgttgacaccctccatcctcagagcaggtcgaaaatattaaatagactggggactctatgatgggcagcctgtgctttttgacttcagtttgctatttttctgtgatcacattagtactgattcatagattctatcttttataattctggagaaaaagatttgttagttttgtaatttttttgtaagaccaaatgtatgtattttagtagctccattgcatgagaagagtgtaactcacactgacttgtgatatcagccttctctgggccttgtgtgtggagagctttctatcttaccaagtggtagggctaaaagaacaacagcctttttggtagtcacatagcagaatgatcagagttacattgcttattccaaaacattggttctttttaaaacatttttttttacccaaagaaaagaataatagaaattactaacaataaatataaattcagagtgttgatataggattcagtatccagagtttatttttaatcttaatcctcagcttcttgggagttgctgggcttcagtgtctctgtggtttcaccagcttagcttgagctctggttattttggatcttttctgctttttttaagtaactgagtcatttttaccacacagtccagtttgcatgtatagctaggaaacatgtattgctctagattgggcagtttaagtcattttaaagaaagttagttcatagttgttgccttttaactcatagtcaagcttcagtctttcaaagagaaatgtgtgattttcatttacttgctgatattttgtagtttggagatccttgtgggcattattctaactgatacgtagacacttacttggaaatttttggacattatattaaatgagtgctatctgtgaaattggttatattaggtggcttgactaatgttttttctataattgtatatggactgcatttttaaaaaaaccgcatttgcctttatgctagattgtaaaaaattatattagaatgcataagacatgtttttccttcatatgctagacttttcctagcatttcgtatttctgtgttgtcagtgtgtgatttttaaaccggaatttggtttaaaaaaaatctggtggtaatatatgtgagaaatactttggtgtttaccttatgaaaataaaggattgtaagtaaagtttcctgcgcaccttataccagaattcagtataatacactactttctgttttcaaacagataaatcataatatagtctgtattatctgtaagatctgtcttgtaaaccacattcttgacaactatttgcttttgagtagtttgtattttaatatgtgacttttgtcttgaaaagtagtaaagccatagacttgtgcaaaacaagtttcaagtttatagatattaagtttgtaatgtgagcatcaaatgtgtatgtaaaaatactttttaccagtctggaacttgggaaaatccagggaatttgaaacatagattttaatgagctggtaaacacaaatcatgtcaataaaggtagtcaggatattttatccttagcattgcttctgcatcctgtgtaggattccaattcttgaatatgttcttttcaaaatcttaagaaaagaaccttttttctttattaacatcatgtgtttactttcagcaaatatttgtattactgcttgattctgtgacagtcacaatagatgtagagaaggcattatttttcattaataaatgtgaaattggaatgg

SEQ ID NO: 1715 - DNA, 2325 bp, Homo sapiens
gttgagcggttagtgaccaggaagcctccccacccaccagagtccaaagagcacaggcgtggctgcctctgtaacctcatcaaaggcaggctctgcctgtggccactagcagagaagctgctgtccttccaccaccagcaccggaccacctgctccaagaccagcctcctggggggaccaggcacccggccttcactggcacccagggagccgtcctcagcagcgtcaacatgtcaaggcccagcagcagagccatttacttgcaccggaaggagtactcccagaacctcacctcagagcccaccctcctgcagcacagggtggagcacttgatgacatgcaagcaggggagtcagagagtccaggggcccgaggatgccttgcagaagctgttcgagatggatgcacagggccgggtgtggagccaagacttgatcctgcaggtcagggacggctggctgcagctgctggacattgagaccaaggaggagctggactcttaccgcctagacagcatccaggccatgaatgtggcgctcaacacatgttcctacaactccatcctgtccatcaccgtgcaggagccgggcctgccaggcactagcactctgctcttccagtgccaggaagtgggggcagagcgactgaagaccagcctgcagaaggctctggaggaagagctggagcaaagcagacctcgacttggaggccttcagccaggccaggacagatggagggggcctgctatggaaaggccgctccctatggagcaggcacgctatctggagccggggatccctccagaacagccccaccagaggaccctagagcacagcctcccaccatccccaaggcccctgccacgccacaccagtgcccgagaaccaagtgcctttactctgcctcctccaaggcggtcctcttcccccgaggacccagagagggacgaggaagtgctgaaccatgtcctaagggacattgagctgttcatgggaaagctggagaaggcccaggcaaagaccagcaggaagaagaaatttgggaaaaaaaacaaggaccagggaggtctcacccaggcacagtacattgactgcttccagaagatcaagcacagcttcaacctcctgggaaggctggccacctggctgaaggagacaagtgcccctgagctcgtacacatcctcttcaagtccctgaacttcatcctggccaggtgccctgaggctggcctagcagcccaagtgatctcacccctcctcacccctaaagctatcaacctgctacagtcctgtctaagcccacctgagagtaacctttggatggggttgggcccagcctggaccactagccgggccgactggacaggcgatgagcccctgccctaccaacccacattctcagatgactggcaacttccagagccctccagccaagcacccttaggataccaggaccctgtttcccttcggcggggaagtcataggttagggagcacctcacactttcctcaggagaagacacacaaccatgaccctcagcctggggaccccaactccaggccctccagccccaaacctgcccagccagccctgaaaatgcaagtcttgtacgagtttgaagctaggaacccacgggaactgactgtggtccagggagagaagctggaggttctggaccacagcaagcggtggtggctggtgaagaatgaggcgggacggagcggctacattccaagcaacatcctggagcccctacagccggggacccctgggacccagggccagtcaccctctcgggttccaatgcttcgacttagctcgaggcctgaagaggtcacagactggctgcaggcagagaacttctccactgccacggtgaggacacttgggtccctgacggggagccagctacttcgcataagacctggggagctacagatgctatgtccacaggaggccccacgaatcctgtcccggctggaggctgtcagaaggatgctggggataagcccttaggcaccagcttagacacctccaagaaccaggccccgctgatgcaagatggcagatctgatacccattagagccccgagaattcctcttctggatcccagtttgcagcaaaccccacaccccagctcacacagcaaaaacaatggacaggcccagaggctgaagcaaacagtgtcccttctggctgtgttggagcctccccagtaaccacctatttattttacctctttcccaaacctggagcatttatgcctaggcttgtcaagaatctgttcagtccctctccttctcaataaaagcatcttcaagcttg

SEQ ID NO: 1716 - DNA, 3231 bp, Homo sapiens
cttctgtagctcgcgttgaagccgcacgtccggccccgatcccggcaccatgagcttcggctcggagcactacctgtgctcctcctcctcctaccgcaaggtgttcggggatggctctcgcctgtccgcccgcctctctggggccggcggcgcgggcggcttccgctcgcagtcgctgtcccgcagcaatgtggcctcctcggccgcctgctcctcggcctcgtcgctcggcctcggcctggcctatcgccggccgccggcgtccgacgggctggacctgagccaggcggcggcgcgcaccaacgagtacaagatcatccgcaccaacgagaaggagcagctgcagggcctcaacgaccgcttcgccgtgttcatcgagaaggtgcatcagctggagacgcagaaccgcgcgttggaggccgagctggccgcgctgcgacagcgccacgctgagccgtcgcgcgtcggcgagctcttccagcgcgagctgcgcgacctgcgcgcgcagctggaggaggccagctcggctcgctcgcaggccctgctggagcgcgacgggctggcggaggaggtgcagcggctgcgggcgcgctgcgaggaggagagccgcggacgcgaaggcgccgagcgcgccctgaaggcgcagcagcgcgacgtggacggcgccacgctggcccgcctggacctggagaagaaggtggagtcgctgctggacgagctggccttcgtacgccaggtgcacgacgaggaggtagccgagctgctggccacgctgcaggcgtcgtcgcaggccgcggccgaggtggacgtgactgtggctaaaccagacctgacctcggctctgagggagatccgcgcccagtatgagtccctggccgctaagaacctgcagtccgcggaagaatggtacaagtccaagtttgccaacctgaacgagcaggcggcgcgcagcaccgaggccatccgggccagccgcgaggagatccacgagtatcggcgccagctgcaggcgcgcaccatcgagatcgagggcctgcgcggggccaacgagtccttggagaggcagatcctggagctggaggagcggcacagtgccgaggtagctggctaccaggatagcattgggcagctggagaatgatctgaggaacaccaagagtgagatggcacgccaccttcgggaataccaggacttgctcaatgtcaaaatggctcttgacattgagatagcagcttacaggaaactgctggaaggcgaggagacacgttttagcaccagtgggttaagcatttcggggctgaatccacttcccaatccaagttacctgctcccacctagaatcctcagtgctacaacctccaaagtctcatccactgggctatcacttaagaaagaggaggaggaggaggaggcatctaaggtagcctctaagaaaacctcccagataggggaaagttttgaagaaatattagaggagacagtaatatctactaagaaaaccgagaaatcaaatatagaagaaaccaccatttcaagccaaaaaatataattccattgctttgaaaaagttaatgcttaagagggaatgatatgcatttgacttgttaaacagcctattcctgaactataacacctgccaccactataaaatgtcttcaaggcttcagtctcatatttagtattgaatacttacattctctaataagaaaaccaccccttagattgaagtaaactgcagtcctggagcaatcacagatgagttatctaagaatacagctttctgaccttcagctcacgcttcacagtgatcgatgattcaggtgcagaggaagtacaaactaaggtgctaaatctgcgatcatcgtcatttgctgtgaactgaaattaaaactattcatgctacccagccattacccagctaaataatcttactctagatacctaaaacataagatcactgccagagataaactaatggtccacacccaattccactctgatagaattatttcacaaataataggtgtttgtttaatggacacttttcacctccttcaattccatatatccttttcttctatgtaggaaaaaaatagtctagtgtagtattcttcccttttaaacacattttggttcttctcaaaagaacttacccccattcgcgctctgctcagtgggtaaaattagatgcatgttgaccatgtctatgattcgtgtaattacttatccctgcccatttcatattctttcaattctgtaggttaaaaaaatggcagtgatgaattttaagggtttcccccaacatataaaataatgcaaagaatccctagactttaggctttcagcttacacaaatctatttaattaggaaaaaaactattaaggatgtagcttttcacctttactttagaagcacagtaaatatcccaaactgtgatgaagccgaccttagatttagtagtgtaagctagaagaagtgagtgtttctatgagtggaaaaagccaaggtgtcatttatgtgtcagttcatttgtggtgatatagaattagctttttcatccccttacccttagaatccacgtattccccttcccactagcctaggtcataaagaggcgttgctttcactctcctatgccttttacgagtgctaagtgtaggatattttgtcaccagaacacaatgctaccgccccaaagtaaaagaaaccacttctggtcaatcaacactaccagcgtatatataagaaagacatctttctcttttctaaaagacttccctaacacttaccccatggctgcacagttggtggggtcctgccggagaggaagagacactcagaccagagaaggggtgtgcatgcgcctactcgcttgctagaagtagattctggacagtcagctcttcatctgcccaactgtgtagcatctgcattgcccagtctttcatgtgtgccaaggctgatgcaggatttgttctctgtccagcagtcacttcggccagagctgaagagttgccccgtctctgttccatgtctcctttaagagctctggtgataaggacatgatgcttttactgaactttcttatcctagcacatgcttcaatagttcaaggaacttgaaaaatacttttccttacctttaccccatccctgtctttactcctcacacttactgtaagacattagtaacataataaattaaaagtcacacgaatctcaccaacataa

SEQ ID NO: 1717 - DNA, 2829 bp, Homo sapiens
tcagtggcgctagcggcggacccggctgggcagttccttccccagaaggagagattcctctgccatggagtcctacgatgtgatcgccaaccagcctgtcgtgatcgacaacggatccggtgtgattaaagctggttttgctggtgatcagatccccaaatactgctttccaaactatgtgggccgacccaagcacgttcgtgtcatggcaggagcccttgaaggcgacatcttcattggccccaaagctgaggagcaccgagggctgctttcaatccgctatcccatggagcatggcatcgtcaaggattggaacgacatggaacgcatttggcaatatgtctattctaaggaccagctgcagactttctcagaggagcatcctgtgctcctgactgaggcgcctttaaacccacgaaaaaaccgggaacgagctgccgaagttttcttcgagaccttcaatgtgcccgctcttttcatctccatgcaagctgtactcagcctttacgctacaggcaggaccacaggggtggtgctggattctggggatggagtcacccatgctgtgcccatctatgagggctttgccatgccccactccatcatgcgcatcgacatcgcgggccgggacgtctctcgcttcctgcgcctctacctgcgtaaggagggctacgacttccactcatcctctgagtttgagattgtcaaggccataaaagaaagagcctgttacctatccataaacccccaaaaggatgagacgctagagacagagaaagctcagtactacctgcctgatggcagcaccattgagattggtccttcccgattccgggcccctgagttgctcttcaggccagatttgattggagaggagagtgaaggcatccacgaggtcctggtgttcgccattcagaagtcagacatggacctgcggcgcacgcttttctctaacattgtcctctcaggaggctctaccctgttcaaaggttttggtgacaggctcctgagtgaagtgaagaaactagctccaaaagatgtgaagatcaggatatctgcacctcaggagagactgtattccacgtggattgggggctccatccttgcctccctggacacctttaagaagatgtgggtctccaaaaaggaatatgaggaagacggtgcccgatccatccacagaaaaaccttctaatgtcgggacatcatcttcacctctctctgaagttaactccactttaaaactcgctttcttgagtcggagtgtttgcgaggaactgcctgtgtgtgagtgcgtgtgtggatatgagtgtgtgtgcacatgcgagtgccgtgtggccctgggaccctgggcccagaaaggacgatgaactacctgcagtggtgatggcctgaggcctggggttgaccactaactggctcctgacagggaagagcgctggcagaggctgtgctccctcctcaggtggcctctggctggctgtgggggactccgtttactaccacagggagacagagggaggtaagccatcccccgggagaccttgctgctgaccatcctaggctgggctggccccaccctcacccccacccccagggtgccctgaggccccaggcagctgctgcctccactatcgatgcctcctgactgcacactgaggactgggactggggttgagttctgtctggttttgttgccattttggtttgggaggctggaaaagcaccccaagagctattacagagactggagtcaggagagagcaggaggccctcatgttcaccagggaacaggaccacaccggccactggaggagggcaggagcagtcctcactctgaatggctgcagagttaatgttcccagcccagtcccctttcgggggccttgggagagtttaaggcacctgctggttccaggacctcgctttccatctgttcttgttgcaatgccatcttcaaaccgttttatttattgaagtgtttgttcagttaggggctggagagagggagcttgctgcctcctgccttgctacactaatgtttacagcacctaagcttagcctccagggccccacctctcccagctgatggtgagctgacagtgtccacaggttccaggaccatttgagattggaagctacactcaaagacactcccaccaggctctttctcccttttcctcttgctcactgccctggaatcaacaggctggttgctggttagattttctgaaacaggaggtaaaatttttctttggcagaggcccctaagcaagggaggggtgttggagagccagtgcccttaagactggagaaagctgcaatttaccaagttgccttttgccactgtagctgaccaggggactaggttgtagaggtgggaaggccccctctgggctgatcttgtgccattcttgaccttggacctgcttggttaaggagggagtgggccagaccagagtgccaggagctaatggagccaggcctgactcctaggagtggtccaaaggccttcagcctagatggtgcaaagctggggccagcctgtcttcaccggcaccctcacctgtgacaccaagacccaccccaatcccagacttcacacagtattctcccccacgccgtcctatgaccaaaggcccctgccaggtgtgggccacagcagcaggtatgtgtgaaagcaacgtagcgccccgcggactgcagtgcgcttaaccaactcacctcccttctcttagcccaagcctgtccctcgcacagcctcgcacaaaccacattgcctggtggggcccagtgtactgaaataaagtcgttccgatagacacgtca

SEQ ID NO: 1718 - DNA, 1157 bp, Homo sapiens
ccatcccggcatactttgcgccgtgcacaggcaagccctggtgcgcattggccccttcggccgccgtcggccggtagttactatggaaacccagctgccatcgctatgtctctgcaaaagacccctccgacccgagtgttcgtggaactggttccctgggctgaccggagccgggagaacaacctggcctcagggagagagacgctaccgggcttacgccaccccctctcctcaacacaagcccaaactgctacccgcgaggtgcaagtaagcggcacctcagaagtgtctgcgggccctgaccgggcgcaggtggtggtgcgagtgagcagcaccaaggaggcggcagccgaggccaaaaagagcgtttgtcgccgtctagattacatcacgcagagcctccagcagcagggcgtgcaggcagaaaatataactgtgacaaaggattttaggagagtggaaaatgcttatcacatggaagcagaggtctgcattacatttactgaatttggaaaaatgcaaaatatttgtaactttcttgttgaaaagctagatagctctgttgtcatcagcccaccccagttctatcatactccaggttctgttgagaatcttcgacggcaagcctgtcttgttgctgttgagaatgcgtggcgcaaagctcaagaagtctgtaaccttgttggccaaaccttaggaaaacctttactaatcaaagaagaagaaacaaaagaatgggaaggccaaatagatgatcaccagtcatccagactctcaagttcattaactgtacaacaaaaaatcaaaagtgcaacaatacatgctgcttcaaaagtatttataacttttgaggtaaagggaaaagagaagagaaaaaagcacctttgaaattccaaacaaattatattgtacttgtatctttttacctatttttatactttttataatgtttacgtttgtcctgaatatatatatatatatatatatatatatatatatggtataggagataagctatttctttccaaaatctataaatctttgaatatagtcccacagaatacttatgttcactttctatttttaaaagactactctgaaaaacactcttggataataaatgtattatgtgcatacttatatactgacagttcata

SEQ ID NO: 1719 - DNA, 2344 bp, Homo sapiens
ctccctaagcaggctgaggaagaagagatagcaagccctcacctaacttgacccctttcttgtctctccccgctgctagcttctcccttctcgctgccttgcggggtggggaaacgtggaaggaattctgggaaaaccagatgtctgggttctctattcccgtctggcttgattctggacaaggggcttcctctccagggcctcggtttccccatctttaaaatggactgatagcatagacctgcccacctttcagaggtgcccgaagccttgacgagataacagatgagaagtggttttcgttgtgatgagccagctgaagcggttgcaccggagcgccagaccgtcagcggtgcagtggctctcgcgtccttcacatccccccacacccatcccgtggatgatgggggaaggcactactcctggggttccccgaagcggatcctgggactgggacctggggacgcggtgagaggcagccctgaagctgagtccagaggtctggggcgtcattgtcccagggcggacccagccccagaccctacaactaaacccaaggccagccgagaagcactaccactggcgggctgagctgagctctcattcttcttaggactctggacctttggaggaaatgaaagggacccagttggaaatatagtctttcttcgcgccccctacatctctctcccccggcggaaacgcggcccaaactgttacgaagtggaagaggctggatagctcttcataattaatcaggaatgggaggtttgagcaggtttacttgatgagggaaacattatagcctcgccaattcattcattatttcaacaattacttattgaacacctgctacgtggcagacagtaagagcctggatagtttctccccgtttttcaaagtcgctaaacgcgaccagagggcagaggagaggccggtaacctaagagtcctggctccgccccctccgcgtttggccttgcctgctcctcccaccaccacttcgctcagaggcggctactggctcaagaggacgacagaagccagtctctgatgcccaccgcattctccagcttcaggcctcaagccctgtagccgagaaggcgaggcctaatgttacaccaccggtctgttccgcctccgtttcggggtccacccgaaaagctttcagatcggatcctcggtgagacggcactcgattaaataggtctgtctctacaggccaaggaggcgggtttggtgcggccactccaaggccaaagcgagaaaatcttactgcgcacgcgcaatagacagccgatggagccaccgatggagccgtccggaggggagcaagagcccggagccgtcaggttcctggacctgccctgggaagacgtgctgctcccacacgtcctgaaccgggtcccgctgcgccagctgctccggctgcagcgcgttagccgggccttccggtcgctggtgcagcttcacctggccgggctgcgtcgcttcgatgccgcgcaggtgggtccgcagatcccgcgggccgcattggcccggctgctgcgggatgccgaggggctgcaggagctggcactggcgccgtgtcacgaatggctgtcagacgaggacctggtgccggtgctggcgcggaatccgcagctgcggagtgtggcgttgggcggctgcgggcaactgagtcgccgggcgcttggggctttggccgagggctgcccacgcctgcagcgcctgtcgctcgcgcactgtgactgggtggacgggctggcgctgcgcggcctcgctgatcgctgcccggccctggaggagctggatctcaccgcctgccgccagctcaaggacgaggccatcgtgtacctggcgcagaggcgcggcgctggtctccgcagcctctctctggccgtcaacgccaacgtgggggacgccgcggttcaagagttggctcggaactgcccagaactccaccaccttgacctcaccggctgcctccgcgtcggaagcgacggtgtcaggacattggccgagtactgccccgtgctgcgttcgctgcgggtgcggcactgccaccatgtggcggagtccagcctgagccgcttgcggaagcgcggcgtggacatcgacgtggagccgccgctgcaccaggccctggtgctgctgcaggatatggcgggcttcgcaccttttgtcaacctgcaggtctgacccgcctgccaatcggagcacagctggactgtgtggctggggcctgacactgagctgtagggaaactgaactgtgaggacctctggtgagaggccagtgccctgccccaccctggagcttcaaataaagagctttttaccccc

SEQ ID NO: 1720 - DNA, 3748 bp, Homo sapiens
ttcctgagtcgtgctgcgtcgacaacggtagtgacgcgtattgcctggaggatggcggacgccggcattcgccgcgtggttcccagcgacctgtatcccctcgtgctcggcttcctgcgcgataaccaactctcagaggtggccaataagttcgccaaagcgacaggagctacacagcaggatgccaatgcctcttccctcttagacatctatagcttctggctcaagtctgccaaggtcccagagcgaaagttacaggcaaatggaccagtggctaagaaagctaagaagaaggcctcatccagtgacagtgaggacagcagcgaggaggaggaggaagttcaagggcctccagcaaagaaggctgctgtacctgccaagcgagtcggtctgcctcctgggaaggctgcagccaaagcatcagagagtagcagcagtgaagagtccagtgatgatgatgatgaggaggaccaaaagaaacagcctgtccagaagggagttaagccccaagccaaggcagccaaagctcctcctaagaaggccaagagctctgattctgattctgactcaagctccgaggatgagccaccaaagaaccagaagccaaagataacacctgtgacagttaaagctcagactaaagcccctcccaaaccagctcgagcagcacctaaaatagccaatggtaaagcagccagtagcagcagtagcagcagcagcagcagtagcagtgatgactcagaggaggagaaggcagcagccacccccaagaagactgtacctaaaaagcaagttgtggccaaggccccagtgaaagcagctaccacccctacccggaagagttctagcagtgaggattcctccagtgacgaggaagaggagcaaaaaaaacccatgaaaaataaaccaggtccctacagttcagtccccccgccttctgctcccccaccaaagaagtctctgggaacccagcctcccaagaaggctgtggagaagcagcagcctgtggaaagcagtgaagacagcagtgatgagtctgattcaagttctgaagaagagaagaaacccccaactaaggcagtagtctctaaagcaaccactaaaccacctccagcaaagaaagcagcagagagctcttcagacagctcagactctgacagctctgaggatgatgaagctccttctaagccagctggtaccaccaagaattcttcaaataagccagctgtcaccaccaagtcacctgcagtgaagccagctgcagcccccaagcaacctgtgggcggtggccagaagcttctgacgagaaaggctgacagcagctccagtgaggaagagagcagctccagtgaggaggagaagacaaagaagatggtggccaccactaagcccaaggcgactgccaaagcagctctatctctgcctgccaagcaggctcctcagggtagtagggacagcagctctgattcagacagctccagcagtgaggaggaggaagagaagacatctaagtctgcagttaagaagaagccacagaaggtagcaggaggtgcagccccttccaagccagcctctgcaaagaaaggaaaggctgagagcagcaacagttcttcttctgatgactccagtgaggaagaggaagagaagctcaagggcaagggctctccaagaccacaagcccccaaggccaatggcacctctgcactgactgcccagaatggaaaagcagctaagaacagtgaggaggaggaagaagaaaagaaaaaggcggcagtggtagtttccaaatcaggttcattaaagaagcggaagcagaatgaggctgccaaggaggcagagactcctcaggccaagaagataaagcttcagacccctaacacatttccaaaaaggaagaaaggagaaaaaagggcatcatccccattccgaagggtcagggaggaggaaattgaggtggattcacgagttgcggacaactcctttgatgccaagcgaggtgcagccggagactggggagagcgagccaatcaggttttgaagttcaccaaaggcaagtcctttcggcatgagaaaaccaagaagaagcggggcagctaccggggaggctcaatctctgtccaggtcaattctattaagtttgacagcgagtgacctgaggccatcttcggtgaagcaagggtgatgatcggagactacttactttctccagtggacctgggaaccctcaggtctctaggtgagggtcttgatgaggacagaagtttagagtaggtcctaagactttacagtgtaacatcctctctggtccttttctgtgttcctagttttgtacagacttgtttttgagtgttgagtagcagggacaaaataagggaatgttattttttaagaaaattcattttcattgttgtctccttccttttctgtgaaagtcctcatactgagaaatttgtatattttatattaaatcacttactattgatttttgttgtgattttcaaaggtggattcccacagataaaatcttggctattgcccaaaacatagtaaagggtcacgtgtgactttttataataggaagaaaattctgcctttgtgagtgcacatgtccacatttcatccctccttccctcaaaaccctagagaggggcattaaagaattgttgatgtatatgcaatgtctgttaagcatgcactatgtatttcatcctcatttattgggtctgggactgaagtttttagccagcatggacctaacctactttttgggataaaattctctgttttgttacaggcaaaattctggtatggcgtgaatgccatgggtcattctgaatatatttttttctgtaattttatcattacacgatgtttgcaatacgtgctttgttttttaatttgaaagcaaacttttctactgttgaaagacattttttgacaacttgacccttcctagtattgagttctaagttgaggactgcatcttctcgttttttacagtatagagaacaaaatgacatgagtttgaaaaatacatatcacttggtattgctgtcttggttgcagtggtgatacagaattggtttcattaattcctacatggttgagaatcactgatcaagaaagtggggggaaaaaaaacaaacgttaaaacctcaatcctcagtaggaaggtagattacattaggtgaaattataggtaatctatgtatgtgctaatggggttggaaagaaccttacagagcatattacctgataaactggagtgggtttgggagaacaaactaataggattattgtgtctcctagttggtacctgggagcaattgacatgcccccttcagaaccttaactgttagtagcagtggctgtaacaacacaaaccagtgaccagagataacagcttttaggccaagctggcctgacggtatggctgcaggaagtgactgagcagtagcggtactcagccagaccaagacggagagggaagagtccacagctttctggaagctaaggcattctggtggtagaaaagtgtgccccaagccttcatggacgagttataggtcttaagattagtctcctcttgtttggattccatacttgctaaataacctgataataacctggttttccatgtaactgcctctaggaagaaaatgtactgttcatgctgacacagatatttcagtctgcatggtaaaagttctaaatcttactacaaaataataaactggctggtttataa

SEQ ID NO: 1721 - DNA, 1717 bp, Homo sapiens
tccgcgacgagctttgttttttcggttgggcatgctgcttaccgcaggatgatggaagcgacggcccgtacaaagacagaagcgttggtttcactgagtcagtgctgattctctcaaatagagcttgaaggataaatcttcatttttgtttcaacaaaacttcgaaacaaaatggaagaaaataatctacagtgcagtagtgtggttgacggtaattttgaagaagttcccagggagacggcaattcagtttaaacctccactatacagacagcggtaccagttcgttaaaaatttagtggatcaacatgagcctaagaaggttgcagacctgggatgtggtgatacttcactcttaaggctgctaaaagtcaatccatgcattgaattgcttgttggagtagatattaatgaggataaattacgatggagaggggattcgttagctcctttcctgggggattttctgaaacctcgggatctgaatttgaccatcacattgtatcatggctccgttgtggagagagactctcgtttgcttggatttgacttgataacgtgtattgaattaatagaacatttggattcaggtgatctggccagatttcctgaagtggtatttgggtacctgtctccatccatgattgtcatcagcacaccaaactctgaattcaatcccctgtttccatcagtgaccttaagagattcagatcataaatttgagtggaccagaatggagtttcagacctgggctttatatgtggcaaatcgctatgattactctgtggagtttactggtgtcggggaaccaccagctggagctgagaatgttggatactgtacccagataggaatcttccggaaaaatggaggaaaggcaacagaatcatgtctttcagagcagcatgatcagcatgtttataaagctagacagggtctcactatgttgcccaggctggtcttgaacttccatcctcaagcaatcctcctgccccatcttcctaaaatgctgagattacaggtttttaccacctcatacccaagcttacagcaggaaaggttctttaaacttgtgttggttaatgaggtgtcccaacaagtggaaagcttaagagtgagccacctgccaaggcggaaagaacaggctggggaacggggtgataagcccaaagacattggtggctcaaaggcccctgtcccatgctttggaccagtcttcacagaggttgagaaggccaagatagagaactctcccacacccttctgtgttggagataaatttttcgtacctctgcagagactccttgcgtatcccaagttgaaccgcttatgtgctaatgaagagatgatgagatcagtcattgctgactcaattcctctgagcagtgatggttctgcagtggtggctgacctgcgtaattattttgatgaacagtttgagttttgaaccatgtttatttcctgaaatttcagggtctcagcgatagttgtgctcacttagaatttagttttttttgtgtaatcctaattcaagtaatgtttttaaagtttcactgcaaaagtctatgttccaagccattggacagacctgcttgagatatggccagactgcagtgagccctgagaaagatatgagggtttaaaacgggtgctttcctttgattttggacttttttgttttctcaagaataaagaagttggatgtggtaatatgttaa

SEQ ID NO: 1722 - DNA, 1874 bp, Homo sapiens
gtttttaggcctttgccacgcctcgggagcgccacgaactcaacagccgcccaagccgccttccggctcgcggtctgcggacgcgctcggagttgggggccttcgccaacagctgccgtaccgtgccgcgtcgcagccgcacgctagcggggtcaacggcgcggcaggcgcaggggtcctcgccaaggttcggaagaggaccttgaaaatggcttctgggcatgcgccacagcggccgttacgagacgcaaaaccgacgccttggaactgagagcctagagggacggagctcggcgcaccatgaggctcccggggcccaaggccgaccgtgagagcgcacgagctgagtcagtgctgattctctcaaatagagcttgaaggataaatcttcatttttgtttcaacaaaacttcgaaacaaaatggaagaaaataatctacagtgcagtagtgtggttgacggtaattttgaagaagttcccagggagacggcaattcagtttaaacctccactatacagacagcggtaccagttcgttaaaaatttagtggatcaacatgagcctaagaaggttgcagacctgggatgtggtgatacttcactcttaaggctgctaaaagtcaatccatgcattgaattgcttgttggagtagatattaatgaggataaattacgatggagaggggattcgttagctcctttcctgggggattttctgaaacctcgggatctgaatttgaccatcacattgtatcatggctccgttgtggagagagactctcgtttgcttggatttgacttgataacgtgtattgaattaatagaacatttggattcaggtgatctggccagatttcctgaagtggtatttgggtacctgtctccatccatgattgtcatcagcacaccaaactctgaattcaatcccctgtttccatcagtgaccttaagagattcagatcataaatttgagtggaccagaatggagtttcagacctgggctttatatgtggcaaatcgctatgattactctgtggagtttactggtgtcggggaaccaccagctggagctgagaatgttggatactgtacccagataggaatcttccggaaaaatggaggaaaggcaacagaatcatgtctttcagagcagcatgatcagcatgtttataaagctgtttttaccacctcatacccaagcttacagcaggaaaggttctttaaacttgtgttggttaatgaggtgtcccaacaagtggaaagcttaagagtgagccacctgccaaggcggaaagaacaggctggggaacggggtgataagcccaaagacattggtggctcaaaggcccctgtcccatgctttggaccagtcttcacagaggttgagaaggccaagatagagaactctcccacacccttctgtgttggagataaatttttcgtacctctgcagagactccttgcgtatcccaagttgaaccgcttatgtgctaatgaagagatgatgagatcagtcattgctgactcaattcctctgagcagtgatggttctgcagtggtggctgacctgcgtaattattttgatgaacagtttgagttttgaaccatgtttatttcctgaaatttcagggtctcagcgatagttgtgctcacttagaatttagttttttttgtgtaatcctaattcaagtaatgtttttaaagtttcactgcaaaagtctatgttccaagccattggacagacctgcttgagatatggccagactgcagtgagccctgagaaagatatgagggtttaaaacgggtgctttcctttgattttggacttttttgttttctcaagaataaagaagttggatgtggtaatatgttaa

SEQ ID NO: 1723 - DNA, 1753 bp, Homo sapiens
acaggagcagccgcccggggcaccggagctgcgggctgcgtggccgggatgagcgccagcacgggcggtggtggggacagcggcggcagcggcggcagtagcagcagctcacaggcctcctgcgggcccgagtcctcgggctccgaactagccctggccacaccggtgcctcagatgctgcagggccttctgggctccgacgacgaggaacaggaagaccccaaagactactgcaagggcggctaccaccctgtgaagatcggcgacgtgttcaatgggcggtaccacgtggtgcgcaaactgggctggggccacttctccaccgtctggctctgctgggacatccagcgcaagcgctttgtggccctcaaagtggtgaagagtgcggggcattacacggagacagctgtggatgagatcaagctcctgaaatgtgtccgggacagcgaccccagtgaccccaaaagagagaccattgtccagctcattgatgacttcaggatctcaggagtcaatggagtccatgtgtgcatggtgctggaggtgctgggccaccagctcctcaaatggatcatcaagtccaactaccagggcctgcccgtgccctgcgtgaagagcatcgtgaggcaggtgctgcacggcctggactacctccacaccaagtgcaagatcatccacacggacatcaagcccgagaacatcttgctgtgtgtgggggacgcttacatcaggcgcctggctgccgaggccacggagtggcaacaggcaggggcgccgcccccctcccgctccatagtcagcactgccccccaggaggtcttgaccggtaagctgtccaaaaacaagaggaagaagatgaggcgcaaacggaaacagcagaagcggctgctggaggagcggctgcgggacctgcagaggctggaggccatggaggctgccacccaggctgaggactctggcttgagactagacgggggcagcggctccacatcctcttcaggctgtcaccccgggggcgccagagcaggtccctccccagcctcttcctcccccgccccagggggcggccgtagcctcagcgcgggctcacagacctcaggcttctccggctccctcttctctcctgcctcctgctccatcctctccggctcgtccaatcagcgagagaccgggggcctcctgtcgcctagcacaccattcggtgcctcgaacctcctggtgaaccccctggagccccaaaatgcagataagatcaagatcaagatcgcagacctgggcaacgcctgctgggtgcacaagcacttcacggaagacatccagactcggcagtaccgggccgtcgaggtgctgatcggcgccgaatacggccccccggcagacatctggagcacagcctgcatggccttcgagctggccactggtgactacctgttcgagccgcattctggagaagactacagtcgtgatgaggaccacatcgctcacatagtggagcttctgggggacatccccccagccttcgccctctcaggccgctattcccgggagttcttcaaccggagaggagagctgcggcacatccacaatctcaagcactggggcctgtacgaggtactcatggaaaagtacgagtggcccctagagcaggccacacagttcagcgcctttctgctgcccatgatggagtacatccccgaaaagcgggccagtgccgctgactgcctccagcacccctggctcaacccctaggccc

SEQ ID NO: 1724 - DNA, 538 bp, Homo sapiens
gaactactgggcgggagccaacgtctcttctttctcccgctctggcggaggctttgtcgctgcgggctgggccccagggtgtcccccatggcggggccgcgggtggaggtcgatggcagcatcatggaagggggcggccagatcctgagagtctctacggccttgagctgtctcctaggcctccccttgcgggtgcagaagatccgagccggccggagcacgccaggcctgaggtaaatctggctggagggggagttgggccgtgaagctgggggatcggggggtcgggctgccgggctggggcatcgggagtccgagtggtggaacccagaaggtcccagacgcaggtatgggcgatccagggcggggcactctgcctgggcggtggcctgggttgtaaagtcttgaaagcctggaggggtgagtttagaaatggtctcgagttttctctgtttgactaaatagtgtcatttgctgaagagctagcttttaaaatgttttctcacctcaccgggcattccaaatatccgaacagcac

SEQ ID NO: 1725 - DNA, 2535 bp, Homo sapiens
gctgactccagtgtcccgagaggcgccgcttcttccgctttctcgtcaggctcctgcgccccaggcatgaaccaaggtttctgaactactgggcgggagccaacgtctcttctttctcccgctctggcggaggctttgtcgctgcgggctgggccccagggtgtcccccatggcggggccgcgggtggaggtcgatggcagcatcatggaagggggcggccagatcctgagagtctctacggccttgagctgtctcctaggcctccccttgcgggtgcagaagatccgagccggccggagcacgccaggcctgaggcctcaacatttatctggactggaaatgattcgagatttgtgtgatgggcaactggagggggcagaaattggctcaacagaaataacctttacaccagagaagatcaaaggtggaatccacacagcagataccaagacagcagggagtgtgtgcctcttgatgcaggtctcaatgccgtgtgttctctttgctgcttctccatcagaacttcatttgaaaggtggaactaatgctgaaatggcaccacagatcgattatacagtgatggtcttcaagccaattgttgaaaaatttggtttcatatttaattgtgacattaaaacaaggggatattacccaaaagggggtggtgaagtgattgttcgaatgtcaccagttaaacaattgaaccctataaatttaactgagcgtggctgtgtgactaagatatatggaagagctttcgttgctggtgttttgccatttaaagtagcaaaagatatggcagcggcagcagttagatgcatcagaaaggagatccgggatttgtatgttaacatccagcctgttcaagaacctaaagaccaagcatttggcaatggaaatggaataataattattgctgagacctccactggctgtttgtttgctggatcatcgcttggtaaacgaggtgtaaatgcagacaaagttggaattgaagctgccgaaatgctattagcaaatcttagacatggtggtactgtggatgagtatctgcaagaccagctgattgttttcatggcattagccaatggagtttccagaataaaaacaggaccagttacactccatacgcaaaccgcgatacattttgctgaacaaatagcaaaggctaaatttattgtgaagaaatcagaagatgaagaagacgccgctaaagatacttatattattgaatgccaaggaattgggatgacaaatccaaatctatagagtatttgcctcttaaatgatacctcattgatatattgcactatttcataaatactataaaataatgactaggaagtaacttattaaaggctatgacttaaatttgaagatgaagtacagtgttctaggtttgctgagaaggcttcattaaattaatctcactttgaatatctcctgagagatggacaatgaaatatcagttggtggatatgtgtgatagctgatttcaatattgaagtattgaaataaaatattctttacacctgaagtaaatacatttttcttttttatgtaattaattaaatcagggatatagatttgatctgtaatttgggtataattctaatctttgctgaaatcacatctcaagtataatgaggcaactttatgcaaatgtacttgttgtgacaacaataacattttccttttttttttttttttttgagacagtctcgttctgtcacccaggctggggtgctgtggtgtgatcttggctcactgcaacctctgcctcccgggttcaagcaattctactgcctcagcttcctgagtagttggtattacaccaccatgcccagctaatttttgtatttttagtagagacagggtttcaccatattggtcaggctggtttcgaactcctgacctcgtgatctgcccgcctcggcctcccaaagtggtgggattacaggcgtgagccagtgcacccggcaacaataacatttaataggcattgtctcattctaatgatatataccttctacctagtgggcactttgtacatatttattttttattttatttattcattttttttgagacagagtctcactctgtcaccaagttggagtgcagtggcacaatctcagctcactgcaacctccgccttccaggttgaagtgattctccagcctcagcctcccgagtagctgggactccaggcacgtaccaccatacccagataatttttgcatttttagtagagacggggtttcaccatgttggctaggatggtctccatctcctgacctcgtgatccgcccaccttggcctcccaaagtgctgggattacaggcatgagccaccacagctggtcgtaaatattttttgaatttgaatctgttttggaagccaaatatgttttggaagccaaacaattaagagaagtaaaattttaaccctagtaggtttcgcagattcatccccagatatgtttttgtttggcttgtgttattaacaaataaatgagtgtctttcaaatggaa

SEQ ID NO: 1726 - DNA, 2289 bp, Homo sapiens
cgcttcccgccgcccgagcttcggaaacttcccggccgcgacgcagggaaccggcgcggagaaccgagcagagcggagcgcccgtggtccagcgtgtagggagccgatcgcccatggagggtctgggccgctcgtgcctgtggctgcgtcgggagctgtcgcccccgcggccgcggctcctgctcctggactgccgcagccgcgagctgtacgagtcggcgcgcatcggtggggcgctgagcgtggccctgccggcgctcctgctgcgccgcctgcggaggggcagcctgtcggtgcgcgcgctcctgcctgggccgccgctgcagccgcccccgcctgcccccgtgctcctgtacgaccagggcgggggccggcgccggcgcggggaggccgaggccgaggccgaggagtgggaggccgagtcggtgctgggcaccctgctgcagaagctgcgagaggaaggctacctggcctactacctccagggaggcttcagcagattccaggccgagtgccctcacctgtgtgagaccagccttgctggccgtgccggctccagcatggcgccggtgcccggtccagtgcccgtggtggggttgggcagcctgtgcctgggctccgactgctctgatgcggaatccgaggctgaccgcgactccatgagctgtggcctggattcggagggtgccacacccccaccagtggggctgcgggcatccttccctgtccagatcctgcccaacctctatctgggcagtgcccgggattccgccaatttggagagcctggccaaactgggcatccgctacatcctcaatgtcacccccaacctcccaaacttcttcgagaagaatggtgactttcactacaagcagatccccatctccgaccactggagccagaacctgtcgcggttctttccggaggccattgagttcattgatgaggccttgtcccagaactgcggggtgctcgtccactgcttggcgggggtcagccgttctgtcaccgtcactgtggcctacctcatgcagaagctccacctctctctcaacgatgcctatgacctggtcaagaggaagaagtctaacatctcccccaacttcaacttcatggggcagttgctggactttgagcgcagcttgcggctggaggagcgccactcgcaggagcagggcagtggggggcaggcatctgcggcctccaacccgccctccttcttcaccacccccaccagtgatggcgccttcgagctggcccccacctagggccccgtggccggcaggccggcccctgccccacccccacccacgggtgtccctgcccactcgtgtggcaagggaggggagggcaggagggctcggcctgagcagggtgctggggggagagcgcaatacctcacgcgggctgccgtcctaatcaacgtgcctatggcgggaccacgctcggagcctgcctcttctgcgactgttactttttctttgcgggatgggggtgggggttccctctccaggtggttgtccaggcccatgtcccggccctgggtgctcagccagctcggctaggccctgcgcctccctgcgcttcccccttcaggaagggtgtgtgccacctcgttgcactggatcccagtggctgcttgggggagaggcgtttgccatcactggtgttgtcacctccctgtttctccaccaagggcttgggcctctcggggctggggcctcccaggggatggggacccagagtgcagtggccgcccacatccatggcctaggagctactgggcaggttcccggccacacatctggtgggctgttttgttttttttttttcctcttcccccagatgtcttgacgggatcactggggctctttgtgagtgagggtggccaaactaccgccggaggagatggggtctcagagcgagagctgcggagggggaggggaagaagaaggcctcacttttgctgctgcggggcccacacagccgctgctactttggggggtggggaaggggccaagctgcagacacacacagtcattcatttctgtccacacccctgtgggtggcgggtgtgcgtgtgtgtgcttgtgtgtgcgcacgtgtcggcgctcacacacacatgctagcccactgatgcacccagcccagggctggcagtctttgcagcgtggggccgtctcaccctggagcctggagaggatctatgcttgtttgtttttgtaatccatatcatagttgctttctttaattgttccttctgaataaacagtttatttaagatactga

SEQ ID NO: 1727 - DNA, 1235 bp, Homo sapiens
agtgctgctcctggccggtggaggcggcggctgcggcagcggaaggggaagcgctgaggcggtggggcccacagccatggcggagcctgtgcaggaggagctctcggtcctggccgcgattttctgcaggccccacgagtgggaggtgctgagccgctcagagacagatgggaccgtgttcagaattcacacaaaagctgaaggatttatggatgtggatatacctctggaattggtgttccatttgccagtcaattatccttcatgtctacctggtatctcgattaactctgaacagttgaccagggcccagtgtgtgactgtgaaagagaatttacttgagcaagcagagagccttttgtcggagcctatggttcatgagctggttctctggattcagcagaatctcaggcatatcctcagccaaccagaaactggcagtggcagtgaaaagtgtactttttcaacaagcacgaccatggatgatggattgtggataactcttttgcatttagatcacatgagagcaaagactaaatatgtcaaaattgtggagaagtgggcttcagatttaaggctgacaggaagactgatgttcatgggtaaaataatactgattttactacagggagacagaaacaacctcaaggagtacttgattcttcagaaaacctccaaagtagatgtggactcaagtggaaagaaatgcaaagagaaaatgattagtgtactgtttgaaacaaaagtacagacagaacacaaaaggtttctggcatttgaagtcaaagagtattcagcgttggatgaattacaaaaggaatttgaaactgcaggacttaagaagcttttctccgaatttgtacttgctctggtaaaatgaaatggaagacaggaatcttttagtaaaatagcagtgttttttgttgtttttgcattggatttggggagtggttaattgaaatagtcaattttaaagtttctctgaagcaaaatgataggcatcattctaacttcaggaacaaaagccagttctgttttatgaaatattaaacatgaagaaaacttgtatattctaatgtttgccaggaaaggctaggttcagtagatgagacattatttaaaagataaatttaaaaagatggtaaatgaacacttgtttttatagacaatatttgtttgaaactatgtaattttctggctaattttcttgtaattaaatgattttttaaaaaaga

SEQ ID NO: 1728 - DNA, 5741 bp, Homo sapiens
gcggccgccgccgcgccgtggccctttgtgctggaacaatgaccagctgccgctggccccggggccccggctggggttgagggtgaccaccgccgccgccgcgtcgagccgaaccgagcccccagacacgcagtcacagggcgtcggagggagggctcccgactgccgccgagcagcccctacgtgcgccccggcggattcgcgtgacgcgggtgcttgcgcgtgtccgcgccccggggcggagacgcccctcggaccctcccctgcgcggtgccgcccactcgcaccgggcgggggctggccagggccgggggcgccgcggaggcggaggcggggctgggccgggcagctccgagtggcggcgcgcgggccagggccggggccggggccggggccggagccggagccggggccgggcggcgcgcctgtggagcgctgggggcggcctggggctgagcatggagcagcgcggcggaggtgaggggggccgggtctgggaggcggcctggggagcccccaacttatgcgcggtggaatccagccggggggacggcgttccccagtcgcccccactttctggaaggggggctggactctggagaatgggtcaggggctcctggcttcccgccgcagaatgggaactcgtgatcgcagacttgaccccgcttgactggtccttggagtttgggtgggagggagactttccccaactcttcagatccgtctccggccctgaaccagctccagccctctgctctcctcagcccactaaaaggggggtgctcctgggccagagtgattgctcagggagtgctggggagaatgaggggttcccatctcccacagccacaaacgcatttctcaaaatggagcctccacttgcccctccttctctttcgggctccaagagcgggagccggcctggctgggcctggctttccagactcctggctctggctccctggatgtgtggctctcagggcccggctctgtggcactttggacttatgggccctcggctccgtggggttggggggccctggctcactgggtcccgctggctgtccccttgtcggcctgaccctcgggcctctccgagtctttgtctcttttgggtccctgtctttctctgagcctgtctccttccttcaattttcactttctccgtgctcgctgaagtggggaaatgcaacagaggtgccagcccccttggccccctaagaagtcccttccccactgttcactccacaccctggagtgggcccagagaggggaggggagggggttctctatctgctctgctgggggctggggtgtgtggggtggtctgagccccagccctacagaggggcctgtggtcactccctgctcctggcctacccctcccccagctccccgcagctcctgccccagcgtggacacctcttcctggttcgcagtgtcttttgacttgggtgggaaggagggcggtggatttaatggagggcatgcgagaaagaaggggaacagatcaggcaaaggagttagataatgtcccacctctccccacacgccgaagagagaaggaaacaggctccccccaccaatgggccctcaagccacccaggctcccaccactctcatacctgcgtgcccacgttcacaggctccactgcaccactcaccttcctagtcacacacaaacacaggagctcacacataaactcatgaacttactgacaagtctgtccaggcaccgtctctcccacacaccacaaattcacttgttagatccacatttataactttcacaggctttctaatgacccctgatccacatactcttctaagatatacacatgtgaattcacacatgaactcatatgtatgtgaatgaactgatatatcaaacatgcatagactcacatgatgttttcacacacattttcatacacacgtgttcattttcatgctcctgtgcatgtagtcacacaacaaataactaaatgcacacactcctactcccagtgcaattctctgtccacttcttggccccgctctgcatgatgacttcagcagatgcctaagtcctggtcatcagcggcctcgggactgggactagggagggggttccgggtggaggcttgcagctgcttccaggaaggagcagagcctggggaggtggagccctcttgcctgggctctgtggaagtgaggttttggagcagcctccagaggtgaaggcagggcatctaccttcctcccctcagggttagtttggggaccttctgaagctgtagggtttcagagaggttggcagtggggcagagcctgtggaggctccttcaggccttcaggcctcaccgattgggtgtgcagaggctaggagttgtcatggaaactggtatgagcctgcatccacctctgggaggcaggagaccccaaaggacacctgtggactccctaagagccgcgggtttcttatttagccagatcgacagagaggcagtttagccgcctttctgtctgagagaaactgaggcccagcagagggaggcagggcactgcctggccttggctctttgttccctaattaccatctgaggtgctgattgcacccctgaggtacctctgcccaaactgccctgtaatgaggccacctggctgagaggaccagggacctgtgcttcaagctggtagagaaggcccctccctcacctgagtcctggcctctgtggaggatgcaggattgggcttgggcctgggtctttgctgccaggtggccctgcggtaatcatccaggcctcccatgcctctcagcatctctgctgagtgaattcactcctcagccctgttcagaccagcattgggcagtgtggtttggggcccagggggaattgagattcattccagcacttgaagggggagtcttggtggggatcagggcttgttactgatgtcaaggaggtgtttggtcaggatcagtgggtcaggaggggtctcaaggtggagggactctgacaccactgccctgcttacaggtcgcctgcgaggccgctggccaggcctgagcctctgccaccatggccattgtgcagactctgccagtgccactggagcctgctcctgaagctgccactgccccacaagctccagtcatgggtagtgtgagcagccttatctcaggccggccctgtcccggggggccagctcctccccgccaccacggccctcctgggcccaccttcttccgccagcaggatggcctgctacggggtggctatgaggcacaggagccgctgtgcccagctgtgccccctaggaaggctgtccctgtcaccagcttcacctacatcaatgaggacttccggacagagtcaccccccagcccaagcagtgatgttgaggatgcccgagagcagcgggcacacaatgcccacctccgcggcccaccaccaaagctcatccctgtctctggaaagctggagaagaacatggagaagatcctgatccgcccaacagccttcaagccagtgctgcccaaacctcgaggggctccgtccctgcctagcttcatgggtcctcgggccaccgggctgtctgggagccagggcagcctgacgcagctgtttgggggccctgcctcctcctcctcctcttcctcctcctcttcagctgctgacaaacccctggcatttagtggctgggccagtggctgcccatcagggacgctatccgactctggccgaaactcactgtccagcctgcccacctacagcaccggaggtgccgagccaaccaccagctccccaggcgggcacctgccttcccatggctctgggcgaggggcactgcctgggccagcccgaggggtccctactgggccctcccactcagacagtggccggtcctcctccagcaagagcacaggctccctagggggccgtgtggctggggggcttttgggcagtggtactcgggcctcccctgacagcagctcctgtggggagcgctcaccaccacccccgcctccacctccttcggatgaggccctgctgcactgtgtcctggaaggaaagctccgagaccgggaggcagagcttcagcagctgcgggacagtctggacgagaatgaggctaccatgtgccaggcatacgaggagcggcagcggcactggcagcgagagcgtgaggccctgcgagaggactgtgcggcccaggcacagcgggcacagcgggcccaacagctgctgcagctgcaggtgttccagctgcagcaggagaagcggcaattgcaggacgacttcgcacagctgctgcaggagcgcgaacagctggagcggcgctgcgccaccttggagcgggagcagcgggagctcgggccgaggcttgaggagaccaagtgggaggtgtgccagaaatcaggcgagatctccctgctgaagcagcagctgaaagagtctcaggcagagctggtgcagaagggcagcgagctggtggctctgcgggtggcgctgcgggaggcccgtgctacgctgcgggtcagtgagggccgtgcgcggggtctacaggaggccgcccgagctcgggagctggagctggaagcctgttcccaggagctgcagcgacaccgccaggaagctgagcagctgcgggagaaagctgggcagttggatgctgaggcggccggactccgggagccccctgtgccacctgccaccgctgacccattcctcctggcagagagtgatgaggccaaagtgcagcgggcagcagccggggttgggggcagcttgcgggcccaggtggagcgattgcgggtggagctgcagcgggagcggcggcggggtgaggagcagcgggacagctttgagggggagcggctggcctggcaggcagagaaggagcaggtgatccgctaccagaagcagctgcagcacaactacatccagatgtaccggcgcaaccggcagctagagcaggagctgcagcagctcagcctggagctggaggcccgggagctcgctgacctgggcctggccgagcaggccccctgcatctgcctggaggagatcactgctactgagatctagggccctcagcaaccagctctgtagggagctctgccagaggggcagcagctgcagatccacttaggccccagggtccacggatggccccaaaggctgagggccccaaagccacttgtctcctaggatccaggcctctgggcttctgccaagaactcagggtggccctatgacttggaggagcaagatcagaccgctcaaaggtccccgtgttcactgttacccagaggctcttgttactacccacttcattccccaccgctgccagtgccactgccaaccctgttcacaggcgcttccagcccactccagccaggggagcagggaagaagaaggggctccctcctcttcacattccccccgaccccaaagccagagaaagccagatggcaccagctgctccggatgtgcctgcccacattgggggacagggccgggcctgggctcggttcccaggtttgagctctgcagcctctctcctggagtgagggggctgaagtcagaccaaaggaagaactcagaaatgtcttgtttatttgtgtttgtgaccaagcagcctctcccttcacccaggtttatggcctcgttttcacttgtatatttttcacactgtaaatttcttgtacaaacccaaagaaaaaattaaaaaaaatttttttgtttaaaaataa

SEQ ID NO: 1729 - DNA, 2883 bp, Homo sapiens
ccaggtcgggccaggcgggcgccgggagctgggagccgggagcccagagttcggaacctagagttcggagccggctagggagccggcgttgtcgcggcgaggaggtgggcgcgctggagcaggagcggggccggaactggagccgaggcgcaggtggcgctgggtcgcctgcgaggccgctggccaggcctgagcctctgccaccatggccattgtgcagactctgccagtgccactggagcctgctcctgaagctgccactgccccacaagctccagtcatgggtagtgtgagcagccttatctcaggccggccctgtcccggggggccagctcctccccgccaccacggccctcctgggcccaccttcttccgccagcaggatggcctgctacggggtggctatgaggcacaggagccgctgtgcccagctgtgccccctaggaaggctgtccctgtcaccagcttcacctacatcaatgaggacttccggacagagtcaccccccagcccaagcagtgatgttgaggatgcccgagagcagcgggcacacaatgcccacctccgcggcccaccaccaaagctcatccctgtctctggaaagctggagaagaacatggagaagatcctgatccgcccaacagccttcaagccagtgctgcccaaacctcgaggggctccgtccctgcctagcttcatgggtcctcgggccaccgggctgtctgggagccagggcagcctgacgcagctgtttgggggccctgcctcctcctcctcctcttcctcctcctcttcagctgctgacaaacccctggcatttagtggctgggccagtggctgcccatcagggacgctatccgactctggccgaaactcactgtccagcctgcccacctacagcaccggaggtgccgagccaaccaccagctccccaggcgggcacctgccttcccatggctctgggcgaggggcactgcctgggccagcccgaggggtccctactgggccctcccactcagacagtggccggtcctcctccagcaagagcacaggctccctagggggccgtgtggctggggggcttttgggcagtggtactcgggcctcccctgacagcagctcctgtggggagcgctcaccaccacccccgcctccacctccttcggatgaggccctgctgcactgtgtcctggaaggaaagctccgagaccgggaggcagagcttcagcagctgcgggacagtctggacgagaatgaggctaccatgtgccaggcatacgaggagcggcagcggcactggcagcgagagcgtgaggccctgcgagaggactgtgcggcccaggcacagcgggcacagcgggcccaacagctgctgcagctgcaggtgttccagctgcagcaggagaagcggcaattgcaggacgacttcgcacagctgctgcaggagcgcgaacagctggagcggcgctgcgccaccttggagcgggagcagcgggagctcgggccgaggcttgaggagaccaagtgggaggtgtgccagaaatcaggcgagatctccctgctgaagcagcagctgaaagagtctcaggcagagctggtgcagaagggcagcgagctggtggctctgcgggtggcgctgcgggaggcccgtgctacgctgcgggtcagtgagggccgtgcgcggggtctacaggaggccgcccgagctcgggagctggagctggaagcctgttcccaggagctgcagcgacaccgccaggaagctgagcagctgcgggagaaagctgggcagttggatgctgaggcggccggactccgggagccccctgtgccacctgccaccgctgacccattcctcctggcagagagtgatgaggccaaagtgcagcgggcagcagccggggttgggggcagcttgcgggcccaggtggagcgattgcgggtggagctgcagcgggagcggcggcggggtgaggagcagcgggacagctttgagggggagcggctggcctggcaggcagagaaggagcaggtgatccgctaccagaagcagctgcagcacaactacatccagatgtaccggcgcaaccggcagctagagcaggagctgcagcagctcagcctggagctggaggcccgggagctcgctgacctgggcctggccgagcaggccccctgcatctgcctggaggagatcactgctactgagatctagggccctcagcaaccagctctgtagggagctctgccagaggggcagcagctgcagatccacttaggccccagggtccacggatggccccaaaggctgagggccccaaagccacttgtctcctaggatccaggcctctgggcttctgccaagaactcagggtggccctatgacttggaggagcaagatcagaccgctcaaaggtccccgtgttcactgttacccagaggctcttgttactacccacttcattccccaccgctgccagtgccactgccaaccctgttcacaggcgcttccagcccactccagccaggggagcagggaagaagaaggggctccctcctcttcacattccccccgaccccaaagccagagaaagccagatggcaccagctgctccggatgtgcctgcccacattgggggacagggccgggcctgggctcggttcccaggtttgagctctgcagcctctctcctggagtgagggggctgaagtcagaccaaaggaagaactcagaaatgtcttgtttatttgtgtttgtgaccaagcagcctctcccttcacccaggtttatggcctcgttttcacttgtatatttttcacactgtaaatttcttgtacaaacccaaagaaaaaattaaaaaaaatttttttgtttaaaaataa

SEQ ID NO: 1730 - DNA, 1375 bp, Homo sapiens
agtgtctcgggctcggcgcccgcggagcgtgtttccgacggtgccctgccggggtccgcgccgctttggtcctccgcagccgccgtccacagcgcccggctccgcgcgagagccctgccagaggagcggctccggccgccgcgcctgacccttgtccggggtcttccgcacagtgggctgagggccatgtcagttttctgccacctacaggatagaccatgaagctgaaggaacttgagcggccagctgtccaggcatggagcccagccagccaataccctttgtatctggccacaggaacatctgcccaacagctagattcctccttcagcacaaatggcacattggaaatatttgaggttgatttcagggacccttctctggacttgaaacacagaggagtcctttctgccttgagcaggtttcacaagctggtctgggggagctttggcagtgggcttctggaaagctccggggttattgttggcggcggggacaatggcatgcttattctatacaatgtgacccacatcctgtcttcggggaaggagcctgtgattgctcagaaacagaagcacacgggggctgtcagagccctcgacttgaatcctttccagggcaacctcctggcttcaggggccagcgattctgaaatcttcatttgggatctgaataacttgaatgtgccaatgaccctgggatccaagtcacagtatcatgagcagcctccagaggacatcaaggcactgtcttggaaccggcaagcccaacacattctgtcttctgctcaccccagtggcaaggcagttgtgtgggatctcaggaagaatgaacctatcatcaaagtcagtgatcacagcaacaggatgcactgctcaggcctggcctggcatcctgacatagccacccagttagtgctgtgctcagaggatgatcgacttcccgtgattcagctgtgggacttgcgctttgcctcctcgcccttgaaggtgctggagagccacagcagggggatcttgtcagtgtcatggagccaggctgatgctgagctgctgctcactagtgctaaggacagccagatcttgtgccggaacctggggagcagtgaggtggtatataagctaccaacacagagcagctggtgctttgatgtgcagtggtgccctcgggacccttcagtgttctctgctgcctccttcaacggctggatcagtttgtactctgtgatgggtaggagctgggaagtccagcatatgagacaggctgacaaggtttgaagggcttggtagagaatgctggagggaaggggctgtctctgtttgtgggagagagacatatggcttgagaagcggagatattggagattgggagacca

SEQ ID NO: 1731 - DNA, 4612 bp, Homo sapiens
gaggagcggctccggccgccgcgcctgacccttgtccggggtcttccgcacagtgggctgagggccatgtcagttttctgccacctacaggatagaccatgaagctgaaggaacttgagcggccagctgtccaggcatggagcccagccagccaataccctttgtatctggccacaggaacatctgcccaacagctagattcctccttcagcacaaatggcacattggaaatatttgaggttgatttcagggacccttctctggacttgaaacacagaggagtcctttctgccttgagcaggtttcacaagctggtctgggggagctttggcagtgggcttctggaaagctccggggttattgttggcggcggggacaatggcatgcttattctatacaatgtgacccacatcctgtcttcggggaaggagcctgtgattgctcagaaacagaagcacacgggggctgtcagagccctcgacttgaatcctttccagggcaacctcctggcttcaggggccagcgattctgaaatcttcatttgggatctgaataacttgaatgtgccaatgaccctgggatccaagtcacagcagcctccagaggacatcaaggcactgtcttggaaccggcaagcccaacacattctgtcttctgctcaccccagtggcaaggcagttgtgtgggatctcaggaagaatgaacctatcatcaaagtcagtgatcacagcaacaggatgcactgctcaggcctggcctggcatcctgacatagccacccagttagtgctgtgctcagaggatgatcgacttcccgtgattcagctgtgggacttgcgctttgcctcctcgcccttgaaggtgctggagagccacagcagggggatcttgtcagtgtcatggagccaggctgatgctgagctgctgctcactagtgctaaggacagccagatcttgtgccggaacctggggagcagtgaggtggtatataagctaccaacacagagcagctggtgctttgatgtgcagtggtgccctcgggacccttcagtgttctctgctgcctccttcaacggctggatcagtttgtactctgtgatgggtaggagctgggaagtccagcatatgagacaggctgacaagatctcctcttccttcagcaaaggccagcctctcccaccactgcaggtgccagagcaagtggcacaagcaccactgatacctcccctgaaaaaaccccccaaatggattagaagaccaacaggtgtttcatttgcttttggagggaagctggttacttttggcctccccagcacccctgcccatctggtgccacagccttgcccccgcctagtcttcatcagtcaagtcaccacagaatctgaattcctgatgcgatcagctgagctgcaggaggccttgggatcaggaaatctactgaattactgtcagaacaagagccagcaagctttactgcaaagtgaaaagatgctgtggcagttcctgaaggtgaccttagagcaagactccagaatgaaattcctaaagcttttaggatacagtaaagatgagcttcagaagaaggtggccacatggttgaagagtgacgtggggctaggtgagagtcctcagcccaagggaaatgacctcaacagtgacagacaacaggccttctgcagccaggcctccaaacacaccacaaaggaagcctctgcttcctcagccttctttgatgagctggtccctcagaacatgactccttgggagatccccatcacaaaagatattgatggactcctaagccaggctctcctgcttggggaactgggtccggccgtggagctgtgtctgaaggaggagcgctttgctgatgccattatcctggcccaggctgggggtacagatctgctgaagcaaacacaggagcgctacttggccaagaagaaaaccaaaatctcctcgcttctagcctgtgttgtgcaaaagaattggaaggatgtggtgtgtacctgtagcctgaagaactggagagaggcactggctttgctactgacatactcaggcacagagaaatttcccgagctctgtgacatgctgggaactcgcatggaacaggagggcagcagggcactaacctccgaagccagactctgttatgtgtgctcagggagtgtggagcggctggtggagtgctgggcaaaatgccaccaggctttgtcccccatggctctgcaggacctgatggagaaggtgatggttcttaacaggagcttggagcaactgcggggtcctcatggggtgagcccaggccctgccacaacctacagggtcactcagtatgccaacctcctggcagcccagggcagcctggccactgccatgagctttctacccagggactgtgctcagccaccagttcagcagctaagagatcggctttttcatgctcaaggttctgctgtcttgggccaacagtctccccctttccccttcccccggattgttgtgggagctaccctccactctaaagagacatcatcttacagattgggatcccagccttctcaccaggtcccaactccatctccaaggccaagggttttcacccctcagtcatcaccagcgatgcccttggcaccttcccatcctagcccttatcagggtcccaggacacagaatataagtgactacagggcacctgggccccaggccatccagcctttgcctttgagccctggggtaaggcctgcttcatctcagccacagctattaggagggcaaagggtgcaagttcctaacccggtgggattccctgggacatggcctcttcctggttcccctctacccatggcatgcccaggcatcatgcgacctggctctacctccctgcctgagactcctagactgttccctctgcttcctctgagaccactaggtcccggccgcatggtctcccacaccccagcccctcctgcaagcttccctgtgccataccttccaggggacccaggtgccccatgctctagtgtcctcccaaccactggcatcttgactcctcacccaggacctcaagattcctggaaagaagccccagcccccaggggaaacctccagaggaacaagctgccagagacatttatgcccccagcaccaattactgctccagttatgagcctcacccctgagctacaagggattcttccctcacagccccctgtctccagtgtgagtcatgctcccccaggagttccaggagaactcagcctgcagcttcagcacctgccacctgagaagatggaaaggaaggagctgcccccagagcatcagtccttgaagagcagctttgaggcgcttctccaacgctgctccctgtctgcaactgacttaaagacaaaaaggaagctggaagaggcagcccagcgtctggagtatctatatgagaagctctgtgaggggacactctcacctcatgtcgtggctgggctccatgaggttgcccgatgtgtggatgcaggaagctttgagcagggccttgcagtgcatgcccaggtggcgggctgtagcagcttcagcgaggtgtccagcttcatgcctatcctgaaggctgtcctcatcatcgctcataagctgctggtctaaaccaggcagcctctcttgctaggaggccacttctgctgttacataactcctccctgcagaagaggggacttctgcaacagattctgtttctttttcccgactcttttccttgctgccaggtatgtgatgctgtaggcttggctccaaaccagctgagtgcctgctttttactcctttatgtctggccttctaggatctgtccaagacactctcaggcctggaggcagggcatagaatcagttcttcactctccctaatactacactctgtaaggacctggggcaggatatcttctcccccagggatcttctatttaagtggcttctgagagggtgaacaggattgttacttttaagcctacctctgctgtgacccatcatgtgggtcttttgtttctcccttctgtggtttatgagcctgcccttaccttttccctgcctctgacttggtatttccaggtccgtatttctctgtagcccagggtctggggtagagctgactgctgttcaccctttgaacaactcatggacgtgagggatgggtgctgagcagaaccaagagaggaaactttggcgctgttaaaatggaatttctcatctgccggcattattaagggtgggctaggttggatggaaggtgaaagggatgaactgccttttgctggaagctgtcttaggctgtgagacaggagcaggggaaccacagcctatggggaactgcccttgactccacctatgttggagccttagcccaaggccattccttctgtgatgataaagcccagttctggaattggagccatattaaggaatgattctcttccagcgctgctcctcaagggttgggggtccttctccctcgcagccaccacatgtctcagggctaccttctccgattggatttgcatttgtggcactgtctttgatgcagtgatgtacttaatggtgcaataaagctgcttcgatttggtttcc

SEQ ID NO: 1732 - DNA, 2383 bp, Homo sapiens
gagcttactccacgggaacagcctctagataatctgagttgttgaaaatacgaagcctgttactcgtgaacagtggctgacaacagtgttgttgtgagcctggctgtctgcttggacccagaggtttcgtctgccagggtttttggttgtatttaggatttcagggaaaagtgtccaagctttcagtgttggagcaggtatggacgacaaaggcgacccgagcaatgaggaggcacctaaggccatcaaacccaccagcaaagagttcaggaaaacatggggttttcgaaggaccactatcgccaagcgagagggcgcaggggacgcggaggctgacccactggagccgccacccccacagcagcagctgggcctgtccctgcggcgcagtgggaggcagcccaagcgcactgagcgcgtggagcagttcctgaccattgcgcggcgccgcggcaggaggagcatgcctgtctccctggaggattctggtgagcccacgtcctgccccgccacagacgccgagacagcctccgagggcagcgtggaaagcgcttctgagaccagaagcggcccccagtctgcttccacagctgtgaaggaacgaccagcctcttctgaaaaggtgaaaggaggggatgaccacgatgacacctccgatagtgacagcgatggcctgaccttgaaagagcttcagaatcgccttcgcaggaagcgggaacaggagcccactgagaggcccctgaaagggatccagagtcgcctgcggaagaagcgccgggaggagggtcccgccgagactgtgggctccgaggccagtgacactgtggagggcgtcctgcccagtaagcaggagcccgagaacgatcagggggttgtgtcccaggctgggaaagatgacagagagagtaagttggagggaaaggcggctcaggacatcaaagatgaggagcctggagacttgggccgaccgaagcctgaatgtgagggttacgaccccaacgccctgtattgcatttgccgccagcctcacaacaacaggtttatgatttgctgtgaccgctgtgaagaatggtttcatggcgattgtgtgggcatttctgaggctcgagggaggcttttggaaaggaatggggaagactatatctgcccaaactgcaccattctgcaagtgcaggatgagactcattcagaaacggcagatcagcaggaagctaaatggagacctggagatgctgatggcaccgattgtacaagtataggaacaatagagcagaagtctagcgaagaccaagggataaagggtagaattgagaaagctgcaaatccaagtggcaagaagaaactcaagatcttccagcctgtgatagaggcgcctggtgcctcaaaatgtattggccccgggtgctgtcacgtggcgcagcccgactcggtgtactgcagtaatgactgtatcctcaaacacgccgcagcgacaatgaagtttctaagctcaggtaaagaacagaagccaaagcctaaagaaaagatgaagatgaagccagagaagcccagtcttccgaaatgcggtgctcaggcaggtattaaaatctcttctgtgcacaagagaccagctccagaaaaaaaagagaccacagtgaagaaggcagtggtggtccctgcgcggagtgaagcactcgggaaggaagcagcttgtgagagcagcacgccgtcgtgggcgagcgatcacaattacaatgcagtaaagccagaaaagactgctgctccctcgccgtcactgttgtataaatgctctggtaagtattcgtattctcttcatcccagtctgattgcatagccacactgcccggcacgccacatccacccctgtctgcacatgagttgttctgacaacagcgctgtatacgcttcagtttttccacattgtccacggccagcacatgaaagcatcacttcttttttatgttgtgggaatctttgcaagttagtgttgcatctgattttcaggtgtacatttatttttgactgggcagataggggatttttttttttccatgtccgattcacacgctacacacccacatgaacacattcgaacttcgaaggccacacactcctgcttcataggccccacggtaagtgagttcacacctagaacactgtcctgaccgcaggacgcgtgccttggacttggtattctacatgtgactggctttcttgccctcgtctcttgaatgtttagactcttaagatcatatcctgccccaaatttcaaattaatgaaatgaagatatttcaaacagatctttgaaacctcagattctgtggtgcaattttaatgttttcttgtttctcagttttctgctataaaactattttcaattca

SEQ ID NO: 1733 - DNA, 2704 bp, Homo sapiens
ggggaaatggctgcgagaccctagaggcctgcggagcttactccacgggaacagcctctagataatctgagttgttgaaaatacgaagcctgttactcgtgaacagtggctgacaacagtgttgttgtgagcctggctgtctgcttggacccagaggtttcgtctgccagggtttttggttgtatttaggatttcagggaaaagtgtccaagctttcagtgttggagcaggtatggacgacaaaggcgacccgagcaatgaggaggcacctaaggccatcaaacccaccagcaaagagttcaggaaaacatggggttttcgaaggaccactatcgccaagcgagagggcgcaggggacgcggaggctgacccactggagccgccacccccacagcagcagctgggcctgtccctgcggcgcagtgggaggcagcccaagcgcactgagcgcgtggagcagttcctgaccattgcgcggcgccgcggcaggaggagcatgcctgtctccctggaggattctggtgagcccacgtcctgccccgccacagacgccgagacagcctccgagggcagcgtggaaagcgcttctgagaccagaagcggcccccagtctgcttccacagctgtgaaggaacgaccagcctcttctgaaaaggtgaaaggaggggatgaccacgatgacacctccgatagtgacagcgatggcctgaccttgaaagagcttcagaatcgccttcgcaggaagcgggaacaggagcccactgagaggcccctgaaagggatccagagtcgcctgcggaagaagcgccgggaggagggtcccgccgagactgtgggctccgaggccagtgacactgtggagggcgtcctgcccagtaagcaggagcccgagaacgatcagggggttgtgtcccaggctgggaaagatgacagagagagtaagttggagggaaaggcggctcaggacatcaaagatgaggagcctggagacttgggccgaccgaagcctgaatgtgagggttacgaccccaacgccctgtattgcatttgccgccagcctcacaacaacaggtttatgatttgctgtgaccgctgtgaagaatggtttcatggcgattgtgtgggcatttctgaggctcgagggaggcttttggaaaggaatggggaagactatatctgcccaaactgcaccattctgcaagtgcaggatgagactcattcagaaacggcagatcagcaggaagctaaatggagacctggagatgctgatggcaccgattgtacaagtataggaacaatagagcagaagtctagcgaagaccaagggataaagggtagaattgagaaagctgcaaatccaagtggcaagaagaaactcaagatcttccagcctgtgatagaggcgcctggtgcctcaaaatgtattggccccgggtgctgtcacgtggcgcagcccgactcggtgtactgcagtaatgactgtatcctcaaacacgccgcagcgacaatgaagtttctaagctcaggtaaagaacagaagccaaagcctaaagaaaagatgaagatgaagccagagaagcccagtcttccgaaatgcggtgctcaggcaggtattaaaatctcttctgtgcacaagagaccagctccagaaaaaaaagagaccacagtgaagaaggcagtggtggtccctgcgcggagtgaagcactcgggaaggaagcagcttgtgagagcagcacgccgtcgtgggcgagcgatcacaattacaatgcagtaaagccagaaaagactgctgctccctcgccgtcactgttgtataaatgtatgtatcacctaggggttggcctcctggacccctcccgttctttctggatagccatcccctgggcctgtccaggactgggagttgcagctttgtgttaagctgatcacagacaccggctgcaccatcagcgggaagcagagcccatgtccaggatgcctcctgctgccctgtgtccatccctagtctgtcaggacttcctgtcactgttttccaaagctgtaaacctcactggtgaacgttcaccttaatgattgattctttaatctctgttttcactctcaggctctggtaagtattcgtattctcttcatcccagtctgattgcatagccacactgcccggcacgccacatccacccctgtctgcacatgagttgttctgacaacagcgctgtatacgcttcagtttttccacattgtccacggccagcacatgaaagcatcacttcttttttatgttgtgggaatctttgcaagttagtgttgcatctgattttcaggtgtacatttatttttgactgggcagataggggatttttttttttccatgtccgattcacacgctacacacccacatgaacacattcgaacttcgaaggccacacactcctgcttcataggccccacggtaagtgagttcacacctagaacactgtcctgaccgcaggacgcgtgccttggacttggtattctacatgtgactggctttcttgccctcgtctcttgaatgtttagactcttaagatcatatcctgccccaaatttcaaattaatgaaatgaagatatttcaaacagatctttgaaacctcagattctgtggtgcaattttaatgttttcttgtttctcagttttctgctataaaactattttcaattcagtc

SEQ ID NO: 1734 - DNA, 2833 bp, Homo sapiens
gtacttgcgcagaactcccctcgcggcgaccacgcactacgggttggcgccagagtcaaaaggcgtcggccctctggcaagatggctgctgcggaggcgttggagcgcggaaatctggaaccgggatggcgacgtctacactgagtcggaggcgaaggagcttactccacgggaacagcctctagataatctgagttgttgaaaatacgaagcctgttactcgtgaacagtggctgacaacagtgttgttgtgagcctggctgtctgcttggacccagaggtttcgtctgccagggtttttggttgtatttaggatttcagggaaaagtgtccaagctttcagtgttggagcaggtatggacgacaaaggcgacccgagcaatgaggaggcacctaaggccatcaaacccaccagcaaagagttcaggaaaacatggggttttcgaaggaccactatcgccaagcgagagggcgcaggggacgcggaggctgacccactggagccgccacccccacagcagcagctgggcctgtccctgcggcgcagtgggaggcagcccaagcgcactgagcgcgtggagcagttcctgaccattgcgcggcgccgcggcaggaggagcatgcctgtctccctggaggattctggtgagcccacgtcctgccccgccacagacgccgagacagcctccgagggcagcgtggaaagcgcttctgagaccagaagcggcccccagtctgcttccacagctgtgaaggaacgaccagcctcttctgaaaaggtgaaaggaggggatgaccacgatgacacctccgatagtgacagcgatggcctgaccttgaaagagcttcagaatcgccttcgcaggaagcgggaacaggagcccactgagaggcccctgaaagggatccagagtcgcctgcggaagaagcgccgggaggagggtcccgccgagactgtgggctccgaggccagtgacactgtggagggcgtcctgcccagtaagcaggagcccgagaacgatcagggggttgtgtcccaggctgggaaagatgacagagagagtaagttggagggaaaggcggctcaggacatcaaagatgaggagcctggagacttgggccgaccgaagcctgaatgtgagggttacgaccccaacgccctgtattgcatttgccgccagcctcacaacaacaggtttatgatttgctgtgaccgctgtgaagaatggtttcatggcgattgtgtgggcatttctgaggctcgagggaggcttttggaaaggaatggggaagactatatctgcccaaactgcaccattctgcaagtgcaggatgagactcattcagaaacggcagatcagcaggaagctaaatggagacctggagatgctgatggcaccgattgtacaagtataggaacaatagagcagaagtctagcgaagaccaagggataaagggtagaattgagaaagctgcaaatccaagtggcaagaagaaactcaagatcttccagcctgtgatagaggcgcctggtgcctcaaaatgtattggccccgggtgctgtcacgtggcgcagcccgactcggtgtactgcagtaatgactgtatcctcaaacacgccgcagcgacaatgaagtttctaagctcaggtaaagaacagaagccaaagcctaaagaaaagatgaagatgaagccagagaagcccagtcttccgaaatgcggtgctcaggcaggtattaaaatctcttctgtgcacaagagaccagctccagaaaaaaaagagaccacagtgaagaaggcagtggtggtccctgcgcggagtgaagcactcgggaaggaagcagcttgtgagagcagcacgccgtcgtgggcgagcgatcacaattacaatgcagtaaagccagaaaagactgctgctccctcgccgtcactgttgtataaatgtatgtatcacctaggggttggcctcctggacccctcccgttctttctggatagccatcccctgggcctgtccaggactgggagttgcagctttgtgttaagctgatcacagacaccggctgcaccatcagcgggaagcagagcccatgtccaggatgcctcctgctgccctgtgtccatccctagtctgtcaggacttcctgtcactgttttccaaagctgtaaacctcactggtgaacgttcaccttaatgattgattctttaatctctgttttcactctcaggctctggtaagtattcgtattctcttcatcccagtctgattgcatagccacactgcccggcacgccacatccacccctgtctgcacatgagttgttctgacaacagcgctgtatacgcttcagtttttccacattgtccacggccagcacatgaaagcatcacttcttttttatgttgtgggaatctttgcaagttagtgttgcatctgattttcaggtgtacatttatttttgactgggcagataggggatttttttttttccatgtccgattcacacgctacacacccacatgaacacattcgaacttcgaaggccacacactcctgcttcataggccccacggtaagtgagttcacacctagaacactgtcctgaccgcaggacgcgtgccttggacttggtattctacatgtgactggctttcttgccctcgtctcttgaatgtttagactcttaagatcatatcctgccccaaatttcaaattaatgaaatgaagatatttcaaacagatctttgaaacctcagattctgtggtgcaattttaatgttttcttgtttctcagttttctgctataaaactattttcaattcagtctttaa

SEQ ID NO: 1735 - DNA, 1963 bp, Homo sapiens
ctgcctccgactccccactggactgcatggcgacggcgtgtggtggggcagtcagctaagccatttgcctaaggggctgtcgggcatctgcgtgctggggaccgacagtgtgggtgtgttaggaggatctgtatggagcacattgctgcctctggctaggacagggtggaaagggtggcgtggctacagcctgacccatgggcaccgtcctaccctttgttctgtgcttccgagtgtcagtcatgtgctggggtctgtgggcccatgactcagacggtgagctctgaccttcctgagccagggctttgctgtagttgtgcctggctcaggagctctaggacaaggggaccgctccaggtctgcatctacggtgtggcagggcccctcggcactcttgtgcactagtgtcatctttcccattgaaatgactgtgaggaccagaatgtgcacatgcagatgggcagctacttgtctgccttggccctttattacacaacttgctgggggtggagatgccaccccccggcagtcagagcccctttatgatgtcatggggctggttacatgactgccaaggggtgctgctggccacactgcactagcaagtttgccagatggaggacaagcgatcattgagtatggctcgctgtgaagaaagaaattcgagaggacaggatcatggcttggaaagggtgcctttccctccccagttgcagtcagagacctaccttcacccagcagatccttcccctgcctgggacgacccggggtccactgggagccctaacttgaggctgctgacagaagaaatcgctttccaacctctggccgaggaagcttcgttcagaaggccgcaccctgacggtgacgtcccgccccagggagaagataatctcctctccctcccctttccacagaaactgtggagactggtcagcagcaaccagttttcgtccatctggtgggatgacagtggggcttgtagagtgatcaatcaaaaactctttgaaaaggagattctcaaaagggacgtcgcacacaaagtgtttgccacaacttcgataaagagcttcttccgccagctaaacttgtatggcttccgaaaacggcgtcaatgcactttcaggaccttcacccgcattttctccgcaaaaaggctggtctccatcttgaataagttagagttctactgccatccttactttcaaagagactcccctcacctcctcgtgaggatgaagagaagagtgggtgtcaagtctgcaccaagacatcaggaggaggacaagccagaagctgctggatcctgtctggcaccagcagacactgagcaacaagatcacacgtctccgaatgagaatgaccaggtcacaccgcaacaccgggaaccggccggtcccaacacccaaatcaggagtggctctgctccaccagcaactcctgtgatggtgcctgattccgccgtggcgagtgacaacagtccagtgacccagccggccggcgagtggtcagagggcagccaggctcacgtcactccggtggccgctgtccctgggcctgcagcgctgcccttcctctatgtccctggatctcccactcagatgaattcttacgggcctgtggtggcccttcccacagcgtcccgtagtacccttgccatggacaccacaggacttcctgcacctggcatgctgcccttttgccatctctgggtaccggtgaccctagtggctgctggggctgcacagcctgctgcctccatggtcatgttcccccatctcccagctctgcaccaccattgcccccacagccaccgcacgtcacagtacatgccagctagcgatgggccccaggcgtacccagactacgcagaccagagcacatagagggcagcatttgggcagaatatgtgctggtcaataaatgtgtcagaaaatgagtaattttctgactgcacaaaaaa

SEQ ID NO: 1736 - DNA, 4172 bp, Homo sapiens
atgccgaccctattcaaaggagtttggggggttgtggagcattccagagctctgggaagattctgtcccgcctgcttaccctcaggcccacacctccacacacagccagctctgggcactgcagaaatgacgctcctctcctcccagtcttcatcactggtggccccttctgggtctgtgtctgccgaaaatccagagcagaggatgctggagaagagagccaaggtcatagaagaacttcttcagacagaaagagactacattcgggatctggaaatgtgtattgagcggatcatggtacccatgcagcaggcacaggtaccaaacattgattttgagggactttttggaaatatgcagatggtgattaaggtctcgaagcaattattggctgctctggaaatcagcgatgctgtaggacctgtgtttcttggtcaccgggatgagcttgagggaacatacaagatttactgccagaatcatgatgaggccattgcgctgcttgaaatctacgagaaggatgagaagatccagaagcatcttcaggactccttggcagatctgaactctttagttctaaaaaagggatgcacaaattatattaacctgggctccttcctcatcaaaccagtacagagagtaatgcgttacccgctgttgctaatggagttgctgaattccaccccagaatcccacccagataaagtgcctttaaccaatgcagtccttgcggtcaaggaaatcaacgttaacattaatgaatataaacggcgaaaggacctggtcctcaagtaccgtaagggtgatgaagatagccttatggagaaaatttccaaactgaacatccactccatcatcaagaaatccaaccgagttagcagtcacctgaagcatctcactggctttgctcctcagataaaagatgaagtatttgaagaaacagaaaaaaacttccgaatgcaagaaagattgattaagtcttttatccgagacctgtctctctacctccagcacatccgggagtccgcatgtgtgaaagtggtggctgctgtgagcatgtgggatgtgtgcatggagagaggacaccgggacctggagcagtttgagagggtgcatcgctacatcagtgaccagctcttcacaaactttaaggagaggacagagcggcttgtcatctcccccttaaatcagttactgagcatgtttacagggccccataagctggtacagaaacgctttgacaagctcctggacttctataactgtacagaacgggcagaaaagctaaaggacaagaagaccctggaggagctgcagtcggcccggaacaactatgaggccctgaatgcacagctgctggatgagctgcccaagttccaccagtacgcccagggcctcttcaccaactgtgtccacggctatgctgaagcccactgtgactttgtgcaccaggctctggagcaattaaagccactgctttcgttactcaaagtggctggcagagagggaaaccttattgccatcttccacgaagagcacagcagagttctgcagcaactccaggtttttaccttcttcccggagtctcttccagctaccaagaagccatttgagaggaaaaccattgaccgccagtctgctcgaaagccactcctgggcctgccaagttacatgctacagtcagaagaactccgggcctccctcctggccaggtatccccctgaaaaactcttccaggcagaacggaacttcaatgctgctcaagacttggatgtctcacttttggaaggtgacctggtgggtgtgattaagaaaaaagaccccatgggcagccagaaccgctggctgattgacaatggagtcaccaaaggcttcgtgtacagctctttcctaaagccctacaatcctcgccgcagccactccgatgcctccgtgggtagccactcctccacagagtctgagcacggcagctcctcccccaggttcccacgccagaacagcggcagcaccctgaccttcaaccccagcagcatggctgtatcctttacctcggggtcttgccagaagcagcctcaagatgcatctcctccgccaaaagaatgtgaccaaggaactctcagtgcatccctaaatccgagtaattcagagagtagtccttccagatgcccttcagacccagactccacctcccagccaaggtcaggggactctgcagatgtagctagagatgtaaagcaacccactgccacgccgaggagctaccggaacttcaggcatccagaaatagttggctactccgtaccaggacgaaatgggcaaagtcaagacctcgtcaaaggatgtgcaagaacagcccaggctccggaagacagaagtacagagccagatggcagtgaggcagaaggcaaccaggtctattttgctgtctacaccttcaaggcacgaaacccaaatgagctgagcgtgtcagccaatcagaaactcaagatcctcgagtttaaagatgttacaggaaatacagagtggtggttagctgaggttaacgggaagaagggctacgttccctccaattatatccgcaaaaccgagtacacctgagcccacgttgcctgccacccagccttgctgcctttgctttcagtccgccgagggttctggcggcccaccgagagggcgcctgctcctgagacacaggccctgtctgcgttgcttaaccatggcatggtggagcacaccacagatcttgttctcctcgattgggttgtaaaccttgatgctcactagaatctctagaatttgaaatggaccctggggctttgcaaatgacttagtgactatgagaagagagacaagtcttagagctggcttttggaaaggagaaacttgcagtcagaagcccagtgtcctatgtatgcaggaagctgtgctctagcaatagacagtgttggtaatggttgtgctgtacggcgtttggggtggccccatgttccatgctcagctgaccggatgccaactcagatgaaaagaattcatggctctgggcaccccgtgaggcagtgcttgcacatggctgggagtttgtcgggattgaaccaaacctagtgcttcaaagctcctgggacacctccagtgtccagcacacattctcatacatactgcccctaatttctaaagtccctaaagcactacattctgtaaccttgtttcttttactccattcccagattagttatgcaaaattcaactgcgttctacttttagaagtgtttagggtctttattttctgttgacccttcatctgaaagattctcttcccttgttaggtacaatcactgcccccccgcttttttttttgagatggggtcttgctatgttgcccaggctggtcttaaacgcctgggctcaagcaaccctcccgcctccctgctgagattacaggtgtaagccaccataccgcaacctcaatgacacctttctgatggtctttacacagtctgtgatgtctggtggcccccctgccctggactcaataattgatagattttcctagagtaacagtatgagagctccagccattccattaaaagtattagttctgctttgagctgaaaccagttgagcctaatggaagactggatgtctttcttcttcatccaagcaccctaatgactgtttagttacatccatagatgcagacaacataacacctgtgacttacttgaattgggataagccattccagaagtagcttatcctagacttggaaataagatttttttcaccactaacttccatgcttcagagatgacattcaaagccagattcccaagtgcctgatcatacctcccagtctcaggaagatatttgcttaccccttagaccaagaatcttaagatcttccccagctatgaagcctatcttggaatgggaaaccatgaaatttgtcttttaaaagaaagggaagaaatagccttacagcccctgttcctccaagtgcacatttagccttaaaatcctgggagtcgggagacaccgtggagtcctaacatccacagtgtctgctggtcgtggtcagaaggcagtaatgcaagagtccttttgtgaagagtgtttctatgtagagatgtttatatttaagtagttcttttataaataaaagcatttctaatggc

SEQ ID NO: 1737 - DNA, 4506 bp, Homo sapiens
actggagttcctcaggccgctctcctgaagcggtgctcagaggccctgaccatcctgccaggcgcccgtgacccctgacctcttccctctgcctcctgctgtggcttctgtccacaagcccctccccttcccctttggacccctcaggcctccccagctgcctgcgctggaccctggcggggctgtttcactttttcctgggcagtgtcatgtatgcacctgtgggctgactgtgtggccacatccagtcaggacccagcctccagaactgacccagggaggctcccgctggccccaggaaggagaagtagaaactgatgatcaggcggggcgagagaaccacaccagcggccctgttgagaaatcaggccgagaggtcggtggcggtggctcaggcctgtaatcccagcactttcggaggcctgggcagtcggatcaccagaggtcaggagtccaagattagcctggccaacatggtgaaactgttgtctctactaaaaatacaacattagccaggcgtgatgggcacctgtaatcccagttcctccagagattgaagcaggagaatcgcttaaacctgggaggtggaggttgcagtgagtggagattgcctgggaggtggaggttgcagtgagtggagattgcctgggaggtggagattgcatgaagctccatctcgaggggaaaaaaataagaaagaaaaatcaggcagagaggcaacgccaggtcccagctggagctcagcggggagccaggggatacagtggctgaccgggcctcctaaccccccttctagcactcccccaggatcctgggtcccaattgttgccctggacaaatacgcccattcctgccctacccaccgagtgaggctcagccccaggccccccaccctcatcacaaggtcagggctgtgtcccaccatcctcatcactaggtacttccggccctttgctcagccccatgatgcttggcctgcagagatgggggctgaagggcttggggcatcaaggggacctgacatcttgctgagaagccatcactagacagggctggaggctggagactcagggcctgccctcaccgtggccagtgaggcgtggggttgggcagggaaggggcattcattcattagaccctgccagaagcacctgggtccccttctggggctacaggtggtgaggccactgcccccaagaacacagcctggtgactttagtgtacaaagcagggggagtctccaggggcacagaacagaggctaaagccagggtggaggtggccagcaggcctaggaggaggagagggtcagggccacaccccaggggaggtgcatgtcagccaggggccaccctaaggtggaagccaggagtcccaaaggggcctagagaaggagcagccccccacctggctaccgcagccctctctggttctgtgcagggtattgggatgcgttactgaggcccaaatctgccccactgggaacccccaaaaaagagccagggcaggagaatgagagggaggagccatgaaacccccgccctttaaagacagctctgtggcagctggcccaggccctgcagccctcaccacgttgggactcacttgggggtctcccatgggggtcctaatcccatctcttttcttcccagtccagaatgacagggtccagaaactggcgagccacgagggacatgtgtaggtatcggcacaactatccggtacgtacctgcccctgccccgggacacagaaccctcccgccagctgctcttctcaggcagaatgtcccaggttctactggaaggctggcctggcttgctgtgccagggccacagttctgggcaggaccctgcctggggcacagcctggtatagattcagagccctgcccttcccctctcgcgggagaccgggggcatccccctacttttctgagcttcagcacaccgtcgccttgcaaacatggccatagtgccagcctcgtgatgcacacgtgtggggtccgtgataccgcccacacagcaccccacccccatgccagccctgtctcctgcaggttgtcctcagccattaccctccacacccctgaatcacggaaacccctgtgctgccttcagggtgctgaggaggggacctgccaggcctggcctggctggcgaaatggggaaggggggtccctggggcttggaggcagctgctgtcctctgaatggcccccacctgcagagtgaggagccaggcgggctcttggggtattgggccagcctggaggtttgcagatgcgcctccccgaaagacacggagggccccagggcagcttgtgtctgatggatccctgctgtcccctttctctggctcttcaggatctggtggaacgagactgcaatggggacacgccaaacctgagtttctacagaaatgagatccgcttcctgcccaacggctgtttcattgaggacattcttcagaactggacggacaactatgacctccttgaggacaatcactcctacatccagtggctgtttcctctgcgagaaccaggagtgaactggcatgccaagcccctcacgctcagggaggtcgaggtgtttaaaagctcccaggagatccaggagcggcttgtccgggcctacgagctcatgctgggcttctacgggatccggctggaggaccgaggcacgggcacggtgggccgagcacagaactaccagaagcgcttccagaacctgaactggcgcagccacaacaacctccgcatcacacgcatcctcaagtcgctgggtgagctgggcctcgagcacttccaggcgccgctggtccgcttcttcctggaggagacgctggtgcggcgggagctgccgggggtgcggcagagtgccctggactacttcatgttcgccgtgcgctgccgacaccagcgccgccagctggtgcacttcgcctgggagcacttccggccccgctgcaagttcgtctgggggccccaagacaagctgcggaggttcaagcccagctctctgccccatccgctcgagggctccaggaaggtggaggaggaaggaagccccggggaccccgaccacgaggccagcacccagggtcggacctgtgggccagagcatagcaagggtgggggcagggtggacgaggggccccagccacggagcgtggagccccaggatgcgggacccctggagaggagccagggggatgaggcagggggccacggggaagataggccggagcccttaagccccaaagagagcaagaagaggaagctggagctgagccggcgggagcagccgcccacagagccaggccctcagagtgcctcagaggtggagaagatcgctctgaatttggaggggtgtgccctcagccagggcagcctcaggacggggacccaggaagtgggcggtcaggaccctggggaggcagtgcagccctgccgccaacccctgggagccagggtggccgacaaggtgaggaagcggaggaaggtggatgagggtgctggggacagtgctgcggtggccagtggtggtgcccagaccttggcccttgccgggtcccctgccccatcggggcaccccaaggctggacacagtgagaacggggttgaggaggacacagaaggtcgaacggggcccaaagaaggtacccctgggagcccatcggagaccccaggccccagcccagcaggacctgcaggggacgagccagccgagagcccatcggagaccccaggcccccgcccagcaggacctgcaggggacgagccagccgagagcccatcggagaccccaggcccccgcccggcaggacctgcaggggacgagccagccgagagcccatcggagaccccaggccccagcccggcaggacctacaagggatgagccagccgagagcccatcggagaccccaggcccccgcccggcaggacctgcaggggacgagccagccgagagcccatcggagaccccaggcccccgcccggcaggacctgcaggggacgagccagccgagagcccatcggagaccccaggccccagcccggcaggacctacaagggatgagccagccaaggcgggggaggcagcagagttgcaggacgcagaggtggagtcttctgccaagtctgggaagccttaaggaaaggagtgcccgtcggcgtcttggtcctcctgtccctgctgcaggggctggggcctccggagctgctgcgggctcccctcaggctctgcttcgtgacccgtgacccatgacccacagtgctggcctcctgtggggccactatagcagccaccagaagccgcgaggccctcagggaagcccaaggcctgcagaagcctcctggcctggctgtgtcttccccacccagctctcccctgcgcccctgtctttgtaaattgacccttctggagtggggggcggcgggcagggctgcttttcttagtctgataccaagcaaggccttttctgaataaattcatttgactttga

SEQ ID NO: 1738 - DNA, 1663 bp, Homo sapiens
agcgcgagccccgccgccgccgagcatggacgaccccgactgcgactccacctgggaggaggacgaggaggatgcggaggacgcggaggacgaggactgcgaggacggcgaggccgccggcgcgagggacgcggacgcaggggacgaggacgaggagtcggaggagccgcgggcggcgcggcccagctcgttccagtccagaatgacagggtccagaaactggcgagccacgagggacatgtgtaggtatcggcacaactatccggatctggtggaacgagactgcaatggggacacgccaaacctgagtttctacagaaatgagatccgcttcctgcccaacggctgtttcattgaggacattcttcagaactggacggacaactatgacctccttgaggacaatcactcctacatccagtggctgtttcctctgcgagaaccaggagtgaactggcatgccaagcccctcacgctcagggaggtcgaggtgtttaaaagctcccaggagatccaggagcggcttgtccgggcctacgagctcatgctgggcttctacgggatccggctggaggaccgaggcacgggcacggtgggccgagcacagaactaccagaagcgcttccagaacctgaactggcgcagccacaacaacctccgcatcacacgcatcctcaagtcgctgggtgagctgggcctcgagcacttccaggcgccgctggtccgcttcttcctggaggagacgctggtgcggcgggagctgccgggggtgcggcagagtgccctggactacttcatgttcgccgtgcgctgccgacaccagcgccgccagctggtgcacttcgcctgggagcacttccggccccgctgcaagttcgtctgggggccccaagacaagctgcggaggttcaagcccagctctctgccccatccgctcgagggctccaggaaggtggaggaggaaggaagccccggggaccccgaccacgaggccagcacccagggtcggacctgtgggccagagcatagcaagggtgggggcagggtggacgaggggccccagccacggagcgtggagccccaggatgcgggacccctggagaggagccagggggatgaggcagggggccacggggaagataggccggagcccttaagccccaaagagagcaagaagaggaagctggagctgagccggcgggagcagccgcccacagagccaggccctcagagtgcctcagaggtggagaagatcgctctgaatttggaggggtgtgccctcagccagggcagcctcaggacggggacccaggaagtgggcggtcaggaccctggggagtcctcctgtccctgctgcaggggctggggcctccggagctgctgcgggctcccctcaggctctgcttcgtgacccgtgacccatgacccacagtgctggcctcctgtggggccactatagcagccaccagaagccgcgaggccctcagggaagcccaaggcctgcagaagcctcctggcctggctgtgtcttccccacccagctctcccctgcgcccctgtctttgtaaattgacccttctggagtggggggcggcgggcagggctgcttttcttagtctgataccaagcaaggccttttctgaataaattcatttgactttga

SEQ ID NO: 1739 - DNA, 1997 bp, Homo sapiens
agcgcgagccccgccgccgccgagcatggacgaccccgactgcgactccacctgggaggaggacgaggaggatgcggaggacgcggaggacgaggactgcgaggacggcgaggccgccggcgcgagggacgcggacgcaggggacgaggacgaggagtcggaggagccgcgggcggcgcggcccagctcgttccagtccagaatgacagggtccagaaactggcgagccacgagggacatgtgtaggtatcggcacaactatccggatctggtggaacgagactgcaatggggacacgccaaacctgagtttctacagaaatgagatccgcttcctgcccaacggctgtttcattgaggacattcttcagaactggacggacaactatgacctccttgaggacaatcactcctacatccagtggctgtttcctctgcgagaaccaggagtgaactggcatgccaagcccctcacgctcagggaggtcgaggtgtttaaaagctcccaggagatccaggagcggcttgtccgggcctacgagctcatgctgggcttctacgatccggctggaggaccgaggcacgggcacggtgggccgagcacagaactaccagaagcgcttccagaacctgaactggcgcagccacaacaacctccgcatcacacgcatcctcaagtcgctgggtgagctgggcctcgagcacttccaggcgccgctggtccgcttcttcctggaggagacgctggtgcggcgggagctgccgggggtgcggcagagtgccctggactacttcatgttcgccgtgcgctgccgacaccagcgccgccagctggtgcacttcgcctgggagcacttccggccccgctgcaagttcgtctgggggccccaagacaagctgcggaggttcaagcccagctctctgccccatccgctcgagggctccaggaaggtggaggaggaaggaagccccggggaccccgaccacgaggccagcacccagggtcggacctgtgggccagagcatagcaagggtgggggcagggtggacgaggggccccagccacggagcgtggagccccaggatgcgggacccctggagaggagccagggggatgaggcagggggccacggggaagataggccggagcccttaagccccaaagagagcaagaagaggaagctggagctgagccggcgggagcagccgcccacagagccaggccctcagagtgcctcagaggtggagaagatcgctctgaatttggaggggtgtgccctcagccagggcagcctcaggacggggacccaggaagtgggcggtcaggaccctggggaggcagtgcagccctgccgccaacccctgggagccagggtggccgacaaggtgaggaagcggaggaaggtggatgagggtgctggggacagtgctgcggtggccagtggtggtgcccagaccttggcccttgccgggtcccctgccccatcggggcaccccaaggctggacacagtgagaacggggttgaggaggacacagaaggtcgaacggggcccaaagaaggtacccctgggagcccatcggagaccccaggccccagcccagcaggacctgcaggggacgagccagccgagagcccatcggagaccccaggcccccgcccggcaggacctgcaggggacgagccagccgagagcccatcggagaccccaggccccagcccggcaggacctacaagggatgagccagccgagagcccatcggagaccccaggcccccgcccggcaggacctgcaggggacgagccagccgagagcccatcggagaccccaggcccccgcccggcaggacctgcaggggacgagccagccgagagcccatcggagaccccaggccccagcccggcaggacctacaagggatgagccagccaaggcgggggaggcagcagagttgcaggacgcagaggtggagtcttctgccaagtctgggaagccttaa

SEQ ID NO: 1740 - DNA, 469 bp, Homo sapiens
gtcaccaggagggtatgcatagggagggcaagagctctgggccactgcgaagattcaaaagctccaaaaacctactgtagacatcgaagaaccaatatatacaatgggccaacaatccagtgtccgcaggctgaagaggagcgtcccctgtgaatccaacgaggccaacgaggccaatgaggccaacaagacgatgccggagaccccaactggggactcagacccgcaacctgctcctaaaaaaatgaaaacatctgagtcctcgaccatactagtggttcgctacaggaggaacgtgaaaagaacatctccagaggaactggtgaatgaccacgcccgagagaacagaatcaaccccgaccaaatggaggaggaggaattcatagaaataacgactgaaagacctaaaaagtagcaagaagctacatccctcaaacttcggcaatgaaaataaagtttgagaagctga

SEQ ID NO: 1741 - DNA, 4070 bp, Homo sapiens
gggtggggccgccgttgccagagaagccactagccggttactagctgcgcttttgttccacttgagcgggcactcttctgcggcaagcaggtctaggaattcgcctggttcccacctcgcgtcccttgccttccttcctagtctacccactgtagtgccccctgcgtcccgctccctcctagccgactcagagcacaagaaggattgccacggtttccattgcagcagccgtggcgcctctgaccctttttttatatcgcggcgacggcgggctgtcgtcacgacgacgtgcggacgcagcggcgggggcctttcagcttatgtggagaagtcgctgtgaagccacctataaatccatttactgaatttatggagaaggctgtaaatgatggaagtcattcagaagaactcttttgccatcttaaaactatatcagagaaagaagatttaccacggtgtaccagtgaaagtcatctcagctgcctgaagcaggacattctaaatgaaaagactgaattggaagcaacacttaaggaagcggagttggtaactcattctgtagaattgcttttgccactatttaaggacaccattgaaaagattaattttgaaaatgcgaatctttctgcattgaatttgaagatttctgaacagaaggaaatattaataaaagaattagacaccttcaaaagtgtaaaactagctttagaacatcttcttagaaagagagactacaaacaaacaggagacaatttatccagcatgttgctagaaaatctaactgataatgaaagtgaaaatactaatcttaagaagaaggtatttgaaaaggaggcccatatccaagaactttcttgtttgtttcagagtgaaaaggcaaatactttgaaagcaaaccgtttttcccaatcagtaaaagtagtacatgaacgactacagatccaaattcataaaagggaagccgagaacgataagttgaaagaatatgtaaagagcttagaaaccaagatagccaagtggaacctgcaatcaagaatgaataagaatgaggctatagtgatgaaagaagcaagtaggcaaaaaactgtagctttaaaaaaggcatctaaagtttacaaacaaaggcttgaccattttacaggagctattgaaaagcttacttcccaaattagagatcaggaagccaagttgtctgaaacaatttcagcttccaatgcctggaaaagtcattatgagaaaattgtgatagaaaaaaccgaattggaagtacagattgaaacaatgaaaaagcaaatcattaatcttttggaagatctgaagaaaatggaagaccatggaaaaaattcatgtgaagaaattcttagaaaagttcactcaattgaatatgaaaatgaaactctgaatcttgagaatacaaaattaaagactacacttgctgctttgaaggatgaagttgtatctgttgaaaatgaactctcagaattgcaagaagtagaaaaaaaacagaaaacccttattgaaatgtataaaactcaggtacaaaagttgcaagaagcagctgaaatagtaaaaagcagatgtgaaaatttgctacataaaaataaccaaataacaaaaaccaaaaataaaaatgtagagaaggttgatggaaatcacaatcttctgacaaagctttctctggaagaggaaaactgtcttattcagctgaagtgtgaaaaccttcaacaaaaattagaacagatggacgcagaaaataaagagcttgagaagaagctggcaaaccaagaagaatgtcttaagcacagcaatcttaagtttaaagagaaatctgcagagtatacagcattggccagacaactggaagctgctttagaagaaggaagacaaaaggttgctgaagaaatagagaaaatgtcatctagagagagtgctttacaaattaaaatattagatctggaaactgagcttagaaagaaaaatgaagaacaaaatcaacttgtttgcaaaatgaacagtaaagcacaacatcaggaagtgtgtttgaaagaagtacaaaatagtcttgagaagtcggaaaatcaaaatgagagtattaagaattatttacagtttcttaaaacttcttatgtaacaatgtttgaataaattgtcaaatttattttctctaagtagtagatttttattatgagtctaaaatgtgattgggtaaaaaaataaatatactaccagttacattttatgatttatgagtggtagtattagaggtttttatgtaaagatttttgaaacataatttatctaactgaaactttaaaataggatagttgttactattcctgtttgctggataattcttatttatctttggtttaatttcttttaaaattaaattggttgttagaatatttttctcacacatagacatggaagtcagattcattctttgtgatgtttgtagccaccattcaagtgaatttgtagtaagtcttggtcaatatgattttaaataatatatataattgttttatattatgatatataaatgtaaaatattctgaattttaatttttaataatggtgtaattacatactttctaaagctactaaatgtctcaatatactacacttaatattgtttcaagtatatgctgagttgccattataatttctgttaggttttaagtatacaattttaaatcatcgctattaagtaccaactgctaatgacagatgaaaacgtggtcatgcattatttctttataaagaatagatattcaggctgtcttcaatttgtactctcttttattcgttttatactaatgattatctgatattattattattttagacattctagagccccttagttaaataaaagattaaaggggaacagcttatcccaccctttccatggccaactcatggggatgatcaaaataagcactcttaacatcaagaagctttaaaataaggtctttagtattgggataaagttgtccaagttgaaaaagaacttgtttgctataatctcccactgtgtgtgccaaggcaggatactctaaaaggggatgacgtggtttacaaaggatcaagtaatagtgactcctcttggacaatgacttgagagctgttaattcagaggaacactcaggtcttaaaagatcactaaaaaaggcaggttgtgaactacacagttccagcctatgaacagaaatatctctttaagatgttttatgctttttttctgatcagagatgggggcctggtcccctctgatcccctcacttttaagactgtcatatcattcacagatgcttactttctagtgatccagttggttcgtagtatttttcttaaaatagcaaaatacagagtgtcagaactggccacattttttacccaacaattgctaacaagattagtgtcattttaaaaaaaatcttagtactcatcatactaaaaacatgcttgacccttgcagccctttctttacctcctaatgcaaagggagccttaaatgcccacatgaaaggaaagcaaagctcttgagttttactcactaaactgtaagctccttaagggccgaaatgtatcttagtcatataaatatctgggcactcagttgatgtttgtggatagatggacagatgttgaaagaggcaggtattcgtactcctgttttagatatgaaaaatgtaagcaaaaaggattaattaccatggctgtggtatgaaacttgtttaaagttggcatttaaattcaagtctgcaacattaaagttctgtgtacagagccgttttcccactgtagcagcagcgcagcagcagcgctgctatgattgattaagcacttgctatgtgccagagttaataattgtgataatatattaactcatttaattttcaggaaactaagacatggaaaggttaggtaacttgcccaaggtcgcacagctagtaagtggcagacatccagagtctctgctctgctcttaactctcaccatactacctctgtatccatttcataaataaagatagtagtttcttataacagtaatgcatttgtctt

SEQ ID NO: 1742 - DNA, 2294 bp, Homo sapiens
gaagccactagccggttactagctgcgcttttgttccacttgagcgggcactcttctgcggcaagcaggtctaggaattcgcctggttcccacctcgcgtcccttgccttccttcctagtctacccactgtagtgccccctgcgtcccgctccctcctagccgactcagagcacaagaaggattgccacggtttccattgcagcagccgtggcgcctctgaccctttttttatatcgcggcgacggcgggctgtcgtcacgacgacgtgcggacgcagcggcgggggcctttcagcttatgtggagaagtcgctgtgaagccacctataaatccatttactgaatttatggagaaggctgtaaatgatggaagtcattcagaagaactcttttgccatcttaaaactatatcagagaaagaagatttaccacggtgtaccagtgaaagtcatctcagctgcctgaagcaggacattctaaatgaaaagactgaattggaagcaacacttaaggaagcggagttggtaactcattctgtagaattgcttttgccactatttaaggacaccattgaaaagattaattttgaaaatgcgaatctttctgcattgaatttgaagatttctgaacagaaggaaatattaataaaagaattagacaccttcaaaagtgtaaaactagctttagaacatcttcttagaaagagagactacaaacaaacaggagacaatttatccagcatgttgctagaaaatctaactgataatgaaagtgaaaatactaatcttaagaagaaggtatttgaaaaggaggcccatatccaagaactttcttgtttgtttcagagtgaaaaggcaaatactttgaaagcaaaccgtttttcccaatcagtaaaagtagtacatgaacgactacagatccaaattcataaaagggaagccgagaacgataagttgaaagaatatgtaaagagcttagaaaccaagatagccaagtggaacctgcaatcaagaatgaataagaatgaggctatagtgatgaaagaagcaagtaggcaaaaaactgtagctttaaaaaaggcatctaaagtttacaaacaaaggcttgaccattttacaggagctattgaaaagcttacttcccaaattagagatcaggaagccaagttgtctgaaacaatttcagcttccaatgcctggaaaagtcattatgagaaaattgtgatagaaaaaaccgaattggaagtacagattgaaacaatgaaaaagcaaatcattaatcttttggaagatctgaagaaaatggaagaccatggaaaaaattcatgtgaagaaattcttagaaaagttcactcaattgaatatgaaaatgaaactctgaatcttgagaatacaaaattaaagactacacttgctgctttgaaggatgaagttgtatctgttgaaaatgaactctcagaattgcaagaagtagaaaaaaaacagaaaacccttattgaaatgtataaaactcaggtacaaaagttgcaagaagcagctgaaatagtaaaaagcagatgtgaaaatttgctacataaaaataaccaaataacaaaaaccaaaaataaaaatgtagagaagatgagaggccagatggagtctcatctgaaggagttagagcgtgtctgcgattccttgacggcggcggaacggaggcttcacgagtgtcaggagagtctgcagtgctgcaaggggaagtgtgcagaccaggaacacaccattagggagcttcagggccaggttgatggaaatcacaatcttctgacaaagctttctctggaagaggaaaactgtcttattcagctgaagtgtgaaaaccttcaacaaaaattagaacagatggacgcagaaaataaagagcttgagaagaagctggcaaaccaagaagaatgtcttaagcacagcaatcttaagtttaaagagaaatctgcagagtatacagcattggccagacaactggaagctgctttagaagaaggaagacaaaaggttgctgaagaaatagagaaaatgtcatctagagagagtgctttacaaattaaaatattagatctggaaactgagcttagaaagaaaaatgaagaacaaaatcaacttgtttgcaaaatgaacagtaaagcacaacatcaggaagtgtgtttgaaagaagtacaaaatagtcttgagaagtcggaaaatcaaaatgagagtattaagaattatttacagtttcttaaaacttcttatgtaacaatgtttgaataaattgtcaaattt

SEQ ID NO: 1743 - DNA, 4363 bp, Homo sapiens
ggtcccgactccgatgatggcggacggcgccgcagctggcgctggcggcagcccatccttgagagagctgcgggcacggatggttgctgcagcaaacgagattgctaaggaaaggaggaagcaagatgtggttaatcgtgttgcaacccattcctcaaatataagatcgacatttaaaccagtaatcgatggatccatgcttaaaaatgacataaaacaaagattagcaagagagcgcagagaggagaaaaggagacagcaagacgccaataaagaaacacaactacttgaaaaagaaagaaagaccaagctccaatatgaaaaacagatggaggaaagacagagaaagctgaaggagcgaaaagagaaagaagaacaacggagaatagctgcagaagaaaaaagacaccagaaggatgaagcacaaaaggaaaaatttacagccattctttatcgtactttggaacggaggagacttgctgatgattatcagcaaaaaagatggtcatggggaggctctgcaatggcgaattctgagagcaaaactgggaaaacagacaaggagagaagctcatctttaaatagaagagatagtaacctacattcgtctactgataaagaacaagccgaaaggaagccacgtgttacaggcgtcaccaattatgtaatgcagtatgtcactgtacccttgcgtaaatgtactagcgacgaattgagggctgttatgtttcccatgtcgacaatgaaaatacctcctcaaacaaaagtagaagagtctcccttggagaaagtagagacacctcccaaggcaagtgtggatgcacccccccaggtgaatgtggaagtattctgcaacacaagcatggaagcgtcccccaaggcaggtgtgggcatggcccctgaggtgagcacggactcattccctgtggtgagcgtggacgtgtcgcctgtggtgagcacatatgattctgagatgagcatggacgcatcccccgagttgagcatagaagcactcccgaaggtggacctggaaacagttcccaaggtgagcatagtagcatccccggaggcgagcctggaagcacccccggaagtgagtctggaagcactgccagaggtgagcgtggaagcagccccagaggggagcctggaagcacctcccaaggggagcgcagaagtagcccccaaggagagtgtgaaagggtcacccaaggagagcatggaggcatctcctgaggcgatggtgaaagcatcccccaagacatcccttgaagcaagcatggaagcatctcccaaggcaaaagcgagagacgctccaaagaaatcagaaatggacaaacaggccttaatccctattgccaagaagcgtctatcatcatacactgagtgttataaatggtcatcatctcctgaaaatgcttgtggtctgccgtctcccatcagcactaacaggcaaatccaaaagaactgccctccatcaccattaccacttatttcaaaacagtcaccacagacttcttttccttataaaataatgcctattcaacacaccctgtctgtgcaaagtgcatcaagtactgtcaaaaagaaaaaagaaacagtttctaaaaccactaacagatgtgaggctttgagccaaaggcatatgatctatgaagagtctggtaataagagtactgcaggtattatgaatgccgaggcggcaacaaaaattttgacagaattgcgccgccttgctcgtgaacaaagagaaaaagaggaagaagaaagacaacgggaagaaatgcagcaaagggtcattaagaaatcaaaagacatggcaaaggaagcagttggaggccaagcagaagaccacttgaaactcaaagatgggcagcaacaaaatgagactaaaaagaagaaaggatggctggatcaggaagaccaggaagcaccactgcagaaaggggacgccaaaataaaagctcaagaggaagctgacaaacgcaagaaagaacacgagagaattatgttacaaaatttacaagaacggttagaaaggaaaaagagaatagaagaaattatgaagcggacaagaaagacagatgtgaatgcctcaaaggtcacagaaacatccagccatgacatatatgaagaggctgaggctgacaacgaagaaagcgacaaggactcattgaatgaaatgtttccatcagccattctaaatggcacaggctcacctaccaaatttaaaatgccgttcaacaatgccaagaaaatgacacacaagctggtatttctagaagatggtaccagccaggtccgtaaagagccaaaaacatattttaatggcgatttgaaaaacttcagacaaaaaagcatgaaagacacttcaatacaggaagtagtttcaagaccatcttccaaaagaatgaccagtcacacaacgaaaaccagaaaggcggatgaaaccaacaccaccagcagatcctctgcacaaacaaaatctgaaggattccatgacatcttgccaaagtcctcagacacctttagacaataagagaagaagcaaacctgtttctcctcatttggaaatcccattcctccttgtgtctcatctgagctggaaactcttcactgccaagtctggcgccaggtcctgttgatccatccattgaaactgtctaccaggatgttcctgtttacaaggccaaggtgatggacactgacctagctttcccctcacgcattgctgcctcgcatttcccttcctggtatcctctacccggagggacagacccctggcctctaccagcagattctgcagatcagcgcattttctacgcctgtgtcattgtggacactgcatgtggaatgaagttttttaacagctccaatccctaaaaaccacaagaatgcagtgtgaaataccataaagaatgccagacaggcccctgaagacctgaacccagctgagagggctgctagctcacgtgtgacattgtgcacgttgttgctcttctctgatccctgttccttgtctgtcaaatgagggggctgtgctacaatctctgcagccttttcagttttgagactccactgttctcaaacacctctaactccttggagccagagcaagagggatcaggaggcataaaacagcagcgatggccaaggagccagagcgtggaggcggactgtgcatgacattttatcatgtcagggggcaattccctgtcattttcagtgaccccacccctccagtgcctggccggcctggttggtcaaaacaggccccgaaacagcctccttgcctttggtctccttaccagtccagttacagtgtttccagatgggtcctaggcacccatctgattctaatttccccaactgtattgtaatcattgcagttaggtttacatgtgcaatatgcaaggtacttgataggcattttctttttgtttttttgagatggagtctcgctctgttgcccaggctggaatgcagtggcgtgatcttgactcactgcaacctctgcctcccaggtttaaggggttcatctgcctcagcctcctgagtagctgggactacaggcacacaccacaacacttggctaatttgtgtatttttagtagagacagggtttcaccatgttggccaggctggtctcgaactcctgacctcaggtgatctgcctgcctcagcctcccaaagtgctgggattacaggcatgagccaccgtgcccagccaggcattttcaatgctcacaacaactctatgaggtgtgggtattcatttatgcctatgaggacactgaaatttgtggagagcagcatttgttccaggtcacacagctggaaagagacagagctgatattcaaacccaagtttgtccctcaaactaacaccccacactgctttgggagtggacatagtgtcttgaggcttgcagggtatgtcacagacaccagagcagtgtctttggtgctgggaatgaaatgtttgttggcatttagtgtgtttactgggtgccagtcccctcactaagcacctgcattatgtctcccacatgggattctgcaaagtagaaattttacgtctcacaggtgaaggatcaagctcagagaggttaacttgcccacagtctcatgactacaaagtggcagagcagccaggatttgaaccctggtagcctggtgccagagcccaccctgttaaccacaagcagagaggttcttgatattctgatcccattaattatgagggagaaaatgtttctctgctgacaaattgttaaggggaaatttaccctcatttctcctgagccttaggggtgtcactcttaaaatcgcatattcaacaaacaaatgccttctaagtact

SEQ ID NO: 1744 - DNA, 4446 bp, Homo sapiens
aaaaggaaatggtacagagcagcctgttgaaattagacagcagggtcaccctggtcctctgtgccacaggaaggaggggtactgaagtgtcagttgttggtgggggagcagtgctgcagtgggaattccagagctgagaaggctgccatcaaccaagtgagacatgaccagcccccgagttgctgcagcaaacgagattgctaaggaaaggaggaagcaagatgtggttaatcgtgttgcaacccattcctcaaatataagatcgacatttaaaccagtaatcgatggatccatgcttaaaaatgacataaaacaaagattagcaagagagcgcagagaggagaaaaggagacagcaagacgccaataaagaaacacaactacttgaaaaagaaagaaagaccaagctccaatatgaaaaacagatggaggaaagacagagaaagctgaaggagcgaaaagagaaagaagaacaacggagaatagctgcagaagaaaaaagacaccagaaggatgaagcacaaaaggaaaaatttacagccattctttatcgtactttggaacggaggagacttgctgatgattatcagcaaaaaagatggtcatggggaggctctgcaatggcgaattctgagagcaaaactgccaataaacgatctgcatctactgaaaaacttgaacagggtacttctgctttaatcagacaaatgcctttgtcatctgcaggccttcaaaattccgttgccaaaaggaaaacagacaaggagagaagctcatctttaaatagaagagatagtaacctacattcgtctactgataaagaacaagccgaaaggaagccacgtgttacaggcgtcaccaattatgtaatgcagtatgtcactgtacccttgcgtaaatgtactagcgacgaattgagggctgttatgtttcccatgtcgacaatgaaaatacctcctcaaacaaaagtagaagagtctcccttggagaaagtagagacacctcccaaggcaagtgtggatgcacccccccaggtgaatgtggaagtattctgcaacacaagcatggaagcgtcccccaaggcaggtgtgggcatggcccctgaggtgagcacggactcattccctgtggtgagcgtggacgtgtcgcctgtggtgagcacatatgattctgagatgagcatggacgcatcccccgagttgagcatagaagcactcccgaaggtggacctggaaacagttcccaaggtgagcatagtagcatccccggaggcgagcctggaagcacccccggaagtgagtctggaagcactgccagaggtgagcgtggaagcagccccagaggggagcctggaagcacctcccaaggggagcgcagaagtagcccccaaggagagtgtgaaagggtcacccaaggagagcatggaggcatctcctgaggcgatggtgaaagcatcccccaagacatcccttgaagcaagcatggaagcatctcccaaggcaaaagcgagagacgctccaaagaaatcagaaatggacaaacaggccttaatccctattgccaagaagcgtctatcatcatacactgagtgttataaatggtcatcatctcctgaaaatgcttgtggtctgccgtctcccatcagcactaacaggcaaatccaaaagaactgccctccatcaccattaccacttatttcaaaacagtcaccacagacttcttttccttataaaataatgcctattcaacacaccctgtctgtgcaaagtgcatcaagtactgtcaaaaagaaaaaagaaacagtttctaaaaccactaacagatgtgaggctttgagccaaaggcatatgatctatgaagagtctggtaataagagtactgcaggtattatgaatgccgaggcggcaacaaaaattttgacagaattgcgccgccttgctcgtgaacaaagagaaaaagaggaagaagaaagacaacgggaagaaatgcagcaaagggtcattaagaaatcaaaagacatggcaaaggaagcagttggaggccaagcagaagaccacttgaaactcaaagatgggcagcaacaaaatgagactaaaaagaagaaaggatggctggatcaggaagaccaggaagcaccactgcagaaaggggacgccaaaataaaagctcaagaggaagctgacaaacgcaagaaagaacacgagagaattatgttacaaaatttacaagaacggttagaaaggaaaaagagaatagaagaaattatgaagcggacaagaaagacagatgtgaatgcctcaaaggtcacagaaacatccagccatgacatatatgaagaggctgaggctgacaacgaagaaagcgacaaggactcattgaatgaaatgtttccatcagccattctaaatggcacaggctcacctaccaaatttaaaatgccgttcaacaatgccaagaaaatgacacacaagctggtatttctagaagatggtaccagccaggtccgtaaagagccaaaaacatattttaatggcgatttgaaaaacttcagacaaaaaagcatgaaagacacttcaatacaggaagtagtttcaagaccatcttccaaaagaatgaccagtcacacaacgaaaaccagaaaggcggatgaaaccaacaccaccagcagatcctctgcacaaacaaaatctgaaggattccatgacatcttgccaaagtcctcagacacctttagacaataagagaagaagcaaacctgtttctcctcatttggatatgtaaaccttactcagcctgggagatgaatacatcttccactctggataactcaactcctgggcccatcagtcctcaaatttttctgcttctgacttgaacctggtaaaggaagtgacaccgaaaaattgaaagaaactgtcaaaaggccactttgatgtatatctcagatgttaaagtcatcttattctcttgtgtctaagcaagagttctaagtaaagagtggtttttgttttctttggaaaatcatcattgtctctcattcttgtgttgtcccaccaatgtgtttgctggagtgagtgcatcaaggatgctttcctgaaactgtaactgtggagtttctagaagaatctgattgcagaactaattctctttcagtatatatttgaaatcttaaagtaatgctttttctttttctttttcttttttttttttttgagacggagtcttgccctgtcgcccaggctgcagtgcagtggcacaatctcggctcactgcaacctccgcctcctcatctcaagcaattctcctgtctcagcctccccagtagctgggattacaggcatgtgccaccacacctggctaatttttttgtattttagtagagatagggttttaccatgttcaccaggctagtctcgaaatcctggcctcaagagatccacccgtcttggcctcccaaagtgttgggattacaggtgtgagccactgcacccagccaagtaatgctttttctgtgtaccagtgacaattttgacagctaaaaactcacagttgatcttgtagagaacagaatagattatgcaagggccgcaggatcgctcacaagagctgtcagattgtttctaatataaaaataccaaaggttgcaaaatccagcaaattgtattttactgtgatatatgtatatttttaactctacccatctgtgccagtgagtacacaggcactaataacctgaaatgctgggagtcctgtaaagccccatcttggaacagtcagcacctttcatgctcttgtcagtgtttccttttgaaggacatattggtgtttatctacagaaacatatattatttttattgtgtacataaaggagtatatggctgttgtcccgtggggtatgtttaattcctctaaatgtttaaagtacttttctgcctgtactctccagttctgtcgttgagtatacactcaggcttgagatacaaccaaaatttgcttgcctttctctagccactggctgccagtgagttcgtgtgatgggcacacagaaatgcacacagatgtacatacacgtatgtatgcacacacagtatatgattccataaaattcaaatgcagattaattctcctaatgagttttcagtgttgaatcgtaaatagtctgaagcaggccagtgttccttttggctgccagtcttggattagtaaaaggaggtaattctttcagattccctggttctttgccactcagagtattgtacttttgatatagaatagagaaggttacctttggtttaaaaactatttttatatactagctctttcatgtataaaacagagacaatcatcctaacaaaagagttcctgttatttttctgcacaaatgtcttgtgttgaaacactgttacagttccatataaatgtgtgctatataaaataaactttggag

SEQ ID NO: 1745 - DNA, 3847 bp, Homo sapiens
gctgggcgggcgggcggctgctccggtccaggggtggaggtcggggccctgacccgacgcagccaggcggaagcgcggctgccattggaggctgcttttacctgcgcggggcccggggcgcaaagtccgaggcgccggggggaggaggcggcggacggcagcgcaggtgggcccgcgctctcggccctgcaagatgcccctgaagctgcgggggaagaagaaggccaagtccaaggagaccgccgggctggtggagggcgagccgacgggcgcgggcggcgggagcctctcagcgtcccgggctcccgcacgcaggctggtcttccacgcgcagctggcgcacggtagtgccacgggccgagtggagggcttctccagcatccaggagctctacgcccagatcgcgggcgcgtttgaaatctcgccgtcggagatcttatattgcactttaaacacacctaaaattgacatggaaagactcttaggaggacaactaggactagaagatttcatatttgcccatgtgaaaggaatcgaaaaagaagtgaatgtgtataaatctgaggattcacttggtctcaccattacagataatggtgttggctatgcttttataaagagaattaaagatggtggtgttattgactcagttaaaacaatctgtgttggggatcatattgaatccataaatggagaaaatattgttgggtggcgtcactatgatgttgctaagaagttaaaggaattaaaaaaggaggaactctttactatgaagttaatagaacctaagaaggcatttgaaatagagctgaggtcaaaggctggaaagtcatcaggagaaaaaattggttgtggaagggcaacacttcgcctgagatcaaaaggtcctgccaccgtggaagaaatgccttctgaaaccaaagcaaaggcaattgaaaagattgatgatgttcttgagttgtacatgggaattcgagatattgatttagccaccacaatgtttgaagctggaaaggacaaagtaaatccagatgaatttgctgtggcacttgacgaaactcttggagactttgcgttcccagacgaatttgtctttgatgtttggggagtcattggtgatgccaaacgaagaggattatgatgtgtacactccatctctgaagaaacaacccatcgttcttttttttctcttttttaaaaagtcctataagatctgtttttggacacctttactaactctggtttaatttcatgtgtatggaatatattctttgaaatataattttggtaattttgatttctgggcactttttaacattgctgatgtagtatgcttaagagaaatgacctaaataaggatcaattgtaatattcattcaaaaggtttttaaaagtaagttttaaggagtatttctcgacagatgattttcttctccattaatacccatgctttgtttttcacatataaatagatgatttcaatagctttgtagttttttttcaaaatcttaatgtaaactaggattggagtatgatttacctcatagtatcttcactgtgttatcctagtttgaacaggatatgttcaggaaatgaaaggtgaattatgccccttattggtctagaagcattggtttttttttgatcctctgagtaagggaaggaagattcctgtggcatgttgatttctatggccaactttctctctttgtaaaacaaagattgattgattttcttgtatgcttctttatacatgctcttaaaacttgtggttgaaatctgtgctgtgtgtgtgtgtctctgcatgtgtaaaagaagggtaaaaaagagatgggtagggtagaactacttgcatttgatttttttttcagtccttaaaacattatttctttttttcactcatagccacttttatgttaccttttataagcactccagggaagattttatatttttttgtagagtttttggaaagatatttactcaaaataactatgctttagaactttttttttttttttttttttggttaaacagcagcactttttagttccctaaactttagaagaaatgctatcagaaatagatttccttccagtggaaagaaaggaggaagggagaattgagaaaatatattagtctattattttagagttctaatacactctaaattaaagagaaaattgagagtaaatgactgtcttatcactcttatttgacatttcgtaggtgtaagagaaatggaaatgaatggtttcaacaaagatcatttaatacagcagagcatggcatgaccaagcatctttgtaaagtgttagatggaaaatgctgtgtgctgccatggtaatcagaaataataacctgttagggatgtattctaggaaatcagaagtagttctcttttcttgctggattattgcttagataactcttgttttctggtaaaactttagttgtattgccatccactcctttttcaaatgagtttaatgccataaagctgatattctttgtccgattaatttgaaatctgcacagaagctgttttagtcattaatgtgtaacaaaagtagcttatagaatatggactgccttattgctgttgcttatcatttgaaaataaaatccagctcaggttgtaacttgttggtactcgtttagtgagttcgttttggaggttctgaaatacctattaattcttaatattacctctcttggaaagacacaaaaaaagagctgttatttttaggcataagatgacttaggaggcccatagaaacattctcgtttaaacaacaacaacaaaataaatttatcagcactagatattagatttgaaataagtcattgttcattattgatggttgtcagtttctccttcctttttgggcatgcataaagacacacttggtgctgattccatgtgatttatggaatgtcattttcacaatgatctttctagaatttgtgtgtaaggttgtgatatccatgtacagctgtaactatatatacttgtctgttagcattcagtggaccattatcattactatcatcacattacctgggcttcaactgggcccaagtactctatatactgcctgtaataggtttttccttgaaatatccttatctttcacctctacagctaaactgataacaaggtcagtttctttatgtcattttattcccatacctaaaattgcatctatttgtgagctttctgcctttttgtaacgctcagtgcaccaaaagcgtctgtttttagtgcagtcacataatatataagtgtgggatacccttctgcagcttcagtgagacaaatcactttttaaaaaacattccattttattggcatcactagatgtttttaggaccctgtccttttcacttttctgtaggctttttttttttaaatggaagatgattattttgtttgttcttgatttcctgttattgaaaacagcatcttccttcttgcaatggccactaatagcacacaatgcgttttctttgattgtagcagaaaatgcaaatgataattgtatgttgggctcgatgaggccttgaacatagctgagtcctaatcagatgtatatactctgatgattacaaataggtacatgttgggtttctgtgatgtttcaaaaatacaattatataattatgatgtaaactctttaagaattcaattataaaagcaataatcaggtaacctctatttggagctgctacatccaatattgtgactgaaaattaactaaagagagataatttttcaaatgatgtataatttgcaatattttcccttgcaactttagcaaatacacatattccaagtaaaacttta

SEQ ID NO: 1746 - DNA, 2917 bp, Homo sapiens
ggagacaccggaaggagccgcggctgctgcgggaagtggccagttcaggaggcggaccccccgagggcagcgctgcggggccgttttccggccctcctgacgcgacactgcccctctccgagagctgagaaggaaaagaggagcttgcggaggtgcggctgcaggccgttgttggtcgagctggcgggtcccgcgggccaggccgtggagagctcctgaaggaagcactaaacatggaaaggaacaaccggtaccagccactgcaaaaacatgccaaattgtaaagaccatcgatgttaggaagaaactgcctcaactaatgagcaaaataaccagctaacatcgtaatgacaggatcaaattcacacataacgatattaaccttaaaggtgttacctcattttgaaagtcttgggaaacaggaaaaaattcctaacaaaatgtcagcttttcgaaatcattgtccacatttggattcagttggtgaaataacaaaagaagatttgatacaaaaatcccttggtacttgtcaggattgtaaagtccaaggaccaaatctttgggcatgtctggagaatagatgttcatatgttggctgtggtgaatcacaagtagatcacagcaccatacattctcaggagacaaagcattatctaactgtgaaccttaccactcttcgagtatggtgttatgcttgcagcaaagaagtatttttggataggaaattaggaactcagccttcattgcctcatgtaagacaacctcaccaaatacaagaaaacagtgtccaggattttaaaatacccagtaatacaacattaaaaactcctctggttgccgtatttgatgatctggatatagaagcggatgaagaagatgaacttagggccagaggtcttacaggtttgaaaaatattggaaatacttgttacatgaatgcagctttgcaggctctttctaattgcccacctttgacacagttttttcttgattgtggaggactagctcgaacagataagaaacctgccatttgtaaaagttatctcaaactaatgacagagctgtggcataaaagcaggccaggatctgttgtgcctactactctgtttcaaggaattaaaactgtaaatccaacatttcgggggtattctcagcaggatgctcaagaattccttcgatgtttaatggatttgcttcatgaagaattgaaagagcaagtcatggaagtagaagaagatccgcaaaccataaccactgaggagacaatggaagaagacaagagccagtcggatgtagattttcagtcttgtgaatcttgtagcaacagtgatagagcagaaaatgaaaatggctctagatgcttttctgaagataataatgaaacaacaatgttaattcaggatgatgaaaacaattcagaaatgtcaaaggattggcaaaaagagaagatgtgcaataagattaataaagtaaattctgaaggcgaatttgataaagatagagactctatatctgaaacagtcgacttaaacaaccaggaaactgtcaaagtgcaaatacacagcagagcttcagaatatatcactgatgtccattcgaatgacctgtctacaccacagatccttccatcaaatgaaggtgttaatccacgtttatcggcaagccctcctaaatcaggcaatttgtggccaggattggcaccaccacacaaaaaagctcagtctgcatctccaaagagaaaaaaacagcacaagaaatacagaagtgttatttcagacatatttgatggaacaatcattagttcagtgcagtgtctgacttgtgacagggtgtctgtaaccctcgagacctttcaagatctgtccttgccaattcctggcaaggaagaccttgctaagctgcattcatcaagtcatccaacttctatagtcaaagcaggatcatgtggcgaagcatatgctccacaagggtggatagcttttttcatggaatatgtgaagagctggttttggggtccagtagtaaccttgcaagattgtcttgctgccttctttgccagagatgaactaaaaggtgacaatatgtacagttgtgaaaaatgcaaaaagttgagaaatggagtgaagttttgtaaagtacaaaactttcctgagattttgtgcatccaccttaaaagattcagacatgaactaatgttttccaccaaaatcagtacccatgtttcatttccgctagaaggcttggatcttcagccatttcttgctaaggatagtccagctcaaattgtgacatatgatcttctgtcagtcatttgccatcatggaactgcaagtagtggacactatatagcctactgccgaaacaatctaaataatctctggtatgaatttgatgatcagagtgtcactgaagtttcagaatctactgtacaaaatgcagaagcttacgttcttttctataggaagagcagcgaagaggcacaaaaagagaggagaaggatatcaaatttattgaacataatggaaccaagcctccttcagttttatatttctcgacagtggcttaataaatttaagacctttgccgaacctggccctatttcaaataatgactttctttgtattcatggaggtgttcctccaagaaaagctggttatattgaagacctggttttgatgctgcctcagaacatttgggataacctatatagcaggtatggtggaggaccagctgtcaaccatctgtacatttgtcatacttgccaaattgaggcggagaaaattgaaaaaagaagaaaaactgaattggaaatttttattcgggtaaaaaagtgatgcttttcaaattgatctaggataaagatgaagacctgacaattatcagagttatatgatattaataaaatgattagatgaaa

SEQ ID NO: 1747 - DNA, 4502 bp, Homo sapiens
ggagacaccggaaggagccgcggctgctgcgggaagtggccagttcaggaggcggaccccccgagggcagcgctgcggggccgttttccggccctcctgacgcgacactgcccctctccgagagctgagaaggaaaagaggagcttgcggaggtgcggctgcaggccgttgttggtcgagctggcgggtcccgcgggccaggccgtggagagctcctgaaggaagcactaaacatggaaaggaacaaccggtaccagccactgcaaaaacatgccaaattgtaaagaccatcgatgttaggaagaaactgcctcaactaatgagcaaaataaccagctaacatcgtaatgacaggatcaaattcacacataacgatattaaccttaaaggtgttacctcattttgaaagtcttgggaaacaggaaaaaattcctaacaaaatgtcagcttttcgaaatcattgtccacatttggattcagttggtgaaataacaaaagaagatttgatacaaaaatcccttggtacttgtcaggattgtaaagtccaaggaccaaatctttgggcatgtctggagaatagatgttcatatgttggctgtggtgaatcacaagtagatcacagcaccatacattctcaggagacaaagcattatctaactgtgaaccttaccactcttcgagtatggtgttatgcttgcagcaaagaagtatttttggataggaaattaggaactcagccttcattgcctcatgtaagacaacctcaccaaatacaagaaaacagtgtccaggattttaaaatacccagtaatacaacattaaaaactcctctggttgccgtatttgatgatctggatatagaagcggatgaagaagatgaacttagggccagaggtcttacaggtttgaaaaatattggaaatacttgttacatgaatgcagctttgcaggctctttctaattgcccacctttgacacagttttttcttgattgtggaggactagctcgaacagataagaaacctgccatttgtaaaagttatctcaaactaatgacagagctgtggcataaaagcaggccaggatctgttgtgcctactactctgtttcaaggaattaaaactgtaaatccaacatttcgggggtattctcagcaggatgctcaagaattccttcgatgtttaatggatttgcttcatgaagaattgaaagagcaagtcatggaagtagaagaagatccgcaaaccataaccactgaggagacaatggaagaagacaagagccagtcggatgtagattttcagtcttgtgaatcttgtagcaacagtgatagagcagaaaatgaaaatggctctagatgcttttctgaagataataatgaaacaacaatgttaattcaggatgatgaaaacaattcagaaatgtcaaaggattggcaaaaagagaagatgtgcaataagattaataaagtaaattctgaaggcgaatttgataaagatagagactctatatctgaaacagtcgacttaaacaaccaggaaactgtcaaagtgcaaatacacagcagagcttcagaatatatcactgatgtccattcgaatgacctgtctacaccacagatccttccatcaaatgaaggtgttaatccacgtttatcggcaagccctcctaaatcaggcaatttgtggccaggattggcaccaccacacaaaaaagctcagtctgcatctccaaagagaaaaaaacagcacaagaaatacagaagtgttatttcagacatatttgatggaacaatcattagttcagtgcagtgtctgacttgtgacagggtgtctgtaaccctcgagacctttcaagatctgtccttgccaattcctggcaaggaagaccttgctaagctgcattcatcaagtcatccaacttctatagtcaaagcaggatcatgtggcgaagcatatgctccacaagggtggatagcttttttcatggaatatgtgaagaggtttgttgtctcatgtgtccctagctggttttggggtccagtagtaaccttgcaagattgtcttgctgccttctttgccagagatgaactaaaaggtgacaatatgtacagttgtgaaaaatgcaaaaagttgagaaatggagtgaagttttgtaaagtacaaaactttcctgagattttgtgcatccaccttaaaagattcagacatgaactaatgttttccaccaaaatcagtacccatgtttcatttccgctagaaggcttggatcttcagccatttcttgctaaggatagtccagctcaaattgtgacatatgatcttctgtcagtcatttgccatcatggaactgcaagtagtggacactatatagcctactgccgaaacaatctaaataatctctggtatgaatttgatgatcagagtgtcactgaagtttcagaatctactgtacaaaatgcagaagcttacgttcttttctataggaagagcagcgaagaggcacaaaaagagaggagaaggatatcaaatttattgaacataatggaaccaagcctccttcagttttatatttctcgacagtggcttaataaatttaagacctttgccgaacctggccctatttcaaataatgactttctttgtattcatggaggtgttcctccaagaaaagctggttatattgaagacctggttttgatgctgcctcagaacatttgggataacctatatagcaggtatggtggaggaccagctgtcaaccatctgtacatttgtcatacttgccaaattgaggcggagaaaattgaaaaaagaagaaaaactgaattggaaatttttattcggcttaacagagcgttccaaaaagaggactctccagctactttttattgcatcagtatgcagtggtttagagaatgggaaagttttgtgaagggtaaagatggagatcctccaggtcctattgacaatactaagattgcagtcactaaatgtggtaatgtgatgcttaggcaaggagcagattctggccagatttctgaagaaacatggaattttctgcagtctatttatggtggagggcctgaagttatcctgcgacctccggttgttcatgttgatccagatatacttcaagcagaagaaaaaattgaagtagaaactcggtctttgtaatttttaggatgtagagagttctaatgaggaatcattttcatgtgccctgacatgtacacatgcgaaaacattcctaaaagcgtgtttatttgctttattttttttcatcatttatcccatttatttcttcttagtgggcattatggaagaatatattaaaatgtgtaatataccacaggttggtatatttagttttaaatacttaccataaagtctttcagtgtaatttttttttgagacagagtcttgctttgtcacccaggctggagtgctgtggtgttacctcagctcactgcagcctccacctcctgggttcaagcgattctcctgcctcagcctctcgagtagctgggattacaggcacctgccaccatgcccggctaatttttgtattttagtagagatggggtttcaccatgttggccaggctagtctcaaactcctgacctcaggtgatccacccacctcggcctcccaaagtgctgggattacaggtgtgagccacagcgcctggcccagtgtaatatttttgaaagaggagggacaattgtgaaatcagtaggttatctttaatctttacactacatgcagatccatagtatcctttgtagtgttgtaaatacttttgctttgaaaactttttcattgtcctaaatcaccctgactctgaccagtctttcagttctccaaaagcccaatttaattgtatagttttgtcatggcttcatataataaagagcctattttaagttgaaagtagtagtcagaaaattgttaatttcctaaagctcaggaaactagggtgtcactttttttgcactgcagcatatacactaactagcttattaaaatttacaaaatgtctttttgaatgtatcaaggatatatttagtttgagtggaatttgtcagcagatatcagtaacttattgccgcttatattgtacaatgttaaacttcaattcctgtaacctggttagtattaatgtcagtgactaaaaaacttagagttagttttagggcactttttattttgagagcatgaagtgtggaatgtgtcactacgattgttgataaagctgaggccacttgcaacttgattttttaaatgaaatagataaagtctttttgaataatatagtatgcactgctatttgcttgattatgtaatgtcaaaagtttaactatattccaagtacaaaaacatactggattacattgaggatgttgaatagcattcatgatggctttgttttggtttggggcagctgtcaccagctaaagcaatgttgttaaaattagctcaataaaaatgtctttaaaatgt

SEQ ID NO: 1748 - DNA, 4327 bp, Homo sapiens
ggagacaccggaaggagccgcggctgctgcgggaagtggccagttcaggaggcggaccccccgagggcagcgctgcggggccgttttccggccctcctgacgcgacactgcccctctccgagagctgagaaggaaaagaggagcttgcggaggtgcggctgcaggccgttgttggtcgagctggcgggtcccgcgggccaggccgtggaggtgttacctcattttgaaagtcttgggaaacaggaaaaaattcctaacaaaatgtcagcttttcgaaatcattgtccacatttggattcagttggtgaaataacaaaagaagatttgatacaaaaatcccttggtacttgtcaggattgtaaagtccaaggaccaaatctttgggcatgtctggagaatagatgttcatatgttggctgtggtgaatcacaagtagatcacagcaccatacattctcaggagacaaagcattatctaactgtgaaccttaccactcttcgagtatggtgttatgcttgcagcaaagaagtatttttggataggaaattaggaactcagccttcattgcctcatgtaagacaacctcaccaaatacaagaaaacagtgtccaggattttaaaatacccagtaatacaacattaaaaactcctctggttgccgtatttgatgatctggatatagaagcggatgaagaagatgaacttagggccagaggtcttacaggtttgaaaaatattggaaatacttgttacatgaatgcagctttgcaggctctttctaattgcccacctttgacacagttttttcttgattgtggaggactagctcgaacagataagaaacctgccatttgtaaaagttatctcaaactaatgacagagctgtggcataaaagcaggccaggatctgttgtgcctactactctgtttcaaggaattaaaactgtaaatccaacatttcgggggtattctcagcaggatgctcaagaattccttcgatgtttaatggatttgcttcatgaagaattgaaagagcaagtcatggaagtagaagaagatccgcaaaccataaccactgaggagacaatggaagaagacaagagccagtcggatgtagattttcagtcttgtgaatcttgtagcaacagtgatagagcagaaaatgaaaatggctctagatgcttttctgaagataataatgaaacaacaatgttaattcaggatgatgaaaacaattcagaaatgtcaaaggattggcaaaaagagaagatgtgcaataagattaataaagtaaattctgaaggcgaatttgataaagatagagactctatatctgaaacagtcgacttaaacaaccaggaaactgtcaaagtgcaaatacacagcagagcttcagaatatatcactgatgtccattcgaatgacctgtctacaccacagatccttccatcaaatgaaggtgttaatccacgtttatcggcaagccctcctaaatcaggcaatttgtggccaggattggcaccaccacacaaaaaagctcagtctgcatctccaaagagaaaaaaacagcacaagaaatacagaagtgttatttcagacatatttgatggaacaatcattagttcagtgcagtgtctgacttgtgacagggtgtctgtaaccctcgagacctttcaagatctgtccttgccaattcctggcaaggaagaccttgctaagctgcattcatcaagtcatccaacttctatagtcaaagcaggatcatgtggcgaagcatatgctccacaagggtggatagcttttttcatggaatatgtgaagaggtttgttgtctcatgtgtccctagctggttttggggtccagtagtaaccttgcaagattgtcttgctgccttctttgccagagatgaactaaaaggtgacaatatgtacagttgtgaaaaatgcaaaaagttgagaaatggagtgaagttttgtaaagtacaaaactttcctgagattttgtgcatccaccttaaaagattcagacatgaactaatgttttccaccaaaatcagtacccatgtttcatttccgctagaaggcttggatcttcagccatttcttgctaaggatagtccagctcaaattgtgacatatgatcttctgtcagtcatttgccatcatggaactgcaagtagtggacactatatagcctactgccgaaacaatctaaataatctctggtatgaatttgatgatcagagtgtcactgaagtttcagaatctactgtacaaaatgcagaagcttacgttcttttctataggaagagcagcgaagaggcacaaaaagagaggagaaggatatcaaatttattgaacataatggaaccaagcctccttcagttttatatttctcgacagtggcttaataaatttaagacctttgccgaacctggccctatttcaaataatgactttctttgtattcatggaggtgttcctccaagaaaagctggttatattgaagacctggttttgatgctgcctcagaacatttgggataacctatatagcaggtatggtggaggaccagctgtcaaccatctgtacatttgtcatacttgccaaattgaggcggagaaaattgaaaaaagaagaaaaactgaattggaaatttttattcggcttaacagagcgttccaaaaagaggactctccagctactttttattgcatcagtatgcagtggtttagagaatgggaaagttttgtgaagggtaaagatggagatcctccaggtcctattgacaatactaagattgcagtcactaaatgtggtaatgtgatgcttaggcaaggagcagattctggccagatttctgaagaaacatggaattttctgcagtctatttatggtggagggcctgaagttatcctgcgacctccggttgttcatgttgatccagatatacttcaagcagaagaaaaaattgaagtagaaactcggtctttgtaatttttaggatgtagagagttctaatgaggaatcattttcatgtgccctgacatgtacacatgcgaaaacattcctaaaagcgtgtttatttgctttattttttttcatcatttatcccatttatttcttcttagtgggcattatggaagaatatattaaaatgtgtaatataccacaggttggtatatttagttttaaatacttaccataaagtctttcagtgtaatttttttttgagacagagtcttgctttgtcacccaggctggagtgctgtggtgttacctcagctcactgcagcctccacctcctgggttcaagcgattctcctgcctcagcctctcgagtagctgggattacaggcacctgccaccatgcccggctaatttttgtattttagtagagatggggtttcaccatgttggccaggctagtctcaaactcctgacctcaggtgatccacccacctcggcctcccaaagtgctgggattacaggtgtgagccacagcgcctggcccagtgtaatatttttgaaagaggagggacaattgtgaaatcagtaggttatctttaatctttacactacatgcagatccatagtatcctttgtagtgttgtaaatacttttgctttgaaaactttttcattgtcctaaatcaccctgactctgaccagtctttcagttctccaaaagcccaatttaattgtatagttttgtcatggcttcatataataaagagcctattttaagttgaaagtagtagtcagaaaattgttaatttcctaaagctcaggaaactagggtgtcactttttttgcactgcagcatatacactaactagcttattaaaatttacaaaatgtctttttgaatgtatcaaggatatatttagtttgagtggaatttgtcagcagatatcagtaacttattgccgcttatattgtacaatgttaaacttcaattcctgtaacctggttagtattaatgtcagtgactaaaaaacttagagttagttttagggcactttttattttgagagcatgaagtgtggaatgtgtcactacgattgttgataaagctgaggccacttgcaacttgattttttaaatgaaatagataaagtctttttgaataatatagtatgcactgctatttgcttgattatgtaatgtcaaaagtttaactatattccaagtacaaaaacatactggattacattgaggatgttgaatagcattcatgatggctttgttttggtttggggcagctgtcaccagctaaagcaatgttgttaaaattagctcaataaaaatgtctttaaaatgtaaaa

SEQ ID NO: 1749 - DNA, 498 bp, Homo sapiens
gttttcatcctggttttgggacagcggcaatcatggcgccacctgtgagatactgcatccccggcgaacgtctgtgtaacttggaggagggcagcccgggcagcggcacctacacccgccacggctacatcttttcgtcgcttgccggctgtctgatgaagagcagcgagaatggcgcgcttccagtggtgtctgtagtgagagaaacagagtcccagttactgccagatgtgggagctattgtaacctgtaaggttgaaatttataagagtttccgcccaggtgacattgtcttggccaaagtgatctccttaggtgatgcacagtccaactacctgctaaccaccgccgagaacgagctgggagtggtggtagcccacagtgagtcaggtatccagatggttcccatcagctggtgtgagatgcagtgccctaagacccacactaaagaattccggaaagtagcccgagtacaacccgaattcttgcagacctaag

SEQ ID NO: 1750 - DNA, 718 bp, Homo sapiens
cggcaatcatggcgccacctgtgagatactgcatccccggcgaacgtctgtgtaacttggaggagggcagcccgggcagcggcacctacacccgccacggctacatcttttcgtcgcttgccggctgtctgatgaagagcagcgagaatggcgcggtctctagcatcaattcacgctttgccaaagtacacatcctgtatgtggggtccatgcctcttaagaactcttttcgaggaactatccgcaaggaagatgtccgagcaactgaaaaagacaaggttgaaatttataagagtttccgcccaggtgacattgtcttggccaaagtgatctccttaggtgatgcacagtccaactacctgctaaccaccgccgagaacgagctgggagtggtggtagcccacagtgagtcaggtatccagatggttcccatcagctggtgtgagatgcagtgccctaagacccacactaaagaattccggaaagtagcccgagtacaacccgaattcttgcagacctaagaagccactttttaccctatggaagggggtaagctgttcctgagtataacaccaagatgctgctgtctttattcaaacacctggcgtcggccaacagccacttccagaaaaatcttccagtttacgctgtagatggaacatgtttctgtgaacctatcagtggatttcattctcttgagtaataaatcttatctttt

SEQ ID NO: 1751 - DNA, 739 bp, Homo sapiens
catggcgccacctgtgagatactgcatccccggcgaacgtctgtgtaacttggaggagggcagcccgggcagcggcacctacacccgccacggctacatcttttcgtcgcttgccggctgtctgatgaagagcagcgagaatggcgcgcttccagtggtgtctgtagtgagagaaacagagtcccagttactgccagatgtgggagctattgtaacctgtaaggtctctagcatcaattcacgctttgccaaagtacacatcctgtatgtggggtccatgcctcttaagaactcttttcgaggaactatccgcaaggaagatgtccgagcaactgaaaaagacaagatctccttaggtgatgcacagtccaactacctgctaaccaccgccgagaacgagctgggagtggtggtagcccacagtgagtcaggtatccagatggttcccatcagctggtgtgagatgcagtgccctaagacccacactaaagaattccggaaagtagcccgagtacaacccgaattcttgcagacctaagaagccactttttaccctatggaagggggtaagctgttcctgagtataacaccaagatgctgctgtctttattcaaacacctggcgtcggccaacagccacttccagaaaaatcttccagtttacgctgtagatggaacatgtttctgtgaacctatcagtggatttcattctcttgagtaataaatcttatcttttcaag

SEQ ID NO: 1752 - DNA, 3269 bp, Homo sapiens
cagggaaggtggggctatggcagctgctagggaccctccggaagtatcgctgcgagaagccacccagcgaaaattgcggaggttttccgagctaagaggcaaacttgtagcacgtggagaattctgggacatagttgcaataacagcggctgatgaaaaacaggaacttgcttacaaccaacagctgtcagaaaagctgaaaagaaaggagttaccccttggagttcaatatcacgtttttgtggatcctgctggagccaaaattggaaatggaggatcaacactttgtgcccttcaatgtttggaaaagctatatggagataaatggaattcttttaccatcttattaattcactctgatgaatggaagaaaaaagtcagtgaatcatatgttatcacaatagaaagattagaagatgacctgcagatcaaggaaaaagaactgacagaactaaggaatatatttggctctgatgaagccttcagtaaagtcaatttaaattaccgcactgaaaatgggctgtctctacttcatttatgttgcatttgtggaggcaagaaatcacatattcgaactcttatgttgaaagggctccgcccatctcgactgacaagaaatggatttacagccttgcatttagcagtttacaaggataatgcagaattgatcacttctctgcttcacagtggagctgatatacagcaggttggatacggtggcctcactgccctccatattgctacaatagctggccacctagaggctgctgatgtgctgttgcaacatggagctaatgtcaatattcaagatgcagtttttttcactccattgcatattgcagcgtactatggacatgaacaggtaactcgccttcttttgaaatttggtgctgatgtaaatgtaagtggtgaagttggagatagacccctccacctagcatctgcaaaaggattcttgaatattgcaaaactcttgatggaagaaggcagcaaagcagatgtgaatgctcaagataatgaagaccatgtcccactccatttctgttctcgatttggacaccatgatatagttaagtatctgctgcaaagtgatttggaagttcaacctcatgttgttaatatctatggagatacccccttacacctggcatgctacaatggcaaatttgaagttgccaaggaaatcatccaaatatcaggaacagaaagtctgactaaggaaaacatcttcagtgaaacagcttttcatagtgcttgtacctatggcaagagcattgacctagtcaaatttcttcttgatcagaatgtcataaacatcaaccaccaaggaagggatgggcacactggattacactctgcttgctaccacggtcacattcgcctggttcagttcttactggataatggagctgatatgaatctagtggcttgtgatcccagcaggtctagtggtgaaaaagatgagcagacatgtttgatgtgggcttatgaaaaagggcatgatgccattgtcacactcctgaagcattataagagaccacaagatgaattgccctgtaatgaatattctcagcctggaggagatggctcctatgtgtctgttccatcacccttggggaagattaaaagcatgacaaaagagaaggcagatattctcctcctaagagctggattgccttcacatttccatcttcagctctcagaaattgagttccatgagattattggctcaggttcttttgggaaagtatataaaggacgatgcagaaataaaatagtggctataaaacgttatcgagccaatacctactgctccaagtcagatgtggatatgttttgccgagaggtgtccattctctgccagctcaatcatccctgcgtaattcagtttgtgggtgcttgcttgaatgatcccagccagtttgccattgtcactcaatacatatcagggggttctctgttctccctccttcatgagcagaagaggattcttgatttgcagtctaaattaattattgcagtagatgttgccaaaggcatggagtaccttcacaacctgacacagccaattatacatcgtgacttgaacagtcacaatattcttctctatgaggatgggcatgctgtggtggcagattttggagaatcaagatttctacagtctctggatgaagacaacatgacaaaacaacctgggaacctccgttggatggctcctgaggtgttcacgcagtgcactcggtacaccatcaaagcagatgtcttcagctatgctctgtgtctgtgggaaattctcactggcgaaattccattcgctcatctcaagccagcggctgcggcagcagacatggcttaccaccacatcagacctcccattggctattccattcccaagcccatatcatctctgctgatacgagggtggaacgcatgtcctgaaggaagacccgaattttctgaagttgtcatgaagttagaagagtgtctctgcaacattgagctgatgtctcctgcatcaagtaacagcagtgggtctctctcaccttcttcttcttctgattgcctggtgaaccggggaggacctggccggagtcatgtggcagcattaagaagtcgtttcgaattggaatatgctctaaatgcaaggtcctatgctgctttgtcccaaagtgctggacaatattcctctcaaggtctgtctttggaggagatgaaaagaagtcttcaatacacacccattgacaaatatggctatgtatccgatcccatgagctcaatgcattttcattcttgccgaaatagtagcagctttgaggacagcagctgacagcattcggcgtatacctaaggagagttttttccccgaactgacagcaacgattccaaccacggcaagctggcttccaactataacattttactctcaaaggtctccttaaattgggcttgtttttacttgtcctatttaattccccactattagcaggctttggatttgtgcctaaggaataatatgcaaaagaaccaagacagaatgtatatgaagaattgtttttaattttgtaaattaaaaaaaaatttagatcgttacttggaaatggagcctaagtctgtggtggacagataataattatgttttcctgggctgaattatgtagacttgtgtttgacagctatgggtttatttcttagaacattgttcattttcttttctcattatgttacttctagtgttcacctctgtgattaaagattctttggtgaaatag

SEQ ID NO: 1753 - DNA, 1377 bp, Homo sapiens
gtgctgtgcggcgcggtctcagggaaggtggggctatggcagctgctagggaccctccggaagtatcgctgcgagaagccacccagcgaaaattgcggaggttttccgagctaagaggcaaacttgtagcacgtggagaattctgggacatagttgcaataacagcggctgatgaaaaacaggaacttgcttacaaccaacagctgtcagaaaagctgaaaagaaaggagttaccccttggagttcaatatcacgtttttgtggatcctgctggagccaaaattggaaatggaggatcaacactttgtgcccttcaatgtttggaaaagctatatggagataaatggaattcttttaccatcttattaattcactctgtatctttccagatataccagaatgctctggcaaaacatcctgtatcattcaaagcatactggattcaagatgttctgtggcacctggctcagttgtggagtattccagattggggcctgatgtttcagttggggaaaactgcattattagtggttcttacatcctaacaaaagctgccctccccgcacattcttttgtatgttccttaagcttaaagatgaatagatgcttaaagtatgcaactatggcatttggagtgcaagacaacttgaaaaagagtgtgaaaacattgtcagatataaagttacttcaattctttggagtctgtttcctgtcatgcttagatgtttggaatcttaaagttacagaggaactgttctctggtaacaagacatgtctgagtttgtggactgcacgcattttcccagtttgttcttctttgagtgactcagttataacatccctaaagatgttaaatgctgttaagaacaagtcagcattcagcctgaatagctataagttgctgtccattgaagaaatgcttatctacaaagatgtagaagatatgataacttacagggaacaaatttttctagaaatcagtttaaaaagcagtttgatgtagagatattttaaatattgtacactttgcctttttgagtaacattccagagataggtattttttgtaggctgtttcactgaactcagttaatgaaaactgtattaacataattgttgtagcataatattaatagtgcaaaagtacatataagtcattttgatgaaaaatattccaagactaagttgagaaaagagatactattttggatgtgtatcagtatttttgtttttaataatgattgatttgtggagcattgttttttcacataattagttttaaaggtaattttctaagcatacctttggaatttttccatcttttttgaggcttttggtccagtgaagttctaagtattcactggcacttctctcctca

SEQ ID NO: 1754 - DNA, 3224 bp, Homo sapiens
gcgtgctgtgcggcgcggtctcagggaaggtggggctatggcagctgctagggaccctccggaagtatcgctgcgagaagccacccagcgaaaattgcggaggttttccgagctaagaggcaaacttgtagcacgtggagaattctgggacatagttgcaataacagcggctgatgaaaaacaggaacttgcttacaaccaacagctgtcagaaaagctgaaaagaaaggagttaccccttggagttcaatatcacgtttttgtggatcctgctggagccaaaattggaaatggaggatcaacactttgtgcccttcaatgtttggaaaagctatatggagataaatggaattcttttaccatcttattaattcactctggtggctacagtcaacgacttccaaatgcaagtgctctgggaaaaattttcactgctttacctcttggtaaccccatttatcagatgctagaattaaaactagccatgtacattgatttccccttaaatatgaatcctggaattctggttacctgtgcagatgatattgaactttatagtattggagaatttgagtttattaggtttgacaaacctggctttactgctttagctcatccttctagtttgacgataggtaccacacatggagtatttgtcttagatccttttgatgatttaaaacatagagaccttgaatacaggtcttgccatcgtttccttcataagcccagcatagaaaagatgtatcagtttaatgctgtgtgtagacctggaaatttttgtcaacaggactttgctgggggtgacattgccgatcttaaattagactctgactatgtctacacagatagcctattttatatggatcataaatcagcaaaaatgttacttgctttttatgaaaaaataggcacactgagctgtgaaatagatgcctatggtgactttctgcaggctttgggacctggagcaactgtggagtacaccagaaacacatcaaatgtcattaaagaagagtcagagttggtagaaatgaggcagagaatatttcatcttcttaaaggaacatcactaaatgttgttgttcttaataactccaaattttatcacattggaacaaccgaagaatatttgttttactttacctcagataacagtttaaagtcagagctcggcttacagtccataacttttagtatctttccagatataccagaatgctctggcaaaacatcctgtatcattcaaagcatactggattcaagatgttctgtggcacctggctcagttgtggagtattccagattggggcctgatgtttcagttggggaaaactgcattattagtggttcttacatcctaacaaaagctgccctccccgcacattcttttgtatgttccttaagcttaaagatgaatagatgcttaaagtatgcaactatggcatttggagtgcaagacaacttgaaaaagagtgtgaaaacattgtcagatataaagttacttcaattctttggagtctgtttcctgtcatgcttagatgtttggaatcttaaagttacagaggaactgttctctggtaacaagacatgtctgagtttgtggactgcacgcattttcccagtttgttcttctttgagtgactcagttataacatccctaaagatgttaaatgctgttaagaacaagtcagcattcagcctgaatagctataagttgctgtccattgaagaaatgcttatctacaaagatgtagaagatatgataacttacagggaacaaatttttctagaaatcagtttaaaaagcagtttgatgtagagatattttaaatattgtacactttgcctttttgagtaacattccagagataggtattttttgtaggctgtttcactgaactcagttaatgaaaactgtattaacataattgttgtagcataatattaatagtgcaaaagtacatataagtcattttgatgaaaaatattccaagactaagttgagaaaagagatactattttggatgtgtatcagtatttttgtttttaataatgattgatttgtggagcattgttttttcacataattagttttaaaggtaattttctaagcatacctttggaatttttccatcttttttgaggcttttggtccagtgaagttctaagtattcactggcacttctctcctcaactgtaattctatttttaataataaaaatggcatactgtagggtcttcagagtagtgtaggaatactgtagaaatactttttcagaaacgaatccatagctgacaaattcactcagtgcccaatatattgtgattattttcgttgataaagaactagatacaaagacctctgaaattgatgataaaatttgtatctcattaattttatcaaaatgaaactaaaagtacatatgtattatacacttgaacatgtgtttgtatatctttaaaattttcctttatgttccattccataggaaaacacacatatgcacacaaaactcagttatctgtggggaaagtggtagtaataattgagattcatcaataatcatataatttcactatagacattacttgcattatctcctatcagtccttctaacaaaacttcaattaccagatgaactgactttagttttcatcttattttttgtccacatgctggtgatgctgagaaacaataattggcccaaatgcagacatcaagaagcaggcaggaaaatggaaaaactgagataatacacaggtgataaacagtttcgagaaaataaaaattggctagaatctcaagttatgtgtttctatattggtataagcatataagtgaaaagtcttataagtgtaatagagaaaagatttgtcagtgtgtttttttaaatgaaataactagtctgtgctactttatgtcaatataaaaattggtaaactagaagtaacttgtccacaaccctcagttatgatacttatgtgcgtgtttttttttccaaagtttttcccaaggagaagatacaaatatatggtagctattgtttaaaaatgattgatttacttgcagatttttcagaggatgttatgtctttgtcattcattaaatgttcaaaattgtagttttaccaaatctgaagtgccatcagttataagaatcaccattattttatgttccattaagaaaaacacaataaaacatgacactgctttttttgtta

SEQ ID NO: 1755 - DNA, 923 bp, Homo sapiens
gttttcatcctggttttgggacagcggcaatcatggcgccacctgtgagatactgcatccccggcgaacgtctgtgtaacttggaggagggcagcccgggcagcggcacctacacccgccacggctacatcttttcgtcgcttgccggctgtctgatgaagagcagcgagaatggcgcgcttccagtggtgtctgtagtgagagaaacagagtcccagttactgccagatgtgggagctattgtaacctgtaaggtctctagcatcaattcacgctttgccaaagtacacatcctgtatgtggggtccatgcctcttaagaactcttttcgaggaactatccgcaaggaagatgtccgagcaactgaaaaagacaaggttgaaatttataagagtttccgcccaggtgacattgtcttggccaaagtgatctccttaggtgatgcacagtccaactacctgctaaccaccgccgagaacgagctgggagtggtggtagcccacagtgagtcaggtatccagatggttcccatcagctggtgtgagatgcagtgccctaagacccacactaaagaattccggaaagtagcccgagtacaacccgaattcttgcagacctaagaagccactttttaccctatggaagggggtaagctgttcctgagtataacaccaagatgctgctgtctttattcaaacacctggcgtcggccaacagccacttccagaaaaatcttccagtttacgctgtagatggaacatgtttctgtgaacctatcagtggatttcattctcttgagtaataaatcttatcttttcaaggcaccaacaaacaaaactgtgatattggaaatagcctatccctcctgacagtccttataaatacatattttttgctatgataaaacttttttactaaaagga

SEQ ID NO: 1756 - DNA, 4069 bp, Homo sapiens
gagcaagaggaagatggccgtgccctgtttttcggtgtaaggcagcgacggcggctgcgacggcgagactgagatcctggtgtcgtgggcacctgagttctagcttcccccagcgagcgcgcgtcccttcgtgcctaggcgagagccggctcttccccgggagatgcgtttgtcccaggctcgggggctcagtgggagttcatgctgcgctggaggctcttggccaccgctctaatcgccttgtgccgccgcagcgccagctccgtcgccagcggtgagcctcccgattcccccccttgcccctggcggcggcgatgaccggggagaagatccgctcactgcggagggaccacaagcccagcaaagaagaaggggacctgctggagcccggggatgaggaagcggcggctgccctcggcggtacctttaccagaagcaggattggcaagggcggcaaagcttgtcataagatcttcagtaaccatcaccaccggctacagctgaaggcagctccggcctcctccaatccccccggcgccccggctctgccgctgcacaattcctccgtgactgccaactcccagtccccggcccttctggccggcaccaaccccgttgctgtcgtcgcggatggaggcagttgccccgcacactacccggtgcacgagtgcgtcttcaagggggatgtgaggagactctcctctctcatccgcacgcacaatatcgggcagaaagataatcacggaaatactcctttacaccttgctgtgatgttaggaaataaagaatgtgcccatttacttttggctcacaatgctccagtcaaggtgaaaaatgctcagggatggagccctctggcggaagccatcagctatggagataggcagatgattacagctcttttgaggaagcttaagcagcaatccagggaaagtgttgaagaaaaacgacctcgattattaaaagccctgaaagagctaggtgacttttatctagaacttcactgggattttcaaagctgggtgcctttactttcccgaattctgccttccgatgcatgtaaaatatacaaacaaggtatcaatatcaggcttgacacaactctcatagactttactgacatgaagtgccaacgaggggatctaagcttcattttcaatggggatgcggcgccctctgaatcttttgtagtattagacaatgaacaaaaagtttatcagcgaatacatcatgaggaatcagagatggaaacagaagaagaggtggatattttaatgagcagtgatatttactctgcaactttatcaacaaaatcaatttctttcacgcgtgcccagacaggatggctttttcgggaagataaaacagaaagagtaggaaactttttggcagacttttacctggtgaatggacttgttttagaatcaaggaaaagaagagaacatctcagtgaagaggatattcttcgaaataaggccatcatggagagtttgagtaaaggtggaaacataatggaacagaattttgagccgattcgaagacagtctcttacacctcctcctcagaacactattacatgggaagaatatatatctgctgaaaatggaaaagctcctcatctgggtagagaattggtgtgcaaagagagtaagaaaacgtttaaagctacgatagccatgagccaggaatttcccttagggatagagttattattgaatgttttagaagtagtagctcccttcaagcactttaacaagcttagagaatttgttcagatgaagcttcctccaggctttcctgtaaaattagatatacctgtgtttcccacaatcacagccactgtgacttttcaggagtttcgatacgatgaatttgatggctccatctttactatacctgatgactacaaggaagacccaagccgttttcctgatctttaactgacgtggaaaaggatgccgtctaaccaaggaaagaaaatacagagaccctagaagtggatccaaatagaagggacaaatgctttcagtgaagaaaagggaattacacattgaatcgacacatcagtaatacgatacagtgaaatgggcctctaataagaatttcagcgagttttctgatgtgccattttttgtctttttaaaaatatacatattataaatgtaatagtttgacacattaatgaccctaagacctgcgtatgtgaagcagctatgagtgctgtgatttgtttttaaaaatttttacacttcttgttgaaatatatatgcatataaatatatctatatctatatctatatctaaaacactcctggaccattaacgtaaattaaatgtcttaagagatatggagcccttttaaacttgtcatctttatgcaaggtgacatttataaatattccttcgagctttgttttcataaaatgtaaactatgtaacattatgtatagttcagtaatttgaatgtttgttcaatataatgaactagaaggaatgcaattttctgtagatgaatgaaccaaatggtaaccattaaacaattgcatttatatgttgcaatacatttcagaaggagcgttcactctgcagggaataaggtacctcctttagcaccttagtgcaattcattgtggtgctatttgtttttacctgaatgtttgttactaatcttcctttcatagaacctctattttttttttttctaaacttgagtttgagtccttgttatggtcatcataaggtaatggttagcatgtttaaagatattcctcttccaaatctcagcactttaaaaaaaaatccaaatttttaaacttgcttcctaataagtacacatcggtctgattattttgtttgtttttagtagaatatggatgcattggtgtcagttttaaaaaacaatacacatattttggacaaccctacatatttaatcctttcaaaataagataaaaacattttatatgctaacagaatatatttgttacaagttaaagtccagaagtatacacaagattgattactcctattattttttttaaatcacaggaaaatattgatttcattgtctccaaagtgataaaatcatgtattactcatttttgcacttaaaatttttcttatttattccaaggtggtttgaaggtccaagtatgaaaataaattagggggattaatgtataacagttataaagtatcatgttgtattaaagagcttacttagattgatgtttttaaaatgtatcctgatgaatgtctcaagaatgcatctgtcaagttttttagactgaccagtagcttaaacttttttcaggattttaggtaatttgaaaggagtttagagacccttattgaaaatatgatttaaaaatccaaagcataaaccgtaagaaaaattttaaataaacatctttaaagctgcatcttccatactgatacatgcattgcgtatgttgacattaaatacattttataatgaagaaaaataatcatagtaaaaaattgaaagacctaattactacgttacatggacctattgaattttgggggaacgtgttagtaaacccagactagctttgttgaatagaagttgatcgctgttatttaggaaatgggtagatcaaatgacttagagactgaattatcctatcagtggttacatggggttggagacactgaaaggcagtgatcactgttgcttctaggctcccttactttgtaggaatatggtatactttcaggaatatgctatatatgttttcataagtacagacaccttagggaagaaaaaaagtgggtaattgaagcttatggttgattaatttcctaacagcacagctatgaatattttgctggggtacactggaggtaggaagactactggaaatttttgcacttgaattttgtttttaaagcttttttctttaaagaatggtagaaacagattatccattccaaaatgtcttttctctgatcacaaagagcaaacaaatgtcaatatctcttatgatggtgaaaaaaaggaattaatcgatgcaaataaacttttcacagtattacttttaatgaa

SEQ ID NO: 1757 - DNA, 2651 bp, Homo sapiens
ggattccggctcccgcggctgcaggcgcgcggctagagtgcctggcgggctccggcttccgcgtccgccccggccccggtccagacttagtcttcagctccgcgcccgctccgccgcggcccaccgcgcccgccggcagccgagcccccagcgacgcccgcacagctccgggtgcccagacagggggccatgccgtgccggagggaggaggaagaggaagccggcgaggaggcggagggggaggaagaggaggaggacagcttcctcctactgcagcagtcagtggcgctgggcagctcgggcgaggtggaccggctggtggcccagatcggcgagacgctgcagctggacgcggcgcagcacagcccggcctcgccgtgcgggcccccgggggcgccgctgcgggccccggggcccctggctgcggcggtgccggcggacaaggccaggtccccggcggtgccgctgctgctgccgcccgcgttggcggagactgtgggcccggcgccccctggggtcctgcgctgcgccctgggggaccgcggccgcgtgcggggccgcgctgcgccctactgcgtggccgagctcgccacaggccccagcgcgctgtccccactgccccctcaggccgaccttgatgggcctccgggagctggcaagcagggcatcccgcagccgctgtcgggtccgtgccggcgaggatggctccggggcgccgccgcctcccgccgcctgcagcagcgacgcgggtcccaaccagaaacccgcacaggcgacgacgacccgcaccggcttctgcagcagctagtgctctctggaaacctcatcaaggaggccgtgcgaaggcttcattcgcgacggctgcagttacgtgcaaagcttccccaacgcccgctcctgggacctctgtcggccccggtgcatgaacccccttcgcctcgcagccctcgcgcggcctgcagtgaccctggcgcctccgggagggcgcagctcagaactggcgacggcgttcttgtgcctggcagctaacacgcccggggtggccacagcgccagcctcagactggagggcaaggggttcccttgagggctgcagttctactcaggctggtggagaactctggcttttggaagcgagagtaaaaagctaatgacgaggaaccgaaaaatcgcgagtgtttcgcgggtaactggggttgagggccaaaatatttggaatgaaggactttggccctatttaaggcagattttacagagcgcacctcaaacgtacaagtcagtaggactccttatttggcgtgacccgacctggccgcggagcctgcatttcctcgcagcctctcagtgccctccagccccgcgaccatgtggccacaatccacgcttctccggatcgcggtgcgccggaaccacggaggatgatgccagttacttgctttaccttttcagggctggctcctgatccactttgggggaggagaacatgagtagataatttcagggtgcagcccaatctgccagacttaaaaaaaccatcttgtgtctttggaggtgctgcttaataccaaacatgcggtgccatgaagggaccctttgggggttgaataggagttaacccctgcgctctctttgcaactgtctctcttctcagagtggtgggggaaggctgtacgacacgggtggggaaaggaggtgggggcggggagtattgaatggtggtggaagggtagagaggcgcggagtgaaccccacgccctgtctaaagtgtattttcagagccggcccgcctctcctcggttcaaggtcactgtttcctgggcacgcactgggttgcgggacagagtagccaggttctgccggtgctcggagaagagcgcagtgttttgcaagtgctggagtctcctgaggacacgcgcgtcgccgccaccgcgggtgtgggaaagcgcggacgtgctgggcggctgtgcttcggtaggcgaccaccgcccctggccgcgctccgggctttcacggaaactcccgagaccgggccctgggttcctcctctcctactcggctctgcagtcctactcaagcgggtggctctgggatcctgggggcctgggttgggggctagggagacgccatgtgatggacactccagggacacacagcctagcacagcagcttataatgggctctccggggccatttgcaataacagctgcaattccctggatagacgagttgatttcctccctctgcccctcccccagccatgccagctggcctttgtaagtgcaggaaaccgagtagaaaatgtgaccctccaaatggagaagctgcaggctttgccattgtgaaccatggtgaagtgcttggaacatactgttcactcactctaaaggcgctgagactgtgctgttgttctcgtttttatagtcaatggcttgttcatcatccagatgtggctactgacatatctacacttcgcaccggagtgtctggaattgtggctatcctgattataggattttaacttaactgaaatgcctgctttgaataaatgtgttgggttttttgtttggttttattttatacttgccatcagtgaaaaagatgtacagaacacatttctctgatctccataaacatgaaaacacttgaaatctc

SEQ ID NO: 1758 - DNA, 1931 bp, Homo sapiens
gtgcgacggtcacctcggtttgggtgagtccctgggttcgagcccgggccccgccagctgccgagttgcctctcggtgccggactgtgactccctctggccggccctgcactctggcctcctgggacgtcatctggagggatagagccaggcctgggactccttttgggagagtttccgttcttctattccgtgctgtccggccaggacccctcagggacttctgtggggcaggggcgaatcatgcatggcctagatgaccccatgcctagaaaaaggcagtgcggggcggtggcggcgcgcacggccgagtgaagcagatagcgtccccggggctggagcccggtagcagggccgggcgttgtggcgcgtgcctgtaatcccagctactcgggaggctgaggcaggagaatcgcttgaatccgggagatggaggttgcagtgagccgagatcatgccactgcactccagcctgggcaacaagagcgaaactctgtctcaaaaaaaaaacaacaacaacaaagaaaaaacaaaacgaaacagcaggaacccgccaagaacagccttgaaggaagggaagatggaagagttgagtcaggccctggctagtagcttttctgtgtctcaagatctgaacagcacagctgccccacacccccgcctatcccagtacaagtccaagtacagttccttggagcagagtgagcgccgccggaggttactggaactgcagaaatccaagcggctggattatgtgaaccatgccagaagactggctgaagatgactggacagggatggagagtgaggaagaaaataagaaagatgatgaagaaatggacattgacactgtcaagaagttaccaaaacactatgctaatcaattgatgctttctgagtggttaattgacgttccttcagatttggggcaggaatggattgtggtcgtgtgccctgttggaaaaagagcccttatcgtggcctccaggggttctaccagtgcctacaccaagagtggctactgtgtcaacaggttttcttcacttctgccaggaggcaacaggcgaaactcaacagcaaaagactacaccattctagattgcatttacaatgaggtaaaccagacctactacgttctggatgtgatgtgctggcggggacaccctttttatgattgccagactgatttccgattctactggatgcattcaaagttaccagaagaagaaggactgggagagaaaaccaagcttaatccttttaaatttgtggggctaaagaacttcccttgcactcccgaaagcctgtgtgatgtgctatctatggatttcccttttgaggtagatggacttctcttctaccacaaacagacccactacagccccggaagcactcccttggtgggctggctgcgcccctacatggtgtcagatgtccttggtgtagctgtgccggctggcccgctgaccaccaagccagactatgctgggcaccagctccagcagattatggagcacaagaagagccagaaggaaggcatgaaggagaaactcacacacaaggcctctgagaatgggcactatgaattggagcacctgtctactcccaagttgaagggttcttcccatagcccagaccaccctggatgcctcatggagaattaaagagagaagcctccttaaggagccacaggatggtacctggccccaaaaggaatcctggagaggaggacagtgacaacaggtgacttcattctttagagtgaactttccaaacccagtccagctggaaacagcttatctataatctgaaatgctggctcaaacagttatggggaggttcccagattgcgtagcattcagattgatttgagcagctcctactgtgataagtgtatcccagatccacaatgtaaatatatgtgatttgtaag

SEQ ID NO: 1759 - DNA, 2362 bp, Homo sapiens
cgcaggaagtggctccagggcgcacgcgcgttgtttccgcggtagtcagggcagtttctaccgcaggcttaaggaggcttcgggctcctgggatttctgtccgcgctcctggccctcgtccttcgcgccagagcaggttcaaaatgagcctgtttggaacaacctcaggttttggaaccagtgggaccagcatgtttggcagtgcaactacagacaatcacaatcccatgaaggatattgaagtaacatcatctcctgatgatagcattggttgtctgtcttttagcccaccaaccttgccggggaactttcttattgcaggatcatgggctaatgatgttcgctgctgggaagttcaagacagtggacagaccattccaaaagcccagcagatgcacactgggcctgtgcttgatgtctgctggagtgacgatgggagcaaagtgtttacggcatcgtgtgataaaactgccaaaatgtgggacctcagcagtaaccaagcgatacagatcgcacagcatgatgctcctgttaaaaccatccattggatcaaagctccaaactacagctgtgtgatgactgggagctgggataagactttaaagttttgggatactcgatcgtcaaatcctatgatggttttgcaactccctgaaaggtgttactgtgctgacgtgatataccccatggctgtggtggcaactgcagagaggggcctgattgtctatcagctagagaatcaaccttctgaattcaggaggatagaatctccactgaaacatcagcatcggtgtgtggctatttttaaagacaaacagaacaagcctactggttttgccctgggaagtatcgaggggagagttgctattcactatatcaaccccccgaaccccgccaaagataacttcacctttaaatgtcatcgatctaatggaaccaacacttcagctcctcaggacatttatgcggtaaatggaatcgcgttccatcctgttcatggcacccttgcaactgtgggatctgatggtagattcagcttctgggacaaagatgccagaacaaaactaaaaacttcggaacagttagatcagcccatctcagcttgctgtttcaatcacaatggaaacatatttgcatacgcttccagctacgactggtcaaagggacatgaattttataatccccagaaaaaaaattacattttcctgcgtaatgcagccgaagagctaaagcccaggaataagaagtagtggctggagactctggctcagccagagttgtttctctccactctgcctcatctctgtacgaatttgggtcccagccttgttgggttgtcagccatggacatggatttcaacccctggagaaaacgatgtcattgttcagcagctgagagcccaggcgtccgcggcgacttgccgtctctccattccactgcctgttgcagagtttttctgtaactaagggggttgaggttattgtagacgttagattgcgggcaccgccagggattttgcagcgcttcagtgtacgtgttagagaatattggaaaagcgtctgtgagccccgtgctgtattttgtaataaagtcttttgcagattgcttcccgagcttcctttgtccttttctccccttgcccaccccgtaacctcaggaacatgcgtcctgcccagcatcagcgtggggttttgagttgagatttcagacaccctctgggaaatgcggcaaccttaggggaaagggagtccccagctgcgctcacttctgctgcgcggaacggcagcctctgtgagccctggtgggcagagtttgaatgtgtttttccttgcttccctcattcccatcttcaaaatccccagtgctttctggccttgctgctcagatttccgagtgactcaaatggggactgttacttgtgctgggtgacaggccatttgtgggtaacctcctaaggcccaagtgggtgacacttgcgtgactttcaagttagaacccaagccccctgcatgggaattgccctgaactcttacccaccccggtcccctgcatgggaattgccctgaaccctcagtagtggttgtttggctgttcttttgtattttgtgtaatttaaaattcctggttggtaagtattcaaaatgaaattcagctgggctgagaaaaagtgtgacttttgggtctgtcactgtatttctcacctgtgatctcaaatgcttcttaggcctttctgtttggactaatgtgtgaagtctgacttgctgagtgtaaaattctagtatcgatagtgttgtaagatgtgtttgcctactcataaaaaacaatgaaaataaaattttctactggaagagaccacctgca

SEQ ID NO: 1760 - DNA, 3679 bp, Homo sapiens
tagtaacaagtgatgatctgcttccaatacctagtgatgcatatgatgtcttacttttgcccatgcaagctgtcagatgttcattatctgatattcctgatcatataccagaagaagtggtggtgtggtttcaggagactattttagataagtcattgaaggctttagttgtagcaaaagatccagatggaacactgattatagaactatatggtgacaatattcaaattagtgctagtattaataagaagttggggctacttagttacaaagatagaataagaaaaaaagaaagtgaagtcctctgttctacaactgaaactcttgaagaaaaaaatgagaatatgaagttgccatgtacagagtatttaagtaaatcagtagggtacaagttacctaataaagaaattttggaagagtcatataaacctcagatcaactcatcatacaaggaactcaaacttttacaaagtttaacaaaaacaaacttagtcactcaatatcaagactctgtgggaaataaaaatagtcaagtgtttccattaacaacagaaaagaaagaagaaatttctgctgagacacccttgaaaacagcaagagtagaagctactctttcagagagaaaaataggagattcatgtgacaaagatttgcctctgaaattttgtgagttcccacagaagactataatgcctggatttaaaacaactgtatatgtttctcatataaatgacctttcagacttttatgttcaactaatagaagatgaagctgaaattagtcatctttcagagagattaaacagtgttaaaacaaggcccgaatattatgtaggtccacctttgcaaagaggagatatgatatgtgctgttttcccagaagataatttatggtatcgtgctgtgatcaaggagcaacaacccaatgaccttctctctgtgcagtttatagattatggcaatgtttctgtggttcatactaacaaaataggtaggcttgaccttgttaatgcaatattgccggggttgtgcattcattgctccttgcagggatttgaggttcctgacaataaaaattctaagaaaatgatgcattacttttcccaacggaccagcgaggctgcaataagatgtgaatttgttaaatttcaagacagatgggaagttattcttgctgatgaacatgggatcatagcagatgatatgattagcaggtatgctctcagtgaaaaatctcaagtagaactttctacccaagtaattaaaagtgccagttcaaagtctgttaacaaatcagacattgacacttcagtatttcttaactggtataatccagaaaaaaaaatgataagagcttatgccactgtgatagatggacctgagtacttttggtgtcagtttgctgatacggagaaacttcagtgtttagaagtagaagtacagactgctggagaacaggtagcagacaggagaaattgtatcccatgtccttatattggagatccttgtatagtaagatacagagaagatggacattattatagggcacttatcactaatatttgtgaagattatcttgtatctgtcaggcttgtggactttggaaacattgaagactgtgtggacccaaaagcactctgggccattccttctgaacttctgtcggttcccatgcaagcctttccatgttgcctctcagggtttaacatttcagaaggattatgttctcaagagggaaatgactatttctatgaaataataacagaagatgtgttggaaataacaatactagaaatcagaagggatgtttgtgatatccctttagcaattgttgacttgaaaagcaaaggtaaaagtattaatgagaaaatggagaaatattctaagactggtattaaaagtgctcttccctatgaaaatattgactcagagataaagcagactcttgggtcctacaatcttgatgtaggacttaagaaattaagtaataaagctgtacaaaataaaatatatatggaacaacagacagatgagcttgctgaaataactgaaaaagatgtaaacattattggaaccaaaccaagtaacttccgtgaccctaaaactgataacatttgtgaagggtttgaaaacccctgcaaagataaaattgatactgaggaactggaaggtgaattagagtgccatctggttgacaaagcagagtttgatgataaatacctgattacaggatttaacacattactaccacatgctaatgaaacaaaggagatactagaactgaattcacttgaggtgccgctttctcctgatgatgaatcaaaagaattcttagaactggaatctattgagttacagaattctctggtggtggatgaagaaaaaggggagctaagcccggtgccaccgaatgtgccactctcccaagagtgtgtcacaaaaggcgccatggagctatttacactgcagcttcctctcagctgtgaagctgagaaacagccagaactagaactacctacagcccagctgcctttagatgacaagatggatcctttgtctttaggagttagtcagaaagcacaggaatccatgtgtactgaggacatgagaaagtcaagttgtgtagaatcttttgatgaccagcgcaggatgtcattgcatctacatggagcagattgtgatcctaaaacacagaatgaaatgaatatatgtgaagaagaatttgtagagtataaaaacagggatgccatttcggcattgatgcctttgttctctgaggaagaaagcagtgatggaagcaagcacaataatggtttaccagatcatatctcagctcaactacagaacacctacactctgaaagcctttactgttggatctaaatgtgttgtgtggtcaagtctaagaaacacatggtctaaatgtgagattttagaaacagctgaagaaggaacaagggttttgaacctttcaaatggtatggaggagatagtgaaccctgagaatgtctggaatggcatacccaaattggataagagtccacctgaggctgtatcccaaagagtagggaaagatctttacttcatgtcagtgggtgataccactattaaagaaaaggggtttggaggtgatggagatttaaccgtggatctatagctgtggccaatcagtcagaagctgcccttgaacaagtggcatcttacgcagaccaacagagtatttgagaaaattgaaaacatgtaaccacaagaagttgtcattttcaaaaacttctatataggtggaaaacaaattaggtctcaggttgatggtggggtgtgtttatagtgatcctgttatatatacagatctgggatctttcgtctttattgtcttacgtttctaattagttgggaggatttattttgctaaacagtttactaacacattacatttcaaaaactattttggtacctttcaaatacagtgtttaaattaaaatagaaaaataagggctcatgacaagtacattatttgattctacttaggatagctttttagcaggatctccttcagaatttttgtcttgactttgaatctttgcctgtttgtctaaacatttgactaacattctgtttgaatttggaagtattctaatacaagatttgaataaagtttatccttaaataaagtttatcctt

SEQ ID NO: 1761 - DNA, 2497 bp, Homo sapiens
aaggcggagcggtccctgcaacccggccggcgggaactgccttctagtttttagtctcagaccagaccaccgggcgcaccccgatgccgagcccgcagcttctggtgctcttcggcagccagacaggcacggctcaggatgtgtcggagagactgggtcgcgaggcccggcgccggcggcttggctgccgggtgcaggccctggactcctacccggtggtgaatctgattaacgagcccctggtgatatttgtttgtgcaactacaggccaaggagacccccctgacaacatgaagaacttctggaggtttatattccggaagaacctgccctccactgccctctgtcagatggactttgccgtcctgggcctcggggactcctcatacgccaagttcaacttcgtggccaagaagctgcaccgacggctactgcagcttgggggcagcgccctcctgcccgtgtgcctgggcgatgaccagcatgagctggggcccgacgctgctgtggacccctggctgcgagacttgtgggacagggttctggggctgtacccgccgcctccgggcctcactgagatccctcccggagtccccctgccctccaagttcaccctgctgttcctccaagaggcacccagcacgggctctgaggggcagcgggtagctcaccccggctctcaggagcccccgtcagagtcgaagcccttcctagcacccatgatctccaaccagagagtcaccggcccctcccacttccaggacgttcggctgattgagtttgacatcttgggctctggcatcagctttgctgctggtgatgtggtgctgattcagccctccaactcggctgcccatgtccagcggttctgccaggtgctgggcctggaccctgaccagctcttcatgctgcagccgcgggagccagatgtctcctcccccacgaggctgccccagccctgctccatgcggcacctcgtgtcccactacctggacatcgccagcgtgcctcgccgctccttcttcgaactcctggcctgtctatccctccatgagctggagcgggagaagctgctggagttcagttctgcccaaggccaggaggagctctttgaatactgcaaccggccccgcaggaccatcctggaggtgctctgtgacttcccgcacacagctgccgccatccctcccgactacctgttggacctcatccccgttatccggccgagggccttctccatcgcctcctcgctgctgactcacccctcacggctgcagatcctcgtggctgtagtgcagttccagactcgcctcaaggagccccgccggggcctctgctcctcctggctggcatccctggaccctgggcaaggacctgtccgggtgcccctctgggtgcggcctgggagtctggccttcccagagacaccagacacacctgtgatcatggtggggcctggcactggggtagcccccttccgagcagccatccaggagcgtgtggcccagggccagactggaaacttcttgttttttggctgccgctggcgggaccaagacttctactgggaggctgagtggcaggagctggagaagcgggactgtctgaccctcatccctgccttctcccgggaacagcccccagccctgttctctgccctacaggagcagaaagtatatgtgcagcaccggctccgggagctggggtcgcttgtgtgggaactgctggaccgccagggtgcatacttctacctggcaggcaacgccaagtccatgccagcggacgtctcggaagccctgatgtccatcttccaggaggagggtggactctgcagcccggacgcagccgcgtatctagccaggctccagcagacacggcgcttccagacagagacgtgggcctgaggcccgcggctgcccgtgccccctctgacagccatcctcctgggagcccaggaaggcatccacgagggagctcctggccagcagccgtcatcctctcggaccagccagctggtcctctgggaacagccagctcccgagcacagccgcactcctgttgaccctggatcccaccctttgagcctgaccccactgcagcctctgcccagccagccctgcgctcccccaccctgacagtgagctgtgtcctcgtccccccacccccttcccagtcaaggtggtggcctgggccgctccacctcaccggtgcagtgacccaggacggcatcagcagcccagtgagcaccaggggtggcatagggcacccatgaggctgcgctgcactcctctgccctggggccacctcggctgctgcagcctgcccagcagcacattccagtcactgcccccgcactcccacagggctcaggctgggctcagaggccactgagatgccagctccttgagagcagtgggggtgtcccaggccagagcagcctcttcctctcctggtcccagaaaaacccttgcagtaaatggtggcctctgggtggtta

SEQ ID NO: 1762 - DNA, 809 bp, Homo sapiens
cgcccgccatggccgagagcgactgggacacggtgacggtgctgcgcaagaagggccctacggccgcccaggccaaatccaagcaggctatcttagcggcacagagacgaggagaagatgtggagacttccaagaaatgggctgctggccagaacaaacaacattctattaccaagaacacggccaagctggaccgggagacagaggagctgcaccatgacagggtgaccctggaggtgggcaaggtgatccagcaaggtcggcagagcaaggggcttacgcagaaggacctggccacgaaaatcaatgagaagccacaggtgatcgcggactatgagagcggacgggccatacccaataaccaggtgcttggcaaaatcgagcgggccattggtgagtgtccctccacccttcgccgggtccgctgaacagggaggctacccgctcccagctggggttggtgagagtgggactcgggggaagaagatggccctgggggtcccctgttctctgaattctggagctttgcttctccaggtagtacagactgagggatggtggggtctctgcaggcctcaggaaacccctaagagcaagtggagtccgagtcccttccccttgccagttcccgtcagcctgtgctgttggcgatggttctctgagcctgagcacagcgggtccgggccctgtcagcatggggccggaagccagttccacagaggaccccggctccggttcttccggagaggggtgttcatgctctgctgtctaaggtgatcagactcatcctcttcaaaattagatgtggg

SEQ ID NO: 1763 - DNA, 790 bp, Homo sapiens
ccggacggacgctcgtcttcgcccgccatggccgagagcgactgggacacggtgacggtgctgcgcaagaagggccctacggccgcccaggccaaatccaagcaggctatcttagcggcacagagacgaggagaagatgtggagacttccaagaaatgggctgctggccagaacaaacaacattctattaccaagaacacggccaagctggaccgggagacagaggagctgcaccatgacagggtgaccctggaggtgggcaaggtgatccagcaaggtcggcagagcaaggggcttacgcagaaggacctggccacgaaaatcaatgagaagccacaggtgatcgcggactatgagagcggacgggccatacccaataaccaggtgcttggcaaaatcgagcgggccattgatgtgggaaccaggagtgctcgtgtgctgagagcccagtgaggcacgggagcggcgtggccccccttccctgggaagatgttgaagaggggcagcgttggggggaggagggagctggtgctgcagtggccagtggctgtggctcatttcaggcctcaagctccggggaaaggacattggaaagcccatcgagaaggggcctagggcgaaatgaacacaaagcctcgaaatcagtgcgctccagctgatctcgttccgccggttccccttggccgccagttccgttctcctcacgggccgaacggaacaaggggtccagcttgcgggggaccctccccagcccattcctgctgtcaaacaaacaaaaccttgcaaagcg

SEQ ID NO: 1764 - DNA, 510 bp, Homo sapiens
cacaacgttcccgtttgcttatagttgtcaacgaccatgatctctggacccacactacagtaacaagtttgtcagtcattttcagataaggtgcaaatcaagggatggctttgtccccacttcggcgcaggtgggacagacttggggaagacgcagctgaagagacaaattctcaggacatgggaaagcggaaccaccaaaaggagtgatgatcaacgatctcatgataaatctggatgctagttctcatgcctcaggacatcctactgggaacgacacaccagctcctgggatcagactttcatctacttaggacccctctttgcccagactactaaagccagtcttcactagccacgaatggctacccaaaggaaacacttggtgaaagattttaatccttacattacctgctatatctgtaaagggtatctgatcaagccaacaacagtgacggaatgcctccatacatctgcagaatcctactggatgtccacttggatgtcctga

SEQ ID NO: 1765 - DNA, 1979 bp, Homo sapiens
acatattcagcagggttagcttgtcctcccctccctcttcagcttcccagacactgagtctggaatgaaaattcacctgcctctgagttggctcctaatgggggtgggagtgttacttcggttcccaggttggaagattatctcacccggccccagctatataagctgaccggtgtggaggggcccagcagggccaactccagggattccttccacgacagaaaaacatacaagactccttcagccaacatgatggtactgaaagtagaggaactggtcactggaaagaagaatggcaatggggaggcaggggaattccttcctgaggatttcagagatggagagtatgaagctgctgttactttagagaagcaggaggatctgaagacacttctagcccaccctgtgaccctgggggagcaacagtggaaaagcgagaaacaacgagaggcagagctcaaaaagaaaaaactagaacaaagatcaaagcttgaaaatttagaagaccttgaaataatcattcaactgaagaaaaggaaaaaatacaggaaaactaaagttccagttgtaaaggaaccagaacctgaaatcattacggaacctgtggatgtgcctacgtttctgaaggctgctctggagaataaactgccagtagtagaaaaattcttgtcagacaagaacaatccagatgtttgtgatgagtataaacggacagctcttcatagagcatgcttggaaggacatttggcaattgtggagaagttaatggaagctggagcccagatcgaattccgtgatatgcttgaatccacagccatccactgggcaagccgtggaggaaacctggatgttttaaaattgttgctgaataaaggagcaaaaattagcgcccgagataagttgctcagcacagcgctgcatgtggcggtgaggactggccactatgagtgcgcggagcatcttatcgcctgtgaggcagacctcaacgccaaagacagagaaggagataccccgttgcatgatgcggtgagactgaaccgctataagatgatccgactcctgattatgtatggcgcggatctcaacatcaagaactgtgctgggaagacgccgatggatctggtgctacactggcagaatggaaccaaagcaatattcgacagcctcagagagaactcctacaagacctctcgcatagctacattctgaggcaaacgacagactcttaatcagtaaatgttcactggcattttgaaggcatggcccaagagaagagacactagccataaaatctagtttctatttatcaacgtgttgtgaagatgtacctaatgaagttttgagaaagcacagggttataggtgtttaaatttcctttagtgaaactcttatttatttttatgtattcctgtttatttatttactgccacgctactgatattcagaccttcatgatcatccatctggtgagcagagcttcatttgtatataacactttcagagccttcccacccataggtagttcttaaaccaggtgaaagagcaaagttcaagtgcctacttatgtgtcattcgctcatgtaagagtttttaagagagggctgattatcacagccctcttttctcctgaatttttaatgcagaagtttgaatgaagcaagggaaggcatgtagggacaggaaaggaaacaatggaaggaaagtgattctgtgaaaaggacagtgaagccagctattttacccccaggctggattttttttttttttttttttttttttttttaccgagtacacagagtacccaagtgaagagaacgtcatgagtgtaagtgcaaatcagtggaaggagcggcaaactgggacatgcagaattgaatttgctcaaaaaagatgaaaggaaatgcaaactgtaaatgtataaatgtatattgtattgtatgtacattttatattcataataaaggcaatcaaactctaaa

SEQ ID NO: 1766 - DNA, 2129 bp, Homo sapiens
cggcccaaggcgttcaggcacgcgctttcggtgctcggagcggaagcagcggcgagaggctcggaggcgcgggggcggccgagcggcgggcgacgggggcgggcgacgggggcgggcgacgcgggccgcggcacgggcggagccggggccatggagccgccgctgccgggctaggcaggtcgtgccccgccgggccggcggcgatgtcgggctaccagcgccgcccgggcgccaccccgctgtcccgagcccggagcctcgccattcccgacgatgacagatttgaagatctggaagaggcaaatccattctcttttagagagtttctgaagaccaagaacctcggcctctcgaaagaggatccggccagcagaatttatgcaaaggaagcctcgaggcattccctgggacttgaccacaactccccaccctcccaaaccggcgggtatggcctggagtatcagcagccatttttcgaggatccgacaggggctggtgacctcctggatgaggaggaggatgaggacaccggatggagtggggcctacctgccgtccgccatcgagcagactcaccccgagagggtccctgccggcacgtcgccctgcagcacatacctttcctttttctccaccccgtcggagctggcagggcctgagtctctgccctcgtgggcgttgagtgacactgattctcgcgtgtctccggcctctccggcagggagtcctagcgcagactttgcggttcatggagagtctctgggagacaggcacctgcggacgctgcagataagttacgacgcactgaaagatgaaaattctaagctgagaagaaagctgaatgaggttcagagcttctctgaagctcaaacagaaatggtgaggacgcttgagcggaagttagaagcaaaaatgatcaaggaggaaagcgactaccacgacctggagtcggtggttcagcaggtggagcagaacctggagctgatgaccaaacgggctgtaaaggcagaaaaccacgtcgtgaaactaaaacaggaaatcagtttgctccaggcgcaggtctccaacttccagcgagagaatgaagccctgcggtgcggccagggtgccagcctgaccgtggtgaagcagaacgccgacgtggccctgcagaacctccgggtggtcatgaacagtgcacaggcttccatcaagcaactggtttccggagctgagacactgaatcttgttgccgaaatccttaaatctatagacagaatttctgaagttaaagacgaggaggaagactcttgaggacccctgggtgttctcagcatgaagctccgtgtataccctgaggtcaccaccgctcgatctaaatgtgcagttgtgtccttaaatatgcagtcttcacccagagtaaagtgttgatcgcaagagtccagtgtcgtgccctcagccagttcttggccaccacaatgggagcagccctggccgagttgtctctgtggtttctatgcagcccttcttggcgaaattcctgcgatcttatagattctaatgagctcttggaagacattgtcataaaagccagtgattttaagaaaaagagtggttctggaatcaatgttttccagtcccatcccagaacatcagttgtaagataagtacaattggttgtccttgatttcataagtagaacaaacactaaatgtgcctctgagatggccaccccgggcagggacctgtgccttccgccgatgctcagggctccctctggctcccgggtcactcttgtggccccagtgggtggtccctgcagtcatggcctgagtgcgcaggggccaccgcgtggctgctgctgtcctcctccgggacccacggggaccaaggtcacacgttccgtgctgtgaagctgtccagatgtgcctctttggctgggggttctggtggacgtttcaagtggcattttgtacaatgcaggttagaattcaggaatttcaagtatgtgcccgggtctgtcaggtcccagttgcctttctgacggcccccctcagagggacggcgatgagcactaaatgcttttttgactattttcctatagattttttttaaaacttttttttcctcctgttccaattgatagctttc

SEQ ID NO: 1767 - DNA, 6419 bp, Homo sapiens
gaatttgaaaacggtaacatcgcagtgctgctcgcgggtctggctagtcaggcgaagtttgcagaatggaatctaattttaatcaagagggagtacctcgaccatcttatgtttttagtgctgacccaattgcaaggccttcagaaataaatttcgatggcattaagcttgatctgtctcatgaattttccttagttgctccaaatactgaggcaaacagtttcgaatctaaagattatctccaggtttgtcttcgaataagaccatttacacagtcagaaaaagaacttgagtctgagggctgtgtgcatattctggattcacagactgttgtgctgaaagagcctcaatgcatccttggtcggttaagtgaaaaaagctcagggcagatggcacagaaattcagtttttccaaggtttttggcccagcaactacacagaaggaattctttcagggttgcattatgcaaccagtaaaagacctcttgaaaggacagagtcgtctgatttttacttacgggctaaccaattcaggaaaaacatatacatttcaagggacagaagaaaatattggcattctgcctcgaactttgaatgtattatttgatagtcttcaagaaagactgtatacaaagatgaaccttaaaccacatagatccagagaatacttaaggttatcatcagaacaagagaaagaagaaattgctagcaaaagtgcattgcttcggcaaattaaagaggttactgtgcataatgatagtgatgatactctttatggaagtttaactaactctttgaatatctcagagtttgaagaatccataaaagattatgaacaagccaacttgaatatggctaatagtataaaattttctgtgtgggtttctttctttgaaatttacaatgaatatatttatgacttatttgttcctgtatcatctaaattccaaaagagaaagatgctgcgcctttcccaagacgtaaagggctattcttttataaaagatctacaatggattcaagtatctgattccaaagaagcctatagacttttaaaactaggaataaagcaccagagtgttgccttcacaaaattgaataatgcttccagtagaagtcacagcatattcactgttaaaatattacagattgaagattctgaaatgtctcgtgtaattcgagtcagtgaattatctttatgtgatcttgctggttcagaacgaactatgaagacacagaatgaaggtgaaaggttaagagagactgggaatatcaacacttctttattgactctgggaaagtgtattaacgtcttgaagaatagtgaaaagtcaaagtttcaacagcatgtgcctttccgggaaagtaaactgactcactattttcaaagtttttttaatggtaaagggaaaatttgtatgattgtcaatatcagccaatgttatttagcctatgatgaaacactcaatgtattgaagttctccgccattgcacaaaaagtttgtgtcccagacactttaaattcctctcaagagaaattatttggacctgtcaaatcttctcaagatgtatcactagacagtaattcaaacagtaaaatattaaatgtaaaaagagccaccatttcatgggaaaatagtctagaagatttgatggaagacgaggatttggttgaggagctagaaaacgctgaagaaactcaaaatgtggaaactaaacttcttgatgaagatctagataaaacattagaggaaaataaggctttcattagccacgaggagaaaagaaaactgttggacttaatagaagacttgaaaaaaaaactgataaatgaaaaaaaggaaaaattaaccttggaatttaaaattcgagaagaagttacacaggagtttactcagtattgggctcaacgggaagctgactttaaggagactctgcttcaagaacgagagatattagaagaaaatgctgaacgtcgtttggctatcttcaaggatttggttggtaaatgtgacactcgagaagaagcagcgaaagacatttgtgccacaaaagttgaaactgaagaaacacataattatgtaggatttgaagatattattgattctcttcaagataatgttgctgatattaagaaacaggctgaaattgctcacttatatattgcatctcttcctgacccccaggaagctactgcttgtttagaactaaagtttaatcaaattaaagctgaattagctaaaaccaaaggagaattaatcaaaaccaaagaagagttaaaaaagagagaaaatgaatcagattcattgattcaagagcttgagacatctaataagaaaataattacacagaatcaaagaattaaagaattgataaatataattgatcaaaaagaagatactatcaacgaatttcagaacctaaagtctcatatggaaaacacatttaaatgcaatgacaaggctgatacatcttctttaataataaacaataaattgatttgtaatgaaacagttgaagtacctaaggacagcaaatctaaaatctgttcagaaagaaaaagagtaaatgaaaatgaacttcagcaagatgaaccaccagcaaagaaagggtctatccatgttagttcagctatcactgaagaccaaaagaaaagtgaagaagtgcgaccgaacattgcagaaattgaagacatcagagttttacaagaaaataatgaaggactgagagcatttttactcactattgagaatgaacttaaaaatgaaaaggaagaaaaagcagaattaaataaacagattgttcattttcagcaggaactttctctttctgaaaaaaagaatttaactttaagtaaagaggtccaacaaattcagtcaaattatgatattgcaattgctgaattacatgtgcagaaaagtaaaaatcaagaacaggaggaaaagatcatgaaattgtcaaatgagatagaaactgctacaagaagcattacaaataatgtttcacaaataaaattaatgcacacgaaaatagacgaactacgtactcttgattcagtttctcagatttcaaacatagatttgctcaatctcagggatctgtcaaatggttctgaggaggataatttgccaaatacacagttagaccttttaggtaatgattatttggtaagtaagcaagttaaagaatatcgaattcaagaacccaatagggaaaattctttccactctagtattgaagctatttgggaagaatgtaaagagattgtgaaggcctcttccaaaaaaagtcatcagattgaggaactggaacaacaaattgaaaaattgcaggcagaagtaaaaggctataaggatgaaaacaatagactaaaggagaaggagcataaaaaccaagatgacctactaaaagaaaaagaaactcttatacagcagctgaaagaagaattgcaagaaaaaaatgttactcttgatgttcaaatacagcatgtagttgaaggaaagagagcgctttcagaacttacacaaggtgttacttgctataaggcaaaaataaaggaacttgaaacaattttagagactcagaaagttgaatgtagtcattcagccaagttagaacaagacattttggaaaaggaatctatcatcttaaagctagaaagaaatttgaaggaatttcaagaacatcttcaggattctgtcaaaaacaccaaagatttaaatgtaaaggaactcaagctgaaagaagaaatcacacagttaacaaataatttgcaagatatgaaacatttacttcaattaaaagaagaagaagaagaaaccaacaggcaagaaacagaaaaattgaaagaggaactctctgcaagctctgctcgtacccagaatctgaaagcagatcttcagaggaaggaagaagattatgctgacctgaaagagaaactgactgatgccaaaaagcagattaagcaagtacagaaagaggtatctgtaatgcgtgatgaggataaattactgaggattaaaattaatgaactggagaaaaagaaaaaccagtgttctcaggaattagatatgaaacagcgaaccattcagcaactcaaggagcagttaaataatcagaaagtggaagaagctatacaacagtatgagagagcatgcaaagatctaaatgttaaagagaaaataattgaagacatgcgaatgacactagaagaacaggaacaaactcaggtagaacaggatcaagtgcttgaggctaaattagaggaagttgaaaggctggccacagaattggaaaaatggaaggaaaaatgcaatgatttggaaaccaaaaacaatcaaaggtcaaataaagaacatgagaacaacacagatgtgcttggaaagctcactaatcttcaagatgagttacaggagtctgaacagaaatataatgctgatagaaagaaatggttagaagaaaaaatgatgcttatcactcaagcgaaagaagcagagaatatacgaaataaagagatgaaaaaatatgctgaggacagggagcgtttttttaagcaacagaatgaaatggaaatactgacagcccagctgacagagaaagatagtgaccttcaaaagtggcgagaagaacgagatcaactggttgcagctttagaaatacagctaaaagcactgatatccagtaatgtacagaaagataatgaaattgaacaactaaaaaggatcatatcagagacttctaaaatagaaacacaaatcatggatatcaagcccaaacgtattagttcagcagatcctgacaaacttcaaactgaacctctatcgacaagttttgaaatttccagaaataaaatagaggatggatctgtagtccttgactcttgtgaagtgtcaacagaaaatgatcaaagcactcgatttccaaaacctgagttagagattcaatttacacctttacagccaaacaaaatggcagtgaaacaccctggttgtaccacaccagtgacagttaagattcccaaggctcggaagaggaagagtaatgaaatggaggaggacttggtgaaatgtgaaaataagaagaatgctacacccagaactaatttgaaatttcctatttcagatgatagaaattcttctgtcaaaaaggaacaaaaggttgccatacgtccatcatctaagaaaacatattctttacggagtcaggcatccataattggtgtaaacctggccactaagaaaaaagaaggaacactacagaaatttggagacttcttacaacattctccctcaattcttcaatcaaaagcaaagaagataattgaaacaatgagctcttcaaagctctcaaatgtagaagcaagtaaagaaaatgtgtctcaaccaaaacgagccaaacggaaattatacacaagtgaaatttcatctcctattgatatatcaggccaagtgattttaatggaccagaaaatgaaggagagtgatcaccagattatcaaacgacgacttcgaacaaaaacagccaaataaatcacttatggaaatgtttaatataaattttatagtcatagtcattggaacttgcatcctgtattgtaaatataaatgtatatattatgcattaaatcactctgcatatagattgctgttttatacatagtataattttaattcaataaatgagtcaaaatttgtatatttttataaggcttttttataatagcttctttcaaactgtatttccctattatctcagacattggatcagtgaagatcctaggaaagaggctgttattctcatttattttgctatacaggatgtaataggtcaggtatttggtttacttatatttaacaatgtcttatgaattttttttactttatctgttatacaactgattttacatatctgtttggattatagctaggatttggagaataagtgtgtacagatcacaaaacatgtatatacattatttagaaaagatctcaagtctttaattagaatgtctcacttattttgtaaacattttgtgggtacatagtacatgtatatatttacggggtatgtgagatgttttgacacaggcatgcaatgtgaaatacgtgtatcatggagaatgaggtatccatcccctcaagcatttttcctttgaattacagataatccaattacattctttagatcatttaaaaatatacaagtaagttattattgattatagtcactctattgtgctatcagatagtagatcattctttttatcttatttgtttttgtacccattaaccatccccacctccccctgcaaccgtcagtacccttaccagccactggtaaccattcttctactctgtatgcccatgaggtcaattgattttatttttagatcccataaataaatgagaacatgcagtctt

SEQ ID NO: 1768 - DNA, 3130 bp, Homo sapiens
acttcctgccgggctgcgggcgcctgagcggctcttcagcgtttgcgccggcggctgccgcgtctctctcggctcccgcttcctttgaccgcctcccccccccggcccggcggcgcccgcctcctccacggccactccgcctcttccctcccttcgtcccttcttcctctcccttttttccttcttccttcccctcctcgccgccaccgcccaggaccgccggccgggggacgagctcggagcagcagccagaaagcataacccctactgtagaactaaatgcactgtgcatgaaacttggaaaaaaaccaatgtataagcctgttgacccttactctcggatgcagtccacctataactacaacatgagaggaggtgcttatcccccgaggtacttttacccatttccagttccacctttactttatcaagtggaactttctgtgggaggacagcaatttaatggcaaaggaaagacaagacaggctgcgaaacacgatgctgctgccaaagcgttgaggatcctgcagaatgagcccctgccagagaggctggaggtgaatggaagagaatccgaagaagaaaatctcaataaatctgaaataagtcaagtgtttgagattgcacttaaacggaacttgcctgtgaatttcgaggtggcccgggagagtggcccaccccacatgaagaactttgtgaccaaggtttcggttggggagtttgtgggggaaggtgaagggaaaagcaagaagatttcaaagaaaaatgccgccatagctgttcttgaggagctgaagaagttaccgcccctgcctgcagttgaacgagtaaagcctagaatcaaaaagaaaacaaaacccatagtcaagacaagcccagaatatggccaggggatcaatccgattagccgactggcccagatccagcaggcaaaaaaggagaaggagccagagtacacgctcctcacagagcgaggcctcccgcgccgcagggagtttgtgatgcaggtgaaggttggaaaccacactgcagaaggaacgggcaccaacaagaaggtggccaagcgcaatgcagccgagaacatgctggagatccttggtttcaaagtcccgcaggcgcagcccaccaaacccgcactcaagtcagaggagaagacacccataaagaaaccaggggatggaagaaaagtaaccttttttgaacctggctctggggatgaaaatgggactagtaataaagaggatgagttcaggatgccttatctaagtcatcagcagctgcctgctggaattcttcccatggtgcccgaggtcgcccaggctgtaggagttagtcaaggacatcacaccaaagattttaccagggcagctccgaatcctgccaaggccacggtaactgccatgatagcccgagagttgttgtatgggggcacctcgcccacagccgagaccattttaaagaataacatctcttcaggccacgtaccccatggacctctcacgagaccctctgagcaactggactatctttccagagtccagggattccaggttgaatacaaagacttccccaaaaacaacaagaacgaatttgtatctcttatcaattgctcctctcagccacctctgatcagccatggtatcggcaaggatgtggagtcctgccatgatatggctgcgctgaacatcttaaagttgctgtctgagttggaccaacaaagtacagagatgccaagaacaggaaacggaccaatgtctgtgtgtgggaggtgctgaaccttttctggccatgaaccattataaaatcccaacatatatactgaaaatactgaaactgctttgaaaatttggaatttctgatacctccagtgggccgagagacacggtgggtaaaggatgtgggcagcagcagggaagacaacagaaacacaaggaggcggctgtggccgggctggactgtgctggggtttgttgtgatggccactcggtgacctggcggtccctacgcaatagcagctgcctgtggggaagaagggctgcccagccagctggttctcccgggacaccagcagatccacaccctgggcacctccgtgtttggtcttttttttcccctgtgtgaaagaagaaacggcacgaccccttctcaagctggctcactcagacacattgggacaaaccctggacagccatgccagagagaggcctttgaccggccccagagctaaaagcaccagagaaaatcaaatgcttcctactcagcgtgacccaacttttctagtgtgccacggccccaccacctcctgcagtacccacaccatcaccactgctttctcttccaacagtgatctgtattcttagtttcattattttcttttgattgatatgacactatataaaattttcatttgagaatttctcaattgtatctagttaaatagcacagtttggaaacttgtctgagactgactttatcaataatctaaccgacaaagatcatatccatgtgtatgtggttagacatttttatttcattgactaacccaggacagtttcagtgatgcaaattgtgtgccctctggttcagctgaaacagtcctggactttcaaaaaccttgaataagtctcccacagttgtataaattggacaatttaggaattttaaactttagatgatcatttggttccatttttatttcatttttatttttgttaatgcaaacaggacttaaatgaactttgatctctgttttaaagattattaaaaaacattgtgtatctatacatatggctcttgaggacttagctttcactacactacaggatatgatctccatgtagtccatataaacctgcagagtgattttccagagtgctcgatactgttaattacatctccattagggctgaaaagaatgacctacgtttctgtatacagctgtgttgcttttgatgttgtgttactgtacacagaagtgtgtgcactgaggctctgcgtgtggtccgtatggaaagcctggtagccctgcgagttaagtactgcttccattcattgtttacgctggaatttttctccccatggaatgtaagtaaaacttaagtgtttgtcatcaataaatggtaatactaaa

SEQ ID NO: 1769 - DNA, 3154 bp, Homo sapiens
acttcctgccgggctgcgggcgcctgagcggctcttcagcgtttgcgccggcggctgccgcgtctctctcggctcccgcttcctttgaccgcctcccccccccggcccggcggcgcccgcctcctccacggccactccgcctcttccctcccttcgtcccttcttcctctcccttttttccttcttccttcccctcctcgccgccaccgcccaggaccgccggccgggggacgagctcggagcagcagccagaaagcataacccctactgtagaactaaatgcactgtgcatgaaacttggaaaaaaaccaatgtataagcctgttgacccttactctcggatgcagtccacctataactacaacatgagaggaggtgcttatcccccgaggtacttttacccatttccagttccacctttactttatcaagtggaactttctgtgggaggacagcaatttaatggcaaaggaaagacaagacaggctgcgaaacacgatgctgctgccaaagcgttgaggatcctgcagaatgagcccctgccagagaggctggaggtgaatggaagagaatccgaagaagaaaatctcaataaatctgaaataagtcaagtgtttgagattgcacttaaacggaacttgcctgtgaatttcgagtctttccctctgaaacaggtggcccgggagagtggcccaccccacatgaagaactttgtgaccaaggtttcggttggggagtttgtgggggaaggtgaagggaaaagcaagaagatttcaaagaaaaatgccgccatagctgttcttgaggagctgaagaagttaccgcccctgcctgcagttgaacgagtaaagcctagaatcaaaaagaaaacaaaacccatagtcaagccacagacaagcccagaatatggccaggggatcaatccgattagccgactggcccagatccagcaggcaaaaaaggagaaggagccagagtacacgctcctcacagagcgaggcctcccgcgccgcagggagtttgtgatgcaggtgaaggttggaaaccacactgcagaaggaacgggcaccaacaagaaggtggccaagcgcaatgcagccgagaacatgctggagatccttggtttcaaagtcccgcaggcgcagcccaccaaacccgcactcaagtcagaggagaagacacccataaagaaaccaggggatggaagaaaagtaaccttttttgaacctggctctggggatgaaaatgggactagtaataaagaggatgagttcaggatgccttatctaagtcatcagcagctgcctgctggaattcttcccatggtgcccgaggtcgcccaggctgtaggagttagtcaaggacatcacaccaaagattttaccagggcagctccgaatcctgccaaggccacggtaactgccatgatagcccgagagttgttgtatgggggcacctcgcccacagccgagaccattttaaagaataacatctcttcaggccacgtaccccatggacctctcacgagaccctctgagcaactggactatctttccagagtccagggattccaggttgaatacaaagacttccccaaaaacaacaagaacgaatttgtatctcttatcaattgctcctctcagccacctctgatcagccatggtatcggcaaggatgtggagtcctgccatgatatggctgcgctgaacatcttaaagttgctgtctgagttggaccaacaaagtacagagatgccaagaacaggaaacggaccaatgtctgtgtgtgggaggtgctgaaccttttctggccatgaaccattataaaatcccaacatatatactgaaaatactgaaactgctttgaaaatttggaatttctgatacctccagtgggccgagagacacggtgggtaaaggatgtgggcagcagcagggaagacaacagaaacacaaggaggcggctgtggccgggctggactgtgctggggtttgttgtgatggccactcggtgacctggcggtccctacgcaatagcagctgcctgtggggaagaagggctgcccagccagctggttctcccgggacaccagcagatccacaccctgggcacctccgtgtttggtcttttttttcccctgtgtgaaagaagaaacggcacgaccccttctcaagctggctcactcagacacattgggacaaaccctggacagccatgccagagagaggcctttgaccggccccagagctaaaagcaccagagaaaatcaaatgcttcctactcagcgtgacccaacttttctagtgtgccacggccccaccacctcctgcagtacccacaccatcaccactgctttctcttccaacagtgatctgtattcttagtttcattattttcttttgattgatatgacactatataaaattttcatttgagaatttctcaattgtatctagttaaatagcacagtttggaaacttgtctgagactgactttatcaataatctaaccgacaaagatcatatccatgtgtatgtggttagacatttttatttcattgactaacccaggacagtttcagtgatgcaaattgtgtgccctctggttcagctgaaacagtcctggactttcaaaaaccttgaataagtctcccacagttgtataaattggacaatttaggaattttaaactttagatgatcatttggttccatttttatttcatttttatttttgttaatgcaaacaggacttaaatgaactttgatctctgttttaaagattattaaaaaacattgtgtatctatacatatggctcttgaggacttagctttcactacactacaggatatgatctccatgtagtccatataaacctgcagagtgattttccagagtgctcgatactgttaattacatctccattagggctgaaaagaatgacctacgtttctgtatacagctgtgttgcttttgatgttgtgttactgtacacagaagtgtgtgcactgaggctctgcgtgtggtccgtatggaaagcctggtagccctgcgagttaagtactgcttccattcattgtttacgctggaatttttctccccatggaatgtaagtaaaacttaagtgtttgtcatcaataaatggtaatactaaa

SEQ ID NO: 1770 - DNA, 3332 bp, Homo sapiens
acttcctgccgggctgcgggcgcctgagcggctcttcagcgtttgcgccggcggctgccgcgtctctctcggctcccgcttcctttgaccgcctcccccccccggcccggcggcgcccgcctcctccacggccactccgcctcttccctcccttcgtcccttcttcctctcccttttttccttcttccttcccctcctcgccgccaccgcccaggaccgccggccgggggacgagctcggagcagcagccagacggagtctcgctcttttgccaggctggagtgcagtggcgcgatcctgagtcactgcaacctccacctcccaggttcaagcgattctcctgcttcagcctgccaagtagctgggactacagagtttattaaccacttaacctctcagaactgaacaaagacaacattgttcctggaacgccctctttttaaaaaagaaagcataacccctactgtagaactaaatgcactgtgcatgaaacttggaaaaaaaccaatgtataagcctgttgacccttactctcggatgcagtccacctataactacaacatgagaggaggtgcttatcccccgaggtacttttacccatttccagttccacctttactttatcaagtggaactttctgtgggaggacagcaatttaatggcaaaggaaagacaagacaggctgcgaaacacgatgctgctgccaaagcgttgaggatcctgcagaatgagcccctgccagagaggctggaggtgaatggaagagaatccgaagaagaaaatctcaataaatctgaaataagtcaagtgtttgagattgcacttaaacggaacttgcctgtgaatttcgaggtggcccgggagagtggcccaccccacatgaagaactttgtgaccaaggtttcggttggggagtttgtgggggaaggtgaagggaaaagcaagaagatttcaaagaaaaatgccgccatagctgttcttgaggagctgaagaagttaccgcccctgcctgcagttgaacgagtaaagcctagaatcaaaaagaaaacaaaacccatagtcaagccacagacaagcccagaatatggccaggggatcaatccgattagccgactggcccagatccagcaggcaaaaaaggagaaggagccagagtacacgctcctcacagagcgaggcctcccgcgccgcagggagtttgtgatgcaggtgaaggttggaaaccacactgcagaaggaacgggcaccaacaagaaggtggccaagcgcaatgcagccgagaacatgctggagatccttggtttcaaagtcccgcaggcgcagcccaccaaacccgcactcaagtcagaggagaagacacccataaagaaaccaggggatggaagaaaagtaaccttttttgaacctggctctggggatgaaaatgggactagtaataaagaggatgagttcaggatgccttatctaagtcatcagcagctgcctgctggaattcttcccatggtgcccgaggtcgcccaggctgtaggagttagtcaaggacatcacaccaaagattttaccagggcagctccgaatcctgccaaggccacggtaactgccatgatagcccgagagttgttgtatgggggcacctcgcccacagccgagaccattttaaagaataacatctcttcaggccacgtaccccatggacctctcacgagaccctctgagcaactggactatctttccagagtccagggattccaggttgaatacaaagacttccccaaaaacaacaagaacgaatttgtatctcttatcaattgctcctctcagccacctctgatcagccatggtatcggcaaggatgtggagtcctgccatgatatggctgcgctgaacatcttaaagttgctgtctgagttggaccaacaaagtacagagatgccaagaacaggaaacggaccaatgtctgtgtgtgggaggtgctgaaccttttctggccatgaaccattataaaatcccaacatatatactgaaaatactgaaactgctttgaaaatttggaatttctgatacctccagtgggccgagagacacggtgggtaaaggatgtgggcagcagcagggaagacaacagaaacacaaggaggcggctgtggccgggctggactgtgctggggtttgttgtgatggccactcggtgacctggcggtccctacgcaatagcagctgcctgtggggaagaagggctgcccagccagctggttctcccgggacaccagcagatccacaccctgggcacctccgtgtttggtcttttttttcccctgtgtgaaagaagaaacggcacgaccccttctcaagctggctcactcagacacattgggacaaaccctggacagccatgccagagagaggcctttgaccggccccagagctaaaagcaccagagaaaatcaaatgcttcctactcagcgtgacccaacttttctagtgtgccacggccccaccacctcctgcagtacccacaccatcaccactgctttctcttccaacagtgatctgtattcttagtttcattattttcttttgattgatatgacactatataaaattttcatttgagaatttctcaattgtatctagttaaatagcacagtttggaaacttgtctgagactgactttatcaataatctaaccgacaaagatcatatccatgtgtatgtggttagacatttttatttcattgactaacccaggacagtttcagtgatgcaaattgtgtgccctctggttcagctgaaacagtcctggactttcaaaaaccttgaataagtctcccacagttgtataaattggacaatttaggaattttaaactttagatgatcatttggttccatttttatttcatttttatttttgttaatgcaaacaggacttaaatgaactttgatctctgttttaaagattattaaaaaacattgtgtatctatacatatggctcttgaggacttagctttcactacactacaggatatgatctccatgtagtccatataaacctgcagagtgattttccagagtgctcgatactgttaattacatctccattagggctgaaaagaatgacctacgtttctgtatacagctgtgttgcttttgatgttgtgttactgtacacagaagtgtgtgcactgaggctctgcgtgtggtccgtatggaaagcctggtagccctgcgagttaagtactgcttccattcattgtttacgctggaatttttctccccatggaatgtaagtaaaacttaagtgtttgtcatcaataaatggtaatactaaa

SEQ ID NO: 1771 - DNA, 2455 bp, Homo sapiens
tttcctttcccctttcataaaagcacagacctaacagcaccctgggtggaaacctcttcagcatttgcttggaatcagtaagctaaaaacaaaatcaaccgggaccccagcttttcagaactgcagggaaacagccatcatgagtgaggtcaccaagaattccctggagaaaatccttccacagctgaaatgccatttcacctggaacttattcaaggaagacagtgtctcaagggatctagaagatagagtgtgtaaccagattgaatttttaaacactgagttcaaagctacaatgtacaacttgttggcctacataaaacacctagatggtaacaacgaggcagccctggaatgcttacggcaagctgaagagttaatccagcaagaacatgctgaccaagcagaaatcagaagtctagtcacttggggaaactacgcctgggtctactatcacttgggcagactctcagatgctcagatttatgtagataaggtgaaacaaacctgcaagaaattttcaaatccatacagtattgagtattctgaacttgactgtgaggaagggtggacacaactgaagtgtggaagaaatgaaagggcgaaggtgtgttttgagaaggctctggaagaaaagcccaacaacccagaattctcctctggactggcaattgcgatgtaccatctggataatcacccagagaaacagttctctactgatgttttgaagcaggccattgagctgagtcctgataaccaatacgtcaaggttctcttgggcctgaaactgcagaagatgaataaagaagctgaaggagagcagtttgttgaagaagccttggaaaagtctccttgccaaacagatgtcctccgcagtgcagccaaattttacagaagaaaaggtgacctagacaaagctattgaactgtttcaacgggtgttggaatccacaccaaacaatggctacctctatcaccagattgggtgctgctacaaggcaaaagtaagacaaatgcagaatacaggagaatctgaagctagtggaaataaagagatgattgaagcactaaagcaatatgctatggactattcgaataaagctcttgagaagggactgaatcctctgaatgcatactccgatctcgctgagttcctggagacggaatgttatcagacaccattcaataaggaagtccctgatgctgaaaagcaacaatcccatcagcgctactgcaaccttcagaaatataatgggaagtctgaagacactgctgtgcaacatggtttagagggtttgtccataagcaaaaaatcaactgacaaggaagagatcaaagaccaaccacagaatgtatctgaaaatctgcttccacaaaatgcaccaaattattggtatcttcaaggattaattcataagcagaatggagatctgctgcaagcagccaaatgttatgagaaggaactgggccgcctgctaagggatgccccttcaggcataggcagtattttcctgtcagcatctgagcttgaggatggtagtgaggaaatgggccagggcgcagtcagctccagtcccagagagctcctctctaactcagagcaactgaactgagacagaggaggaaaacagagcatcagaagcctgcagtggtggttgtgacgggtaggacgataggaagacagggggccccaacctgggattgctgagcagggaagctttgcatgttgctctaaggtacatttttaaagagttgttttttggccgggcgcagtggctcatgcctgtaatcccagcactttgggaggccgaggtgggcggatcacgaggtctggagtttgagaccatcctggctaacacagtgaaatcccgtctctactaaaaatacaaaaaattagccaggcgtggtggctggcacctgtagtcccagctacttgggaggctgaggcaggagaatggcgtgaacctggaaggaagaggttgcagtgagccaagattgcgcccctgcactccagcctgggcaacagagcaagactccatctcaaaaaaaaaaaaaaaaaaaaaaaagagttgttttctcatgttcattatagttcattacagttacatagtccgaaggtcttacaactaatcactggtagcaataaatgcttcaggcccacatgatgctgattagttctcagttttcattcagttcacaatataaccaccattcctgccctccctgccaagggtcataaatggtgactgcctaacaacaaaatttgcagtctcatctcattttcatccagacttctggaactcaaagattaacttttgactaaccctggaatatctcttatctcacttatagcttcaggcatgtatttatatgtattcttgatagcaataccataatcaatgtgtattcctgatagtaatgctacaataaatccaaacatttcaactctgttagaa

SEQ ID NO: 1772 - DNA, 2496 bp, Homo sapiens
cttccttcccctaaaagcaattactcaaaaacggagaaaacatcagctgatgcgtgccctactctcccacccctttatatagttccttcagtatttacttgaggcagacaggaagacttctgaagaacaaatcagcctggtcaccagcttttcggaacagcagagacacagagggcagtcatgagtgaggtcaccaagaattccctggagaaaatccttccacagctgaaatgccatttcacctggaacttattcaaggaagacagtgtctcaagggatctagaagatagagtgtgtaaccagattgaatttttaaacactgagttcaaagctacaatgtacaacttgttggcctacataaaacacctagatggtaacaacgaggcagccctggaatgcttacggcaagctgaagagttaatccagcaagaacatgctgaccaagcagaaatcagaagtctagtcacttggggaaactacgcctgggtctactatcacttgggcagactctcagatgctcagatttatgtagataaggtgaaacaaacctgcaagaaattttcaaatccatacagtattgagtattctgaacttgactgtgaggaagggtggacacaactgaagtgtggaagaaatgaaagggcgaaggtgtgttttgagaaggctctggaagaaaagcccaacaacccagaattctcctctggactggcaattgcgatgtaccatctggataatcacccagagaaacagttctctactgatgttttgaagcaggccattgagctgagtcctgataaccaatacgtcaaggttctcttgggcctgaaactgcagaagatgaataaagaagctgaaggagagcagtttgttgaagaagccttggaaaagtctccttgccaaacagatgtcctccgcagtgcagccaaattttacagaagaaaaggtgacctagacaaagctattgaactgtttcaacgggtgttggaatccacaccaaacaatggctacctctatcaccagattgggtgctgctacaaggcaaaagtaagacaaatgcagaatacaggagaatctgaagctagtggaaataaagagatgattgaagcactaaagcaatatgctatggactattcgaataaagctcttgagaagggactgaatcctctgaatgcatactccgatctcgctgagttcctggagacggaatgttatcagacaccattcaataaggaagtccctgatgctgaaaagcaacaatcccatcagcgctactgcaaccttcagaaatataatgggaagtctgaagacactgctgtgcaacatggtttagagggtttgtccataagcaaaaaatcaactgacaaggaagagatcaaagaccaaccacagaatgtatctgaaaatctgcttccacaaaatgcaccaaattattggtatcttcaaggattaattcataagcagaatggagatctgctgcaagcagccaaatgttatgagaaggaactgggccgcctgctaagggatgccccttcaggcataggcagtattttcctgtcagcatctgagcttgaggatggtagtgaggaaatgggccagggcgcagtcagctccagtcccagagagctcctctctaactcagagcaactgaactgagacagaggaggaaaacagagcatcagaagcctgcagtggtggttgtgacgggtaggacgataggaagacagggggccccaacctgggattgctgagcagggaagctttgcatgttgctctaaggtacatttttaaagagttgttttttggccgggcgcagtggctcatgcctgtaatcccagcactttgggaggccgaggtgggcggatcacgaggtctggagtttgagaccatcctggctaacacagtgaaatcccgtctctactaaaaatacaaaaaattagccaggcgtggtggctggcacctgtagtcccagctacttgggaggctgaggcaggagaatggcgtgaacctggaaggaagaggttgcagtgagccaagattgcgcccctgcactccagcctgggcaacagagcaagactccatctcaaaaaaaaaaaaaaaaaaaaaaaagagttgttttctcatgttcattatagttcattacagttacatagtccgaaggtcttacaactaatcactggtagcaataaatgcttcaggcccacatgatgctgattagttctcagttttcattcagttcacaatataaccaccattcctgccctccctgccaagggtcataaatggtgactgcctaacaacaaaatttgcagtctcatctcattttcatccagacttctggaactcaaagattaacttttgactaaccctggaatatctcttatctcacttatagcttcaggcatgtatttatatgtattcttgatagcaataccataatcaatgtgtattcctgatagtaatgctacaataaatccaaacatttcaactctgttagaa

SEQ ID NO: 1773 - DNA, 3534 bp, Homo sapiens
acttcctgccgggctgcgggcgcctgagcggctcttcagcgtttgcgccggcggctgccgcgtctctctcggctcccgcttcctttgaccgcctcccccccccggcccggcggcgcccgcctcctccacggccactccgcctcttccctcccttcgtcccttcttcctctcccttttttccttcttccttcccctcctcgccgccaccgcccaggaccgccggccgggggacgagctcggagcagcagccaggtggagttttgctcttgtcgcccaggctggagtgcagtggcgtgatctcggctcactgcaacctccacctcccaggttcaagcgattttcccacttcagcctcccgataagctgagattacagagtttattaaccacttaacctctcagaactgaacaaagacaacattgttcctggaacgccctctttttaaaaaagaaagcataacccctactgtagaactaaatgcactgtgcatgaaacttggaaaaaaaccaatgtataagcctgttgacccttactctcggatgcagtccacctataactacaacatgagaggaggtgcttatcccccgaggtacttttacccatttccagttccacctttactttatcaagtggaactttctgtgggaggacagcaatttaatggcaaaggaaagacaagacaggctgcgaaacacgatgctgctgccaaagcgttgaggatcctgcagaatgagcccctgccagagaggctggaggtgaatggaagagaatccgaagaagaaaatctcaataaatctgaaataagtcaagtgtttgagattgcacttaaacggaacttgcctgtgaatttcgagtctttccctctgaaacaggtggcccgggagagtggcccaccccacatgaagaactttgtgaccaaggtttcggttggggagtttgtgggggaaggtgaagggaaaagcaagaagatttcaaagaaaaatgccgccatagctgttcttgaggagctgaagaagttaccgcccctgcctgcagttgaacgagtaaagcctagaatcaaaaagaaaacaaaacccatagtcaagccacagacaagcccagaatatggccaggggatcaatccgattagccgactggcccagatccagcaggcaaaaaaggagaaggagccagagtacacgctcctcacagagcgaggcctcccgcgccgcagggagtttgtgatgcaggtgaaggttggaaaccacactgcagaaggaacgggcaccaacaagaaggtggccaagcgcaatgcagccgagaacatgctggagatccttggtttcaaagtcccgcaggcgcagcccaccaaacccgcactcaagtcagaggagaagacacccataaagaaaccaggggatggaagaaaagtaaccttttttgaacctggctctggggatgaaaatgggactagtaataaagaggatgagttcaggatgccttatctaagtcatcagcagctgcctgctggaattcttcccatggtgcccgaggtcgcccaggctgtaggagttagtcaaggacatcacaccaaagattttaccagggcagctccgaatcctgccaaggccacggtaactgccatgatagcccgagagttgttgtatgggggcacctcgcccacagccgagaccattttaaagaataacatctcttcaggccacgtaccccatggacctctcacgagaccctctgagcaactggactatctttccagagtccagggattccaggttgaatacaaagacttccccaaaaacaacaagaacgaatttgtatctcttatcaattgctcctctcagccacctctgatcagccatggtatcggcaaggatgtggagtcctgccatgatatggctgcgctgaacatcttaaagttgctgtctgagttggaccaacaaagtacagagatgccaagaacaggaaacggaccaatgtctgtgtgtgggaggtgctgaaccttttctggccatgaaccattataaaatcccaacatatatactgaaaatactgaaactgctttgaaaatttggaatttctgatacctccagtgggccgagagacacggtgggtaaaggatgtgggcagcagcagggaagacaacagaaacacaaggaggcggctgtggccgggctggactgtgctggggtttgttgtgatggccactcggtgacctggcggtccctacgcaatagcagctgcctgtggggaagaagggctgcccagccagctggttctcccgggacaccagcagatccacaccctgggcacctccgtgtttggtcttttttttcccctgtgtgaaagaagaaacggcacgaccccttctcaagctggctcactcagacacattgggacaaaccctggacagccatgccagagagaggcctttgaccggccccagagctaaaagcaccagagaaaatcaaatgcttcctactcagcgtgacccaacttttctagtgtgccacggccccaccacctcctgcagtacccacaccatcaccactgctttctcttccaacagtgatctgtattcttagtttcattattttcttttgattgatatgacactatataaaattttcatttgagaatttctcaattgtatctagttaaatagcacagtttggaaacttgtctgagactgactttatcaataatctaaccgacaaagatcatatccatgtgtatgtggttagacatttttatttcattgactaacccaggacagtttcagtgatgcaaattgtgtgccctctggttcagctgaaacagtcctggactttcaaaaaccttgaataagtctcccacagttgtataaattggacaatttaggaattttaaactttagatgatcatttggttccatttttatttcatttttatttttgttaatgcaaacaggacttaaatgaactttgatctctgttttaaagattattaaaaaacattgtgtatctatacatatggctcttgaggacttagctttcactacactacaggatatgatctccatgtagtccatataaacctgcagagtgattttccagagtgctcgatactgttaattacatctccattagggctgaaaagaatgacctacgtttctgtatacagctgtgttgcttttgatgttgtgttactgtacacagaagtgtgtgcactgaggctctgcgtgtggtccgtatggaaagcctggtagccctgcgagttaagtactgcttccattcattgtttacgctggaatttttctccccatggaatgtaagtaaaacttaagtgtttgtcatcaataaatggtaatactaaatttttttgttaatttattctcaaatgccactactgctaggttggtcccctcccaacttgcccctatcctttttttatttttaagaaaaaaactttgtaatgcttgtgattccatctgggcaaaagtctgaagatctgaaataactttatatcaaaccattgatcaataaacagctactaatg

SEQ ID NO: 1774 - DNA, 1454 bp, Homo sapiens
gccgcgtcttcctgaggtagctcctgtcagcccactgatcccaccacccgctccctactgccccgcggtcttcgcgtgagctcggagactgagggacaacaaaaatggcggaggggagccagtcggcgcctgaggcaggcaatgatatgggaaatgatgatgccattggagggaatgtgagcaaatatatagtgcttccaactggctattgtggacagcccaagaaaggacatcttatctttgatgcttgctttgaaagtggtaacctgggccgggtggaccaggtctctgagtttgagtatgatctgttcattaggccggacacctgtaatccacgcttccgagtctggttcaactttactgttgaaaatgtgaaagaatcacagagggtcattttcaacattgttaacttcagtaaaaccaagagtctctatagagatgggatggcccctatggtgaaatctaccagcagaccaaaatggcaaaggctgccacccaaaaatgtttactactaccgctgcccggaccataggaagaactatgtgatgtcctttgccttttgttttgaccgagaagaagatatttaccagtttgcttactgctacccatatacatacactcgcttccaacattaccttgacagcctgcaaaagagaaacatggattacttctttcgggagcagctgggccagagtgtgcaacaacgaaagcttgacctcctgacgataaccagccctgctggaagatggagctggtgaaatcatttgcttctgaaggagaatggtggcctttccaaatttgactatcagatatgaatttgacctaatctcgggaatgtttccggctggaagatggagctggtgaaatcatttgcttctgaaggagaatggtggcctttccaaatttgactatcagatatgaatttgacctaatctcgggaatgtttccggtaagactgcagactctcaggtgcttaagaagtcactgaggctctggacaaacaggaacgtattagctttttgcctactgactacacagcctccaccattcacccaaaatggatctgcatctcccaggtgcatctgcaagcacacaaaaacacacactgggaaggggtatgagctgaggttagtcctaggtgctgcactttctattcctgacatatcaggatgtgtgggagggaggccaaagctgcagcaccaggctgggcttccagtcctgttgctactgtggaagctggctccagacaggtgggggcagcaaagagccagcctgtatggtcagctgggattctagttgaccaaagctgttgggagaactcaagctcatcagtgtggcaagttagacaacttgatctggacacatgcataaatggaacaggggtccagatacccacaggattaatactaataaaccattttgcttaagcagcaaaactcggtttatatattgaa

SEQ ID NO: 1775 - DNA, 1353 bp, Homo sapiens
aggcaaccgtcgtgccgcgtcttcctgaggtagctcctgtcagcccactgatcccaccacccgctccctactgccccgcggtcttcgcgtgagctcggagactgagggacaacaaaaatggcggaggggagccagtcggcgcctgaggcaggcaatgatatgggaaatgatgatgccattggagggaatgtgagcaaatatatagtgcttccaactggctattgtggacagcccaagaaaggacatcttatctttgatgcttgctttgaaagtggtaacctgggccgggtggaccaggtctctgagtttgagtatgatctgttcattaggccggacacctgtaatccacgcttccgagtctggttcaactttactgttgaaaatgtgaaagaatcacagagggtcattttcaacattgttaacttcagtaaaaccaagagtctctatagagatgggatggcccctatggtgaaatctaccagcagaccaaaatggcaaaggctgccacccaaaaatgtttactactaccgctgcccggaccataggaagaactatgtgatgtcctttgccttttgttttgaccgagaagaagatatttaccagtttgcttactgctacccatatacatacactcgcttccaacattaccttgacagcctgcaaaagagaaacatggattacttctttcgggagcagctgggccagagtgtgcaacaacgaaagcttgacctcctgacgataaccagccctgacaatctccgggaaggggcagagcagaaggtggtattcatcacaggacgagtccacccaggggaaacaccctcatcatttgtgtgccaagggatcattgacttccttgtaagccagcaccctattgcctgtgtcctccgggaatacctggtcttcaagatcgcaccaatgctcaatcctgatggagtctacctgggcaattacaggtgttctctgatgggatttgatctgaatcgtcactggctggatccctctccatgggtccatcctaccctgcatggagtgaaacaactcatcgtccagatgtacaacgacccagtaagtaactgaatgccctccacagctgctgatctatggcttgatctgggaaagggcagcattgtattgggaaagtccactagaagctgcaaattaggaatacatagctaaaaccagggaggcactaggcctgctcttctctgaatccagcagacccaaggaccttctcccaatctcttttcctgcaacctctcacaaatagtggattcagttttggaggtctggagggttaaaggaaatatattggagtgtatccatatttgtcagggatctttggttacaagc

SEQ ID NO: 1776 - DNA, 2947 bp, Homo sapiens
aggcaaccgtcgtgccgcgtcttcctgaggtagctcctgtcagcccactgatcccaccacccgctccctactgccccgcggtcttcgcgtgagctcggagactgagggacaacaaaaatggcggaggggagccagtcggcgcctgaggcaggcaatgatatgggaaatgatgatgccattggagggaatgtgagcaaatatatagtgcttccaactggctattgtggacagcccaagaaaggacatcttatctttgatgcttgctttgaaagtggtaacctgggccgggtggaccaggtctctgagtttgagtatgatctgttcattaggccggacacctgtaatccacgcttccgagtctggttcaactttactgttgaaaatgtgaaagaatcacagagggtcattttcaacattgttaacttcagtaaaaccaagagtctctatagagatgggatggcccctatggtgaaatctaccagcagaccaaaatggcaaaggctgccacccaaaaatgtttactactaccgctgcccggaccataggaagaactatgtgatgtcctttgccttttgttttgaccgagaagaagatatttaccagtttgcttactgctacccatatacatacactcgcttccaacattaccttgacagcctgcaaaagagaaacatggattacttctttcgggagcagctgggccagagtgtgcaacaacgaaagcttgacctcctgacgataaccagccctgacaatctccgggaaggggcagagcagaaggtggtattcatcacaggacgagtccacccaggggaaacaccctcatcatttgtgtgccaagggatcattgacttccttgtaagccagcaccctattgcctgtgtcctccgggaatacctggtcttcaagatcgcaccaatgctcaatcctgatggagtctacctgggcaattacaggtgttctctgatgggatttgatctgaatcgtcactggctggatccctctccatgggtccatcctaccctgcatggagtgaaacaactcatcgtccagatgtacaacgacccaaaaacaagcctggagttttatattgacatccatgcccactccaccatgatgaatggcttcatgtatggcaacatctttgaggatgaggaacggttccagaggcaggccatttttcccaagctcctctgccagaatgctgaggacttctcctattccagcacatcctttaaccgggacgctgtgaaagcaggaactggccgtcgcttcctcggtggactcctggaccacacttcctattgctacaccctagaggtctccttctacagctacatcatcagtggcaccacggctgctgtgccctacactgaagaagcctatatgaagctggggcggaatgtggcaagaacctttttggactattatcggctgaaccccgtggttgaaaaggtggcaattcccatgccgagactgcgaaataaagaaatagaagtccagagaaggaaagaaaaatcccctccttacaagcacccactcctgcggggcccagccagcaactaccccaacagcaaaggggacaagaagagctcagtgaaccacaaagacccttcaacccctttttaaagacacggagtcctgggaggtcttatggggacaggagcatgcattttctgctggggaatgaaattaatcactcttctctagcttccaaggatttgtggattaatgcataggctagtgaaagggaagggatacaatgagaaacttcatcactgattttccctttttccaatggaaaatcaattgtaagccttcagctcaaaaagctcaggaacaaaataggagatcggaaccaggtgagcacagatgctattttctacaacatagagatcttccaagatgaggaaaacctacacatcccttttaagagatttgacacatatcaggtcagttctttcaaagccactttacatttttaagttttatagttactgcagatggttaccttttaaataggcttggttgtttacagctttagaaatgcagtgtttgtattttctgatccaaaacaacagcaacaacacatgcaaccaaagggcaaatgcatcctagggaacaatgggacagaatttttgaaatcaacggtggacttaaatatatggtcactgtatctaagctgcatgcttgctgattccctcaaaccccagcatgcagatttagaaaactgttttgagagctgtttcccaatttcctcggtagtttaattaaaattttagctctaaagacaaaaagcactggtcactcattttaaaaggtttattatggttaaggtctccagatcccaggtgacagggattaagcctggcccctgaagatgtaggcattgctaatctgcaatgaggaaagggtgattgccaggcaaggaagatgcaaaagacagaaggatgcaccctgaggcagggaggaatgataaaataaaacagtagtagcaattcccaaggtgtggcaagctaaatattggcatttttgtgaagagtaaagtgcctttgtatgatgaatgggtccaggggggtctgctcccttcctgtctgtggaaacagcaggctgagtcaccatgacagcctgctaattaaaatgacctcccggaaatgaggattagaacacagggagaggaagggaggctccagggaggaaaatcccttagcacagagctccactaaagcattttttgtttgtttgtttgtttgtttgtttgtttgagttggagattattgaagtttgctacaaaaatcaaaaagaaaacttgttctcctttgcatgctagttttcagaaatgatgacaaagagccatatgttgattggctacaaatgtcatgttgtatatacagcttctcccctgggttcgttttgcccagaggaacacaaataaagtgttttgtgc

SEQ ID NO: 1777 - DNA, 3500 bp, Homo sapiens
acttcctgccgggctgcgggcgcctgagcggctcttcagcgtttgcgccggcggctgccgcgtctctctcggctcccgcttcctttgaccgcctcccccccccggcccggcggcgcccgcctcctccacggccactccgcctcttccctcccttcgtcccttcttcctctcccttttttccttcttccttcccctcctcgccgccaccgcccaggaccgccggccgggggacgagctcggagcagcagccagagtttattaaccacttaacctctcagaactgaacaaagacaacattgttcctggaacgccctctttttaaaaaaggtagaactttagacttcatagcactgaattaacctgcactgaaagctgtttacctgcatttgttcacttttgttgaaagtgaccatgtctcaagttcaagtgcaagttcagaacccatctgctgctctctcagggagccaaatactgaacaagaaccagtctcttctctcacagcctttgatgagtattccttctactactagctctctgccctctgaaaatgcaggtagacccattcaaaactctgctttaccctctgcatctattacatccaccagtgcagctgcagaaagcataacccctactgtagaactaaatgcactgtgcatgaaacttggaaaaaaaccaatgtataagcctgttgacccttactctcggatgcagtccacctataactacaacatgagaggaggtgcttatcccccgaggtacttttacccatttccagttccacctttactttatcaagtggaactttctgtgggaggacagcaatttaatggcaaaggaaagacaagacaggctgcgaaacacgatgctgctgccaaagcgttgaggatcctgcagaatgagcccctgccagagaggctggaggtgaatggaagagaatccgaagaagaaaatctcaataaatctgaaataagtcaagtgtttgagattgcacttaaacggaacttgcctgtgaatttcgaggtggcccgggagagtggcccaccccacatgaagaactttgtgaccaaggtttcggttggggagtttgtgggggaaggtgaagggaaaagcaagaagatttcaaagaaaaatgccgccatagctgttcttgaggagctgaagaagttaccgcccctgcctgcagttgaacgagtaaagcctagaatcaaaaagaaaacaaaacccatagtcaagccacagacaagcccagaatatggccaggggatcaatccgattagccgactggcccagatccagcaggcaaaaaaggagaaggagccagagtacacgctcctcacagagcgaggcctcccgcgccgcagggagtttgtgatgcaggtgaaggttggaaaccacactgcagaaggaacgggcaccaacaagaaggtggccaagcgcaatgcagccgagaacatgctggagatccttggtttcaaagtcccgcaggcgcagcccaccaaacccgcactcaagtcagaggagaagacacccataaagaaaccaggggatggaagaaaagtaaccttttttgaacctggctctggggatgaaaatgggactagtaataaagaggatgagttcaggatgccttatctaagtcatcagcagctgcctgctggaattcttcccatggtgcccgaggtcgcccaggctgtaggagttagtcaaggacatcacaccaaagattttaccagggcagctccgaatcctgccaaggccacggtaactgccatgatagcccgagagttgttgtatgggggcacctcgcccacagccgagaccattttaaagaataacatctcttcaggccacgtaccccatggacctctcacgagaccctctgagcaactggactatctttccagagtccagggattccaggttgaatacaaagacttccccaaaaacaacaagaacgaatttgtatctcttatcaattgctcctctcagccacctctgatcagccatggtatcggcaaggatgtggagtcctgccatgatatggctgcgctgaacatcttaaagttgctgtctgagttggaccaacaaagtacagagatgccaagaacaggaaacggaccaatgtctgtgtgtgggaggtgctgaaccttttctggccatgaaccattataaaatcccaacatatatactgaaaatactgaaactgctttgaaaatttggaatttctgatacctccagtgggccgagagacacggtgggtaaaggatgtgggcagcagcagggaagacaacagaaacacaaggaggcggctgtggccgggctggactgtgctggggtttgttgtgatggccactcggtgacctggcggtccctacgcaatagcagctgcctgtggggaagaagggctgcccagccagctggttctcccgggacaccagcagatccacaccctgggcacctccgtgtttggtcttttttttcccctgtgtgaaagaagaaacggcacgaccccttctcaagctggctcactcagacacattgggacaaaccctggacagccatgccagagagaggcctttgaccggccccagagctaaaagcaccagagaaaatcaaatgcttcctactcagcgtgacccaacttttctagtgtgccacggccccaccacctcctgcagtacccacaccatcaccactgctttctcttccaacagtgatctgtattcttagtttcattattttcttttgattgatatgacactatataaaattttcatttgagaatttctcaattgtatctagttaaatagcacagtttggaaacttgtctgagactgactttatcaataatctaaccgacaaagatcatatccatgtgtatgtggttagacatttttatttcattgactaacccaggacagtttcagtgatgcaaattgtgtgccctctggttcagctgaaacagtcctggactttcaaaaaccttgaataagtctcccacagttgtataaattggacaatttaggaattttaaactttagatgatcatttggttccatttttatttcatttttatttttgttaatgcaaacaggacttaaatgaactttgatctctgttttaaagattattaaaaaacattgtgtatctatacatatggctcttgaggacttagctttcactacactacaggatatgatctccatgtagtccatataaacctgcagagtgattttccagagtgctcgatactgttaattacatctccattagggctgaaaagaatgacctacgtttctgtatacagctgtgttgcttttgatgttgtgttactgtacacagaagtgtgtgcactgaggctctgcgtgtggtccgtatggaaagcctggtagccctgcgagttaagtactgcttccattcattgtttacgctggaatttttctccccatggaatgtaagtaaaacttaagtgtttgtcatcaataaatggtaatactaaa

SEQ ID NO: 1778 - DNA, 1326 bp, Homo sapiens
ggaccctgaaggagggacagggcacctcggtggtggcccaaggcccaagccggcccctgcccagcacggccaacgtggtggtcattggtggaggcagcttgggctgccagaccctgtaccacctggccaagctgggcatgagtggggcggtgctgctggagcgggagcggctgacctccgggaccacctggcacacggcaggcctgctgtggcagctgcggcccagtgacgtggaggtggagcttctggcccacactcggcgggtggtgagccgggagctggaggaggagacgggactacacacgggctggatccagaatgggggcctcttcatcgcgtccaaccggcagcgcctggacgagtacaagaggctcatgtcgctgggcaaggcgtatggtgtggaatcccatgtgctgagcccggcagagaccaagactctgtacccgctgatgaatgtggacgacctctacgggaccctgtatgtgccgcacgacggtaccatggaccccgctggcacctgtaccaccctcgccagggcagcttctgcccgaggagcacaggtcattgagaactgcccagtgaccggcattcgtgtgtggacggatgattttggggtgcggcgggtcgcgggtgtggagactcagcatggttccatccagacaccctgcgtggtcaactgtgcaggagtgtgggcaagtgctgtgggccggatggctggagtcaaggtcccgctggtggccatgcaccatgcctatgtcgtcaccgagcgcatcgaggggattcagaacatgcccaatgtccgtgatcatgatgcctctgtctacctccgcctccaaggggatgccttgtctgtgggtggctatgaggccaaccccatcttttgggaggaggcagtcaaatacagacccagggcagctggagggctttgcctcaaaacatccacagagaaggtctgcgcagtgtggagtgatgacctcagaagggcatgagagcacacaagtcctacgtccttcagcaaatgacactgccctcccaaccagctgctgcagcggcatttcccctggcctgggctgtttcccgggcagcttctggggttagggcagccctgcagccctgttctatgtgtatatgcatttagtccacacatggaacgactgagtggctactttgggctaaaaactgctttaatttctggagaaagagggaaactaagataaaagtccctgactctgggtgcctatattttggtggagagacatacaataaacaaacaaatggctgggcacggtggctcacacctgtaatcccagcactttgggaggctga

SEQ ID NO: 1779 - DNA, 2266 bp, Homo sapiens
gtgccgtgtcggcagttaggagggcaggtggcggggtggggggttgtctgcaggagcagcggccagggaggggcatggggctgtggggctgtggggtgtctgatgggggcagatcccagggaggccaaggcagtggcagaaaagctggactctggagcccacgcacctgcctggcttcgtgccactgccaggtccaggacttgtctgtgcccttgggcgagatataacttctctgcgcctcactttcctcatctgtagaaaggggcacacctggtaggagtgtaagacgcttcccgcaggggctggcccagagcaggagctgggcctgggattgccgtggctccagggagcagccctggctgaggtcctgggtaaccacctctccctgtcgttccccaccttgggtgcatccagctcctcctccagcctcctgggccctggctgggctctcagacccaccaggcaaccctgcggcctcctttgtgcctctgttttgcctggacctcatgggggccccctgcccgcgtccacaacacacgggcactcagtgcagggctctccgagggcagggccaggcctgaccccatcacagcctcagcgggaccccgctctggggagggaagcggggaggggccaaagaggcaggctgaggaccacgtcttttcttcccaggtcctcgagtacgactactacggggcttacgggagccgcgcgcacgaggactacgcctaccgcaggctgctggcagacgagtacaccttcgccttcccgccccaccacgacacgatcaagaaggagtgcctggcctgcagaggggccgccgctgtgtttgacatgtcctacttcgggaagttctacctggtggggctggatgcaaggaaggctgccgactggctcttctccgcagatgtcagccgacccccaggctccaccgtgtacacgtgcatgctcaaccaccgtgggggcaccgagagtgacctgactgtcagccgcctggcacccagccaccaggcctccccgctggcccccgcctttgaaggggacggttactacctggccatgggcggggccgtggcccagcacaactggtcccacatcaccaccgtgctgcaggaccagaagtcccagtgccagctcatcgacagctccgaggacctgggtatgatcagtatccagggcccagccagccgagccattttgcaggaggtgctggacgcagacctgagcaacgaggccttcccgttctccacccacaagctactgagagccgcagggcacctggtccgagccatgcggctgtcctttgtgggggagctgggctgggagctgcacattccaaaggcgtcctgcgtgcctgtgtaccgggctgtgatggccgcgggtgccaagcacggcctcatcaacgcagggtaccgcgccatcgactccctgagcattgagaaaggctaccggcactggcacgcggacctgcggccagacgacagccccctggaggcaggcctggccttcacctgcaagctcaagtcgccggtgcccttcctggggagggaggccctggagcagcagcgggccgcaggcctccgccggcgcctggtgtgcttcaccatggaggagccgctgtggacgcgtccccaccctgcggtttctggggccccagctttctctactgcttcttccagcaaagtacccatgtttggcctggaggccatctggaggaacggccaagtggtgggccatgtccggagggctgactttgggttcgccatcgacaagaccatcgcctacggttacatccatgaccccagcggtgggccggtctcgctggactttgtgaagagcggggactatgccctggagagaatgggggtgacctatggtgcccaggctcacctgaagtcgcccttcgaccccaacaacaagagggtgaagggaatctactgagggctcagaccacatgccccatcccatgctgtccatccattctcacaggtcccaaatggccctgggtcccaggaccctggacccagccagaacttgtgccctccctgtccttagcctaggcctagtcctgcgaaaacccccaaaccagatacggacagagaccaagatggcccatcctgtggtcactgactggaaggcagtctctaatccaccccaatcctcccagaaagcaaacctgtaagtgtcttgggctcagggaccatggcttgtagccctttccaagcttctagaaggtgcttagtaaatacttgataagccccacgtg

SEQ ID NO: 1780 - DNA, 3344 bp, Homo sapiens
agtgtgggctacccggccactgccctggagctgtggtgactgctgcgtttttctcccatgcacttgcacgtccaggactcctgggagaacttgggccacactccttccttgccctcttgagctcattcgtcaccctgttgggtgagcacagccctagctcaggccactgggcaagccacaccatccaaagaggaggtcctctgccccaggacccccacaccaccccagctccctgtttcgctgaggcctggagcccccatggcctcactgagccgagccctacgtgtggctgctgcccaccctcgccagagccctacccggggcatggggccatgcaacctgtccagcgcagctggccccacagccgagaagagtgtgccatatcagcggaccctgaaggagggacagggcacctcggtggtggcccaaggcccaagccggcccctgcccagcacggccaacgtggtggtcattggtggaggcagcttgggctgccagaccctgtaccacctggccaagctgggcatgagtggggcggtgctgctggagcgggagcggctgacctccgggaccacctggcacacggcaggcctgctgtggcagctgcggcccagtgacgtggaggtggagcttctggcccacactcggcgggtggtgagccgggagctggaggaggagacgggactacacacgggctggatccagaatgggggcctcttcatcgcgtccaaccggcagcgcctggacgagtacaagaggctcatgtcgctgggcaaggcgtatggtgtggaatcccatgtgctgagcccggcagagaccaagactctgtacccgctgatgaatgtggacgacctctacgggaccctgtatgtgccgcacgacggtaccatggaccccgctggcacctgtaccaccctcgccagggcagcttctgcccgaggagcacaggtcattgagaactgcccagtgaccggcattcgtgtgtggacggatgattttggggtgcggcgggtcgcgggtgtggagactcagcatggttccatccagacaccctgcgtggtcaactgtgcaggagtgtgggcaagtgctgtgggccggatggctggagtcaaggtcccgctggtggccatgcaccatgcctatgtcgtcaccgagcgcatcgaggggattcagaacatgcccaatgtccgtgatcatgatgcctctgtctacctccgcctccaaggggatgccttgtctgtgggtggctatgaggccaaccccatcttttgggaggaggtgtcagacaagtttgccttcggcctctttgacctggactgggaggtgttcacccagcacattgaaggcgccatcaacagggtccccgtgctggagaagacaggaatcaagtccacggtctgcggccctgaatccttcacgcccgaccacaagcccctgatgggggaggcacctgagctccgagggttcttcctgggctgtggcttcaacagcgcaggaatgatgctgggtggtggctgtgggcaggagctggcccactggatcatccatgggcgcccggagaaggacatgcatggctatgacatcaggcgcttccatcactcgctcacggaccacccccgctggatccgagagcgaagccatgagtcctacgccaagaactactccgtcgtcttcccccacgatgagccgctggccgggcgcaacatgaggagagacccgctgcacgaggaactccttggacaaggctgcgtgttccaggagcggcatggctgggagcgaccgggatggtttcatccccgaggcccagctccggtcctcgagtacgactactacggggcttacgggagccgcgcgcacgaggactacgcctaccgcaggctgctggcagacgagtacaccttcgccttcccgccccaccacgacacgatcaagaaggagtgcctggcctgcagaggggccgccgctgtgtttgacatgtcctacttcgggaagttctacctggtggggctggatgcaaggaaggctgccgactggctcttctccgcagatgtcagccgacccccaggctccaccgtgtacacgtgcatgctcaaccaccgtgggggcaccgagagtgacctgactgtcagccgcctggcacccagccaccaggcctccccgctggcccccgcctttgaaggggacggttactacctggccatgggcggggccgtggcccagcacaactggtcccacatcaccaccgtgctgcaggaccagaagtcccagtgccagctcatcgacagctccgaggacctgggtatgatcagtatccagggcccagccagccgagccattttgcaggaggtgctggacgcagacctgagcaacgaggccttcccgttctccacccacaagctactgagagccgcagggcacctggtccgagccatgcggctgtcctttgtgggggagctgggctgggagctgcacattccaaaggcgtcctgcgtgcctgtgtaccgggctgtgatggccgcgggtgccaagcacggcctcatcaacgcagggtaccgcgccatcgactccctgagcattgagaaaggctaccggcactggcacgcggacctgcggccagacgacagccccctggaggcaggcctggccttcacctgcaagctcaagtcgccggtgcccttcctggggagggaggccctggagcagcagcgggccgcaggcctccgccggcgcctggtgtgcttcaccatggaggacaaagtacccatgtttggcctggaggccatctggaggaacggccaagtggtgggccatgtccggagggctgactttgggttcgccatcgacaagaccatcgcctacggttacatccatgaccccagcggtgggccggtctcgctggactttgtgaagagcggggactatgccctggagagaatgggggtgacctatggtgcccaggctcacctgaagtcgcccttcgaccccaacaacaagagggtgaagggaatctactgagggctcagaccacatgccccatcccatgctgtccatccattctcacaggtcccaaatggccctgggtcccaggaccctggacccagccagaacttgtgccctccctgtccttagcctaggcctagtcctgcgaaaacccccaaaccagatacggacagagaccaagatggcccatcctgtggtcactgactggaaggcagtctctaatccaccccaatcctcccagaaagcaaacctgtaagtgtcttgggctcagggaccatggcttgtagccctttccaagcttctagaaggtgcttagtaaatacttgataagccccacgtgaaaa

SEQ ID NO: 1781 - DNA, 1854 bp, Homo sapiens
ggttttgctccgctttagcagcggcgaagggaggacccccgggagccggtccccggcgtccggtcgcccagcccttttcaggcttgggcccgcatggaggggaccgtggagtcccagacgcctgacctgcgggatgtggagggtaaggtgggcaggaagacccctgaagggctgctccgcgggctgcgaggcgagtgtgagctgggaacctctggcgccctgctgctcccaggggcgtctagcaccggccacgacttgggggacaagatcatggcgctgaagatggagctggcttacctgcgagccatcgatgtgaagatcctgcagcagctggtgaccttgaatgagggcatcgaggcagtgcgctggctgttggaggagcgggggacgttgaccagtcattgcagcagcctcaccagcagtcaatatagcctgacaggcgggagcccaggccgctcaaggcgaggcagctgggacagcctgccagacaccagcaccaccgaccggctggacagtgtctctattggcagcttcctggacacagtggcccccagcgagctggatgaacagggcccacctggggctccacgttccgagatggactgggcaaaagttatagctggtggagagagggccaggactgaggtggatgtggcagccaccaggctagggagcttgagagctgtgtggaagcccccaggggagaggcttcaaggtggaccacctgagtcaccagaggatgagagtgccaagctgggcttcgaggcccactggttctgggagcagtgccaggatgatgtgaccttcttgtaacaactattccacccttttgtaatcctgtggctcttttatccattagatgtggtctcccccaaaattgattctccctcagtctgagactaggaagaggctgcactgaaatcagttaccatggaaacctggctcatcatttctctagtccctagggagtctctgcctttatccctcaattattgggtccctagagctagcttgctctttctttctttctttctttttttgagacagggtcttatgctgttacccaagatagagagcagtggcatgatcacagctcactgcagccttgacctcctgggctcaagcgatcctcctatttcagcctcccccatagttaggaccacaggcatgcaccaccatgcccagctaattgtttatttatttattttttttttgtagagatagggtttccctgtgttgcccaggctggtctcaaactcctgggctcaagggatcctcccgcctcagcctcccaaagtgctgggattatgcccagcccctagagatacttctatagagatattgactctaaaggattgacctatggcttttggtatttagtatctctcactactccccccagctaagtaaggatttaaggaatttaggactccctggagttaacagatgaagagatgggggcataattacttcacccaaagtctagaagccttggcctctctcttggccaagatggaggattgaggagggacatggaccttcaggactaaccctctatggattggccctcccagaagcgtttgggctggtagacccaccccttcctacctgctgagtgatgtcatttcctgccaggatgggtagccctttgtacgggtccttggatggtagtaggtcatataggggcatctgagcccctgctgctaagtgagatcacattatttatcgtccataccattacttcttgtgaacagtaacatgtcactcctcctggcaggaaagtttctcattgtcagatgtttgtgcttcttttcaggtcttactttttaaatagagtgttctcattttatccta

SEQ ID NO: 1782 - DNA, 609 bp, Homo sapiens
agtttctgcgacttgtgttgggactgctgataggaagatgtcttcaggaaatgctaaaattgggcaccctgcccccaacttcaaagccacagctgatgaaggcatctcgttcaggggcctttttatcattgatgataagggtattcttcggcagatcactgtaaatgacctccctgttggccgctctgtggatgagactttgagactagttcaggccttccagttcactgacaaacatggggaagtgtgcccagctggctggaaacctggcagtgataccatcaagcctgatgtccaaaagagcaaagaatatttctccaagcagaagtgagcgctgggctgttttagtgccaggctgcggtgggcagccatgagaacaaaacctcttctgtattttttttttccattagtaaaacacaagacttcagattcagccgaattgtggtgtcttacaaggcaggcctttcctacagggggtggagagaccagcctttcttcctttggtaggaatggcctgagttggcgttgtgggcaggctactggtttgtatgatgtattagtagagcaacccattaatcttttgtagtttgtattaaacttgaactgaga

SEQ ID NO: 1783 - DNA, 3028 bp, Homo sapiens
tcagtctttcgcggcccgggagctcagcagagctaccagctgccctgttggcttcgctggtcggatcgtcctcctggccccgccaaacaggcggggggagcggccccgactgtggggccatggcagtagtctcctcgttcgccgccgccgctagcctagctgagtcgccggcttctgcgctaggggctcccaccgcctccgcaggctaaggagccgctgccaccaacgagctgtgagggttactatgctccctctttgccgccgtctcctcctcttgcccgcgcaggcacccctctggctgctcagtcctgcctcagtgtcaaaccagaagagaagtaaaattcaacaaaaatttatgtgtggagttccttcttaaaagaagaaaaaagtgattatttagactatggatcggagcaaacggaattcaattgcaggatttcctccacgtgtggagcgtcttgaagagtttgaaggaggtggtggaggagaaggaaatgtgagccaggtgggaagagtttggccatcttcgtatcgagctcttataagtgccttttccagactgacgcgtttggatgatttcacctgtgaaaaaatagggtctggcttcttttctgaagtgttcaaggtacgacaccgagcttctggtcaggtgatggctcttaagatgaacacattgagcagtaaccgggcaaacatgctgaaagaagtacagctcatgaatagactctcccatcccaacatccttaggtatatcaactccgggaacctggaacagttgctagacagtaacctgcatttgccttggactgtgagggtaaaactggcctatgacatagcagtgggcctcagctaccttcacttcaaaggcatttttcatcgggacctcacatctaagaactgcctgataaagagggatgagaatggttactctgcagtggtagctgactttggcctggctgagaagatccccgatgtcagcatggggagtgagaagctggccgtggtgggttccccattctggatggcacctgaggttctccgagatgagccctataatgaaaaggcagatgtgttctcttatggtatcatcctctgcgagatcatcgcccgcatccaggccgatccggactatcttccccgcacagagaatttcgggctggactatgatgctttccagcacatggtgggagactgtcccccagattttctgcaacttactttcaactgctgtaacatggatcccaaactgcgcccatcttttgtggagattgggaagaccctggaggaaattctgagccgcctacaggaagaagagcaggagagggataggaagctgcagcccacagccaggggactcttggagaaagcacctggggtgaagcgactaagctcactggatgacaagatcccccacaagtcaccatgcccaagacgtaccatctggctgtctcgaagccagtcagatatcttttcccgtaagcccccacgtacagtgagtgtcttggacccatactaccggccacgagatggtgctgcccgcacccccaaagtcaacccttttagtgctcgccaggacctcatggggggcaagatcaagttttttgacctgcccagcaagtctgtcatctctctggtatttgacctggatgcaccagggcccggaactatgcccctggctgactggcaggagcccctggccccacctattcgccggtggcgttccttgcctggttcgcctgagttcttgcatcaagaggcttgtccatttgtgggccgggaagaatcgctatctgatgggcccccaccacgcctaagtagtctcaagtacagagttaaagagatcccaccattccgggcatctgccctaccagctgctcaagcccatgaggctatggactgctccattctccaggaagaaaatggttttgggtccaggccccaggggaccagtccatgccctgcgggtgcttctgaggagatggaggtagaagaaaggccagcaggctcaactccagccaccttctccacctcaggcataggcctgcaaacccagggaaagcaggatgggtgagggggtttagtccctgcctcaccttggggatggaccttcagctgaaaccatatggccccctaggtgcacagccttgattcttccctggagcctacagagcaggcaggctaggccaagccaggctcaacttctgggctcccagtgcccattggctgtgtatgacgggaggcagcagtgagaggccttcctagttagggccaacagctgataccaagcctctgaaatccagcaaggaggtctgcctcccaccagaccctctccagtgtacttccccagataggaccagaggatgtctagttctaggctgagctggcaggcagctattaccccggttctttccccaccccaggtctgtctcttgccttttcttggggcatataagctactgagtggaacatggagctgatcaagaggccgtaatggtcatggctgtttcccagacctgaatattggggtgcttcttgccagtattctaagacatttgagtaattgctgtttgcacttactgcatggtcagaccacgtcactacatttctatgcaaggggacagcaaggcagcgtggtggtcatggctcttagctaacctattcaaagaccttttcctgttgattaatctattttcatatttataaaggagtcttaatgttctgccccataagactttcaaccttgtggttgggagtggggctggttttgtaggccctagggcctgcttctatgtatttatcaacatgtgatacattcaattggttaaatggtttatacagggactgatttgcttcccttcctgccatggctggagctttgggaacagtctgtccttacagagctgcaataagaaataaccaaagatgaagctggtcaaatattttcataacttgcttctgttgatttttttttttgtaaaactttcccaagacattttcagacttaaaaataaagtcagtgttacaggtg

SEQ ID NO: 1784 - DNA, 2600 bp, Homo sapiens
tgattatttagactatggatcggagcaaacggaattcaattgcaggatttcctccacgtgtggagcgtcttgaagagtttgaaggaggtggtggaggagaaggaaatgtgagccaggtgggaagagtttggccatcttcgtatcgagctcttataagtgccttttccagactgacgcgtttggatgatttcacctgtgaaaaaatagggtctggcttcttttctgaagtgttcaaggtacgacaccgagcttctggtcaggtgatggctcttaagatgaacacattgagcagtaaccgggcaaacatgctgaaagaagtacagctcatgaatagactctcccatcccaacatccttaggttcatgggtgtatgtgttcatcaaggacaattgcatgcacttacagagtatatcaactccgggaacctggaacagttgctagacagtaacctgcatttgccttggactgtgagggtaaaactggcctatgacatagcagtgggcctcagctaccttcacttcaaaggcatttttcatcgggacctcacatctaagaactgcctgataaagagggatgagaatggttactctgcagtggtagctgactttggcctggctgagaagatccccgatgtcagcatggggagtgagaagctggccgtggtgggttccccattctggatggcacctgaggttctccgagatgagccctataatgaaaaggcagatgtgttctcttatggtatcatcctctgcgagatcatcgcccgcatccaggccgatccggactatcttccccgcacagagatggatcccaaactgcgcccatcttttgtggagattgggaagaccctggaggaaattctgagccgcctacaggaagaagagcaggagagggataggaagctgcagcccacagccaggggactcttggagaaagcacctggggtgaagcgactaagctcactggatgacaagatcccccacaagtcaccatgcccaagacgtaccatctggctgtctcgaagccagtcagatatcttttcccgtaagcccccacgtacagtgagtgtcttggacccatactaccggccacgagatggtgctgcccgcacccccaaagtcaacccttttagtgctcgccaggacctcatggggggcaagatcaagttttttgacctgcccagcaagtctgtcatctctctggtatttgacctggatgcaccagggcccggaactatgcccctggctgactggcaggagcccctggccccacctattcgccggtggcgttccttgcctggttcgcctgagttcttgcatcaagaggcttgtccatttgtgggccgggaagaatcgctatctgatgggcccccaccacgcctaagtagtctcaagtacagagttaaagagatcccaccattccgggcatctgccctaccagctgctcaagcccatgaggctatggactgctccattctccaggaagaaaatggttttgggtccaggccccaggggaccagtccatgccctgcgggtgcttctgaggagatggaggtagaagaaaggccagcaggctcaactccagccaccttctccacctcaggcataggcctgcaaacccagggaaagcaggatgggtgagggggtttagtccctgcctcaccttggggatggaccttcagctgaaaccatatggccccctaggtgcacagccttgattcttccctggagcctacagagcaggcaggctaggccaagccaggctcaacttctgggctcccagtgcccattggctgtgtatgacgggaggcagcagtgagaggccttcctagttagggccaacagctgataccaagcctctgaaatccagcaaggaggtctgcctcccaccagaccctctccagtgtacttccccagataggaccagaggatgtctagttctaggctgagctggcaggcagctattaccccggttctttccccaccccaggtctgtctcttgccttttcttggggcatataagctactgagtggaacatggagctgatcaagaggccgtaatggtcatggctgtttcccagacctgaatattggggtgcttcttgccagtattctaagacatttgagtaattgctgtttgcacttactgcatggtcagaccacgtcactacatttctatgcaaggggacagcaaggcagcgtggtggtcatggctcttagctaacctattcaaagaccttttcctgttgattaatctattttcatatttataaaggagtcttaatgttctgccccataagactttcaaccttgtggttgggagtggggctggttttgtaggccctagggcctgcttctatgtatttatcaacatgtgatacattcaattggttaaatggtttatacagggactgatttgcttcccttcctgccatggctggagctttgggaacagtctgtccttacagagctgcaataagaaataaccaaagatgaagctggtcaaatattttcataacttgcttctgttgatttttttttttgtaaaactttcccaagacattttcagacttaaaaataaagtcagtgttacaggtg

SEQ ID NO: 1785 - DNA, 3074 bp, Homo sapiens
agtctttcgcggcccgggagctcagcagagctaccagctgccctgttggcttcgctggtcggatcgtcctcctggccccgccaaacaggcggggggagcggccccgactgtggggccatggcagtagtctcctcgttcgccgccgccgctagcctagctgagtcgccggcttctgcgctaggggctcccaccgcctccgcaggctaaggagccgctgccaccaacgagctgtgagggttactatgctccctctttgccgccgtctcctcctcttgcccgcgcaggcacccctctggctgctcagtcctgcctcagtgtcaaaccagaagagaagtaaaattcaacaaaaatttatgtgtggagttccttcttaaaagaagaaaaaagtgattatttagactatggatcggagcaaacggaattcaattgcaggatttcctccacgtgtggagcgtcttgaagagtttgaaggaggtggtggaggagaaggaaatgtgagccaggtgggaagagtttggccatcttcgtatcgagctcttataagtgccttttccagactgacgcgtttggatgatttcacctgtgaaaaaatagggtctggcttcttttctgaagtgttcaaggtacgacaccgagcttctggtcaggtgatggctcttaagatgaacacattgagcagtaaccgggcaaacatgctgaaagaagtacagctcatgaatagactctcccatcccaacatccttaggttcatgggtgtatgtgttcatcaaggacaattgcatgcacttacagagtatatcaactccgggaacctggaacagttgctagacagtaacctgcatttgccttggactgtgagggtaaaactggcctatgacatagcagtgggcctcagctaccttcacttcaaaggcatttttcatcgggacctcacatctaagaactgcctgataaagagggatgagaatggttactctgcagtggtagctgactttggcctggctgagaagatccccgatgtcagcatggggagtgagaagctggccgtggtgggttccccattctggatggcacctgaggttctccgagatgagccctataatgaaaaggcagatgtgttctcttatggtatcatcctctgcgagatcatcgcccgcatccaggccgatccggactatcttccccgcacagagaatttcgggctggactatgatgctttccagcacatggtgggagactgtcccccagattttctgcaacttactttcaactgctgtaacatggatcccaaactgcgcccatcttttgtggagattgggaagaccctggaggaaattctgagccgcctacaggaagaagagcaggagagggataggaagctgcagcccacagccaggggactcttggagaaagcacctggggtgaagcgactaagctcactggatgacaagatcccccacaagtcaccatgcccaagacgtaccatctggctgtctcgaagccagtcagatatcttttcccgtaagcccccacgtacagtgagtgtcttggacccatactaccggccacgagatggtgctgcccgcacccccaaagtcaacccttttagtgctcgccaggacctcatggggggcaagatcaagttttttgacctgcccagcaagtctgtcatctctctggtatttgacctggatgcaccagggcccggaactatgcccctggctgactggcaggagcccctggccccacctattcgccggtggcgttccttgcctggttcgcctgagttcttgcatcaagaggcttgtccatttgtgggccgggaagaatcgctatctgatgggcccccaccacgcctaagtagtctcaagtacagagttaaagagatcccaccattccgggcatctgccctaccagctgctcaagcccatgaggctatggactgctccattctccaggaagaaaatggttttgggtccaggccccaggggaccagtccatgccctgcgggtgcttctgaggagatggaggtagaagaaaggccagcaggctcaactccagccaccttctccacctcaggcataggcctgcaaacccagggaaagcaggatgggtgagggggtttagtccctgcctcaccttggggatggaccttcagctgaaaccatatggccccctaggtgcacagccttgattcttccctggagcctacagagcaggcaggctaggccaagccaggctcaacttctgggctcccagtgcccattggctgtgtatgacgggaggcagcagtgagaggccttcctagttagggccaacagctgataccaagcctctgaaatccagcaaggaggtctgcctcccaccagaccctctccagtgtacttccccagataggaccagaggatgtctagttctaggctgagctggcaggcagctattaccccggttctttccccaccccaggtctgtctcttgccttttcttggggcatataagctactgagtggaacatggagctgatcaagaggccgtaatggtcatggctgtttcccagacctgaatattggggtgcttcttgccagtattctaagacatttgagtaattgctgtttgcacttactgcatggtcagaccacgtcactacatttctatgcaaggggacagcaaggcagcgtggtggtcatggctcttagctaacctattcaaagaccttttcctgttgattaatctattttcatatttataaaggagtcttaatgttctgccccataagactttcaaccttgtggttgggagtggggctggttttgtaggccctagggcctgcttctatgtatttatcaacatgtgatacattcaattggttaaatggtttatacagggactgatttgcttcccttcctgccatggctggagctttgggaacagtctgtccttacagagctgcaataagaaataaccaaagatgaagctggtcaaatattttcataacttgcttctgttgatttttttttttgtaaaactttcccaagacattttcagacttaaaaataaagtcagtgttacaggtg

SEQ ID NO: 1786 - DNA, 2530 bp, Homo sapiens
ctgtcctcctgcagaggtggctgtggtcctggacctatgggcccttcccttcccccaacattgagccttgtgtgtctgcatggaggaggttcccaaggtctcatagtataagctgttcaagggtcagagaagcccccaggtcctgccttttcctgtccctttatgttggggagttgggggtgttacaggtatgctaaactctttagctgcagtctatctacccatgccagattcatcaagatcctcgatagtgtcctgcaccacctggtacctgcctgggaccacacactgggcaccttcagtgagattaagcaagtgaagcagttcctactgctgtcccgccagcggccaggcctggtggctcagtgcctgcgtgactctgagagcagcaagcccagcttcatgccacgcctatacatcaaccgccgtcttgccatggaacaccgtgcctgcccctctcgagaccctgcctgcaagaatgcagtcttcacccaggtatatgaaggcctcaagccctctgacaaatatgaaaagcccctggactacaggtggcccatgcgctatgaccagtggtgggagtgtaaatttattgcagaaggcatcattgaccaagggggtggtttccgggacagcctggcagatatgtcagaagagctgtgccctagctcagcggatacccccgtgcccctgcccttctttgtacgcacagccaaccagggcaatggcactggtgaggctcgggacatgtatgtacccaacccctcctgccgagactttgccaagtatgaatggatcggacagctgatgggggctgcccttcggggtaaggagttcctggtcctggccctgcctggttttgtgtggaagcagctttctggtgaggaggtgagctggagcaaggacttcccagctgtggactctgtgctggtgaagctcctggaagtgatggaaggaatggacaaggagacgtttgagttcaagtttgggaaggaactaacattcaccactgtactgagtgaccaacaggtggtggagctgatccctgggggtgcaggcatcgtcgtgggatatggggaccgttctcgtttcatccaactggtccagaaggcacggctagaggagagcaaggagcaggtggcagctatgcaggcaggtctgctgaaggtggtaccacaggctgtgctggacttgctgacctggcaagagttggagaagaaagtgtgtggggatccagaggtcactgtggatgctctgcgcaagctcacccggtttgaggacttcgagccatctgactcgcgggtgcagtatttctgggaggcactgaacaacttcaccaacgaggaccggagccgcttcctgcgctttgtcacgggccgcagtcgcctgccagcacggatctacatctacccagacaagctgggctacgagaccacagacgcgctgcccgagtcttccacttgctccagcaccctcttcctgccacactatgccagtgccaaggtatgcgaggagaagctccgctatgcggcctacaactgcgtggccatcgacactgacatgagcccttgggaggagtgaggcgtgccgccggctgtgggaccagcaagactgcacgtgtccctcttggccttgcccagggcgaagacaccttccctgccctggtttggctgacgtgctcagcaaaaccccatgtgccctgctcctgtgtgcagttggggtaggggcagctggcatggtcaggtaacactagtggcccagccccgcagacccacaagccctacccgtgctggggcttgcttcccgaggtatttcacctcttaagagggaatcttccacaagcccagcacaagctgccaggcctgagctacttgaagggggccatctaggtccccaacccatggactttgcctccattttcagctccgccttttttctcctattttctctctggctttcttcagccatgactcacaactaaaaacataaaacactggaggttagtggaggcccctccccaagcagggagcctgggatgggcagggagtgatagccaaactccttggtcacctgctccaagaaggaagcagtagctgagcacctgccctcacattctgctcttttcccctctccctccataccagagatgtggtgagctctgttcttctaccaacccagtctcaacacacaaagtgccaccaccttccctgactcagaacccacatccactcaatgtgaactctactaccacgacctccccatattcctcacttctccatcacctccagcctgactccctgtctgccctttcacccccaagattttgcacaggttaaggccagttatggcctttttgaaatctgtaatagctcccctttccccaactctaaagcctagaccttaaacctgttcctagagctatgcacacccctgccccagtttaccgttcctccctcagggcctccgtgacactccatgaaaagaagttcttgcataccggaaagttgaataaatggatgaattcattccttca

SEQ ID NO: 1787 - DNA, 1301 bp, Homo sapiens
atgatgccccgcgagacctttattctaaccgcaaggagtagcggaggggaggtcgtgatggcggcgccggaggcggaggttctgtcctcagccgcagtccctgatttggagtggtatgagaagtccgaagaaactcacgcctcccagatagaactacttgagacaagctctacgcaggaacctctcaacgcttcggaggccttttgcccaagagactgcatggtaccagtggtgtttcctgggcctgtgagccaggaaggctgctgtcagtttacttgtgaacttctaaagcatatcatgtatcaacgccagcagctccctctgccctatgaacagcttaagcacttttaccgaaaaccttctccccaggcagaggagatgctgaagaagaaacctcgggccaccactgaggtgagcagcaggaaatgccaacaagccctggcagaactggagagtgtcctcagccacctggaggacttctttgcacggacactagtaccgcgagtgctgattctccttgggggcaatgccctaagccccaaggagttctatgaactcgacttgtctctgctggccccctacagcgtggaccagagcctgagcacagcagcttgtttgcgccgtctcttccgagccatattcatggctgatgcctttagcgagcttcaggctcctccactcatgggcaccgtcgtcatggcacagggacaccgcaactgtggagaagattggtttcgacccaagctcaactatcgagtgcccagccggggccataaactgactgtgaccctgtcatgtggcagaccttccatccgaaccacggcttgggaagactacatttggttccaggcaccagtgacatttaaaggcttccgcgagtgaatgagtgcttcttaatcctaaaaacacaatggctgaattatctttctccatgtggcgctgaatcacccatctggtttggagctagagttgcttcctggtgagagaggaagcaactctccttctggttgtctgcctcccctcagatttcctgataggctgatggcatgtggctgtgactgtgactgtaatcattgctgaacaacatctctttgaatcaaaggttgattttcccagagggtgctgggtcaggcatttctattaggagttggaaagcaaaaatgggtccatagacactctatggaggtgtccctttctgctctttgctgtgtcctttcagaatttttaccaggaacataatgtggatgtgacttatgaacttaaatataaaataaatagattcttattatattttcctgaaa

SEQ ID NO: 1788 - DNA, 3610 bp, Homo sapiens
gctctgtccgcggtcgcgccagctgttccccgggcagggtcgcctctaggtgctcacctccgccacttcgccatggcgggtcctggcccgggcgcggtgctggagtccccccggcagctgctgggccgcgtgcgcttcttggcagaggcagcgcggagcctccgcgccgggcggccgctgccagcagcgctggctttcgtgccgcgagaggtgctctacaagctttacaaggacccagcgggaccgtcgcgcgtgcttctgccggtgtgggaggcagagggcctggggctgcgtgtgggcgccgcaggcccagcccccggtaccggctccgggcccctccgcgccgcccgcgacagcattgagctccggcgcggcgcctgcgtgcgcaccacgggcgaggagctgtgcaatggccacgggctctgggtgaagctgacaaaggagcagctggcagagcacctgggcgactgcgggctgcaggaaggctggctgctggtgtgccgcccggcggagggcggagcccgcctggtacccatcgacactcccaaccacctccagcggcagcagcagctctttggcgtggattatcggccggtgctcaggtgggaacaggtggtggacctgacatactcacatcgcctgggatcgagacctcagccggcagaggcatacgcagaagctgtacaaaggctactctatgtacccccgacatggacctacgagtgcgacgaggacctgatccacttcttgtatgaccacctgggcaaggaggatgagaacctgggtagcgtgaagcagtatgtggagagcatagacgtttcctcctacacggaggagttcaacgtgtcctgcctgacagacagcaatgccgatacctactgggagagcgatgggtcccagtgccaacactgggtacggcttactatgaagaagggcaccattgtcaagaagctgctactcacagtggataccacagatgacaactttatgccaaagcgggtggtggtctatgggggtgaaggggacaacctgaagaagctgagtgacgtgagcattgacgagaccctcatcggggatgtctgtgtcctggaggacatgaccgtccacctcccgatcatcgagatccgcatcgtggagtgccgagatgatgggattgatgttcgtctccgaggggtcaagatcaagtcatctagacagcgggaactagggttgaatgcagacctgttccagccaactagtctggtgcgatatccacgcctagaaggcaccgaccctgaagtactgtaccgcagagctgtcctcctgcagagattcatcaagatcctcgatagtgtcctgcaccacctggtacctgcctgggaccacacactgggcaccttcagtgagattaagcaagtgaagcagttcctactgctgtcccgccagcggccaggcctggtggctcagtgcctgcgtgactctgagagcagcaagcccagcttcatgccacgcctatacatcaaccgccgtcttgccatggaacaccgtgcctgcccctctcgagaccctgcctgcaagaatgcagtcttcacccaggtatatgaaggcctcaagccctctgacaaatatgaaaagcccctggactacaggtggcccatgcgctatgaccagtggtgggagtgtaaatttattgcagaaggcatcattgaccaagggggtggtttccgggacagcctggcagatatgtcagaagagctgtgccctagctcagcggatacccccgtgcccctgcccttctttgtacgcacagccaaccagggcaatggcactggtgaggctcgggacatgtatgtacccaacccctcctgccgagactttgccaagtatgaatggatcggacagctgatgggggctgcccttcggggtaaggagttcctggtcctggccctgcctggttttgtgtggaagcagctttctggtgaggaggtgagctggagcaaggacttcccagctgtggactctgtgctggtgaagctcctggaagtgatggaaggaatggacaaggagacgtttgagttcaagtttgggaaggaactaacattcaccactgtactgagtgaccaacaggtggtggagctgatccctgggggtgcaggcatcgtcgtgggatatggggaccgttctcgtttcatccaactggtccagaaggcacggctagaggagagcaaggagcaggtggcagctatgcaggcaggtctgctgaaggtggtaccacaggctgtgctggacttgctgacctggcaagagttggagaagaaagtgtgtggggatccagaggtcactgtggatgctctgcgcaagctcacccggtttgaggacttcgagccatctgactcgcgggtgcagtatttctgggaggcactgaacaacttcaccaacgaggaccggagccgcttcctgcgctttgtcacgggccgcagtcgcctgccagcacggatctacatctacccagacaagctgggctacgagaccacagacgcgctgcccgagtcttccacttgctccagcaccctcttcctgccacactatgccagtgccaaggtatgcgaggagaagctccgctatgcggcctacaactgcgtggccatcgacactgacatgagcccttgggaggagtgaggcgtgccgccggctgtgggaccagcaagactgcacgtgtccctcttggccttgcccagggcgaagacaccttccctgccctggtttggctgacgtgctcagcaaaaccccatgtgccctgctcctgtgtgcagttggggtaggggcagctggcatggtcaggtaacactagtggcccagccccgcagacccacaagccctacccgtgctggggcttgcttcccgaggtatttcacctcttaagagggaatcttccacaagcccagcacaagctgccaggcctgagctacttgaagggggccatctaggtccccaacccatggactttgcctccattttcagctccgccttttttctcctattttctctctggctttcttcagccatgactcacaactaaaaacataaaacactggaggttagtggaggcccctccccaagcagggagcctgggatgggcagggagtgatagccaaactccttggtcacctgctccaagaaggaagcagtagctgagcacctgccctcacattctgctcttttcccctctccctccataccagagatgtggtgagctctgttcttctaccaacccagtctcaacacacaaagtgccaccaccttccctgactcagaacccacatccactcaatgtgaactctactaccacgacctccccatattcctcacttctccatcacctccagcctgactccctgtctgccctttcacccccaagattttgcacaggttaaggccagttatggcctttttgaaatctgtaatagctcccctttccccaactctaaagcctagaccttaaacctgttcctagagctatgcacacccctgccccagtttaccgttcctccctcagggcctccgtgacactccatgaaaagaagttcttgcataccggaaagttgaataaatggatgaattcattccttca

SEQ ID NO: 1789 - DNA, 2315 bp, Homo sapiens
ggagttgcagtttgagagcagttccgggcagggaggcgcctttgctgccctcacagacttggcccctagcagtgcagaactacaagtcccagggatcctagcgaccgtccgtccgtagtcaagttgccggtggaattggcccaggatgacagctggagaatggagtcagttttatccaagtatgaagatcagattactattttcactgactacctagaagaatatccagatacagatgagctggtatggatcttagggaagcagcatctccttaaaacagaaaaatctaagctgttgtctgatataagtgctcgtctatggtttacatacagaaggaaattttcaccaattggtggaacgggcccttcatcagatgctggttggggatgtatgctacgctgtggacagatgatgctggctcaagcccttatctgtagacacttgggaagggactggagctgggagaaacaaaaagaacaacccaaagaataccaacgcatcctacagtgcttcttagatagaaaagattgttgctactctatccatcaaatggcacaaatgggtgtaggagaagggaaatcaattggagaatggtttggaccaaatacagttgcacaggtgttaaaaaaacttgctttatttgacgaatggaattccttggctgtttatgtttcaatggataacacagtggtcattgaagatatcaaaaaaatgtgccgtgtccttcccttgagtgctgacacagctggtgacaggcctcccgattctttaactgcttcaaaccagagtaagggcacctctgcctactgctcagcctggaaacccctgctgctcattgtgccccttcgcctgggcataaaccaaatcaatcctgtctatgttgatgcattcaaagagtgttttaagatgccacagtctttaggggcattaggaggaaaaccaaataacgcgtattatttcataggattcttaggtgacgagctcatcttcttggaccctcatacaacccagacctttgttgacactgaagagaatggaacggttaatgaccagactttccattgcctgcagtccccacagcgaatgaacatcctaaacctggatccttcagttgcattgggatttttctgcaaagaagaaaaagactttgataactggtgtagccttgttcagaaggaaattctaaaggagaatttaaggatgtttgaattagttcagaaacatccatcacactggcctccctttgtacctccagccaagccagaagtgacaaccactggggcagaattcattgactctactgagcaactggaggagtttgatctggaggaagattttgagattctgagtgtgtagaatcctgggaactcaacttgaaggtctgtcttccatctggcaccataaaaacatgaacttattgcataaaacttttctagtcagcaagtgcctgatatgccaatagcatacaaactcaatagcaatcatgactgagccaatcactgtttctcagaaaaacaaaacaaaacaaaacaaatgacagtaacccttccccggaaagaaatagaacaatcatggagcctaggagcagagagatgaggaggagttcattgcttcccagcttgtgttatatggctacagcaagtcttcagctgctgcaatgaggaaatgggcatctggaagacaaacagcaactctcagcttgcttcaagaaccagcagataagagatggttaagctgttcttcaccctttcagatgtgacctcttttggactaagcagcaatctgttctcttgctcaaataataaagtgactgaatcagggaggaaaaggttcttgttaaattatttgattgtgtagttgaagtaattataatttatatcaaaacgtttgtcaaagaaacgatgtcaaatatacacttcttgatctcccttctgtttgcggggatcttactatttgatgggtcactgtccccattcttactgatacttttgtcagatatcaccctgtccttaaatcatgatcacttaaatcaggggtcagcaaactttttctgtaaagggccagacgggaaatattttgggctttgcaggccatgcggcctctgtcacatctactcaactctgctgttgacatgcaaaagcagcaatagacaatatgcgtgtaaatgagtgtggctgtaatccaagaaaactttatttacaaaagcaggtggagggctgggtttggcctgcaggctgtagcttgccaatcagtgacttaaattgttgatttttgtttgataaattaaaaataaattgtgtttgaagtatacccta

SEQ ID NO: 1790 - DNA, 2650 bp, Homo sapiens
atggacttacaccgggcagccttcaagatggagaactcatcctaccttcccaaccctctggcatccccagcactgatggtcctggcatccacggctgaggccagccgtgatgcttccatcccttgtcagcagccacgaccctttggtgtacctgtctcagttgacaaggacgtgcatattcctttcaccaacggttcctatacctttgcctctatgtaccatcggcaaggtggggtgccaggcacttttgccaatcgtgatttccccccttctctactacacctccaccctcaatttgctcccccaaatctagattgcaccccaatcagtatgctgaatcatagtggtgtgggggctttccggccctttgcctccaccgaggaccgggagagctatcagtcagcctttacgccggccaagcgacttaagaactgccatgacacagagtctccccacttgcgcttctcagatgcagatggcaaggaatatgactttgggacacagctgccatctagctcccccggttcactaaaggttgatgacactgggaagaagatttttgctgtctctggcctcatttctgatcgggaagcctcatctagcccagaggatcggaatgacagatgtaagaagaaagcagcggcattgttcgacagccaggccccaatttgccccatctgccaggtcctgctgaggcccagtgagctgcaggagcatatggagcaggaactggagcagctagcccaactgccctcgagcaagaattcccttctgaaggatgccatggctccaggcaccccaaagtccctcctgttgtctgcttccatcaagagggaaggagagtctccaacggcatcaccccactcatctgccaccgatgacctccaccattcagacagataccagacctttctgcgagtacgagccaaccggcagacccgactgaatgctcggattgggaaaatgaaacggaggaagcaagatgaagggcagagggaaggctcctgcatggctgaggatgatgctgtggacatcgagcatgagaacaacaaccgctttgaggagtatgagtggtgtggacagaagcggatacgggccaccactctcctggaaggtggcttccgaggctctggcttcatcatgtgcagcggcaaagagaacccggacagtgatgctgacttggatgtggatggggatgacactctggagtatgggaagccacaatacacagaggctgatgtcatcccctgcacaggcgaggagcctggtgaagccaaggagagagaggcacttcggggcgcagtcctaaatggcggccctcccagcacgcgcatcacacctgagttctctaaatgggccagtgatgagatgccatccaccagcaatggtgaaagcagcaagcaggaggccatgcagaagacctgcaagaacagcgacatcgagaaaatcaccgaagattcagctgtgaccacgtttgaggctctgaaggctcgggtcagagaacttgaacggcagctatctcgtggggaccgttacaaatgcctcatctgcatggactcgtactcgatgcccctaacgtccatccagtgttggcacgtgcactgcgaggagtgctggctgcggaccctgggtgccaagaagctctgccctcagtgcaacacgatcacagcgcccggagacctgcggaggatctacttgtgagctatctgccccaggcaggcctcgcctccagcagccccacctgcccccagcctctgtgacagtgaccgtctccctttgtacatacttgcacacaggttccccatgtacatacatgcacatactcaaacatgcgtacacacacacacatttacacacgcaggactctggagccagagtagaggctgtggcccaggcactacctgctggctcccacctatggtttgggggccatacctgttccagctctgttcccagggtggggcagggaggtgggggttgggggagtagtggggcacggctcctaagatccagcccccatactgacagacggacagacagacatgcaaacaccagactgaagcacatgtaatatagaccgtgtatgtttacaatgttgtgtataaatgggacaactcctcgccctctacctgtcccctccccctttggttgtatgattttcttcttttttaagaacccctggaagcagcgcctccttcagggttggctgggagctcggcccatccacctcttggggtacctgcctctctctctcctgtggtgtcccttccctctcccatgtgctcggtgttcagtggtgtatatttcttctcccagacatggggcacacgccccaagggacatgatcctctccttagtcttagctcatggggctctttataaggagttggggggtagaggcaggaaatgggaaccgagctgaagcagaggctgagttagggggctagaggacagtgctcctggccacccagcctctgctgagaaccattcctgggattagagctgcctttcccagggaaaaagtgtcgtctccccgaccctcccgtgggccctgtggtgtgatgctgtgtctgtatattctatacaaaggtacttgtcctttccctttgtaaactacatttgacatggattaaaccagtataaacagttg

SEQ ID NO: 1791 - DNA, 1878 bp, Homo sapiens
atgccgagagcccggagcggccggaggagcagaggggccggcgggagggaggaaacctttctgcgagtacgagccaaccggcagacccgactgaatgctcggattgggaaaatgaaacggaggaagcaagatgaagggcaggtatgtcccctgtgcaaccgccccctggcaggatcggagcaggagatgagtaggcatgtggagcattgcctttctaagagggaaggctcctgcatggctgaggatgatgctgtggacatcgagcatgagaacaacaaccgctttgaggagtatgagtggtgtggacagaagcggatacgggccaccactctcctggaaggtggcttccgaggctctggcttcatcatgtgcagcggcaaagagaacccggacagtgatgctgacttggatgtggatggggatgacactctggagtatgggaagccacaatacacagaggctgatgtcatcccctgcacaggcgaggagcctggtgaagccaaggagagagaggcacttcggggcgcagtcctaaatggcggccctcccagcacgcgcatcacacctgagttctctaaatgggccagtgatgcagagatgccatccaccagcaatggtgaaagcagcaagcaggaggccatgcagaagacctgcaagaacagcgacatcgagaaaatcaccgaagattcagctgtgaccacgtttgaggctctgaaggctcgggtcagagaacttgaacggcagctatctcgtggggaccgttacaaatgcctcatctgcatggactcgtactcgatgcccctaacgtccatccagtgttggcacgtgcactgcgaggagtgctggctgcggaccctgggtgccaagaagctctgccctcagtgcaacacgatcacagcgcccggagacctgcggaggatctacttgtgagctatctgccccaggcaggcctcgcctccagcagccccacctgcccccagcctctgtgacagtgaccgtctccctttgtacatacttgcacacaggttccccatgtacatacatgcacatactcaaacatgcgtacacacacacacatttacacacgcaggactctggagccagagtagaggctgtggcccaggcactacctgctggctcccacctatggtttgggggccatacctgttccagctctgttcccagggtggggcagggaggtgggggttgggggagtagtggggcacggctcctaagatccagcccccatactgacagacggacagacagacatgcaaacaccagactgaagcacatgtaatatagaccgtgtatgtttacaatgttgtgtataaatgggacaactcctcgccctctacctgtcccctccccctttggttgtatgattttcttcttttttaagaacccctggaagcagcgcctccttcagggttggctgggagctcggcccatccacctcttggggtacctgcctctctctctcctgtggtgtcccttccctctcccatgtgctcggtgttcagtggtgtatatttcttctcccagacatggggcacacgccccaagggacatgatcctctccttagtcttagctcatggggctctttataaggagttggggggtagaggcaggaaatgggaaccgagctgaagcagaggctgagttagggggctagaggacagtgctcctggccacccagcctctgctgagaaccattcctgggattagagctgcctttcccagggaaaaagtgtcgtctccccgaccctcccgtgggccctgtggtgtgatgctgtgtctgtatattctatacaaaggtacttgtcctttccctttgtaaactacatttgacatggattaaaccagtataaacagtt

SEQ ID NO: 1792 - DNA, 2199 bp, Homo sapiens
cgcctttgctgccctcacagacttggcccctagcagtgcagaactacaagtcccagggatcctagcgaccgtccgtccgtagtcaagttgccggtggaattggcccaggatgacagctggagaatggagtcagttttatccaagtatgaagatcagattactattttcactgactacctagaagaatatccagatacagatgagctggtatggatcttagggaagcagcatctccttaaaacaggtggaacgggcccttcatcagatgctggttggggatgtatgctacgctgtggacagatgatgctggctcaagcccttatctgtagacacttgggaagggactggagctgggagaaacaaaaagaacaacccaaagaataccaacgcatcctacagtgcttcttagatagaaaagattgttgctactctatccatcaaatggcacaaatgggtgtaggagaagggaaatcaattggagaatggtttggaccaaatacagttgcacaggtgttaaaaaaacttgctttatttgacgaatggaattccttggctgtttatgtttcaatggataacacagtggtcattgaagatatcaaaaaaatgtgccgtgtccttcccttgagtgctgacacagctggtgacaggcctcccgattctttaactgcttcaaaccagagtaagggcacctctgcctactgctcagcctggaaacccctgctgctcattgtgccccttcgcctgggcataaaccaaatcaatcctgtctatgttgatgcattcaaagagtgttttaagatgccacagtctttaggggcattaggaggaaaaccaaataacgcgtattatttcataggattcttaggtgacgagctcatcttcttggaccctcatacaacccagacctttgttgacactgaagagaatggaacggttaatgaccagactttccattgcctgcagtccccacagcgaatgaacatcctaaacctggatccttcagttgcattgggatttttctgcaaagaagaaaaagactttgataactggtgtagccttgttcagaaggaaattctaaaggagaatttaaggatgtttgaattagttcagaaacatccatcacactggcctccctttgtacctccagccaagccagaagtgacaaccactggggcagaattcattgactctactgagcaactggaggagtttgatctggaggaagattttgagattctgagtgtgtagaatcctgggaactcaacttgaaggtctgtcttccatctggcaccataaaaacatgaacttattgcataaaacttttctagtcagcaagtgcctgatatgccaatagcatacaaactcaatagcaatcatgactgagccaatcactgtttctcagaaaaacaaaacaaaacaaaacaaatgacagtaacccttccccggaaagaaatagaacaatcatggagcctaggagcagagagatgaggaggagttcattgcttcccagcttgtgttatatggctacagcaagtcttcagctgctgcaatgaggaaatgggcatctggaagacaaacagcaactctcagcttgcttcaagaaccagcagataagagatggttaagctgttcttcaccctttcagatgtgacctcttttggactaagcagcaatctgttctcttgctcaaataataaagtgactgaatcagggaggaaaaggttcttgttaaattatttgattgtgtagttgaagtaattataatttatatcaaaacgtttgtcaaagaaacgatgtcaaatatacacttcttgatctcccttctgtttgcggggatcttactatttgatgggtcactgtccccattcttactgatacttttgtcagatatcaccctgtccttaaatcatgatcacttaaatcaggggtcagcaaactttttctgtaaagggccagacgggaaatattttgggctttgcaggccatgcggcctctgtcacatctactcaactctgctgttgacatgcaaaagcagcaatagacaatatgcgtgtaaatgagtgtggctgtaatccaagaaaactttatttacaaaagcaggtggagggctgggtttggcctgcaggctgtagcttgccaatcagtgacttaaattgttgatttttgtttgataaattaaaaataaattgtgtttgaagt

SEQ ID NO: 1793 - DNA, 779 bp, Homo sapiens
aagtagttgctgggacagcgaaatggaggggtgtgtgtctaacctaatggtctgcaacctggcctacagcgggaagctggaagagttgaaggagagtattctggccgataaatccctggctactagaactgaccaggacagcagaactgcattgcactgggcatgctcagctggacatacagaaattgttgaatttttgttgcaacttggagtgccagtgaatgataaagacgatgcagcttcgaaaaacaggcatgagatcgctgtcatgttactggaaggcggggctaatccagatgctaaggaccattatgaggctacagcaatgcaccgggcagcagccaagggtaacttgaagatgattcatatccttctgtactacaaagcatccacaaacatccaagacactgagggtaacactcctctacacttagcctgtgatgaggagagagtggaagaagcaaaactgctggtgtcccaaggagcaagtatttacattgagaataaagaagaaaagacacccctgcaagtggccaaaggtggcctgggtttaatactcaagagaatggtggaaggttaaacagcttggatttattcttactttgtatgttgtgttgttgtccccagtgtcctacaaactaatgtatttgtgcacaagacatcatctatgaatgatgaagttttctcaccttcaaagtcttataaacatgttgactcttgttcctgctgagttacttgttcgaagcttacagcttgttttccaggcatcgaataactgt

SEQ ID NO: 1794 - DNA, 878 bp, Homo sapiens
aagtagttgctgggacagcgaaatggaggggtgtgtgtctaacctaatggtctgcaacctggcctacagcgggaagctggaagagttgaaggagagtattctggccgataaatccctggctactagaactgaccaggacagcagaactgcattgcactgggcatgctcagctggacatacagaaattgttgaatttttgttgcaacttggagtgccagtgaatgataaagacgatgcagcttcgaaaaacaggcatgagatcgctgtcatgttactggaaggcggggctaatccagatgctaaggaccattatgaggctacagcaatgcaccgggcagcagccaaggacacttagcctgtgatgaggagagagtggaagaagcaaaactgctggtgtcccaaggagcaagtatttacattgagaataaagaagaaaagacacccctgcaagtggccaaaggtggcctgggtttaatactcaagagaatggtggaaggttaaacagcttggatttattcttactttgtatgttgtgttgttgtccccagtgtcctacaaactaatgtatttgtgcacaagacatcatctatgaatgatgaagttttctcaccttcaaagtcttataaacatgttgactcttgttcctgctgagttacttgttcgaagcttacagcttgttttccaggcatcgaataactgttgagattgttctactgttgtcgtatattcttctatattgaattctggttaatttggagtaactaattctgtggctgttgtgagtcttcagcaccctcccatgtaccttatatccctctctgaaacagaacagctccaatagcaacaagctagttgttctgccagatgtttctatgtgg

SEQ ID NO: 1795 - DNA, 1201 bp, Homo sapiens
cttcacttcatctcttccccctcacccacagcagcactggctccttggtgtgtgtatggccgaagagggcctggacacagggtaccctgggtgaaagatggggctgaggctccaaggctcctgctgtacttttcttctttttgagcaggagctggagggtgcctcaggaatacaggagggacatgggaggagggctgttgggctgagggctccctgtctggctgccatctcttcttcctgctaccctgttcacaaactgggggtgcttaactccctctgtgaatcaacatgaagtcactgctggcaacctagagcctgcgagacatctggccctgatggagggggagggaaaggtgtctggaacccaaactttctgcattatgatccccacccccaacctctctcacgtacacctgcgtgttcatgtacacatacatgtacatagcatcccttgagctgtcctcacctgacctactgaactctgaggtggtccgggtcccccagagatggctgggtagctggttttggcagcctctacctgtgaggtgtgaagttgggggctggggtggcaggtgagtgggggggatggtccttggagctggctggggctgggcttaccagctccacctcctgcaggctctgaagcggaagccagatttgttcctgtgtgaacgattggatgtcaaagctgtgttccagtgtgctgtgctggccctcaagttccctgaggcacctactgtcaaggcctcctgtggcttctttacagagctgctgcctcggtgtggggaagtagagtctgtgggaaaggtggtacaggaagacggtcgtatgctgctcatagcagtgctggaggccattgggggccaggcctcccgcagcctcatggactgctttgccgatatcctgttcgccctgaacaagcactgcttcagcctcctgagcatgtggatcaaggaggccctgcagccacctggtttcccctctgcccgcctcagccctgaacagaaggataccttcagccagcagatccttcgcgagcgagtgaacaagaggcgggtgaaggagatggtgaaggagttcacactgctgtgccggggtctccatggcacagattacacagctgactactgaggggtgcccccatcccatccaccccttctcttcatccttccctattcccaaagagtaaacctggaccctc

SEQ ID NO: 1796 - DNA, 3894 bp, Homo sapiens
cggccggcctggcttgtcttgtcagtcactggggcggaggcagcggctgtagcggggctgtagccgggcgttgagcacagcgcgggccaggccgaacggaagggacctgccacagcccctcaactccacggactcttcgccctagactagcggagctgcatctccgcgcttcgttggacgcctccgtaaccacgaagggctctctctctcccgtgaccctccagccccatgacctgttcatagcagccgagagctcacccaggcgggggtgttgtgggtacaggccatcgaccctgtgacccctcaagagccagggactcggtttcccccgcaggcctccctcccctgtgactccctccacacagattctggggacagagctgttacctgccactaggatccccgcctgagagctcctcactgacggctccctcctcggagtccccttcattgggtctcctaagagcaccaattttggtctctggcaagcctcccacccccaaacgaggtggggaggcctcggcagccatgcccgccctgggccccccctcaccccaccactccctgggcacccaagccggggtctagcagggggccagcagccaaggggctggggcaggagacagatcagggcccacctccctgccagggagggagcaaagatggagcggcgggaggagcagccgggggctgcaggggctggagcagcaccagccttggacttcactgtggagaacgtggagaaggcgctgcaccagctctactatgatcccaacattgagaataagaacctggctcagaagtggctgatgcaggcccaggtctccccacaggcctggcacttcagctggcagctactgcagcccgacaaggtaccagagatccagtactttggggccagtgctcttcacatcaagatctctcgctactggagtgacatccccactgaccagtatgaaagcctaaaggcacagctcttcacccagatcacccgctttgccagtggctccaagattgtactgactcggctgtgcgtggcactggcctcactggctctcagcatgatgcctgacgcttggccatgtgctgtggcagatatggtacgactcttccaggctgaggactcaccagtggatgggcagggccgctgcctagccctgttagagctgctgacagtgctgcctgaggagttccagaccagtcgcctaccccagtaccgcaaaggcctggtgcggaccagcctggcggtggaatgtggggctgtcttcccgctgctggagcagctgctacagcagcccagctcacccagctgtgtgcgtcagaaggtgctcaagtgtttctccagctgggtgcagctggaggtgccgctgcaggactgtgaggcgctcattcaggctgcctttgctgctctgcaggactcggagctcttcgacagcagtgtggaggccattgtgaatgccatctcacagcctgatgcccagaggtacgtgaacacactcctgaaactcatcccgctggtgctgggtctgcaggaacaactgcggcaggcagtgcagaatggggacatggagacctcccatggcatctgtcgcatcgctgtggccctgggcgagaaccactcccgggccttgctggaccaagtagagcactggcagagtttcctggcactcgtcaacatgattatgttctgcacaggcatccctggccactatcctgtcaatgagaccaccagctccctaaccctcaccttctggtacacactgcaggatgatattctatcctttgaggcagagaagcaggctgtataccagcaggtgtaccggccagtctacttccagctggtggatgtgcttctgcacaaggcccagttcccttctgatgaggaatatggattctggtcctcagacgagaaggagcagttccgaatttacagggtggacatctcagacacgctcatgtatgtctatgagatgttgggggccgagctgctcagcaacctctatgacaagctgggtcgtttgctcaccagctcagaggagccctactcctggcagcacacagaggccctcctctacggcttccaatccatcgcagagaccattgacgtcaactattctgatgtggtgcctgggctcattggcctcatcccacggatcagcatcagcaacgtgcagctggcagacactgtcatgttcaccattggagctctgtctgaatggctggctgaccaccccgtcatgatcaacagtgttctgcccttggtactgcatgccctaggcaatcctgagctgtctgtctcttctgtgtccaccctcaagaagatctgccgagagtgcaagtatgacctgcctccctatgctgccaacattgtggctgtgtcccaggatgtgctgatgaaacagatccacaagacaagccagtgcatgtggctgatgcaggcgctgggcttcctgctgtcagctcttcaagtggaggagatccttaagaacctgcactcgcttatctcaccctatatccagcaactggagaagctggcagaggagatacccaatccctccaacaagctggccattgttcacatcttggggcttctctccaacctcttcaccacactggacatcagtcatcatgaggatgatcatgaaggccctgagcttcggaagctgccagtgccacagggacccaaccccgtggtggtggtgctgcagcaggtcttccagcttatccagaaggtgctgagcaaatggttgaatgatgcccaggttgtggaggcggtgtgcgctatctttgagaagtctgttaagacgctgctggatgactttgcccccatggtgccacagctgtgtgagatgctgggtcggatgtacagcaccatcccccaggcctctgctcttgacctcactcgacagctggtccacatctttgctcatgagcctgcccactttcccccaattgaggccctcttcctgctcgtcacctccgtcacactcactctcttccagcaagggcccagggatcatcctgatattgttgattcatttatgcaactcctggcacaggctctgaagcggaagccagatttgttcctgtgtgaacgattggatgtcaaagctgtgttccagtgtgctgtgctggccctcaagttccctgaggcacctactgtcaaggcctcctgtggcttctttacagagctgctgcctcggtgtggggaagtagagtctgtgggaaaggtggtacaggaagacggtcgtatgctgctcatagcagtgctggaggccattgggggccaggcctcccgcagcctcatggactgctttgccgatatcctgttcgccctgaacaagcactgcttcagcctcctgagcatgtggatcaaggaggccctgcagccacctggtttcccctctgcccgcctcagccctgaacagaaggataccttcagccagcagatccttcgcgagcgagtgaacaagaggcgggtgaaggagatggtgaaggagttcacactgctgtgccggggtctccatggcacagattacacagctgactactgaggggtgcccccatcccatccaccccttctcttcatccttccctattcccaaagagtaaacctggaccctcactgctgtctctgcctcctttctgctgtcaccaccacctaactgaaagcctgggtccagaaggcctgggggaaggatgggaggatgcttggacccaggccttgggagggaatggtgggaacatcctctagctcccaggttggaagagatactactgtagccaagccacctaggctggagcccttcagaatactgtcattgtccttggggcggggtggttgcagtagtgtcatcaacccccccatccccattaaattaatcccaacatgca

SEQ ID NO: 1797 - DNA, 2907 bp, Homo sapiens
atgaggttgctgaggcatacagagagtgagcagtggtttcatcgcttccctctgtgtccttctctcactttctgggccccagtggccatgtggccacagacacactgtgtaggtggtcggtcatcaggcttaacgaaatggacatattcattttcagcatcactccaagatgggtcgttcccctatgactctgtcccttggcagcagaacaccaaccagcctcccggctccctttccgtggtcaccacggtttggggagtaaccaacacatcccagagccaggctgacgttctcatcccccacgccacctgccgcccaggcccgctccttatcaccgcttgggaaccctatggccaatgccaacaaccccatgaatccaggcggcaaccccatggcgtcgggcatgaccaccagcaacccaggcctcaactccccacagtttgcggggcagcagcagcagttctcagccaaggctggccccgctcagccctacatccagcagagcatgtatggccggcccaactaccccggcagcgggggctttggggccagcccgcggcagccgctgcagcagcggcagtggcagcagcagcagccacagctacagccacagccacggccactgtggcagccctgcaggagacacagaacaaggatataaaccagtatggaccggccccagtgctgctccctgaccttctgaaggatgggttaggggatgaggagaggggagcccccataggaatgcagaacagcatgaaccccgcgagcatggcggctggcatgacgccctcggggatgagcggccctcccatgggcatgaaccagccccggccgcccggcatcagcccctttggcacacacgggcagcggatgccccagcagacctacccgggcccccggccccagtcccttcctattcagaacataaagaggccataccctggagagcccaactatggaaaccagcaatatggaccaaacagccagttccccacccagccaggccagtacccagcccccaaccccccgaggccactcacctcccccaactacccaggacagaggatgcccagccagccgagctccgggcagtacccgccccccacggtcaacatggggcagtattacaagccagaacagtttaatggacaaaataacacgttctcgggaagcagctacagtaactacagccaagggaatgtcaacaggcctcccaggccggttcctgtggcaaattacccccactcacctgttccagggaaccccacaccccccatgacccctgggagcagcatccctccatacctgtcccccagccaagacgtcaaaccacccttcccgcctgacatcaagccaaatatgagcgctctgccaccacccccagaccacaatgacgagctgcggctcacattccctgtgcgggatggcgtggtgctggagcccttccgcctggagcacaacctggcggtcagcaaccatgtgttccacctgcggcccacggtccaccagacgctgatgtggtctgacctggagctgcagttcaagtgctaccaccacgaggaccggcagatgaacaccaactggcccgcctcggtgcaggtcagcgtgaacgccacgcccctcaccattgagcgcggcgacaacaagacctcccacaagcccctgcacctgaagcacgtgtgccagccgggccgcaacaccatccagatcaccgtcacggcctgctgctgctcccacctcttcgtgctgcagctggtacaccggccctccgtccgctctgtgctgcaaggactcctcaagaagcgcctcctgcccgcagagcactgtatcacgaaaaagcggaatttcagcagcgtggctgcctcctcgggcaacacgaccctcaacggggaggatggggtggagcagacggccatcaaggtgtctctgaagtgccccatcacattccggcgcatccagctgcctgctcgaggacacgattgcaagcatgtgcagtgctttgatctggagtcatacctgcagctgaattgcgagagagggacctggaggtgtcctgtgtgcaaaaccgctctgctggagggcctggaggtggatcagtacatgtggggaatcctgaatgccatccactccgagtttgaagaggtcaccatcgatcccacgtgcagctggcggccggtgcccatcaagtcggacttacacatcaaggacgaccctgatggcatcccctccaagcggttcaagaccatgagtcccagccagatgatcatgcccaatgtcatggagatgatcgcagccctgggccccggcccgtccccctatcccctcccgcctcccccagggggcaccaactccaacgactacagcagccaaaacaactaccaaggccatggcaactttgacttcccccacgggaaccctggagggacatccatgaatgacttcatgcacgggcccccccagctctcccaccccccggacatgcccaacaacatggccgccctcgagaaacccctcagccaccccatgcaggaaactatgccacacgctggcagctctgaccagccccacccctccatacaacaaggtttgcacgtaccacaccccagcagccagtcagggcctccattacatcacagtggggctcctcctcctcctccttcccagcctccccggcagccgccacaggccgctcccagcagccatccacacagcgacctgacctttaacccctcctcagccttagagggtcaggccggagcgcagggagcgtccgacatgccggagccttcgctggatctccttcccgaactcacaaatcctgacgagctcctgtcttatctggacccccccgacctgccgagcaatagtaacgatgacctcctgtctctatttgagaacaactga

SEQ ID NO: 1798 - DNA, 607 bp, Homo sapiens
ccaagatggcgatggagatgaggcttccagtggctcgcaagcctcttagcgagagactgggccgcgacactaagaaacatctagtggtgccgggggatacaatcactacggacacaggattcatgcggggccatggaacgtatatgggagaagagaagctcattgcatctgttgctggctctgtggagagagtaaacaagttgatctgtgtgaaagctttgaaaaccagatacattggtgaagtaggagacatcgtagtgggacgaatcacagaggttcaacagaagaggtggaaggtggagaccaactccaggctggattcggtcttgctgctctcgtccatgaaccttcctggaggagagctgaggagaagatctgcagaagatgagcttgcaatgagaggtttcttacaggaaggggaccttatcagtgctgaggtccaggcagtgttctctgacggagctgtctctttgcacacgaggagcctgaaatatggaaaaacccactttcatgatttgccatgtggtgcctcagtgattctcggtaacaacggcttcatctggatttacccaacacctgagcacaaagaagaggaagcagggggctt

SEQ ID NO: 1799 - DNA, 1885 bp, Homo sapiens
gccaagatggcgatggagatgaggcttccagtggctcgcaagcctcttagcgagagactgggccgcgacactaagaaacatctagtggtgccgggggatacaatcactacggacacaggattcatgcggggccatggaacgtatatgggagaagagaagctcattgcatctgttgctggctctgtggagagagtaaacaagttgatctgtgtgaaagctttgaaaaccagatacattggtgaagtaggagacatcgtagtgggacgaatcacagagaggagaagatctgcagaagatgagcttgcaatgagaggtttcttacaggaaggggaccttatcagtgctgaggtccaggcagtgttctctgacggagctgtctctttgcacacgaggagcctgaaatatggaaaactaggtcagggggttttggtccaggtttccccctccctggtgaaacggcagaagacccactttcatgatttgccatgtggtgcctcagtgattctcggtaacaacggcttcatctggatttacccaacacctgagcacaaagaagaggaagcagggggcttcattgcaaacctggagcctgtctctcttgctgatcgagaggtgatatcccggcttcggaactgcatcatctcgctggtaactcagaggatgatgctgtatgataccagcatcctgtactgctatgaagcatcccttccacatcagatcaaagacatcttaaagccagaaataatggaggagattgtgatggaaacacgccagaggcttttggaacaggagggataaggaggtgctccagaagcacgggactgtggaccttgcaggagtgaagactgtgatgtgtggtccccatatgtggctcagcaaagactcgagagatcatccctttgtctgcattgacggccctgtgacggcctccagcccacaggcctgctttctcctgtcctaacaccaagcctgggtggcagatgaacagtgcttccttgggttgccagctgagtcccggtattagggaatagtttcagctctttcaaagtgcacagtgttacagtcgaatgggctcccatcctggaataatatggagaatcctttgtcttccactcactgtcattcacaaggcacagtgccccatgaaattgccccaatagaaaacatggcatccctgacctccaaatggtctgttttggcctccattcctatatcctttaaatgactgagaatgcagctggtaaagttggaagaataaagttaaccaagcaggccaggcacggtggctcacgcctataatcccagcacttagggaggccaaggcgggcagatcacctgaggtcaatagttcgagaccagcctggccaacaaggtgaaaccccatctctactaaaaatacaaaaaattagccaggtgtggtggtgtgcacctgtagtcccagctatttgggaggctgaggtgggagaatcacttgaacctgggaggcggaggttgcagtgagctgaaatcgcgtaccacactccagcctgggtgacagagcgagactgtgtttcaaagaaaaaaaaaaacaagcagccttttgcttggttggaatctgattttctgttgcgtgttccttgtagccatagatgtgattatgtccacaccgggctgccttaatctgtcctgcttggagagtgacttgtaagatgctgaattattcatgataatacagtgaatgttctgggtccatgtactcagataaacatgaagaaaataagcaaagaaaaatggagactgggaaagcaaagctgttttcatcctataattgaagtagtgtggagcattaacttgtggatgattcagagttaaaagataaaaagacgccagagttctcgctgaagaa

SEQ ID NO: 1800 - DNA, 1957 bp, Homo sapiens
attggcgccaagatggcgatggagatgaggcttccagtggctcgcaagcctcttagcgagagactgggccgcgacactaagaaacatctagtggtgccgggggatacaatcactacggacacaggattcatgcggggccatggaacgtatatgggagaagagaagctcattgcatctgttgctggctctgtggagagagtaaacaagttgatctgtgtgaaagctttgaaaaccagatacattggtgaagtaggagacatcgtagtgggacgaatcacagaggttcaacagaagaggtggaaggtggagaccaactccaggctggattcggtcttgctgctctcgtccatgaaccttcctggaggagagctgaggagaagatctgcagaagatgagcttgcaatgagaggtttcttacaggaaggggaccttatcagtgctgaggtccaggcagtgttctctgacggagctgtctctttgcacacgaggagcctgaaatatggaaaagtttccccctccctggtgaaacggcagaagacccactttcatgatttgccatgtggtgcctcagtgattctcggtaacaacggcttcatctggatttacccaacacctgagcacaaagaagaggaagcagggggcttcattgcaaacctggagcctgtctctcttgctgatcgagaggtgatatcccggcttcggaactgcatcatctcgctggtaactcagaggatgatgctgtatgataccagcatcctgtactgctatgaagcatcccttccacatcagatcaaagacatcttaaagccagaaataatggaggagattgtgatggaaacacgccagaggcttttggaacaggagggataaggaggtgctccagaagcacgggactgtggaccttgcaggagtgaagactgtgatgtgtggtccccatatgtggctcagcaaagactcgagagatcatccctttgtctgcattgacggccctgtgacggcctccagcccacaggcctgctttctcctgtcctaacaccaagcctgggtggcagatgaacagtgcttccttgggttgccagctgagtcccggtattagggaatagtttcagctctttcaaagtgcacagtgttacagtcgaatgggctcccatcctggaataatatggagaatcctttgtcttccactcactgtcattcacaaggcacagtgccccatgaaattgccccaatagaaaacatggcatccctgacctccaaatggtctgttttggcctccattcctatatcctttaaatgactgagaatgcagctggtaaagttggaagaataaagttaaccaagcaggccaggcacggtggctcacgcctataatcccagcacttagggaggccaaggcgggcagatcacctgaggtcaatagttcgagaccagcctggccaacaaggtgaaaccccatctctactaaaaatacaaaaaattagccaggtgtggtggtgtgcacctgtagtcccagctatttgggaggctgaggtgggagaatcacttgaacctgggaggcggaggttgcagtgagctgaaatcgcgtaccacactccagcctgggtgacagagcgagactgtgtttcaaagaaaaaaaaaaacaagcagccttttgcttggttggaatctgattttctgttgcgtgttccttgtagccatagatgtgattatgtccacaccgggctgccttaatctgtcctgcttggagagtgacttgtaagatgctgaattattcatgataatacagtgaatgttctgggtccatgtactcagataaacatgaagaaaataagcaaagaaaaatggagactgggaaagcaaagctgttttcatcctataattgaagtagtgtggagcattaacttgtggatgattcagagttaaaagataaaaagacgccagagttctcgctgaagaa

SEQ ID NO: 1801 - DNA, 2040 bp, Homo sapiens
ggcctggagttgtggagtcggatatcgcagctcccgactgagctgcgcctgcgcaactcattggcgccaagatggcgatggagatgaggcttccagtggctcgcaagcctcttagcgagagactgggccgcgacactaagaaacatctagtggtgccgggggatacaatcactacggacacaggattcatgcggggccatggaacgtatatgggagaagagaagctcattgcatctgttgctggctctgtggagagagtaaacaagttgatctgtgtgaaagctttgaaaaccagatacattggtgaagtaggagacatcgtagtgggacgaatcacagaggttcaacagaagaggtggaaggtggagaccaactccaggctggattcggtcttgctgctctcgtccatgaaccttcctggaggagagctgaggagaagatctgcagaagatgagcttgcaatgagaggtttcttacaggaaggggaccttatcagtgctgaggtccaggcagtgttctctgacggagctgtctctttgcacacgaggagcctgaaatatggaaaactaggtcagggggttttggtccaggtttccccctccctggtgaaacggcagaagacccactttcatgatttgccatgtggtgcctcagtgattctcggtaacaacggcttcatctggatttacccaacacctgagcacaaagaagaggaagcagggggcttcattgcaaacctggagcctgtctctcttgctgatcgagaggtgatatcccggcttcggaactgcatcatctcgctggtaactcagaggatgatgctgtatgataccagcatcctgtactgctatgaagcatcccttccacatcagatcaaagacatcttaaagccagaaataatggaggagattgtgatggaaacacgccagaggcttttggaacaggagggataaggaggtgctccagaagcacgggactgtggaccttgcaggagtgaagactgtgatgtgtggtccccatatgtggctcagcaaagactcgagagatcatccctttgtctgcattgacggccctgtgacggcctccagcccacaggcctgctttctcctgtcctaacaccaagcctgggtggcagatgaacagtgcttccttgggttgccagctgagtcccggtattagggaatagtttcagctctttcaaagtgcacagtgttacagtcgaatgggctcccatcctggaataatatggagaatcctttgtcttccactcactgtcattcacaaggcacagtgccccatgaaattgccccaatagaaaacatggcatccctgacctccaaatggtctgttttggcctccattcctatatcctttaaatgactgagaatgcagctggtaaagttggaagaataaagttaaccaagcaggccaggcacggtggctcacgcctataatcccagcacttagggaggccaaggcgggcagatcacctgaggtcaatagttcgagaccagcctggccaacaaggtgaaaccccatctctactaaaaatacaaaaaattagccaggtgtggtggtgtgcacctgtagtcccagctatttgggaggctgaggtgggagaatcacttgaacctgggaggcggaggttgcagtgagctgaaatcgcgtaccacactccagcctgggtgacagagcgagactgtgtttcaaagaaaaaaaaaaacaagcagccttttgcttggttggaatctgattttctgttgcgtgttccttgtagccatagatgtgattatgtccacaccgggctgccttaatctgtcctgcttggagagtgacttgtaagatgctgaattattcatgataatacagtgaatgttctgggtccatgtactcagataaacatgaagaaaataagcaaagaaaaatggagactgggaaagcaaagctgttttcatcctataattgaagtagtgtggagcattaacttgtggatgattcagagttaaaagataaaaagacgccagagttctcgctgaagaa

SEQ ID NO: 1802 - DNA, 4474 bp, Homo sapiens
ggagtttcggccttcgcctgctggaaaagcagtaggatcggccagtggcgacagcaggagctgagcctaagccctggcggggctttgggctgtagattcctgtctgactaaagggacctcaaaaaggagggaaaatggcttctgagtctgaaactctgaatcccagtgctaggataatgaccttttatccaactatggaagagttccgaaacttcagtagatacattgcctacattgaatcccaaggagctcatcgggcagggctagccaaggttgttcctccaaaagagtggaagccacgagcatcctatgatgacattgatgatttggtcattcctgcccccattcaacagctggtgacggggcagtctggcctctttactcagtacaacatacagaagaaagccatgactgttcgagagttccgcaagatagccaatagcgataagtactgtaccccacgctatagtgagtttgaagagctcgagcggaaatactggaaaaatcttacattcaatcctccaatctatggtgcagatgtgaatggtaccctctatgaaaagcatgttgatgagtggaatattggccggctgagaacaatcctggacttggtggaaaaggagagtgggatcaccattgagggtgtgaacaccccatacctgtactttggcatgtggaagacatcctttgcttggcacactgaagacatggacctctacagcatcaactacctgcactttggagaaccaaagtcctggtactctgttccacctgagcatggaaagcggttggaacgcctcgccaaaggctttttcccaggaagtgctcaaagctgtgaggcatttctccgccacaagatgaccctgatttccccgttaatgctgaagaaatatggaattccctttgacaaggtgactcaagaggctggagagtttatgatcactttcccttatggttaccatgccggctttaaccatggttttaactgtgcggagtctaccaattttgctacccgtcggtggattgagtacggcaagcaagctgtgctgtgctcctgtagaaaggacatggtgaagatctccatggatgtgtttgtgagaaagttccagccagaaaggtacaaactttggaaagctgggaaggacaacacagttattgaccatactctgcccacgccagaagcagctgagtttcttaaggagagtgaactgcctccaagagctggcaacgaggaggagtgcccagaggaggacatggaaggggtggaggatggagaggaaggagacctgaagacaagcctggccaagcaccgaatagggacaaagaggcaccgagtttgtcttgaaataccacaggaggtgagtcagagtgagctcttccccaaggaggatctgagttctgagcagtatgagatgacggagtgcccggcagccctcgcccctgtgaggcccacccatagctctgtgcggcaagttgaggatggtcttaccttcccagattattctgactccactgaagtcaaatttgaagagcttaaaaatgtcaaactagaagaggaggatgaggaggaagaacaagcagcagctgccttggatctttctgtgaatcctgcgtctgtagggggacgccttgtcttctcaggctccaaaaagaaatcatcttctagcctgggctctggctcttcacgggattctatctcttctgattcagaaactagtgagcctctctcctgccgagcccaagggcaaacgggagttctcactgtgcacagttatgccaaaggggatggcagggtcactgtgggagagccatgcacgaggaagaaaggaagcgccgctagaagtttcagtgagcgggagctggcagaggttgcagatgaatacatgttttccctagaagagaataagaagtccaagggacgccgtcagcctttaagcaagctcccccgccatcacccacttgtgctgcaggagtgtgtcagtgatgatgagacatctgaacagctgacccctgaggaagaggctgaggagacagaggcctgggccaagcctctgagccaactgtggcagaaccgacctccaaactttgaggctgagaaggaattcaatgagaccatggcccaacaggcccctcactgcgctgtctgtatgatcttccagacttatcatcaggttgaatttggaggctttaatcagaactgtggaaatgcttcagatttagccccccagaagcagaggaccaagccattgattccagaaatgtgcttcacttcgactggctgcagcacggacatcaacctttctactccttatcttgaggaggatggcaccagcatactcgtttcctgcaagaagtgcagcgtccgggtccatgccagttgctatggggtcccccctgcaaaggcttctgaagactggatgtgttctcggtgttcagccaatgccctagaggaggactgctgtttatgctcattacgaggaggggccctgcagagagcaaatgatgacaggtgggtccacgtttcatgtgctgtggcaattctggaagcaaggtttgtcaacattgcagaaagaagtccggtggatgtgagcaaaatccccctgccccgcttcaaactgaaatgtatcttctgtaagaagcggaggaaaagaactgctggctgctgtgtgcagtgttctcacggccgctgcccaactgccttccatgtgagctgcgcccaggctgccggtgtgatgatgcagcctgacgactggccttttgtggtcttcattacctgctttcggcacaagattcctaatttggagcgtgccaagggggccttgcaaagcatcactgcaggccagaaagtcattagcaagcataagaacgggcgcttctaccagtgtgaagtggtcaggctcaccaccgagaccttctatgaagtcaactttgatgatggctccttcagcgacaatctttatcctgaggacatagtgagccaggactgtctccagtttggtcctcctgctgaaggggaagtggtccaagtgagatggacagacggccaagtctatggagccaagtttgtggcctcccaccctatccaaatgtaccaggtggagtttgaggatggctcacaacttgtggttaagagagatgatgtatacacactggatgaagagcttcccaagagagtcaaatctagactgtcagtagcctcagacatgcgcttcaatgagattttcacagagaaagaggttaagcaagaaaagaaacggcaacgagttatcaactcaagataccgggaagattatattgagcctgcactataccgggccatcatggagtaggtgcttccagggtccaagggattctcagccatccaggcaagagcactctgggttccacagcacagcagacatggaacgctgaagtctctgaaagtgaagttgtaaaaagaaaaggaatgaaataaccgacccatcatcttctcacccaccctcattgcattccgctgtagtgaaaggacgagccatttctgggcacgtggcagcagtcgctgatctcccagctgaggggctgagcactggaatgctgtggctgcactggccccagtccatagaggggtcaactatgctggctggactggctgccttgttcctggcctaggacttagcttcataactatcacctgcaccgactaggctgaggtgctggtacttgccccaacccctacttttgtatttatatgtgtgtgtgtgtgtgcgtgcgtgcgtgcgtgcgtgtatgtttggtctggaccagcttctgccagcccctggcctttactttcttccttgcctatgcagggcaaacaaaatgtgaaattctgccctcagctgagctgagtaagggctcctgggggttggctggagatgggtgtggcatctgtccaggcctggaaccgtctcaagacagtgctggcaaagctgcagtattgagatgctaaggagctgatgccacctctttgtcttcccctaaaggagaacatggggataacatgggtgtgtgcccacaacactctaggtgcagagcccctgtggcaaagtattacagggtgtgggtggggattaccctgaatcggggattttaatgatggaagcaggcagagcctggtgggtgattctgtcaacagaaaattgcaatcatgcaggggctgggagggttaggatgaaaaaactggggccattggaggcccactgtaggtgggagggagctgattttggggtggggggtgggactagagggcaatactgaaggggttaaacaggtttttgctcctcaagaatttgtttgcctgggcccaggattggagggcttcacaccaataccctgtgtatacaagaatcagatttataatacttccccttttttgttacgtatgaacactataaaccaaattattttgaaaactggtgcatcaccttgtccttagcaataaaatgtgttgagcaga

SEQ ID NO: 1803 - DNA, 4305 bp, Homo sapiens
ctcagagggggcgcgcttgactgacaggcggcggcggcgcagttgcgagtgcaggctccttgccagaggcctccactcactccagacccctatagcccgtcgctgtcagctgtcaacaaaggatgcgaatgctggccgcttcctgtgggcttcgtgtcacccagaggtgagcccaggccaggatgggggactccagggacctttgccctcaccttgactccataggagaggtgaccaaagaggacttgctgctcaaatctaagggaacctgtcagtcgtgtggggtcaccggaccaaacctatgggcctgtctgcaggttgcctgcccctatgttggctgcggagaatcctttgctgaccacagcaccattcatgcacaggcaaaaaagcacaacttgaccgtgaacctgaccacgttccgactgtggtgttacgcctgtgagaaggaggtattcctggagcagcggctggcagcccctctgctgggctcctcttccaagttctctgaacaggactccccgccaccctcccaccctctgaaagctgttcctattgctgtggctgatgaaggagagtctgagtcagaggacgatgacctgaaacctcgaggcctcacgggcatgaagaacctcgggaactcctgctacatgaacgctgccctgcaggccctgtccaattgcccgccgctgactcagttcttcttggagtgtggcggcctggtgcgcacagataagaagccagccctgtgcaagagctaccagaagctggtctctgaggtctggcataagaaacggccaagctacgtggtccccaccagtctgtctcatgggatcaagttggtcaacccaatgttccgaggctatgcccagcaggacacccaagagttccttcgctgcctgatggaccagctgcacgaggagctcaaggagccggtggtggccacggtggcgctgacggaggctcgggactcagattcgagtgacacggatgagaaacgggagggtgaccggagcccatcagaagatgagttcttgtcctgtgactcgagcagtgaccggggtgagggtgacgggcaggggcgtggcgggggcagctcgcaggccgagacggagctgctgatcccagatgaggcgggccgagccatctctgagaaggagcggatgaaggaccgcaagttctcctggggccagcagcgtacaaactcggagcaagtggacgaggacgctgatgtggacactgccatggctgcccttgacgaccagcccgcggaggcccagcccccgtcaccacggtcctccagcccctgccggacgccagagccggacaatgatgctcacctacgcagctcctctcgcccctgcagccccgtccaccaccacgagggccatgccaagctgtctagcagcccccctcgtgcaagccccgtgaggatggcaccgtcgtacgtgctcaagaaagcccaggtattgagtgctggcagccggaggcggaaggagcagcgctaccgcagcgtcatctcagacatctttgacggctccattctcagccttgtgcagtgtctcacctgtgaccgggtatccaccacagtggaaacgttccaggacttatcactgcccattcctggaaaggaggacctggccaagctccattcagccatctaccagaatgtgccggccaagccaggcgcctgtggggacagctatgccgcccagggctggctggccttcattgtggagtacatccgacggtttgtggtatcctgtacccccagctggttttgggggcctgtcgtcaccctggaagactgccttgctgccttctttgccgctgatgagttaaagggtgacaacatgtacagctgtgagcggtgtaagaagctgcggaacggagtgaagtactgcaaagtcctgcggttgcccgagatcctgtgcattcacctaaagcgctttcggcacgaggtgatgtactcattcaagatcaacagccacgtctccttccccctcgaggggctcgacctgcgccccttccttgccaaggagtgcacatcccagatcaccacctacgacctcctctcggtcatctgccaccacggcacggcaggcagtgggcactacatcgcctactgccagaacgtgatcaatgggcagtggtacgagtttgatgaccagtacgtcacagaagtccacgagacggtggtgcagaacgccgagggctacgtactcttctacaggaagagcagcgaggaggccatgcgggagcgacagcaggtggtgtccctggccgccatgcgggagcccagcctgctgcggttctacgtgtcccgcgagtggctcaacaagttcaacaccttcgcggagccaggccccatcaccaaccagaccttcctctgctcccacggaggcatcccgccccacaaataccactacatcgacgacctggtggtcatcctgccccagaacgtctgggagcacctgtacaacagattcgggggtggccccgccgtgaaccacctgtacgtgtgctccatctgccaggtggagatcgaggcactggccaagcgcaggaggatcgagatcgacaccttcatcaagttgaacaaggccttccaggccgaggagtcgccgggcgtcatctactgcatcagcatgcagtggttccgggagtgggaggcgttcgtcaaggggaaggacaacgagccccccgggcccattgacaacagcaggattgcacaggtcaaaggaagcggccatgtccagctgaagcagggagctgactacgggcagatttcggaggagacctggacctacctgaacagcctgtatggaggtggccccgagattgccatccgccagagtgtggcgcagccgctgggcccagagaacctgcacggggagcagaagatcgaagccgagacgcgggccgtgtgatctgctgggctagtctccccatgtgccccaccccgcggaaggcgtgtttgtgcccagaagagaggccgggctgctgcagaaccccgccgtgtaaagaggcagaaaagttggtttggtttgcagtaacgctgcaactagaaaatatatgcacttcaggcttgttgaaacgaccaagactctgtgacgttaatttgggtctttgtcctggcagtgcctctgccagtcactgtcatcgttgtgtcccccacaactgtcctcttgctagctcggcccagctttgtccctggagcccgatgctacccctgtcagacagaggctgcggcctgggccagagtcagggagtagctgctgcttcacggcgtctccactgtgcgattggcccggagccccgaagactcggagggagctgctcagggccggtgagcgcagccagaagccctggccagtgaggagctcacaggtcctccctggtggtcccgccgcacctctgcatctcctgggcgtcaccaggaaggctctgaagtcccgggctgctctcagcacttctcctgcagactgaagactctggactcattgctgattggaacaccaggaggaggttggatttctgccagtgggggatgtttctggaggcagctggtcccccacaccgcgtcctgctgagcctgccccctggattggctgtaatttgcctcgaagttcagcagttcatcttcatgggaaatttgctgagcccccaccagggaaccggatgatgaaacagggatacctcacagcttggccatttgaggcaaaggcagcttcccgagctgatgctaaagaagacagactttcccttcctcccagcagcagcagtgcagagcccacctggagggatgtgggggctgtgcagggtgcagcgctcaggtggatcctgggaagcagcctctggatgctgagtggagggagccactgagcacagcaaggcaccaaagcccctggagaaaccgccagggcgaggtgcgaccatcatcaggatcaaagcagacggggcgtgggtggggaaggggctctgggaccagaccccccacactactgcgtctttgtttctatcagtctttgtagaagcaggtggtggtggaaattccagcaggtgggtcccgcagaggccctgaggcctcacttttcggatcttctgtcccagatcctgctccctccctgctgagcctggggttcccctggcattggccccagccttctgaaagccggcgctgcagccagaggccgcacgctgcactgtcgcgacgcagagaggcttctgtgcaggctgggatcgggccccatgtctgtgctgtctagtttgtgttcaaaatgtcagaataaacacagaataaatgtt

SEQ ID NO: 1804 - DNA, 1985 bp, Homo sapiens
cggcaggcgggtgcgcggagggctggtgccccgcagcaggtgggcggggtgcggttggcggcggcggctgggccgggggctgccggctgcgctcgggccgtgcgcggcggccgtgcgggcacgccatggacttcaacatgaagaagctggcgtcggacgcgggcatcttcttcacccgggcggtgcagttcacggaggagaaatttggccaggctgagaagactgagcttgatgcccactttgaaaaccttctggcccgggcagacagcaccaagaactggacagagaagatcttgaggcagacagaggtgctgctgcagcccaaccccagtgcccgagtggaggagttcctgtatgagaagctggacaggaaggtcccctcaagggtcaccaacggggagctgctggctcagtacatggcagacgcggccagtgagctggggccgaccaccccctatgggaagacactgatcaaggtggcagaagctgaaaagcaactgggagccgcggagagggattttatccacacggcctccatcagcttcctcacacccttgcgcaacttcctggagggggactggaagaccatctcgaaggagaggcggctcctccaaaaccggcgtctggacttggatgcctgcaaagcgaggctgaagaaggccaaggctgcagaagccaaagccacgtgtgagggagatacggtgcctgactttcaggagactagacctcgtaattacattctctcggccagcgcctccgcgctctggaatgatgaagtggacaaggccgagcaggagctccgcgtggcccagacagagtttgaccggcaagcagaagtgacccgtctcttgctggagggaatcagtagcactcacgtgaaccacctgcgctgcctccacgagttcgtcaagtctcagacaacctactacgcacagtgctaccgccacatgctggacttgcagaagcagctgggcagctcccagggtgccatatttcccggcaccttcgtgggcaccacagagcccgcctccccacccctgagcagcacctcacccaccactgctgcggccactatgcctgtggtgccctctgtggccagcctggcccctccgggggaggcctcgctctgcctggaagaggtggccccccctgccagtgggacccgcaaagctcgggtgctctatgactacgaggcagccgacagcagtgagctggccctgctggctgatgagctcatcactgtctacagcctgcctggcatggaccctgactggctcattggcgagagaggcaacaagaagggcaaggtccctgtcacctacttggaactgctcagctaggcaggtgcccccatcccccccgcattctggcctaggcaggagaggatgggcgcagccctgccacttaacttgtttgttggtgacacagttgttcagagtggggagaattcaccccattctgtccctgcccctagtcacctagctgtgagggtgcctgaggctgaatggctccacccctcccccagccctgcttctgacctgtggctctggagcccctgcccctgcctgcatccccgagcaccccaccctccaggctccactaaggagggaggggctgtctgcagcagctgcactcagcacctaggccagggtggggccgccgcagatgggctcaggaagccccaggtgcactcagcgagagccctgcctttcagttgccaaaagctgcatcaggggaatgcggcaaggcacacagggctctggcagcccctggggactgggcgctgcccctgggaggggagagcctggccagggctggtgttgggcccggagcagcatcttccggtgctatcctcccctcccacccctcacagctcaagccaagtccagcggccgcagtcttcacctctccacactcactttttatctggtgtttttacttctgcctgcgtttgctctctagccaataaaccgtccttgtgtgcg

SEQ ID NO: 1805 - DNA, 1365 bp, Homo sapiens
ggctgggccgggggctgccggctgcgctcgggccgtgcgcggcggccgtgcgggcacgccatggacttcaacatgaagaagctggcgtcggacgcgggcatcttcttcacccgggcggtgcagttcacggaggagaaatttggccaggctgagaagactgagcttgatgcccactttgaaaaccttctggcccgggcagacagcaccaagaactggacagagaagatcttgaggcagacagaggtgctgctgcagcccaaccccagtgcccgagtggaggagttcctgtatgagaagctggacaggaaggtcccctcaagggtcaccaacggggagctgctggctcagtacatggcagacgcggccagtgagctggggccgaccaccccctatgggaagacactgatcaaggtggcagaagctgaaaagcaactgggagccgcggagagggattttatccacacggcctccatcagcttcctcacacccttgcgcaacttcctggagggggactggaagaccatctcgaaggagaggcggctcctccaaaaccggcgtctggacttggatgcctgcaaagcgaggctgaagaaggccaaggctgcagaagccaaagccacgacggtgcctgactttcaggagactagacctcgtaattacattctctcggccagcgcctccgcgctctggaatgatgaagtggacaaggccgagcaggagctccgcgtggcccagacagagtttgaccggcaagcagaagtgacccgtctcttgctggagggaatcagtagcactcacgtgaaccacctgcgctgcctccacgagttcgtcaagtctcagacaacctactacgcacagtgctaccgccacatgctggacttgcagaagcagctgggcagatttcccggcaccttcgtgggcaccacagagcccgcctccccacccctgagcagcacctcacccaccactgctgcggccactatgcctgtggtgccctctgtggccagcctggcccctccgggggaggcctcgctctgcctggaagaggtggccccccctgccagtgggacccgcaaagctcgggtgctctatgactacgaggcagccgacagcagtgagctggccctgctggctgatgagctcatcactgtctacagcctgcctggcatggaccctgactggctcattggcgagagaggcaacaagaagggcaaggtccctgtcacctacttggaactgctcagctagctcaagccaagtccagcggccgcagtcttcacctctccacactcactttttatctggtgtttttacttctgcctgcgtttgctctctagccaataaaccgtccttgtgtgcgagtca

SEQ ID NO: 1806 - DNA, 2982 bp, Homo sapiens
cgggcgggcaggcgggcaggccggcaggcgggtgcgcggagggctggtgccccgcagcaggtgggcggggtgcggttggcggcggcggctgggccgggggctgccggctgcgctcgggccgtgcgcggcggccgtgcgggcacgccatggacttcaacatgaagaagctggcgtcggacgcgggcatcttcttcacccgggcggtgcagttcacggaggagaaatttggccaggctgagaagactgagcttgatgcccactttgaaaaccttctggcccgggcagacagcaccaagaactggacagagaagatcttgaggcagacagaggtgctgctgcagcccaaccccagtgcccgagtggaggagttcctgtatgagaagctggacaggaaggtcccctcaagggtcaccaacggggagctgctggctcagtacatggcagacgcggccagtgagctggggccgaccaccccctatgggaagacactgatcaaggtggcagaagctgaaaagcaactgggagccgcggagagggattttatccacacggcctccatcagcttcctcacacccttgcgcaacttcctggagggggactggaagaccatctcgaaggagaggcggctcctccaaaaccggcgtctggacttggatgcctgcaaagcgaggctgaagaaggccaaggctgcagaagccaaagccacgacggtgcctgactttcaggagactagacctcgtaattacattctctcggccagcgcctccgcgctctggaatgatgaagtggacaaggccgagcaggagctccgcgtggcccagacagagtttgaccggcaagcagaagtgacccgtctcttgctggagggaatcagtagcactcacgtgaaccacctgcgctgcctccacgagttcgtcaagtctcagacaacctactacgcacagtgctaccgccacatgctggacttgcagaagcagctgggcagatttcccggcaccttcgtgggcaccacagagcccgcctccccacccctgagcagcacctcacccaccactgctgcggccactatgcctgtggtgccctctgtggccagcctggcccctccgggggaggcctcgctctgcctggaagaggtggccccccctgccagtgggacccgcaaagctcgggtgctctatgactacgaggcagccgacagcagtgagctggccctgctggctgatgagctcatcactgtctacagcctgcctggcatggaccctgactggctcattggcgagagaggcaacaagaagggcaaggtccctgtcacctacttggaactgctcagctaggcaggtgcccccatcccccccgcattctggcctaggcaggagaggatgggcgcagccctgccacttaacttgtttgttggtgacacagttgttcagagtggggagaattcaccccattctgtccctgcccctagtcacctagctgtgagggtgcctgaggctgaatggctccacccctcccccagccctgcttctgacctgtggctctggagcccctgcccctgcctgcatccccgagcaccccaccctccaggctccactaaggagggaggggctgtctgcagcagctgcactcagcacctaggccagggtggggccgccgcagatgggctcaggaagccccaggtgcactcagcgagagccctgcctttcagttgccaaaagctgcatcaggggaatgcggcaaggcacacagggctctggcagcccctggggactgggcgctgcccctgggaggggagagcctggccagggctggtgttgggcccggagcagcatcttccggtgctatcctcccctcccacccctcacagctcaagccaagtccagcggccgcagtcttcacctctccacactcactttttatctggtgtttttacttctgcctgcgtttgctctctagccaataaaccgtccttgtgtgcgagtcacctgggctcctgtcagggcctggccctgagggtggtaaagggaaaggtagactcaccctctgccccactcttccacagagtgagcaggggccctgtggctgccccggcccccagctctctagttgggaagaagtgcagccctccctgtcttctgcggggcctgtgcctctcagagggcagtgctgttcctggacatgaagccgcacaaggaacgttttattcctaagaaaaagtttcctaaatttggattgtggagcggactgtagaatgcgtctgacagttcagttcaagcacaagaagtgggtagcggtcagtgctgtctgcaggtcgggcgtttcacccagcatgtgcccccgtgccatgggttctcatgccgtcctcagtgtccacatttcacagatgagatcagcaagacagtcagctcctcaagggaccacagttggcaagtggccaagcagggactgaagcccaggcagcctgattctagaaaccctaagtgatgtctgtgttttagatggcccctagcaggacctagcattctgacttcagtcctgagaaggccaacagccagtaggccccactgttggggcttctgaagaggggatcgggggatgacgggggcacggggctataaataggaaggcacagagcttcaagaaaggctcacccagggatgagctcagcccactgggccaatgaaagcagggtcaaggacaggaccagcgcaggccaaggaagggaatatctgacagcgcccacccagccaaaccctcagcccaaggacaggaatgaggagatgctggtgaactagccatccatcagtacctgccttcccccgaggctgcagccccactcccaggcgcctggccaggggagttttctaggttctgagagccacgttgtcatccctgggctttgaagttaaacatcacacagctgtctataaacaagattttaatatctgtataaatagaccacagaattaccaaaactgcaaa

SEQ ID NO: 1807 - DNA, 962 bp, Homo sapiens
gagctatgagctggacctgtccgcgttgccagcaacctgttttcttcgctgagaaggtgagctccctgggcaagaactggcaccgcttctgcctgaaatgtgagcgctgccacagcatcctgtcccctggcgggcatgcagagcacaatgggaggccatactgccacaagccatgctatggggctctctttggacccaggggggtgaacattggtggtgtaggctcctacttgtacaatccccccactcccagccctggctgcaccactcctctcagccccagcagcttcagccctcccaggccaaggactggcctcccccaaggcaagaaaagccctccccatatgaagacattcactggggagacctcgctgtgccctggctgtggggagcccgtctattttgctgagaaggtgatgtcattaggcagaaattggcaccgaccgtgtctgaggtgccagcgttgccacaagaccctgactgctgggagtcatgctgagcatgatggagtcccctactgccacgtcccctgctacggctacctgtttggccccaaaggtgtgaacattggcgatgtgggctgctacatctatgacccagtgaagataaaattcaaatgagacgctcacaaaaaaggtcaccctaactcaggcctcccatcatgcccctcatggtccaatggaagctacaaaaatctccagtcccatgggggttggggaaggtgggatcttgggggcctgggcctaggctccatggtaggccagagagtctagactttctctgccaattttttccctttcccatttctatctggttagggaacagcccgttttgaagggtatcctcctcctggccatcacaacccctttccccagcacattctggagcttcaaggtactcataaaacttgtgtttattgaatttcagcctctgtggcttcttcaataaaatgttggctccca

SEQ ID NO: 1808 - DNA, 1495 bp, Homo sapiens
agagccagttccaaccccgggatcgccgcggaaccacgcacagagtctgcagaagtgcacagctttatcgacagcgcttgaagcatggagtctcttcgcgggtacacccacagtgatattggctaccgcagcctggcagtcggcgaggacatcgaggaagtgaatgatgagaaacttaccgtgacctcgctgatggcaaggggaggagaggacgaggagaatacacggtccaaacctgagtacggaacagaagcggaaaacaacgttggcacggaagggtccgtcccctcggacgaccaagaccgtgagggtggcggcggccacgagccggagcaacagcaggaggagccgcccctgaccaagccggagcaacagcaggaggagccgcccctgctcgagctgaagcaagagcaggaggagccgccccagacgaccgtggaggggccacagccggcggaggggccacaaaccgctgagggaccacagcccccagagaggaaacgccgccgccgcaccgcgttcacgcagtttcagctgcaggagctagagaactttttcgatgaatctcaatatcccgacgttgtggcgcgagagagacttgcagcacgcctgaatttgactgaagacagagtgcaggtttggtttcagaacagaagagccaagtggaaacgaaatcagagggtgctaatgttgagaaacactgctactgctgacctggcccaccctttggacatgttcttgggtggggcctattatgctgctcctgctctggatcctgctttgtgtgttcatctggtgccacaactacctagaccacctgtgctgcctgtgccacctatgccacccaggccacccatggtccctatgccacccaggccacccatagcacctatgccacccatggcgcctgtgccacccggctcacgcatggcgcctgtgccacccgggccacgcatggcgcctgtgccaccctggccgcccatggcgcctgtgccaccctggccgcccatggcgcctgtgccaaccgggccgcccatggcgcctgtgccacccgggccgcccatggcgcgtgtgccacccgggccgcccatggcgcgtgtgccacccgggccgcccatggcgcctctgccacccgggccgcccatggcgcctctgccacccgggccgcccatggcgcctctgccacccgggccgcccatggcgcctctgccacccaggtcacatgtgcctcacactggcctggctcctgtacacatcacatgggcccctgtcatcaacagttattatgcatgtccctttttctaaagtaaggtattcataacagtttttccaaagttctttcctgccagatagaaattgtgcacagcacagcatcaagtaattcgttagatgcttgttaaatgaagtgggtaggtgaacaaagttaacgaatgccctgttatttttgtaggccacataattgtagtattttcaataaagatgtgacttaatagta

SEQ ID NO: 1809 - DNA, 1051 bp, Homo sapiens
gctactgtcacatttcagtgatgtcacagctgcaggtggtacagagccagcaccaccatctgatgcccagcctgagtgctggctgaactgagaggaacagggttggtgcctggcactggtgttgctccattcatctctgaggtctcacagccccagcatgagtccatcagcaaagaagaggcccaagaacagcagggtttccaagatgcaagatgagaaactgcgggacgagacagagcagcctgtgagcaaagtaattgagcggaaccgtctgagaacggtgttaaaaaacttgtcgctcttgaagctactcaagagctcaaaccgccggatccaagaactgcataagctggccaaaaggtgttggcattcactgctcagtgttccaaagattctccgcatctcctctggggaaaacagtgcctgcaataaaacaaaacaaaataatgaagagttccaggagatcgggtgctccgagaaggaactcaagtccaagaaattagagtccacaggggaccctaagaaaaaagagtacaaggagtggaagtcccaggtgcagtcagggatgaggaacaaggagaaaacgtcattggcggcaatgccacggaaagaaaagcatatagagcctgaggttccaaggacatcgagggatgatagcttgaaccctggagtccaggggaggcaaccactcaccgagggcccccgagtcatcttcattaagccctaccgcaatagaactcccatggggcacatgaagcagctggatgtagccgaccagtggatctggtttgaggggctgcccacacgaatccacctcccggcgcccagggtgatgtgcagatcctccaccctgcgttgggtcaagcgccgctgcacccgcttctgctccgcatcacttgaaatgcctatgtggcatccatacaaggttgatgtgacctggacgagagccagaggtgcgagcagagggtggagatcgcgccatcagctgaaggggaggaatgggtggcgaaattcacgagtctacaaataagatcttccatatggcacctaa

SEQ ID NO: 1810 - DNA, 5130 bp, Homo sapiens
gagaatcgaagtgaggagccgccagaggagagctgaggagaggagggggaggtcgacgacctgggccctgggcctctgaaggaaaggagctgtaacttctattgggaaaatgactgacttcaaagttggcaggaggtgtaatcaggctgcaggtcttggggtgattagggaatcattgaggaagagcagacaggtctgtttctttctaggttcctgtagagatctgtatgtagctgttcacttggaagttaattaagaaagaacaaaaactattcatttggattcaaggtccatctccactggtggctgtggtggctttggattgttggaagaccatcaccttcagcaggtctgcacttgggaacaatcattctcccccagcccgagcgtgcctctgccctctgtatcattgacagaggctgtatgtttggaaagagaactttgtgactgcagaactgacagttgactctaattcttgctaccaagtttttccccgacccagtgaaagagtgttaagacttcgacctaggacacattgagaaccaaggccaagactggacagggccatataactgggcttcaaccatggctgggactaagaataagacaagagcccaggccaaaactgaaaaaaaggctgctatacaagctaaagctggagcagagagggaggctactggtgttgttaggcctgtagccaagaccagggccaaagcaaaagccaagacagggtctaagacagatgcagtagcagagatgaaggcagtgtctaagaacaaggttgttgctgagacgaaggaaggagctctgtcagagcctaagactctgggcaaagccatgggagatttcactcccaaggctgggaatgagtccaccagctccacatgtaaaaatgaggctggtactgatgcctggttctgggctggggaagaggccactatcaattcctggttctggaatggagaagaggctggtaatagtttcagcactaagaatgataaacctgaaattggtgcccaggtctgtgctgaggagttggaacctgcggctggggccgattgcaaacctaggtcaggggctgaggaggaggaggaagagaatgttattgggaactggttttgggaaggagatgatactagttttgaccctaatcctaaacctgtgagcaggatagttaagcctcagcctgtgtatgaaattaatgaaaaaaataggcccaaggactggtctgaggtaactatctggcccaatgcccctgctgtaactccagctgtgttaggatttagatcccaggcaccatctgaggcaagccctccttcatatattgttctggcctccgctgaagaaaatgcctgttctttgcctgtggcaacagcttgccgcccttctaggaacactcgctcatgctcacagcctatccctgagtgtcgttttgattctgacccctgcatccagaccatagatgagattagacgtcaaatcaggatcagggaggtaaatgggattaagccatttgcttgtccttgcaaaatggaatgctatatggattctgaggaatttgaaaaacttgttagcttacttaagtcaactactgatcctcttattcataaaatagcacggattgcaatgggtgtccataatgttcacccatttgcccaagagtttattaacgaagtaggtgtagtgacacttattgaaagcttgctcagttttccttcccctgaaatgagaaaaaagactgtaattactctgaatcctccttctggggatgaaagacaacgcaaaattgaattacatgttaagcatatgtgtaaagaaaccatgtcatttcctttgaactcaccgggacagcaatctggattaaagatactaggacaactgactactgattttgtccatcactacattgttgccaattacttttcagagcttttccatttgctgtcctcaggaaattgcaaaaccagaaatcttgttttgaaactacttttaaatatgtctgaaaatccaactgcagccagagacatgatcaatatgaaggcattggcagcattaaaactcatctttaaccagaaagaggcaaaagccaatcttgttagtggtgtggccatatttattaacataaaggagcatatcagaaaaggctcaattgtagttgttgatcacttgagttataatacactcatggccattttcagggaagttaaagagattattgaaacaatgtaaaatgagccagagatagaacattttaagccatcttcaaactctagcaggctgtacattacagtgtacacattatacactgcatctttaacacagagtcacctgtgacaggctctaggtttgagctagactattttgggggtatcaaatgaatattataccttgggctgaaaatgtttgatttttatcttgtctagattggcatatttttaacattttacttaagatagcaaaccagttcgttttaagtaagctaacttgttcattagtatctgtggcttaaaatggcaaaaaagaaaatatccttgagtttgtaatctagttacagaagtaaggcatacacacacacaaagataacagtacctagagagagagtgtgtgtgagtgtgcgtgtctctgtgtgtgcacgtgcacgctcatggccaaatgtgcgcactctacataaaggaggcaggagttcctataggctatttaatgtaagagaaactatttttctcctgttccagctgtatcagatactcgttccgcaacacagaaatgactcagaatctcagacaaaatgtattatttgttcaattttaattttgctactacattcataactcttaaattgttaggctgtttcatttacatcaaagttatctcacaaaagagaaggcaggaaacgttttgtgagtgcctattctatgtcaaacactgtgttggcaccatattttacaagtttttttcctcttctcacagtgatcttgtgagttagttacttatatttttattagaactcattattctgggtaccctccaatgagaattagagaggttaaataccttttcctagattcccacagcaggaaggtggcatagctgttttgtctgacaccagaacccatctcaccacactgctttacagtcttcctgaaggacattttgaggtgggggggccttcaaagctcagagactggtttgaatggtttaattttgcaatggatcatgtccatgccaggtgttacaattcttaacttcctccaaattcgtgtgtccattagacatttggctacatctggctggaggtcaggagaaaattctgaggtaaatagatggattttatctggcagtgtcgaaaatagtaggagcctaaaactttgttcaatgagtaagatgtagatttggagtcatcagcaggggaaacttgttagatgtcctttgtatctttttctatccatttgtattttttctttcccaaagagctgaaatcattttataccctgaatttaaaaggtaattgcttttttcctccttgcgaaatcataccttaattttttttttttttttttttaccatttatgatttattctcctatgtgtcatatgaaaggccaaggggctttatcttttactagtaggcaagcctgggcatttctgcatttgtgccagctaacactacaaaatagacttaattagagaaatttagacccagaattgcagcttcaacaacacaaaacaggaaagctagaagaggttgctgtgtcaacctacaagatagtgattcttggaagttggtatggaccagaaagcattcccaggacatttaggctatggctgagttctctaagactcagggtgggaattataatccctggtctaagctgatatgaaagtttctatgtgtgaaaatatggagttatatgctttgagattttctgccagttaaactaaaacaagatcatactgtaaatgtttgtaacttgcttccccccactgtatactgtaaacatctttgcatgtcaataaatatgcctctacaacatatttttgaatcacttaatatttttcccatgttaacagttggtatatagtgttgtaaacctttattgcatattctcataacatacaatatacacattcttttgcaaaaatgggaacacagtattgagacttgccttttcctcttaacacttatcttttcaatttagtattatatagatctgtcacatgctttttatctaataactttatagaaatataattgccatacattaagctgcatgttgaaagtatacagtgtgatcagttttggaatgtatatacacacaaaaccataaccacaatcaaaattgtaaatacattcatcacccaccaaagctactttttttttgagacagagtcttgctctgtcacccaggctggagtacagtggcgcaatctcggcccactgcaacctctgcttcccaggttcaagtgattctcgtgccttagcctcctgagcagctgggactacaggtgcatgccaccacatccgactaatttttttttttattttttgtatttttagtagagacagggtttcaccatgttggccaggctggtcttgaactcctggtctcaagtgatctacccatcttggtctccctgagtgccaggattacaggcgtgagccaccatgcccagcctcccccaaagcttcttaatgcccttttgtaatccctccctcccctctctccctgtgcccctaacccaggcaaccatgggacattttctgacaaaatagaattgttttcatttcctgtaattgtgtataaatggactcatatagcatgtactctttggtcgggaggggatctggcttatttcacttagtgtaattatttgagattcatccatatcatgtgtctcactatttcattgctttttattgccaagtagtattccaccatatggctttaccacagtttatttatccattcacttattgatggacatttgggctgttcagagtttggccattataagtaaagcagctatgagcatttgtgtacaagtgtttttatggacataggctttcatatctttggaatgacatctaacaatattgaatcttcgacccatgaataaaatctctctccactta

SEQ ID NO: 1811 - DNA, 2322 bp, Homo sapiens
ttgtggcaagattctgaggggaagtgtagctcccaggttggttccaagtcttcttccaattaggatcttatccaggacgcttcattgcatttggtcttcatttctccttagtctcctccaggctgacatttcctcaatctttattggtcttccacagccctgacacttttggagataccagtcagcatttccaagttcgttctgtgagactgtagtgtcaggacaaagcaacaacaaaatgtgctctactctaaagaagtgtgggacatacagaactgaagttgcagaatgccatgaccatggtagcacttttcaaggaagaaagaaaggtgggagttctttccgggataattttgacaagaggagctgtcattatgaacatggtgggtatgagcgcccgccttcacactgccaggagaatgatggaagcgtggagatgagggatgtccacaaggaccaacaactaagacacactccttatagcatccgatgcgaaagaagaatgaaatggcatagtgaagacgaaatccgtattaccacgtggagaaatagaaaacctccggagagaaaaatgagtcagaacacacaggatggatacacaaggaactggtttaaggtcacaattccttacgggataaagtatgacaaggcatggctaatgaattcaatccagagccattgcagtgaccgcttcactccggttgatttccactacgtccgaaatcgggcatgcttctttgtccaggatgctagcgctgcctccgcattgaaggatgtcagttataagatttatgatgatgagaaccaaaagatatgtatatttgtcaatcattctactgcgccctactctgtgaagaataagttgaagccaggccaaatggagatgctaaagctgaccatgaacaaacggtacaatgtctcccagcaagctcttgatctccagaatctccgctttgacccagacttgatgggccgtgacattgatataatcctgaatcgaagaaactgcatggctgccaccctgaagatcattgaaagaaatttccctgagctgttgtctttgaacttgtgcaacaacaagctgtaccagctggatggcctttctgacattacagagaaggctcccaaagtcaagaccctgaatctctccaaaaataagctggagtcggcgtgggagttgggcaaggtgaaagggctgaagctcgaagagctatggctagaagggaacccgttgtgcagcaccttctcggaccagtccgcctatgtaagtgccatccgggattgtttccccaagttgttacgcctggacggccgagagttatccgcaccagtgattgttgacattgacagctctgagacaatgaaaccctgcaaggaaaactttactggatctgagaccctaaagcatttagtcctgcaattcctgcagcagtattactcgatctatgactctggagatcgacagggtctcctcggtgcttaccacgatgaggcctgcttctccttggctattcccttcgaccccaaggactcagccccgagcagcttgtgcaagtactttgaggatagcaggaatatgaaaacactcaaggacccctacctgaagggggaactgctgaggcgcacaaaacgtgacattgtggactccctcagtgcgttgcccaaaactcagcatgacctcagctccatcctggtggacgtgtggtgccagacggaaaggatgctctgcttttctgtcaatggggttttcaaggaagtggaaggacagtctcagggttctgttctcgccttcacccggaccttcattgctacccctggcagcagttccagtctgtgcatcgtgaatgacgagctgtttgtgagggatgccagcccccaagagactcagagtgccttctccatcccagtgtccacactctcctccagctctgagccctccctctcccaggagcagcaggaaatggtgcaggctttctctgcccagtctgggatgaaactggagtggtctcagaagtgccttcaggacaatgagtggaactacactagagctggccaggccttcactatgctccagaccgagggcaagatccccgcggaggccttcaagcaaatctcctaaaaggagccctccgatgtcttctttgtcttcgttcacatcctctttgtttcctcttttcaccagcctaaggcctggctgaccaggaagccaacgttaacttgcaggccacgtgacataaccacccaaagagccagttgctctgtgtattcgccccactcatgatcaccattttattttcataataaagagtgacgttacacgtt

SEQ ID NO: 1812 - DNA, 2884 bp, Homo sapiens
cctcctcctctgggatcttgaaaacgtagaattcccagagactctgctgatggacagaatccggctccaggaactggcattccagttgcaccagttaactgtcctggcctcagtcttgctagtggccagaagcttctctggtgaagttttattcagatcacctgaatttgtggatagactgaaatgcaccaccaaggccctaactgaggaatttatctccaggcctgaagagactatgctgagtgtgagtgaacaggtgtctcaggaagtccatcaaggccttaaggacatgggcctcactactctgagcagtgaaaacacagcatctcttctaggccaactccagaacatcaccaagaaagagaactgcattcgtagcattgttggagtctctgctacactttcctggaggcctcattctcattgaaaaggagttggcagaactgggctggaagtttctcaatctgatgcatcataatcagcagagtcatttttcacaaaacgaaatctttccagaagatcacgaataagagagatcaaagctaggcagcttgagttgaagtagagctggaagaaggagttttgaggactgtttcaaaaccactggactagatgatctctaaaggatcttatccaggacgcttcattgcatttggtcttcatttctccttagtctcctccaggctgacatttcctcaatctttattggtcttccacagccctgacacttttggagataccagtcagcatttccaagttcgttctgtgagactgtagtgtcaggacaaagcaacaacaaaatgtgctctactctaaagaagtgtgggacatacagaactgaagttgcagaatgccatgaccatggtagcacttttcaaggaagaaagaaaggtgggagttctttccgggataattttgacaagaggagctgtcattatgaacatggtgggtatgagcgcccgccttcacactgccaggagaatgatggaagcgtggagatgagggatgtccacaaggaccaacaactaagacacactccttatagcatccgatgcgaaagaagaatgaaatggcatagtgaagacgaaatccgtattaccacgtggagaaatagaaaacctccggagagaaaaatgagtcagaacacacaggatggatacacaaggaactggtttaaggtcacaattccttacgggataaagtatgacaaggcatggctaatgaattcaatccagagccattgcagtgaccgcttcactccggttgatttccactacgtccgaaatcgggcatgcttctttgtccaggatgctagcgctgcctccgcattgaaggatgtcagttataagatttatgatgatgagaaccaaaagatatgtatatttgtcaatcattctactgcgccctactctgtgaagaataagttgaagccaggccaaatggagatgctaaagctgaccatgaacaaacggtacaatgtctcccagcaagctcttgatctccagaatctccgctttgacccagacttgatgggccgtgacattgatataatcctgaatcgaagaaactgcatggctgccaccctgaagatcattgaaagaaatttccctgagctgttgtctttgaacttgtgcaacaacaagctgtaccagctggatggcctttctgacattacagagaaggctcccaaagtcaagaccctgaatctctccaaaaataagctggagtcggcgtgggagttgggcaaggtgaaagggctgaagctcgaagagctatggctagaagggaacccgttgtgcagcaccttctcggaccagtccgcctatgtaagtgccatccgggattgtttccccaagttgttacgcctggacggccgagagttatccgcaccagtgattgttgacattgacagctctgagacaatgaaaccctgcaaggaaaactttactggatctgagaccctaaagcatttagtcctgcaattcctgcagcagtattactcgatctatgactctggagatcgacagggtctcctcggtgcttaccacgatgaggcctgcttctccttggctattcccttcgaccccaaggactcagccccgagcagcttgtgcaagtactttgaggatagcaggaatatgaaaacactcaaggacccctacctgaagggggaactgctgaggcgcacaaaacgtgacattgtggactccctcagtgcgttgcccaaaactcagcatgacctcagctccatcctggtggacgtgtggtgccagacggaaaggatgctctgcttttctgtcaatggggttttcaaggaagtggaaggacagtctcagggttctgttctcgccttcacccggaccttcattgctacccctggcagcagttccagtctgtgcatcgtgaatgacgagctgtttgtgagggatgccagcccccaagagactcagagtgccttctccatcccagtgtccacactctcctccagctctgagccctccctctcccaggagcagcaggaaatggtgcaggctttctctgcccagtctgggatgaaactggagtggtctcagaagtgccttcaggacaatgagtggaactacactagagctggccaggccttcactatgctccagaccgagggcaagatccccgcggaggccttcaagcaaatctcctaaaaggagccctccgatgtcttctttgtcttcgttcacatcctctttgtttcctcttttcaccagcctaaggcctggctgaccaggaagccaacgttaacttgcaggccacgtgacataaccacccaaagagccagttgctctgtgtattcgccccactcatgatcaccattttattttcataataaagagtgacgttacacgtt

SEQ ID NO: 1813 - DNA, 3193 bp, Homo sapiens
cctgactcacctagctcctcctgcagcatggcgtgttcacttccaagcggggcagactctgctgatggacagaatccggctccaggaactggcattccagttgcaccagttaactgtcctggcctcagtcttgctagtggccagaagcttctctggtgaagttttattcagatcacctgaatttgtggatagactgaaatgcaccaccaaggccctaactgaggaatttatctccaggcctgaagagactatgctgagtgtgagtgaacaggtgtctcaggaagtccatcaaggccttaaggacatgggcctcactactctgagcagtgaaaacacagcatctcttctaggccaactccagaacatcaccaagaaagagaactgcattcgtagcattgttgatcagtggatccgtttttttctcaaatgctgtttgcttcatggcatgcaggagtctctgctacactttcctggaggcctcattctcattgaaaaggagttggcagaactgggctggaagtttctcaatctgatgcatcataatcagcagagtcatttttcacaaaacgaaatctttccagaagatcacgaataagagagatcaaagctaggcagcttgagttgaagtagagctggaagaaggagttttgaggactgtttcaaaaccactggactagatgatctctaaagtggtgacatggacataggataatggttatagacagtccccctcccaacgggaaaaaatgaaagcaagcaaaaagttaccagctccaagccaacttgaaatccaatcaggatcttatccaggacgcttcattgcatttggtcttcatttctccttagtctcctccaggctgacatttcctcaatctttattggtcttccacagccctgacacttttggagataccagtcagcatttccaagttcgttctgtgagactgtagtgtcaggacaaagcaacaacaaaatgtgctctactctaaagaagtgtgggacatacagaactgaagggatgatgcttcctgtctgtcacaaggctgagtgaacacaacatgcctgtaggtccagaacattcttcctacagagaccagatgtccagaaagccctatctgctggattcagggaacgcctctcctcatttctgtcagcactatttgcaaaagcctccttctctgagatcttcaaagctgcagttctagccacagtctgcagggagttgcagaatgccatgaccatggtagcacttttcaaggaagaaagaaaggtgggagttctttccgggataattttgacaagaggagctgtcattatgaacatggtgggtatgagcgcccgccttcacactgccaggagaatgatggaagcgtggagatgagggatgtccacaaggaccaacaactaagacagtaagtgaccaggcagcctggtttgcacgtagcagcccccgggactgtgcaaccctttcattctctgtggtcttccttttcttctctcattagagaactgacgaatgctggaagtggaatagtggctgagcagtcctaattgtagccctggcgtcagtgagtggagcatgtataggagactttcttagatttaatggatacccgccttctctcctcttccccacagcactccttatagcatccgatgcgaaagaagaatgaaatggcatagtgaagacgaaatccgtattaccacgtggagaaatagaaaacctccggagagaaaaatgagtcagaacacacaggatggatacacaaggaactggtttaaggtcacaattccttacgggataaagtatgacaaggcatggctaatgaattcaatccagagccattgcagtgaccgcttcactccggttgatttccactacgtccgaaatcgggcatgcttctttgtccaggatgctagcgctgcctccgcattgaaggatgtcagttataagatttatgatgatgagaaccaaaagatatgtatatttgtcaatcattctactgcgccctactctgtgaagaataagttgaagccaggccaaatggagatgctaaagctgaccatgaacaaacggtacaatgtctcccagcaagctcttgatctccagaatctccgctttgacccagacttgatgggccgtgacattgatataatcctgaatcgaagaaactgcatggctgccaccctgaagatcattgaaagaaatttccctgagctgttgtctttgaacttgtgcaacaacaagctgtaccagctggatggcctttctgacattacagagaaggctcccaaagtcaagaccctgaatctctccaaaaataagctggagtcggcgtgggagttgggcaaggtgaaagggctgaagctcgaagagctatggctagaagggaacccgttgtgcagcaccttctcggaccagtccgcctatgtaagtgccatccgggattgtttccccaagttgttacgcctggacggccgagagttatccgcaccagtgattgttgacattgacagctctgagacaatgaaaccctgcaaggaaaactttactggatctgagaccctaaagcatttagtcctgcaattcctgcagcagtattactcgatctatgactctggagatcgacagggtctcctcggtgcttaccacgatgaggcctgcttctccttggctattcccttcgaccccaaggactcagccccgagcagcttgtgcaagtactttgaggatagcaggaatatgaaaacactcaaggacccctacctgaagggggaactgctgaggcgcacaaaacgtgacattgtggactccctcagtgcgttgcccaaaactcagcatgacctcagctccatcctggtggacgtgtggtgccagacggtgccttcaggacaatgagtggaactacactagagctggccaggccttcactatgctccagaccgagggcaagatccccgcggaggccttcaagcaaatctcctaaaaggagccctccgatgtcttctttgtcttcgttcacatcctctttgtttcctcttttcaccagcctaaggcctggctgaccaggaagccaacgttaacttgcaggccacgtgacataaccacccaaagagccagttgctctgtgtattcgccccactcatgatcaccattttattttcataataaagagtgacgttacacgttgta

SEQ ID NO: 1814 - DNA, 2034 bp, Homo sapiens
gcagactgccataagatggcgtccgtggcggctgcacgagcagttcccgtgggcagtgggctcaggggcctgcaacggaccctacctcttgtagtgattctcggggccacgggcaccggcaaatccacgctggcgttgcagctaggccagcggctcggcggtgagatcgtcagcgctgactccatgcaggtctatgaaggcctagacatcatcaccaacaaggtttctgcccaagagcagagaatctgccggcaccacatgatcagctttgtggatcctcttgtgaccaattacacagtggtggacttcagaaatagagcaactgctctgattgaagatatatttgcccgagacaaaattcctattgttgtgggaggaaccaattattacattgaatctctgctctggaaagttcttgtcaataccaagccccaggagatgggcactgagaaagtgattgaccgaaaagtggagcttgaaaaggaggatggtcttgtacttcacaaacgcctaagccaggtggacccagaaatggctgccaagctgcatccacatgacaaacgcaaagtggccaggagcttgcaagtttttgaagaaacaggaatctctcatagtgaatttctccatcgtcaacatacggaagaaggtggtggtccccttggaggtcctctgaagttctctaacccttgcatcctttggcttcatgctgaccaggcagttctagatgagcgcttggataagagggtggatgacatgcttgctgctgggctcttggaggaactaagagattttcacagacgctataatcagaagaatgtttcggaaaatagccaggactatcaacatggtatcttccaatcaattggcttcaaggaatttcacgagtacctgatcactgagggaaaatgcacactggagactagtaaccagcttctaaagaaaggacctggtcccattgtcccccctgtctatggcttagaggtatctgatgtctcgaagtgggaagagtctgttcttgaacctgctcttgaaatcgtgcaaagtttcatccagggccacaagcctacagccactccaataaagatgccatacaatgaagctgagaacaagagaagttatcacctgtgtgacctctgtgatcgaatcatcattggggatcgcgaatgggcagcgcacataaaatccaaatcccacttgaaccaactgaagaaaagaagaagattggactcagatgctgtcaacaccatagaaagtcagagtgtttccccagaccataacaaagaacctaaagagaagggatccccagggcagaatgatcaagagctgaaatgcagcgtttaagagacatgtccagtggcctttggaaaggtggtggggatccagttcaggagggaggggtatgtttgtctcccagtctgggcaaaggagtgctatgcggaattctctgcatagcagaaaagctcccaccattttcttttgatgtggttttaaagtctcacgttctctataatagaaacagcaggtcttgtcagctccttgtgtggctgatgtgtctggaaatgatgtagttcaggaaagcattttttttttctttgaaccttaaaggttctattattaaaagcagcacagattccacatttttatacatgaggatcttctttgtggtgaataccaggattgactgcatccctttaaagaagttttatgtccctgactctggctaaaattatctaatttccagatgcttttgtagatgactgaagtatttgtgagccacatattgggagttctagatttgagtgaatggcaggaaagggccatctccattgagatgattaagtgaaccaaactagttctcagaattctacagagaaggagggaatcagactgaggaagctgtgacataggacttgaagaccaaagactttgaaatttgcgagctgctcatgtgtgagttattatcactgctgtctttctattgagttacaaatctatatttttattgaagtttaaataaagaaaaaatttacaaga

SEQ ID NO: 1815 - DNA, 1880 bp, Homo sapiens
cagactgccataagatggcgtccgtggcggctgcacgagcagttcccgtgggcagtgggctcaggggcctgcaacggaccctacctcttgtagtgattctcggggccacgggcaccggcaaatccacgctggcgttgcagctaggccagcggctcggcggtgagatcgtcagcgctgactccatgcagccccaggagatgggcactgagaaagtgattgaccgaaaagtggagcttgaaaaggaggatggtcttgtacttcacaaacgcctaagccaggtggacccagaaatggctgccaagctgcatccacatgacaaacgcaaagtggccaggagcttgcaagtttttgaagaaacaggaatctctcatagtgaatttctccatcgtcaacatacggaagaaggtggtggtccccttggaggtcctctgaagttctctaacccttgcatcctttggcttcatgctgaccaggcagatgagcgcttggataagagggtggatgacatgcttgctgctgggctcttggaggaactaagagattttcacagacgctataatcagaagaatgtttcggaaaatagccaggactatcaacatggtatcttccaatcaattggcttcaaggaatttcacgagtacctgatcactgagggaaaatgcacactggagactagtaaccagcttctaaagaaaggtattgaggctctgaaacaagtaactaagagatatgcccggaaacaaaaccgatgggttaaaaaccgttttttgagcagacctggtcccattgtcccccctgtctatggcttagaggtatctgatgtctcgaagtgggaagagtctgttcttgaacctgctcttgaaatcgtgcaaagtttcatccagggccacaagcctacagccactccaataaagatgccatacaatgaagctgagaacaagagaagttatcacctgtgtgacctctgtgatcgaatcatcattggggatcgcgaatgggcagcgcacataaaatccaaatcccacttgaaccaactgaagaaaagaagaagattggactcagatgctgtcaacaccatagaaagtcagagtgtttccccagaccataacaaagaacctaaagagaagggatccccagggcagaatgatcaagagctgaaatgcagcgtttaagagacatgtccagtggcctttggaaaggtggtggggatccagttcaggagggaggggtatgtttgtctcccagtctgggcaaaggagtgctatgcggaattctctgcatagcagaaaagctcccaccattttcttttgatgtggttttaaagtctcacgttctctataatagaaacagcaggtcttgtcagctccttgtgtggctgatgtgtctggaaatgatgtagttcaggaaagcattttttttttctttgaaccttaaaggttctattattaaaagcagcacagattccacatttttatacatgaggatcttctttgtggtgaataccaggattgactgcatccctttaaagaagttttatgtccctgactctggctaaaattatctaatttccagatgcttttgtagatgactgaagtatttgtgagccacatattgggagttctagatttgagtgaatggcaggaaagggccatctccattgagatgattaagtgaaccaaactagttctcagaattctacagagaaggagggaatcagactgaggaagctgtgacataggacttgaagaccaaagactttgaaatttgcgagctgctcatgtgtgagttattatcactgctgtctttctattgagttacaaatctatatttttattgaagtttaaataaagaaaaaatttacaagagcctctttgatcctt

SEQ ID NO: 1816 - DNA, 3661 bp, Homo sapiens
ctcctggcttccccgcggggcctcccagggcacctgcccaaggccacccagcgcgcggcagccgagacagcggagcagagccggacctcccagccgtcgatgaaggcggcgaccgcctagggccttcccacggctcggcggcgcgtcaccgcgggggcgagggggcgcctgggcgcccggagctgcggcgcaggaaagggccctgggaaagggcggtggcggcgcccccgaggcggggccggggcggggccggggcggggcctgacttcccgactgggagccttagccgcggggctgagaccaggcagcctgcgttcgccatgaagcgacccaaggagccgagcggctccgacggggagtccgacggacccatcgacgtgggccaagagggccagctgagccagatggccaggccgctgtccacccccagctcttcgcagatgcaagccaggaagaaacacagagggatcatagagaaacggcgtcgagaccgcatcaacagtagcctttctgaattgcgacgcttggtccccactgcctttgagaaacagggctcttccaagctggagaaagccgaggtcttgcagatgacggtggatcacttgaaaatgctccatgccactggtgggacaggattctttgatgcccgagccctggcagttgacttccggagcattggttttcgggagtgcctcactgaggtcatcaggtacctgggggtccttgaagggcccagcagccgtgcagaccccgtccggattcgccttctctcccacctcaacagctacgcagccgagatggagccttcgcccacgcccactggccctttggccttccctgcctggccctggtctttcttccatagctgtccagggctgccagccctgagcaaccagctcgccatcctgggaagagtgcccagccctgtcctccccggtgtctcctctcctgcttaccccatcccagccctccgaaccgctccccttcgcagagccacaggcatcatcctgccagcccggaggaatgtgctgcccagtcgaggggcatcttccacccggagggcccgccccctagagaggccagcgacccctgtgcctgtcgcccccagcagcagggctgccaggagcagccacatcgctcccctcctgcagtcttcctccccaacaccccctggtcctacagggtcggctgcttacgtggctgttcccacccccaactcatcctccccagggccagctgggaggccagcgggagccatgctctaccactcctgggtctctgaaatcactgaaatcggggctttctgagctgccccttcaccaccccgccccaaggaataaggaaggttcttttaccaggagcccaaaaaagggcactgccttttctgctttgcttcatggactggctcatatgtgaaggcacgttctccagccatcagaggccccctcctcctccaacccatctctccttctcactgttatcccagcttatccacccagctctcctggagctgttctggtctcagaggcttggttccatttctcacctgaacagatgagtcctgggagagaccctcagagatccgcccagacccctctcctgccctctgcacaccagcagcaggcatgaaccttgggtctgggaaaaagctttaacctgcagggcaccaggacccaaggcaggctgttccttggggcggtcagaccccagtcaggagcaatgactgactggctgcagccttcccacgccaagaggctggaacatagtgtctgcctcgcttcctggagatagtaactgagcaggggctacaaagaggtctcctgggaaccctgtctgccccttcccacctgtccttgggccacaccatcacactgaaccacaggacagaccctttctccaccacagccaaggcctggagactgggggcccagcagagcctgctcccaccctcctcccagcagcagacacccaccctctcactgactaacaggtccctgcacacagctggcctggtaaacccagctgggaggtttctaggcagcagcaaaactctgtgacagggtgtcctcacaccaggccttggacagctctcccagacaggagccagggttgagcaatggagagcccagcccccacgtcttacagtcgccatcctccaggcgtgtggtccctccccattgggtgcacagtgcagaggggccgtggccccatgtgatggtgcgcagagaggaacctcttgggattcagcaccagacgtctgtgctgcctggtttgcatccggctcacagagcccagactgctggaacagccaaggactgtcaggctggacaaaaataactgcaaggaggggcaagagaaaggatgattcgaggcaccttggcccttcaaggtcatgcagtgggtcgagcgcctgagatcctgttcaccaggactccacagagctggctctgctcagaagccatttcattccccggctccaccctaggccactttttctaacagaggaaacaaatggtccagcagtcgttcccagcagaacagcggagcctggactgacacccagtgggaccagtgttgccacaccagttgataaaatgcagaaacccttctgtactcgttggtaaatatctactcccccaagtgactccaggtgccccccaccgcctggcacttcccccaggactcctacgatctggttactgcctggccgatccaaggctgtggagtcccagagccagcagttcactggtgctcattccacactggttagatacttcagttgtcacccctgggaagattctcccacctcctccctttgatggaaccaccctccccagaggctgcattgaggagactccacagactgaaaagtgagtttgcagaaaccttggggaaaagggccctttcaaagaagtggataagagggaggagatcattgagtgacccagaaagctcttttgaaaagacagactcctcaaggagagataaagaggaaagcacctctttcattttttagtgtgagctaattccatcagactgctgtcctcctggacccatctgagatgtgcagtagcaaggagaggggggatcattttagagagtgggtcattggcagggagtgctccggagggaggcagaggggagactgtggtagaaggaagacagaactcacacatgctcccaggattggggacagggacagaggaggtaacagaaggcaaaggccagtttccccgttatcatgaaggggcccactcaggacaggaacaaggacaactcctcctcctcctcctcctctcctgctgctcctgggataccaggtcagtgatgtagtcttgcagtttggcaacttcctagcctgagaatccctagtggggctgtgggaaacacatttccacgttgcaagcatgcaactccaaagaatctgtgatgccactgaaatgagatgggaatgatccagctctttcagcatcttggttgaacttgctttcattgtccctgggatattgtggaaggaaaggtgactgtgtgatctgattctgtggtcaaggacttgcatcttgtgtttctatccccaagccttcctggtgtctccaactcctaccccattgcatgggttgttgcggacatccaataaagatttttttagtgcttctggaaa

SEQ ID NO: 1817 - DNA, 4121 bp, Homo sapiens
agccaacaccgcctttctcagcatggagacctttgagcccatcagccaagagcccctcagccaagccagctatgacaaagccccagacccagttcctgagctccaagactcgttctatgcagaactgcaacgtgcagagagcctccaagagaagagcataaaagaggccaagaccaaatgcaggacaattgcatccctgctcactgcagcccccaacccccactccaaaggggtacttatgtttaagaaacggcggcagagagccaagaagtacaccctggtgagcttcggggctgctgctgggacaggcgctgaggaggaggacggcgttccccccacgagtgagtccgagctggacgaagaagccttctctgacgcccgcagcctcaccaatcaatctgactgggacagtccctatctggacatggagcttgccagggcgggctcaagagcatcagagggccagggctctgggctgggagggcagctgagtgaggtctctgggcgaggggtgcagctctttgaacagcagcgccagcgcgcagactccagcacccaggaactggcacgggtcgaaccagcagccatgctcaacggggaaggcctgcagtcaccacctcgggcccagagtgctcccccagaggcagctgtgctcccacccagccccttgccggcgcctgtagccagccccagacccttccaaccaggtggtggagccccgaccccagctccaagcatctttaaccggtcagccaggccctttaccccgggcctacaagggcagcggccaactaccacctcggttattttccggcctttagcccccaaaagggcgaacgacagcctggggggcctcagccccgccccaccccccttcttgtcttcgcaggggcccacccctctgcccagcttcacttcaggggttcccagccacgcgccagtctctggttcccccagcaccccacgctcctcgggccctgtgacagccaccagctccctgtacatcccagcccctagtcggcctgtcaccccaggtggagctccagagccccccgctcctcctagcgcagctgccatgacctccaccgcttctatcttcctatctgcgcctttgcgaccctctgcgcgcccagaggcgcctgccccaggcccaggggctcctgagccccccagcgctcgcgagcagcgcatctctgtgccagctgcccgcacgggtatcctgcaggaggcccggcgccgggggacccggaagcagatgttccggccgggaaaggaggagacgaagaactcgcccaaccccgagctgctatcgctggtacagaacctggatgaaaagcctcgggccgggggtgcagaatctggtcctgaagaagatgctctgagcctcggggctgaagcctgcaacttcatgcagccagtaggggccaggagttacaagaccctgcctcacgtgacacctaagaccccccctccaatggctcccaagaccccgccccctatgactcctaagactccacccccagtggctcctaagcccccatctcgagggctccttgatgggctcgtgaatggggcagcctcttcggctggaatccctgagccaccaaggctgcagggcaggggtggggagctgtttgctaagcggcagagccgtgcggacaggtatgtggtggaaggtacacctggtcctggtcttggccctcggcctagaagtccttctcctaccccgtctctgcccccttcctggaaatattcacccaacatccgtgccccgcctcctattgcttacaacccactgctctctccctttttcccccaggcggcccgaactctccctaaggcccaatcccaggggcctcgggcaacacccaagcagggcatcaaggctctagattttatgcggcatcagccctatcaacttaaaactgccatgttctgttttgatgaggttcccccgactcctggccctatcgcctcagggtcccccaaaactgcccgagtccaggagattcgccggttttccactccggcaccccagcccactgcagaacccctggctcccactgtgcttgccccccgagcagccactacactggatgagcccatctggagaacagaactggcctcagcccctgttcctagcccagcccctcctccagaggctcccaggggccttggggcttctcccagctcctgcggtttccaggtagccaggccccgattttcagccaccagaacaggattgcaagctcatgtgtggaggcctggggcagggcaccagtgaacaggcacaggtcccaggaccaaggagaggtggaacatccagttcctaaagttgcttctcctaccctatcccatcccctgtcacgcatctggaagctaaattgcctcctgccagagatggtttccaagttgatgtccccttcccccaccttcctcctcactctctacctccctgccgctttccaaccaagtatgtctgctttggtatctttgcctctctttgtctctgcatttcctttcctggatctctgtctttatttccaggcttctccacccatattcctccacagatctctcttccttgacatttgtgcttttctccctgggcctcattttaatgttcagtgagaagtaaacagagcagaagtgaccactgggacttcaggcaagaagctcaccaccaggcacacagcaaagggactgaactgacccctgtttgcactaagccacccccaccccccactctgctttcccaagcttgactggcatatacctaggcctgtgtgtgtgtgtgtgtgtgtgtgtgtgtgtgtgtgtgtgctcttccgtctaaggcatgaataagaggggaggtcaaaataaagacccaatctgaggccgggcacggtggctcacgccggtaatcccagcactttgggaggccgaggcgggcggatcacgaggtcaggagatcgagaccatcctggctaacacggtgaaaccccatttccactaaaaatacaaaaaattagctgggcgtggtggcgagcgcctgtagtcccagctactcgggaggctgaggcaggagaatggcatgaacctggaaggcggagcttgcagtgagctgagattgcgccactgcactccagcctgggcgacggagcgagactctgtctcaaaacaaacaaacaaacaaaagacccaatctgagtcttatcgttgtactgatagaagggtcagatatccccacatggagttgagtgggagaaagagattcactagagaataactccttagagaccaatgtctgtagcaggtgtacagcatcttgtgaaagttatggagcatgaaaagactgaagggccaggacagtttgcatgggctgagttataccagctagaccaggaatagaacaaagaattctatacctcaggatttcaaaaagttagcaacttgagaggccagtgctgagcaacccagtacccaggaaatgaaaaaaagaaagaaaattccctccgagaatgaacaaatcattggcttcattgcctcatgagcttgagagaaaggagaagagagccagagtgtggcaagtgaggccaaaatcagaagcatggcagaaatgagtgtaagtgattgagccacagacagaagtgtggcgagggacaatgccatattgggagaaggtaaagttgagtaacaagaaaccaaccgtgtgtgagagggggattggaaaaaaatttgagggagaagaatgttagaatggaagggaatgatggtggaagggaggtgtgagggtgtgtgctgagtgttgaaagaacggttggtgtctgtgtgattttccttgagtctgttcttcagtgtgtcttctgcagcttgccatgactgcctgggaaagagtagggaaatacccagagccaaaacctcctttcagtcccaccccatccctcaaaaccccagctattgcttcttttcagcttcaggtcctgatctccaatcttagtatggactcccttctcaccaagaccaccaccagctacgtttgctgtgtaatctggaaagtgataatttcctttgcttgttgggtgtgagtcacaatactttggtttgtgcacaagaataaatttatgccccataccttc

SEQ ID NO: 1818 - DNA, 1616 bp, Homo sapiens
gagagaggaagcttgaagccaatatggagtccgtcagttgctccgctgctgctgtcaggaccggagacatggagtcccagcgggacctgagcctggtgcctgagcggcttcagagacgcgaacaagaacggcagctggaagttgaaaggcggaaacaaaagcggcagaaccaggaggtagagaaggagaacagccactttttcgtcgccacctttgttcgggagcgagcggccgtggaagagcttctggagcgcgcggagtcggtcgagcggctggaggaggcggcctctcggctccaggggctgcagaaactaatcaacgactcagtttttttcctagccgcttacgacctgcggcagggacaagaggcgctggcgcggctgcaggcggccttggccgagcggcgccgggggctgcagcccaagaagcgtttcgctttcaagacccggggaaaggatgctgcttcgtctaccaaagtagacgcggctcctggcatccccccggcagttgaaagcatacaggactccccgctgcccaagaaggcggaaggagacctcggccccagctgggtctgcggtttctccaacctggagtcccaagtcttggagaagagagccagcgagttgcaccagcgcgacgttcttttgaccgaactgagcaactgcacggtcagactgtatggaaatcccaacaccctgcggctaaccaaggcccacagctgcaagctgctctgcggtccggtgtctacctctgttttcctggaggactgcagtgactgcgtgctggcagtggcctgccaacagctccgcatacacagtacgaaagacacccgcatcttcctgcaggtgaccagcagggccatcgtggaggactgcagtgggatccagttcgccccttacacctggagctacccggagatcgacaaggacttcgagagctctggtttagataggagcaaaaataactggaacgatgttgacgattttaactggctggcccgggatatggcctccccaaactggagtattcttcctgaagaggagcgaaatatccagtgggactaagcagttgtcactctgttcttcactcctaccaaatactttccacgttggactttcccccttattgggtctcgaagtttacttattgtcacactgtgtatgttttcagcattttaaggctagagattgtaatgggctcctacttgtaatttccattaaattcgtaacaggtataacactaaagcatttttgctattttcgtcatgcctttgagactgagtcttactccgtcccccagcgtggtggcgcgctgggattacaggcgcgcgccaccacgcgaacttgtatttttagtagagacggggtttcgccatgttgtccgggctgctctcgaactcctgacctcaggtgatccacccgcttcagcttcccaaagtgctggcattacaggcgtgagccaccacgccagggctttatttatttatttttaccacaatagtttgaagcagtaagggggaaggagggtgattatattgctttgtaatggtttgtgatacttgaaacatcacggtgcataataaagtaggtctgcagtaaatacatgggtttgtttgg

SEQ ID NO: 1819 - DNA, 2375 bp, Homo sapiens
acagggtctcactgtgtcacccaggctggagtgcagtagtgcaatctctgctcactgcagccttcacctcctgggttcaagtgattctcctgcctcagcctcccgagtagctgggattacaggtgtgtgccaccatgcccaactagtttttgtattttttagcagagacggggtttcctcatattggccaggctggtctcaaactcctgtacgcctgacctcaagtcaggcccacctcggcctcccagagtgctgggattacagaacatatgcagtaatgtcacctcaaaagagagttaagaacgtccaggcacaaaacaggacttcacaaggtagtagtagttttcagaccacgctttcagcctggaaagtaaaacaggatccaagcaactcgaagaacatctcaaaacatggacaaaacaatccagtgggagattatgaacatgctgatgatcaagctgaagaagatgctttgcaaatggcagtgggatattttgagaaaggtcccattaaagcttcacagaataaagataaaaccttggaaaaacacttgaaaactgtggaaaatgtggcttggaagaatgggttagcttcagaagaaattgatattctattaaatattgcactcagtggcaaatttggaaatgctgtaaacacacggatattgaagtgcatgatcccagcaacagtaatatcagaagattctgtggttaaggcagtctcctggctttgtgttggcaagtgttctggtagcaccaaggtacttttttatcgttggctggttgcaatgtttgacttcattgatcgtaaggagcaaattaacttgctctatggcttcttttttgcttcattgcaagatgatgcactgtgcccttatgtttgccatttgttatatttacttaccaaaaaagagaatgtcaaaccatttcgtgtgagaaaactgcttgatcttcaggccaaaatgggaatgcagcctcatctccaggctttgttgtcactgtataagttctttgctcctgctctgatttcagtatctttgcctgtaaggaagaagatatattttaagaattcagagaatctatggaagacggctctgcttgccgtgaagcaaagaaaccggggaccttctccagaacctctgaagttgatgttaggtccagctaatgttcgtcctctaaaaagaaagtggaattctctctcagttataccagtgctcaattccagtagctacactaaagaatgtggaaaaaaagagatgagtctttctgattgtctgaatagaagtggatcatttccactagaacaacttcaaagcttcccccaacttttacagaacatccattgcttagagctgccttctcagatgggctcagtgctaaacaactctctgctgcttcactacattaactgtgtcagagatgagccagtcttgctgaggttttattactggttgagtcaaacattacaagaagaatgtatttggtacaaggtgaataattatgaacatggaaaagaatttaccaacttcctggataccatcatcagggcagagtgcttcttacaagaggggttttattcctgtgaagcattcctgtataagagccttcctctctgggatggcctttgttgtcggtcacagttccttcagcttgtgagctggattccttttagtagcttctctgaggtgaaaccacttctttttgaccatctagcgcagctcttctttacatcaaccatttatttcaagtgtagtgtgcttcagagtctgaaagagctattgcagaattggctgttgtggctttctatggacattcacatgaaacctgttacaaacagtcctctgtgagttatctaacggtcttccacaagagacgatctgtatacaaatgtttgcatatgtttaatagtgtggcgtgaaacaatttttttcatgtaaatgcttagtagtacttttttggaagacttttttgtgacttttcactcttcttcccccacaatcctgaaaggaaggctaattctctaagttcctattgtgtaaatcagaaagcaacccttatctgctaaatgacttctttcaagagttaatataacaaaacactagagagatgagactagaatttgcaactttgacttccattcagtttaactcattttataaattatattcttatatttaaagccaattttcatgatggctagaaaaatctctaacgtaattttgcgtacaactttgtttttatgtttctgtgctgtattttggttatatgtgttaatttatcttaactttggagtttaaaataagagccctaaattgttaaatgtgtgctttaccttcaaagtaaaagtaaaagactaaatttcaaggaactgcataa

SEQ ID NO: 1820 - DNA, 3262 bp, Homo sapiens
acagggtctcactgtgtcacccaggctggagtgcagtagtgcaatctctgctcactgcagccttcacctcctgggttcaagtgattctcctgcctcagcctcccgagtagctgggattacaggtgtgtgccaccatgcccaactagtttttgtattttttagcagagacggggtttcctcatattggccaggctggtctcaaactcctgtacgcctgacctcaagtcaggcccacctcggcctcccagagtgctgggattacagaacatatgcagtaatgtcacctcaaaagagagttaagaacgtccaggcacaaaacaggacttcacaaggtagtagtagttttcagaccacgctttcagcctggaaagtaaaacaggatccaagcaactcgaagaacatctcaaaacatggacaaaacaatccagtgggagattatgaacatgctgatgatcaagctgaagaagatgctttgcaaatggcagtgggatattttgagaaaggtcccattaaagcttcacagaataaagataaaaccttggaaaaacacttgaaaactgtggaaaatgtggcttggaagaatgggttagcttcagaagaaattgatattctattaaatattgcactcagtggcaaatttggaaatgctgtaaacacacggatattgaagtgcatgatcccagcaacagtaatatcagaagattctgtggttaaggcagtctcctggctttgtgttggcaagtgttctggtagcaccaaggtacttttttatcgttggctggttgcaatgtttgacttcattgatcgtaaggagcaaattaacttgctctatggcttcttttttgcttcattgcaagatgatgcactgtgcccttatgtttgccatttgttatatttacttaccaaaaaagagaatgtcaaaccatttcgtgtgagaaaactgcttgatcttcaggccaaaatgggaatgcagcctcatctccaggctttgttgtcactgtataagttctttgctcctgctctgatttcagtatctttgcctgtaaggaagaagatatattttaagaattcagagaatctatggaagacggctctgcttgccgtgaagcaaagaaaccggggaccttctccagaacctctgaagttgatgttaggtccagctaatgttcgtcctctaaaaagaaagtggaattctctctcagttataccagtgctcaattccagtagctacactaaagaatgtggaaaaaaagagatgagtctttctgattgtctgaatagaagtggatcatttccactagaacaacttcaaagcttcccccaacttttacagaacatccattgcttagagctgccttctcagatgggctcagtgctaaacaactctctgctgcttcactacattaactgtgtcagagatgagccagtcttgctgaggttttattactggttgagtcaaacattacaagaagaatgtatttggtacaaggtgaataattatgaacatggaaaagaatttaccaacttcctggataccatcatcagggcagagtgcttcttacaagaggggttttattcctgtgaagcattcctgtataagagccttcctctctgggatggcctttgttgtcggtcacagttccttcagcttgtgagctggattccttttagtagcttctctgaggtgaaaccacttctttttgaccatctagcgcagctcttctttacatcaaccatttatttcaagtgtagtgtgcttcagagtctgaaagagctattgcagaattggctgttgtggctttctatggacattcacatgaaacctgttacaaacagtcctctagagacaactttgggtggatccatgaactctgtgtctaaactgatccactatgtagggtggctatccactactgcaatgcgcttggagagcaacaatactttcttgctgcactttattttggatttctatgagaaggtgtgtgacatatatataaattataaccttccattagtggtattgtttcctcctgggatcttctattctgcactcctcagcctggataccagcatcctgaaccagctgtgttttattatgcacagatatcgtaaaaatttgactgccgcaaagaaaaatgagttggtacaaaagacaaaatcagagttcaatttcagcagcaagacttatcaagaatttaatcactatttgacatcaatggttggttgcctgtggacgtccaaaccctttgggaaaggaatatatattgaccctgaaatcctagaaaaaactggagtggctgaatataaaaacagtttaaatgtagtccatcatccttctttcttgagttacgctgtttcctttttgctacaggaaagcccagaagaaaggacagtaaatgtgagctctattcggggaaagaaatggagctggtatttggactatttattttcacaggggttacaaggcttgaaactttttataagaagtagtgttcatcattcttccattcccagagcagagggcataaactgcaacaatcaatattaaatgaatgttgacataaactgaacacactggactaaactcactcctcattgctagagcaaagtggctcatcttgagttcccattttcatttcactgacagactgccatcctcaaggagtactcagactggccttctgttcatggcttaggagagccttggtgtgcctaactgatttttcaaaatttagatttttttagcctaccagtgaaaaatgaccccttcatcatcaggctctgcgttctaccaaattgtatgtaaaaagacacatctgttttgtggtaggattttttcacatttttgggtactatgagctgcattgatggaagacagcaggcaatatgtggtgacagttaactcacagacataaacatgcaaaatactttgctgtctctggggatattgccatttttcttactgtgagcaacagcaccaacaccaagttaacaggatgcaacatgtgtatgactctaaaagccctaagtagttggtaacttcctgggccttcaatcatagcaatttgatgagggaaggaaggggagaggatttgttgggtaatcaagacattcccgtatatgtctgatttcatggaactgctctattttgtttgtgtgtattgtatatgtatatgtgtatgtgtgcgtgtatgtgtgtgtctgtagcttcagtttttaagtgtaaggactaaataaactaactgaaattttactttcagaa

SEQ ID NO: 1821 - DNA, 6680 bp, Homo sapiens
acactacgccagaacaagatggccgacgcggcggccacagctggggccggtggctccggaacgagatcgggaagtaaacagtccactaaccctgccgataactatcatctggcccggaggagaaccctgcaggtggttgtgagctccttgctgacagaggcagggtttgagagtgccgagaaagcatccgtggaaacgctgacagagatgctgcagagctacatttcagaaattgggagaagtgccaagtcttactgtgagcacacagccaggacccagcccacactgtccgatatcgtggtcacacttgttgagatgggtttcaatgtggacactctccctgcttatgcaaaacggtctcagaggatggtcatcactgctcctccggtgaccaatcagccagtgacccccaaggccctcactgcagggcagaaccgaccccacccgccgcacatccccagccattttcctgagttccctgatccccacacctacatcaaaactccgacgtaccgtgagcccgtgtcagactaccaggtcctgcgggagaaggctgcatcccagaggcgcgatgtggagcgggcacttacccgtttcatggccaagacaggcgagactcagagtcttttcaaagatgacgtcagcacatttccattgattgctgccagacctttcaccatcccctacctgacagctcttcttccgtctgaactggagatgcaacaaatggaagagacagattcctcggagcaggatgaacagacagacacagagaaccttgctcttcatatcagcatggaggattctggagccgagaaggagaacacctctgtcctgcagcagaacccctccttgtcgggtagccggaatggggaggagaacatcatcgataacccttatctgcggccggtgaagaagcccaagatccgcaggaagaagtccctctcctgagctgagaaggaaacctggcttgtacaggggcgcagattccaccctcccggggagttaaagccactcaagggaagaagagggtgacctcctcatggccaagccgaggctgcagggtgtgatcggacatgattttcatggcaaaccgtcttattaagatgacctattttcactggatgtttgggttgaggaagatatgaacagaataatgagaatttttttttttattttgagatggagtcttactctatcacccaggctggaatgcagtggtgtgatctcagctcactgcagtctcagcaaccctgggtccaagtgattctcctgccttggcctcccgagtagctgggactagaggcaagcgccaccatgctggctaatttttgtattttgagtagagatagggtttcgccatgttggccaggctggtcttgaactcctgacctcaagtgatccacccgcattggcctcccaaagagttgcgattacaggtgtgagccaccacgcccagctaatttttgtatttttaatagagataaggtttcgccatgttggccaggctggtcttgaactcctgacctcaagtgataacccgcctcggcctcccaaagtgctgagattacaggcgtgagccaccgcaccccaccagagactttcttaatcaatcaggctatgtggtggggcatagcagcagccagtgacttcgttcattatcacaggatttgattcctttgaaactcaagagaccagggaaagtgacaggaaggaaagggctctttgctgctgtgcttattacaaggaagactgtttgtccagcgtgtatttcaggatatctggatcccttttattgactcacaatttgtggcaccactttctcatcccagaacttcattcttatttctctcctcatctggcctcccaagtgctccgttgagctgatgaaaagttctttgtactccctcaacgtgtcggaaacaggaggccacacagcacagctttgtttggggtgggcaggagtcaggagtcttgagcagatgcatcactgtgaagaagaacgacatgtcggggctgcacctgtcctcccgtcggcatttgacgaaagctccctgaagcggggcagcactctcctcctgagagatttaccatttattgcccctgtgaggaatgtgtgcttgggaactgccaagtcttaccccttctggaagaagaggttttctctgacaagagcctagagcgtcggctctattatgctgggacttgacagaggagccatggggtttaaacagtaggaaagaggggctacgcgcagtggctcacgcctgtaatcccagcacttcgggaggcgaaggcaggtggatcacttgaggtcaggagttcgagaccagcctggccaacatagtgaaaccccgtctctactaaaaatacaaaaattagccgggtgtggttactcatgcctgtaatcccagctactcgggaggctgaggcaggagaatcacttgaacctgggaggcggaggttgcagtgagccgagatcgtgccactgcactccagcctgggtgacagagcgagactccatttcaaaaaaataaaaaaaggataaagtaaacaataggaaaggatttggtggggtgagggtggggtgttgagggctgggcctcatcttgtattctgaaagctgagaaacggctggtcagctggaaggctggtggatgggcaggagtgagccaagctgaggcgttctgcaagaagcaggtctgagtctgtccaaccaatttgtatcctgtggggagaacaacttcattcttaacataccctacaaaccagaaaacaagtttttaaggaagatgctgggcatgctgatagcttttctggtctcctaaggaagagtttttaaaactaaatccaaggaagaaaaatgtaacaacacgtggaagtgaacactggatgaataagcttgtttcccaaattagaatcctaacgtccatatttagcttcatgtattcccctttggcttccacagttcaactccttttattttgagacagggtctcgctgtgtcgccccagctggagtatagtggcactacctcggctcactgcaacctccactccccgggttcaagcaattctcagagtagctgggattacagatgcccgccaccacatctggctaattttttttttttttttttagtagacacgggattttgctatgttgcccaggctggtcttgaactcctggcctcaagtgatccacccgccttggccttccaaagtgttgagattacaggcgtgagccacggtgcccagcccatctcttagtcttccattcccttggtgaatttggaaacttgaaaaacttggggacttgacagcaggctccatgttcttctggcctcactgtactgtgtaaggaaagagctgcttgtcaggaacggaagaggggacgctagtaaaaaaaaaaaaattggattccccaactggactaaataggagtttttcaggtttgtagtaacgtgaaactctcctagatcgaagcagttagactggcctatgtggccttctcagggtttgtgattcagttcttagcgattcttggcctgataagtttatgaacacagccccacattcaagccgtggccaatcccagctgttctcactgctcttgggaggtgttgtcccagtcagtgtttctgcagcttccatttgttgttgttatccagtgtaagcacctgttgaatgcagatgtgctgagttagaggtgggatttggaaaagggctgctatttctgctgttgagatttcagaggctatactctttttttttcttttcttttttttttttttttgagacggcatctcactcttatcgcccaggctggagtgcaatggcgtgatctcggctcactgcaacctccacctcctgggttcaagggattctcctgcctcagcctcctgagtagctgggattacaggcacctaccacaattctcggctaattttttttgtatttttggtagagacggggtttcaccaggttggccagggtggtctcgaacacctgacctcagatgatccacccacctcggcctcccagtgtgggtgggattacaggcatgagccaccgcgcctggcctcagaggctatactcttataattttgttctgaggggagacagggaaagggttagacaacttgaaacattgaccctgtataaaaatgcaaaattctcaatgtgtatttataaatttctattttttataactttatgggacttcttagaggccaaaagtagtaaacatgcagattaaaaatgtttatgaaaatctcaataaaaattcataataaaaactttgtaaataaatagaactgtaagctttgaacttaatttgtgttcaaaagttaacagcaatgtggacaaataagtcaggcttagcccttgtgttggcctaagcacacctgggaacttagtaaaacttttattttggaaattttcaaatacaaaattagagagcaaaatatatgaacccctgtatatgcctcatcaagcttccacacttgtcagtagcttgttgattctgtttcatctgtttctcccactttttgtcctttattttctttcctcctggagtgtgtgtgtgtgtgtgtgtgcgtgtgtgtgcgtgtgagacagagtttcgcgctggagtgcaatggtgcaatcttggcccactgcaacttctgcctcccgggttcaaatgattctactgcctcagcttcctgagtagctgggattataggtatctaccaccaccaccacgcctggctaattttttcttttttttttggagacggagtctcgctctgtcgcccaggctggattgcagtggattgtcaagattgcagtggtgcaatctcagctcaccgcaagctccgccacccaggttcacgccattctcctgcctcagcctcccaagtagctgggactacaggtgcctgctaccacgcccagctaattttttgtatttttcagtagagatggagtttcactgcattagccaggatggtctcgatctcctgacctcatgatccgcccgcctcggcctcccaaagtgctgggattacaggcatgagccaccgcacctggcctaatttttttgtaggtttagtagagatggggtttcaccatgttggccagactggtctccaactcctgacctcaggtgatcacctgcctcagcctcctaaagtgctgaggttacaggcgtgagcccccgcgcctggctcttctggagtatttttaaatgcaaactccagacctgtgtcatttaatctaaatgtgtctatacgtatctctgattgatctttctttaaattttaattttggaataattatagattcacaagatgttgcaaaaaatgttgagagagatcctatgtacccatcacccactttctcccagtggtagcatcttgcataactgtggtgcaatatcaaaacccttgcattcagtttcagtgtacaatgtagatggtatattagtacaatgcatagagcttatttagttttcaccatgtgcacgtgtgtgttatgtgtgtgttgttccgtgcagtttcatcgtgtagatttgtgtaaccaccagcacacaaatggtgaagacacagaaccattgcatcagtacagttctccctcatgctgtctctttgcaatcacatccacctctctgctcttccacttctctcctggcagccactactctgttctctatctctaatgttattgaaagaatgttataaattgaatcataaagtatgtgacttttttctttttgagacagagtcttgctctatcgcctaggctggatggagtgcagtggagcgatcccagctcactgcaactcctccacctcccgggttcaagagattctcctgcctcagcctcccaagtagctgggattacaggcatgtgccaccacacccagctaacttttgtatttttagtagagatggggtttcaccatgttggccaggttggtctccaactcctgacctcaagtgatccgcccacctcagcctcccaaagtgctaggattataggtatgacccaccgcacctggccgagtatgggactttttgacgttggctttttcagttctgcataattctcttgaggtccatctaggtggttgtgtgtatcagtagttcctttctttttattgctgagtagcatggaggcaccatagtttaacacagtttctttaaccattcacgcattgagacaaaaaaagttcttaattctgcgaacatcaacttcctgtgcccaggtgcaagtgcgggggcagctggcccagggtagagctttaccatggaccctggcgctcctggaaaaaaattcaaggtatttttcctcctcttggagcgtgtggcctacctcatctccatttgattactagcttttctttttctcctttgttaaacagttatttaattttgaagagataatatatgtatacagtataaaatttaaaagacagaaaaagatataagtgataacaaaatatcttcctcctcccctgtttcccagaggctcagacctcatccctggcagctgctattatgttactgtcaatatgaccttatgtattcttccagaagtattctgtgcatcaaatgcaaatacttatattttctacttctcagtgtattttttggtgatgttccatgtcagtaataaagagcttctctgtttcgtggc

SEQ ID NO: 1822 - DNA, 3069 bp, Homo sapiens
caaggtttcggggactgagtgggtttcagactttctctcaggatttccgctggcttcaggttccggtcaggcgtcgggacagagcctgatccaggcttcggcggccggtggcagctctcgatcagctctcgcagtcggagaggcggctaaggaaaggtgccacagcagagacgcgaaggagaggccctagaaccttttcaaagaagaatggaagaaaccatgaagcttgctacgatggaagacacagtggagtactgcctgttcctgataccagatgagtcaagggactcagataaacataaagagattcttcagaagtacattgagagaataatcactcggtttgcacctatgctggtcccctacatctggcagaatcagcctttcaatcttaaatataaacctgggaaaggaggtgttcctgctcatatgtttggcgtgacaaagtttggggataacattgaggatgaatggtttattgtttatgtaataaagcagatcacaaaggaatttccagagttagtagcaaggattgaagacaatgatggtgaattcttgttaatagaagctgctgactttctccctaaatggctggatcctgaaaatagcaccaatagggtatttttctgccatggggaattgtgtattatccctgcaccaagaaaatctggagcagaatcttggttacccaccacacccccaacaattccacaagcattgaatataatcacagcacattcagaaaaaatacttgcttcagaatctatacgagctgctgtgaataggcgcatcagagggtacccagaaaaaattcaggcctcacttcatcgagcacactgcttccttccagctggcattgtggcagtgctaaagcagcgccccagattggtggctgcagcagtccaggcattttacctacgagaccctattgacctgcgagcttgtcgtgttttcaagacattcttgcctgaaacacgaataatgacatcggtcacattcactaaatgtctatatgcacaattggtgcaacaaaggtttgtgccagaccggcggagtggatacaggctgcctcctccatctgatccccagtaccgagcccatgaattgggcatgaaattggctcatggatttgagatcttatgctccaaatgtagcccacatttttctgactgcaagaaatcccttgtgactgcctcaccactctgggccagtttccttgaaagtctgaaaaagaatgattactttaagggactgatagaaggttctgctcagtaccgggaaaggctagaaatggcagagaattacttccagctctcagtagactggccagaaagttctcttgctatgagccctggtgaagaaatcttaaccttattacagacaataccatttgatatagaagaccttaagaaagaagcagctaatcttcccccagaggatgatgaccagtggttagatctctcaccagatcagctggaccagctgctgcaggaagctgttggcaaaaaagaatccgagtctgtttccaaggaggagaaggagcagaactatgacttaactgaagtctcagagagcatgaaagctttcatatccaaagtctcaacccacaagggagcagagctgcctcgagaaccttctgaggctccaatcacttttgatgcagattcttttcttaattattttgataagattttagggccaaggcctaatgagtcagattctgatgatctggatgatgaagactttgaatgtttagatagtgatgatgacttggactttgaaacacacgaacctggcgaagaggcttccctgaaaggaacacttgataatctcaagtcatacatggcccagatggaccaggaactagcacacacctgcatcagcaaaagtttcaccactaggaaccaagtggaacctgtatcccagactaccgataacaattcagatgaggaagattctggtacgggagaatctgttatggcaccagtagatgtagacctgaacctggtttcaaatatattggaatcctatagctcccaagctggactggcaggacctgcttccaatcttttacaaagcatgggagtgcagctgcctgacaacaccgatcacagaccaacaagtaagccaacaaaaaattaaccagcacatttagcttctcttttttctttttaaataaatattgaatatgattctgttcatttctagtttagattactcatttagtaaaaatgtttcttcattacaagttttacagattgacttctccatgagccccaaatgtggccctcttggcacaagtctttgtgatctcagctgtgggttatacacaggttttgaactcggcagggtagaatctagcccctagacaaccttgagatgaaattcacacacttcatgctaaagacataccctaccacaatatacccttggagtaattctaaatatttaaatttctcccttactgctattcatcctcagatcaaaatttcaagttgacaaatttggatttgaaaactcattcactttttcaatttttttaatgaggcataacatgcatatggttaagtgcacaaatcttaagtgtacagtcagtgaatttttgcatgtatgtatgtacctgaagcaagatatagaacttatttacttgtaaataacagctatattgatatgtcacataccaaaaaatttaccctttaaattatacaattcagtggtttttagtatatttacaaaattgtgcaaccatccctaccatctaattctagaatattagaaaccccatactcactaatagtctctcattcccttctactcccagcccctagaaaccactagtctactttctgtctctatggatttgcctattttggatatttcatacctgatactgtacttaattgttttaattaattaattggtttgatatttaatataactgatatatcttttgctaagatgaaatgtttatttcttaaaatgatgctcatattcctcctaaaataaatcaagtattatctatatatcataaaattcaccattaaaagcaaaaaaaaagtcttctttaca

SEQ ID NO: 1823 - DNA, 2445 bp, Homo sapiens
gaagaggcagaaaaacaagagataacaaaggctccgtttcctttctgtgagagaaggcttttgtctttcctcctgctacgatgtcagtgtctggcaagaaagagtttgatgtgaaacagatcctaaggctacgctggaggtggtttagtcatccttttcaaggttccaccaacactggaagctgtcttcagcaggaaggatatgagcatagagggaccccggttcagggcaggttgaagagccactctcgggacagaaacggactgaagaaaagcaacagtcctgtccaccacaatatactggcaccagtgccaggaccggcccctgcccatcagagagccgttcagaatttgcagcaacataatctgatagtacattttcaagcaaatgaagatactcctaaatcagttccagagaagaatttattcaaagaagcttgtgagaaacgcgcacaagatttggagatgatggctgatgacaatatagaagattctacagcaagattagatacacaacactctgaagacatgaatgccaccagatctgaagagcagttccatgttataaaccacgcagagcaaactcttcgtaaaatggagaactacttgaaagagaaacaactatgtgatgtgctactgattgcaggacacctccgcatcccagcccataggttggttctcagcgcagtgtctgattattttgctgcaatgtttactaatgatgtgcttgaagccaaacaagaagaggtcaggatggaaggagtagatccaaatgcactaaattccttggtgcagtatgcttacacaggagtcctgcaattgaaagaagataccattgaaagtttgctggctgcagcttgtcttctgcagctgactcaggtcattgatgtttgctccaattttctcataaagcagctccatccttcaaactgcttagggattcgatcatttggagatgcccaaggctgtacagaacttctgaacgtggcacacaaatacactatggaacacttcattgaggtaataaaaaaccaagaattcctcctgcttccagctaatgaaatttcaaaacttctgtgcagtgatgacattaatgtgcctgatgaagagaccatttttcatgctctaatgcagtgggtggggcatgatgtgcagaataggcaaggagaactggggatgctgctttcttacatcagactgccattactcccaccacagttactggcagatcttgaaaccagttccatgtttactggtgatcttgagtgtcagaagctcctgatggaagctatgaagtatcatcttttgcctgagagaagatccatgatgcaaagccctcggacaaagcctagaaaatcaactgtgggggcactttatgctgtaggaggcatggatgctatgaaaggtactactactattgaaaaatatgacctcaggaccaacagttggctacatattggcaccatgaatggccgtaggcttcaatttggagtcgcagttattgataataagctctatgtcgtgggaggaagagacggtttaaaaactttgaatacagtggaatgttttaatccagttggcaaaatctggactgtgatgcctcccatgtcaacacatcggcacggcttaggtgtagccactcttgaaggaccaatgtatgctgtaggtggtcatgatggatggagctatctaaatactgtagaaagatgggaccctgagggacgacagtggaattacgtagccagtatgtcaactcctagaagcacagttggtgttgttgcattaaacaacaaattatatgctattggtggacgtgatggaagttcctgcctcaaatcaatggaatactttgacccacacactaacaagtggagtttgtgtgctccaatgtccaaaagacgtggaggtgtgggagttgccacatacaatggattcttatatgttgtaggggggcatgatgcccctgcttccaaccattgctccaggctttctgactgtgtggaacggtatgatccaaaaggtgattcatggtcaactgtggcacctctgagtgttcctcgagatgctgttgctgtgtgccctcttggagacaaactctacgtggttggaggatatgacggacatacttatttgaacacagttgagtcatatgatgcacagagaaatgaatggaaagagagcatgcaagaacttctacaaaacttctataccacacagaagctgaaagagactctggggcactaaattcagatcctttctccacacagcaatgacatttatcaatctgactcaggtgtggctgttgcccctttttgatatggagggaacactgaaagacagtttccttctggagttccaaatgcaatatagaaaaaaaaaccctgtgactctggattttattttaagttctctaacaagactcctaccttgagatcttagtctaggt

SEQ ID NO: 1824 - DNA, 5818 bp, Homo sapiens
agtgggggaggggagagaaagcaagaaagactgctctcggcacttgtgcttttgttagttctacagaagaggcagaaaaacaagagataacaaaggctccgtttcctttctgtgagagaaggcttttgtctttcctcctgctacgatgtcagtgtctggcaagaaagagtttgatgtgaaacagatcctaaggctacgctggaggtggtttagtcatccttttcaaggttccaccaacactggaagctgtcttcagcaggaaggatatgagcatagagggaccccggttcagggcaggttgaagagccactctcgggacagaaacggactgaagaaaagcaacagtcctgtccaccacaatatactggcaccagtgccaggaccggcccctgcccatcagagagccgttcagaatttgcagcaacataatctgatagtacattttcaagcaaatgaagatactcctaaatcagttccagagaagaatttattcaaagaagcttgtgagaaacgcgcacaagatttggagatgatggctgatgacaatatagaagattctacagcaagattagatacacaacactctgaagacatgaatgccaccagatctgaagagcagttccatgttataaaccacgcagagcaaactcttcgtaaaatggagaactacttgaaagagaaacaactatgtgatgtgctactgattgcaggacacctccgcatcccagcccataggttggttctcagcgcagtgtctgattattttgctgcaatgtttactaatgatgtgcttgaagccaaacaagaagaggtcaggatggaaggagtagatccaaatgcactaaattccttggtgcagtatgcttacacaggagtcctgcaattgaaagaagataccattgaaagtttgctggctgcagcttgtcttctgcagctgactcaggtcattgatgtttgctccaattttctcataaagcagctccatccttcaaactgcttagggattcgatcatttggagatgcccaaggctgtacagaacttctgaacgtggcacacaaatacactatggaacacttcattgaggtaataaaaaaccaagaattcctcctgcttccagctaatgaaatttcaaaacttctgtgcagtgatgacattaatgtgcctgatgaagagaccatttttcatgctctaatgcagtgggtggggcatgatgtgcagaataggcaaggagaactggggatgctgctttcttacatcagactgccattactcccaccacagttactggcagatcttgaaaccagttccatgtttactggtgatcttgagtgtcagaagctcctgatggaagctatgaagtatcatcttttgcctgagagaagatccatgatgcaaagccctcggacaaagcctagaaaatcaactgtgggggcactttatgctgtaggaggcatggatgctatgaaaggtactactactattgaaaaatatgacctcaggaccaacagttggctacatattggcaccatgaatggccgtaggcttcaatttggagtcgcagttattgataataagctctatgtcgtgggaggaagagacggtttaaaaactttgaatacagtggaatgttttaatccagttggcaaaatctggactgtgatgcctcccatgtcaacacatcggcacggcttaggtgtagccactcttgaaggaccaatgtatgctgtaggtggtcatgatggatggagctatctaaatactgtagaaagatgggaccctgagggacgacagtggaattacgtagccagtatgtcaactcctagaagcacagttggtgttgttgcattaaacaacaaattatatgctattggtggacgtgatggaagttcctgcctcaaatcaatggaatactttgacccacacactaacaagtggagtttgtgtgctccaatgtccaaaagacgtggaggtgtgggagttgccacatacaatggattcttatatgttgtaggggggcatgatgcccctgcttccaaccattgctccaggctttctgactgtgtggaacggtatgatccaaaaggtgattcatggtcaactgtggcacctctgagtgttcctcgagatgctgttgctgtgtgccctcttggagacaaactctacgtggttggaggatatgacggacatacttatttgaacacagttgagtcatatgatgcacagagaaatgaatggaaagaggaagttcctgttaacattggaagagctggtgcatgtgttgtagtggtgaagctaccctaaagctatctatctttatcaaatggaatgaaactagataatttcaagaaactgagtaggacaaagggagaaagaaatacatgttctttttcctgcaattaataatcagactggaaaattgttgtatcattttaatttgtagttacaattgctttcattcgtgaagccgaaacgtttttaaacatgaattacatatgaattattaagcatatgtgctttcgcagctgataatataaaaggaaatcccacagtctagatatagccccattactacaaaatgctaaaatatttaatgaaaattgatggtggccacagtgtgcaggttataaaagcattaatacatttcaaggtaagagccttaaaagttaaaaacattttcagtttttttttaaaaaacgtactcttattatctggaacatagaaatataaaaggtaacatctaaagcttagaatagtgtgatttttagtaagccattattctcctattcaaataatatcccaaagagctaaacaattccttacatttaccaagaggaaagcttttactgtgttgaagctaaaaaaataatggctctttgacaaaacttgttatgttgatcgcggtatgtcaaaatttttacaggtttgctcatctgccagagcacacatataaatttggtatttcttaacatattatcttgttagatttgttaccagtaaaatattactgtaatttcatatacacagtctatacaatgaaataatgaatatttatcatattgatacaaactgtgacctcagcttcagagtgtcagggcctcacttgtatagaatgtaatgttctcctcaaacatttatgttaactctataaacaaatatcgttaagttaaacaagttttcaaaaacaaaacaatttttaaagtaccttaaaattgaggatgttactcagtgttaacacatgggaacaccaaaatattcaataagcctggtcaattctatagttatcttttttgtaccaacacatgcttttctgttactgttatattatccagtagaaaatgttaggatatgtgtgctatataaaaaaaaaaaaagacttgttaagttttaaaataacaaaaatggctagttgaatagtattttatgtgtaattcttccatttattctgtttaattatacaactaagatgaaatattgaaaaaccctttgtgaaagtaacttttcaagtaaatgcacaactttagaatttctacaaataagttcttttaaacagtctttttattgtggattgtgaaatcaaaatctggagaaatgcttataaaatatactactagcttttaagttttaagaaagaagaacgtaagttgtacaaagatatttgtactttgacaaactgaatttaaataaactttatttcctctcactatagtgtggctttagaatatatcaagtacaacctgaatggactttttgattttacatttcctatatcactaaaatacttaaacacaaaaataaaattccactcctttatttcttcttacacctgccattgtctctaattctaaagagagagctatagatttctgcagttctagaggtgaagatagagacatagagaggctgtgaaacacacatacagccctgttaggtcttttgaattcacaccttattgaaatcagtgtagaagtagagttacctaaacctttatcgccaatgcacagcttggcctgttaagttaaatgtgggtgtcaaccagtggaaaagatcaaaggaccttttgcagcctagcttgccaatcttccagtaacaacgaggtgctaccaataggcagactgtgtctagagtcatgcatggacaagaggaaagtgaaagttgaatactctcttctcaatggcatagctggacttgattaagtattgactcatagaagagacatgtatgtttcccggggctaccccttcatagctgcatttaaaaatggtgttcaggccactatggctgctgtggtttgaatatttttttccctcgaaaactcatgttgaaacttaactcctaatgtagcagtactgagaggcagggcccttaagaggtgattgggccatgaggtctgtgccctcctgaatggattaatccattcatggattaatggattattatgagtgggggactggtgactttatatgaaaaggaaggaagagtgacctaagctagcatgctcagggtgcaccgtatgtcccctggtcatgtgatgctatgtgttaccttgggacttacctgacagctcttaccaacaagaaggccatcccagatatggcctctcaacctcagacttctcagcctgcctaactgtaagaaattaattctttttctttataaattacccaggttctgttttaagcctcagaaaatgaactaagacaatgccctagatgagctgccaaaatctgagcagatatgagccatcagaatagagacctgcagaggcccagggcactcaaacataactgtgcttgtctcagtcaaacttaattgggaaaaggaggagtaagagcaggccctttctgacatgctttagcagagataacttatcagggctagtttaaacaaatgtgtataggaaaggatgttatttatatattcttacaagagtgtaagggctcacacatttactgtactcagatctgaaagacaatgttgcttcttgatttttttctataatcactatgaccgtgttcacgattccctactctgcaactctcagcatgcatcatgatgattctctaacactgtctgtcaccttcctgtatttccacagagcatgcaagaacttctacaaaacttctataccacacagaagctgaaagagactctggggcactaaattcagatcctttctccacacagcaatgacatttatcaatctgactcaggtgtggctgttgcccctttttgatatggagggaacactgaaagacagtttccttctggagttccaaatgcaatatagaaaaaaaaaccctgtgactctggattttattttaagttctctaacaagactcctaccttgagatcttagtctaggtaaagaaaaaaaaaaaaaggtcatgaaacacaaatgtcctcaactgtcatcattctatgtttactttctcccaatcacatcacctgaggtagaagagatttttcagttgctatttctcttcgtaatgaattttctttacatcctgtccacactgctggagatactaagtcccaacctaaatgatggaaggagcatctcccctcttgtctgtggaagatatcacatgaactacctaattttcaagcatggatctccatatttcaaaggaaagttttaaaaatgtttttaaaacttcaaatatctcaccacagtgaattatgggtaaggtgataatatgtttaattagcttgatttaatcatcccacactgtatacatatgccaaaatatcattttgtatgccataatatatatgatttatgaattatagtaatattaataaaagtgttaaagcttt

SEQ ID NO: 1825 - DNA, 1797 bp, Homo sapiens
atgtatgatgatgccactgcactccagcctgggggtcagccagattctgtcttaaaaacaacaacaacaacaacaacaaaacctgctgaatgaatggacctgtcagccccaaatccaaggccaggccatcctctccctccacatcctggcacaggcctgcctccccctgccccagcccagggccaggccacactctgcctccaaagccaccgtccccccgaggcaccactgcatcccccaaggggcgggttcggaggaaggaggaggcaaaggagagccccagcgccgcagggcccgaggacaagagccagagcaagcgcagggccagtaacgagaaggagtcagcagccccagcctcaccggcaccttcgccggcgccctcgcccaccccagccccgccccagaaggagcagccccccgcggagacccctacagcccctgctcccccggtgacccctagcaaaccaatggccggcaccacagaccgagaagaagccactcggctcttggctgagaagcggcgccaggcccgggagcagcgggagcgcgaggagcaggagcggaggctgcaggcagaaagggacaagcgaatgcgagaggagcagctggcacgggaggccgaggcccgggcggagcgggaggcggaggcccggaggcgggaggagcaggaggcacgagagaaggcgcaggccgagcaggaggagcaggagcggctgcagaagcagaaagaggaggccgaagctcggtcgcgggaagaggcggagcggcagcgtctggagcgggaaaagcacttccagcagcaggagcaagagcggcaagagcgcagaaagcgtctggaggagatcatgaagaggactcggaagtcagaagtttctgaaaccaagaagcaggacagcaaggaggccaacgccaacggttccagcccagagcctgtgaaagctgtggaggctcggtccccagggctgcagaaggaggctgtgcagaaagaggagcccatcccacaggagcctcagtggagtctcccaagcaaggagttgccagcgtccctggtgaatggcctgcagcctctcccagcacaccaggagaatggcttctccaccaacggaccctctggggacaagagtctgagccgaacaccagagacactcctgccctttgcagaggcagaagccttcctcaagaaagctgtggtgcagtccccgcaggtcacagaagtcctttaagagggtttgccttggatccgggcacagttgtgagggctcctctgcatcacctaccaggatgtctggaggagaaaaagacagaacaaagatggaagtggcctgggcccctgggggtgggtcctctctgttgtttttaatctgcaccttatagactgatgtctctttggccggagccagatctgcccctcagtgcattcgtgtgctcgcacgcgcagacatcccttctcccccatacacacatatacactcacagcctctctggcctcttcccttggggaggggccacctgtagtatttgccttgatttggtggggtacagtggatgtgaatactgtaaatagcttgtgctcagactcctctgcgtggagagggtgggtgcaggaggcagaccctccccccaaagccccctggggagatcttcctctctctatttaactgtaactgagggggatcccaggtctggggatgggggacaccttgggccacaggatactggttgcttcaggggtacccatgccccctgccctcgcctggaatcagtgttactgcatctgattaaatgtctccagaaata

SEQ ID NO: 1826 - DNA, 3238 bp, Homo sapiens
gaacgggttcgcgaccgcagccgagagaccccgggcgaccggcacctccgagactcgcgggccacctgcctcgaccttccccggagcgcccccgcctccgagtcgctacttgccgggccgggccgggccgggcgtgatgcgccgcgggacccctgtcctggccactggccgccgccgccgccgccgctgagaccccgagacccccagtgacgccgcagccatggagagcggcccgcgtgcggagctgggggcgggcgcacccccagctgtggtcgccaggacccccccagagccaagaccttctccagaaggtgacccttcccccccaccaccaccaatgtcagccctggtccccgacactcccccggacacccctcctgccatgaagaatgccactagctctaagcagctcccactggaaccagagagcccctcagggcaggtcgggcctaggccagcccccccgcaggaagagtccccttcctctgaagcaaagagcagaggacccaccccaccagccatgggcccacgggatgccagacctcctcgaaggagcagccagccatctccaacagcagtgccagcctccgacagccctcccaccaagcaagaggtgaagaaggcaggagagagacacaagctggcaaaggagcggcgagaagagcgggccaagtacctggcggccaagaaggcagtgtggctggagaaggaggagaaggccaaggcgctgcgggagaagcagctccaggagcgccggcgccggctggaggagcaacgtcttaaagccgagcaacgccgtgcagccctggaggaacggcagcggcagaagctcgagaaaaacaaggagcgctatgaagcagccatccaacggtcagtgaagaagacgtgggccgaaatccggcagcagcgctggtcctgggcaggggccctgcaccacagctctccaggacataagaccagtgggagcaggtgctccgtgtcggcagttaacctgcccaaacacgtggactctataatcaacaagcggctctcaaagtcctctgccacgctctggaactcccccagtagaaatcgcagcctgcagctgagcgcatgggagagcagcatcgtggatcgtctgatgacgcccactctctccttccttgctcggagtcgcagcgcggtcacactgccccgcaacggccgggaccaggccgtgccggtgtgcccgcgctcggcctccgccagccccctgacgccgtgcagcgtcacccgaagcgtgcaccgctgcgcccccgccggtgagcgcggggagcgccgcaagcccaacgccgggggcagccccgctccggtgcgccgccggccggaggcctcgccggtgcagaaaaaggagaagaaggacaaggagcgggaaaacgagaaggagaagagtgccctagcccgggagcgcagcctcaagaagcgccagtcgctgcccgcctccccacgtgcccgcctctctgccagcaccgcctctgagctcagccccaaatccaaggccaggccatcctctccctccacatcctggcacaggcctgcctccccctgccccagcccagggccaggccacactctgcctccaaagccaccgtccccccgaggcaccactgcatcccccaaggggcgggttcggaggaaggaggaggcaaaggagagccccagcgccgcagggcccgaggacaagagccagagcaagcgcagggccagtaacgagaaggagtcagcagccccagcctcaccggcaccttcgccggcgccctcgcccaccccagccccgccccagaaggagcagccccccgcggagacccctacagacgctgctgtcttgacctcacccccagcccctgctcccccggtgacccctagcaaaccaatggccggcaccacagaccgagaagaagccactcggctcttggctgagaagcggcgccaggcccgggagcagcgggagcgcgaggagcaggagcggaggctgcaggcagaaagggacaagcgaatgcgagaggagcagctggcacgggaggccgaggcccgggcggagcgggaggcggaggcccggaggcgggaggagcaggaggcacgagagaaggcgcaggccgagcaggaggagcaggagcggctgcagaagcagaaagaggaggccgaagctcggtcgcgggaagaggcggagcggcagcgtctggagcgggaaaagcacttccagcagcaggagcaagagcggcaagagcgcagaaagcgtctggaggagatcatgaagaggactcggaagtcagaagtttctgaaaccaagaagcaggacagcaaggaggccaacgccaacggttccagcccagagcctgtgaaagctgtggaggctcggtccccagggctgcagaaggaggctgtgcagaaagaggagcccatcccacaggagcctcagtggagtctcccaagcaaggagttgccagcgtccctggtgaatggcctgcagcctctcccagcacaccaggagaatggcttctccaccaacggaccctctggggacaagagtctgagccgaacaccagagacactcctgccctttgcagaggcagaagccttcctcaagaaagctgtggtgcagtccccgcaggtcacagaagtcctttaagagggtttgccttggatccgggcacagttgtgagggctcctctgcatcacctaccaggatgtctggaggagaaaaagacagaacaaagatggaagtggcctgggcccctgggggtgggtcctctctgttgtttttaatctgcaccttatagactgatgtctctttggccggagccagatctgcccctcagtgcattcgtgtgctcgcacgcgcagacatcccttctcccccatacacacatatacactcacagcctctctggcctcttcccttggggaggggccacctgtagtatttgccttgatttggtggggtacagtggatgtgaatactgtaaatagcttgtgctcagactcctctgcgtggagagggtgggtgcaggaggcagaccctccccccaaagccccctggggagatcttcctctctctatttaactgtaactgagggggatcccaggtctggggatgggggacaccttgggccacaggatactggttgcttcaggggtacccatgccccctgccctcgcctggaatcagtgttactgcatctgattaaatgtctccagaaataaagaataattctgccaa

SEQ ID NO: 1827 - DNA, 3324 bp, Homo sapiens
gggttcgcgaccgcagccgagagaccccgggcgaccggcacctccgagactcgcgggccacctgcctcgaccttccccggagcgcccccgcctccgagtcgctacttgccgggccgggccgggccgggcgtgatgcgccgcgggacccctgtcctggccactggccgccgccgccgccgccgctgagaccccgagacccccagtgacgccgcagccatggagagcggcccgcgtgcggagctgggggcgggcgcacccccagctgtggtcgccaggacccccccagagccaagaccttctccagaaggtgacccttcccccccaccaccaccaatgtcagccctggtccccgacactcccccggacacccctcctgccatgaagaatgccactagctctaagcagctcccactggaaccagagagcccctcagggcaggtcgggcctaggccagcccccccgcaggaagagtccccttcctctgaagcaaagagcagaggacccaccccaccagccatgggcccacgggatgccagacctcctcgaaggagcagccagccatctccaacagcagtgccagcctccgacagccctcccaccaagcaagaggtgaagaaggcaggagagagacacaagctggcaaaggagcggcgagaagagcgggccaagtacctggcggccaagaaggcagtgtggctggagaaggaggagaaggccaaggcgctgcgggagaagcagctccaggagcgccggcgccggctggaggagcaacgtcttaaagccgagcaacgccgtgcagccctggaggaacggcagcggcagaagctcgagaaaaacaaggagcgctatgaagcagccatccaacggtcagtgaagaagacgtgggccgaaatccggcagcagcgctggtcctgggcaggggccctgcaccacagctctccaggacataagaccagtgggagcaggtgctccgtgtcggcagttaacctgcccaaacacgtggactctataatcaacaagcggctctcaaagtcctctgccacgctctggaactcccccagtagaaatcgcagcctgcagctgagcgcatgggagagcagcatcgtggatcgtctgatgacgcccactctctccttccttgctcggagtcgcagcgcggtcacactgccccgcaacggccgggaccagggtaggggctgcgaccctgggagaggccccacgtggggccgggcaggggccagcctggcgcgcgggccgcaacccgaccgcactcatccctctgcagccgtgccggtgtgcccgcgctcggcctccgccagccccctgacgccgtgcagcgtcacccgaagcgtgcaccgctgcgcccccgccggtgagcgcggggagcgccgcaagcccaacgccgggggcagccccgctccggtgcgccgccggccggaggcctcgccggtgcagaaaaaggagaagaaggacaaggagcgggaaaacgagaaggagaagagtgccctagcccgggagcgcagcctcaagaagcgccagtcgctgcccgcctccccacgtgcccgcctctctgccagcaccgcctctgagctcagccccaaatccaaggccaggccatcctctccctccacatcctggcacaggcctgcctccccctgccccagcccagggccaggccacactctgcctccaaagccaccgtccccccgaggcaccactgcatcccccaaggggcgggttcggaggaaggaggaggcaaaggagagccccagcgccgcagggcccgaggacaagagccagagcaagcgcagggccagtaacgagaaggagtcagcagccccagcctcaccggcaccttcgccggcgccctcgcccaccccagccccgccccagaaggagcagccccccgcggagacccctacagacgctgctgtcttgacctcacccccagcccctgctcccccggtgacccctagcaaaccaatggccggcaccacagaccgagaagaagccactcggctcttggctgagaagcggcgccaggcccgggagcagcgggagcgcgaggagcaggagcggaggctgcaggcagaaagggacaagcgaatgcgagaggagcagctggcacgggaggccgaggcccgggcggagcgggaggcggaggcccggaggcgggaggagcaggaggcacgagagaaggcgcaggccgagcaggaggagcaggagcggctgcagaagcagaaagaggaggccgaagctcggtcgcgggaagaggcggagcggcagcgtctggagcgggaaaagcacttccagcagcaggagcaagagcggcaagagcgcagaaagcgtctggaggagatcatgaagaggactcggaagtcagaagtttctgaaaccaagcagaagcaggacagcaaggaggccaacgccaacggttccagcccagagcctgtgaaagctgtggaggctcggtccccagggctgcagaaggaggctgtgcagaaagaggagcccatcccacaggagcctcagtggagtctcccaagcaaggagttgccagcgtccctggtgaatggcctgcagcctctcccagcacaccaggagaatggcttctccaccaacggaccctctggggacaagagtctgagccgaacaccagagacactcctgccctttgcagaggcagaagccttcctcaagaaagctgtggtgcagtccccgcaggtcacagaagtcctttaagagggtttgccttggatccgggcacagttgtgagggctcctctgcatcacctaccaggatgtctggaggagaaaaagacagaacaaagatggaagtggcctgggcccctgggggtgggtcctctctgttgtttttaatctgcaccttatagactgatgtctctttggccggagccagatctgcccctcagtgcattcgtgtgctcgcacgcgcagacatcccttctcccccatacacacatatacactcacagcctctctggcctcttcccttggggaggggccacctgtagtatttgccttgatttggtggggtacagtggatgtgaatactgtaaatagcttgtgctcagactcctctgcgtggagagggtgggtgcaggaggcagaccctccccccaaagccccctggggagatcttcctctctctatttaactgtaactgagggggatcccaggtctggggatgggggacaccttgggccacaggatactggttgcttcaggggtacccatgccccctgccctcgcctggaatcagtgttactgcatctgattaaatgtctccagaaataaagaataa

SEQ ID NO: 1828 - DNA, 1084 bp, Homo sapiens
aacctgcccaaacacgtggactctataatcaacaagcggcagcgtctggagcgggaaaagcacttccagcagcaggagcaagagcggcaagagcgcagaaagcgtctggaggagatcatgaagaggactcggaagtcagaagtttctgaaaccaagaagcaggacagcaaggaggccaacgccaacggttccagcccagagcctgtgaaagctgtggaggctcggtccccagggctgcagaaggaggctgtgcagaaagaggagcccatcccacaggagcctcagtggagtctcccaagcaaggagttgccagcgtccctggtgaatggcctgcagcctctcccagcacaccaggagaatggcttctccaccaacggaccctctggggacaagagtctgagccgaacaccagagacactcctgccctttgcagaggcagaagccttcctcaagaaagctgtggtgcagtccccgcaggtcacagaagtcctttaagagggtttgccttggatccgggcacagttgtgagggctcctctgcatcacctaccaggatgtctggaggagaaaaagacagaacaaagatggaagtggcctgggcccctgggggtgggtcctctctgttgtttttaatctgcaccttatagactgatgtctctttggccggagccagatctgcccctcagtgcattcgtgtgctcgcacgcgcagacatcccttctcccccatacacacatatacactcacagcctctctggcctcttcccttggggaggggccacctgtagtatttgccttgatttggtggggtacagtggatgtgaatactgtaaatagcttgtgctcagactcctctgcgtggagagggtgggtgcaggaggcagaccctccccccaaagccccctggggagatcttcctctctctatttaactgtaactgagggggatcccaggtctggggatgggggacaccttgggccacaggatactggttgcttcaggggtacccatgccccctgccctcgcctggaatcagtgttactgcatctgattaaatgtctccagaaataaagaataattctgcc

SEQ ID NO: 1829 - DNA, 1923 bp, Homo sapiens
cgagattccctattaaaaaaaaatagaattgatgcaaacagcctgttccttccggggttttgggctggaactgcagcgcttagagagctcggtggaagctgctaaaggcggaggcggggctctggcgagttctccttccaccttcccccacccttctctgccaaccgctgtttcagcccctagctggattccagccattgctgcagctgctccacagcccttttcaggacccaaacaaccgcagccgctgttcccaggatggtgatccgtgtatatattgcatcttcctctggctctacagcgattaagaagaaacaacaagatgtgcttggtttcctagaagccaacaaaataggatttgaagaaaaagatattgcagccaatgaagagaatcggaagtggatgagagaaaatgtacctgaaaatagtcgaccagccacaggttaccccctgccacctcagattttcaatgaaagccagtatcgcggggactatgatgccttctttgaagccagagaaaataatgcagtgtatgccttcttaggcttgacagccccacctggttcaaaggaagcagaagtgcaagcaaagcagcaagcatgaaccttaagcactgtgctttaagcatcctgaaaaatgagtctccattgcttttataaaatagcagaattagctttgcttcaaaagaaataggcttaatgttgaaataatagattagttgggttttcacatgcaaacattcaaaatgaatacaaaattaaaatttgaacattatggtgattatggtgaggagaatgggatattaacataaaattatattaataagtagatatcgtagaaatagtgttgttacctgccaagccatcctgtatacaccaatgattttacaaagaaaacacccttccctccttctgccattactatggcaacttaagtgtatctgcagctctacattaaaaaggagaaagagaaataacctgtctctcattcctaagttgcctcattaattttcatgaacaagaatatgtacctttttgatgctatattactgcgattaaaaagttcttgcaggtaatgtttatgatatgttaaacgttgtaatttcctatcgtaattataacattcccattcttttgtagatgaaacttctacatattgaaccacagattttctgagcttctaaatgtagcctttcattgcacatttcagtgatcagaatagatatccttttacacgcacaaaagcaatagattcattcagtggacaagttccttgtttaactacacagctatgatggaatgatatatccaagttccttgcctcagtgaaatatgcatatgtatatcatgaaagtgggatgccaagtaagcttaaaatggcattctctagcaaagagattagacttttaaataactcttataaaacaggttggcgatcatttcccaagattggtttcccttgagtttttgctaaaacaaatcttagtagttttgcccgtttaaaacaactcacaatcgtaaatgctactattcctaagatatcttacctttttatttcagtttagccatgtattgtatgagtgtattagtctaagcagtgagaatcttttctatgcctctattccagcaaaaagtagaagtatcaaataaaaagggcaacttttaaaatattaagcctgaagacttctaaaaagacaagaaacatggcctaaataaccaacatagatttacatagtaagtttcacactaccttattaccaaaagcaaacacctcttactttaaactacattatcatgtatatctattgtatgctggtctttactttttgccaaaatcaacatataatgaagagatgcctttgtttcatgagattcaaacttgatgctatgctttaaaataaactcagtacttttagaaacataa

SEQ ID NO: 1830 - DNA, 746 bp, Homo sapiens
ctccggcactatgagcggcttcagcaccgaggagcgcgccgcgcccttctccctggagtaccgagtcttcctcaaaaatgagaaaggacaatatatatctccatttcatgatattccaatttatgcagataaggatgtgtttcacatggtagttgaagtaccacgctggtctaatgcaaaaatggagattgctacaaaggaccctttaaaccctattaaacaagatgtgaaaaaaggaaaacttcgctatgttgcgaatttgttcccgtataaaggatatatctggaactatggtgccatccctcagacttgggaagacccagggcacaatgataaacatactggctgttgtggtgacaatgacccaattgatgtgtgtgaaattggaagcaaggtatgtgcaagaggtgaaataattggcgtgaaagttctaggcatattggctatgattgacgaaggggaaaccgactggaaagtcattgccattaatgtggatgatcctgatgcagccaattataatgtatgtaatagtgttgtgatcctctgacatagcctctgcctctggaccagggatagtacctcaagcctgtaatcccagtgctttgggaagccaaggcaggaggattgcttgagcccaggagtttgagaccagcctgggcaacatgacgagaccccatttctacaaaaaatttaaaaattagctgggcgtgtgcatgcttatagtcccagctactcaggaggctgag

SEQ ID NO: 1831 - DNA, 1294 bp, Homo sapiens
agtgctcgcagtgcgcaggcgtggggctctctccttgtcagtcggcgccgcgtgcgggctggtggctctgtggcagcggcggcggcaggactccggcactatgagcggcttcagcaccgaggagcgcgccgcgcccttctccctggagtaccgagtcttcctcaaaaatgagaaaggacaatatatatctccatttcatgatattccaatttatgcagataaggatgtgtttcacatggtagttgaagtaccacgctggtctaatgcaaaaatggagattgctacaaaggaccctttaaaccctattaaacaagatgtgaaaaaaggaaaacttcgctatgttgcgaatttgttcccgtataaaggatatatctggaactatggtgccatccctcagacttgggaagacccagggcacaatgataaacatactggctgttgtggtgacaatgacccaattgatgtgtgtgaaattggaagcaaggtatgtgcaagaggtgaaataattggcgtgaaagttctaggcatattggctatgattgacgaaggggaaaccgactggaaagtcattgccattaatgtggatgatcctgatgcagccaattataatgatatcaatgatgtcaaacggctgaaacctggctacttagaagctactgtggactggtttagaaggtataaggttcctgatggaaaaccagaaaatgagtttgcgtttaatgcagaatttaaagataaggactttgccattgatattattaaaagcactcatgaccattggaaagcattagtgactaagaaaacgaatggaaaaggaatcagttgcatgaatacaactttgtctgagagccccttcaagtgtgatcctgatgctgccagagccattgtggatgctttaccaccaccctgtgaatctgcctgcacagtaccaacagacgtggataagtggttccatcaccagaaaaactaatgagatttctctggaatacaagctgatattgctacatcgtgttcatctggatgtattagaagtaaaagtagtagcttttcaaagctttaaatttgtagaactcatctaactaaagtaaattctgctgtgactaatccaatatactcagaatgttatccatctaaagcatttttcatatctcaactaagataacttttagcacatgcttaaatatcaaagcagttgtcatttggaagtcacttgtgaatagatgtgcaaggggagcacatattggatgtatatgttaccatatgttaggaaataaaattattttgctgaaacttg

SEQ ID NO: 1832 - DNA, 2654 bp, Homo sapiens
gatgaggtaatcgcgccgctgagaggcacgcgcagccggtgcctagccggttggtccctgcgcccctgccccgccggccaccgcccccccacaccgtcccggccccggcagcctggccccaccatgaccgagcggtgcagcctgtggagtgccctgtcggccgccgcctgctgcttctaccgcggctccttcgtgcagttctccaaggagaagtacatcctggactcatcgccagagaaactccacaaggaattggaggaggagctcaaactcagcagcacggatctccgcagccatgcctggtaccatggccgcatcccccgagaggtctcggagaccttggtacaacgcaacggcgacttcctcatccgggactcactcaccagcctgggcgactatgtgctcacgtgccgctggcgcaaccaggccttgcacttcaagatcaacaaggtggtggtgaaggcaggcgagagctacacacacatccagtacctgtttgagcaggagagctttgaccacgtgcccgccctcgtgcgctatcatgtgggcagccgcaaggctgtgtcagagcagagtggtgccatcatctactgcccggtgaaccgcaccttcccactgcgctacctcgaggccagctatggcctgggacaggggagtagcaagcctgctagccccgtcagcccctcaggccccaagggcagccacatgaagcggcgcagcgtcaccatgaccgatgggctcactgctgacaaggtcacccgcagcgatggctgccccaccagtacgtcgctgccccgccctcgggactccatccgcagctgtgccctcagcatggaccagatcccagacctgcactcacccatgtcgcccatctccgagagccctagctcccctgcctacagcactgtaacccgtgtccatgccgcccctgcagccccttctgccacagcattgcctgcctcccctgtcgcccgccgttccagtgagccccagctgtgtcccggaagtgccccaaagacccatggggagtcagacaagggcccccacaccagcccctcccacacccttggcaaggcctccccgtcaccatcactcagcagctacagtgacccggactctggccactactgccagctccagcctcccgtgcgtggcagccgagagtgggcagcgactgagacctccagccagcaggccaggagctatggggagaggctaaaggaactgtcagaaaatggggcccctgaaggggactggggcaagaccttcacagtccccatcgtggaagtcacttcttccttcaacccggccaccttccagtcactactgatccccagggataaccggccactggaggtgggccttctgcgcaaggtcaaggagctgctggcagaagtggatgcccggacgctggcccggcatgtcaccaaggtggactgcctggttgctaggatactgggcgttaccaaggagatgcagaccctaatgggagtccgctggggcatggaactgctcaccctcccccatggccggcagctacgcctagacctgctggaaaggttccacaccatgtccatcatgctggccgtggacatcctgggctgcaccggctctgcggaggagcgggcagcgctgctgcacaagaccattcagctggcggccgagctgcgggggactatgggcaacatgttcagcttcgcggcggtcatgggtgccctggacatggcccagatttctcggctggagcagacatgggtgaccctgcggcagcgacacacagagggtgccatcctgtacgagaagaagctcaagccttttctcaagagcctcaacgagggcaaagaaggcccgccgctgagcaacaccacgtttcctcatgtgctgcccctcatcaccctgctggagtgtgactcggccccaccagagggccctgagccctggggcagcacggagcacggcgtggaggtggtgctggctcacctggaggccgcccgcacagtggcacaccacggaggcctgtaccacaccaatgctgaagtcaagctgcaggggttccaggcccggccggagctcctggaggtgttcagcacggagttccagatgcgccttctctggggcagtcagggtgccagcagcagccaggcccggcgctatgagaagttcgacaaggtcctcactgccctgtcccacaagctggaacctgctgtccgctccagcgagctgtgaccccagggacatttcccctctgcagctgcggacagcgtcaggggcagaggggcacacaactttccccagagcaccccaaggacactgtgatcaacccgagaatgttctgggttcaactcaagcatctcccttgcacctccagggtcctgcgtggactctgggttccatcccacctgctacatgctcaccaggtctccattgaggaagaacaggaacgccggttcccccaccagcttttgctgctccccttcctgctggggttccctgttttcgagccatgggaggcaggctgctcacgcctcctcactctctgtctgtccctcaccaacaccaaggcctccatctcactgtaaataagtctctgttctgtaaatagatgtacagaagccatgttatttctttcatataataaacttttatgactcttt

SEQ ID NO: 1833 - DNA, 2807 bp, Homo sapiens
atggcccctgctctgccttctcctcacaaggctgtcgcccgtcctgagctcctgctggacactgcagcccactcaggaaaactgagggctccagacggtggagagggagcagaatgtgctgggcacaatggtggcccatcttggggagtggggcagggccaaagccaagagccttcccggcagggaatcccacaggccccatggctggtgtcctggcagagacggggctttccacccagctctttttgcccagggcctttaaggactgagaagctcagagcaggcaggtgcccgttgcttctctgcggtggggctgctggagagccagaggctggcagcgactatgtgaagttctccaaggagaagtacatcctggactcatcgccagagaaactccacaaggaattggaggaggagctcaaactcagcagcacggatctccgcagccatgcctggtaccatggccgcatcccccgagaggtctcggagaccttggtacaacgcaacggcgacttcctcatccgggactcactcaccagcctgggcgactatgtgctcacgtgccgctggcgcaaccaggccttgcacttcaagatcaacaaggtggtggtgaaggcaggcgagagctacacacacatccagtacctgtttgagcaggagagctttgaccacgtgcccgccctcgtgcgctatcatgtgggcagccgcaaggctgtgtcagagcagagtggtgccatcatctactgcccggtgaaccgcaccttcccactgcgctacctcgaggccagctatggcctgggacaggggagtagcaagcctgctagccccgtcagcccctcaggccccaagggcagccacatgaagcggcgcagcgtcaccatgaccgatgggctcactgctgacaaggtcacccgcagcgatggctgccccaccagtacgtcgctgccccgccctcgggactccatccgcagctgtgccctcagcatggaccagatcccagacctgcactcacccatgtcgcccatctccgagagccctagctcccctgcctacagcactgtaacccgtgtccatgccgcccctgcagccccttctgccacagcattgcctgcctcccctgtcgcccgccgttccagtgagccccagctgtgtcccggaagtgccccaaagacccatggggagtcagacaagggcccccacaccagcccctcccacacccttggcaaggcctccccgtcaccatcactcagcagctacagtgacccggactctggccactactgccagctccagcctcccgtgcgtggcagccgagagtgggcagcgactgagacctccagccagcaggccaggagctatggggagaggctaaaggaactgtcagaaaatggggcccctgaaggggactggggcaagaccttcacagtccccatcgtggaagtcacttcttccttcaacccggccaccttccagtcactactgatccccagggataaccggccactggaggtgggccttctgcgcaaggtcaaggagctgctggcagaagtggatgcccggacgctggcccggcatgtcaccaaggtggactgcctggttgctaggatactgggcgttaccaaggagatgcagaccctaatgggagtccgctggggcatggaactgctcaccctcccccatggccggcagctacgcctagacctgctggaaaggttccacaccatgtccatcatgctggccgtggacatcctgggctgcaccggctctgcggaggagcgggcagcgctgctgcacaagaccattcagctggcggccgagctgcgggggactatgggcaacatgttcagcttcgcggcggtcatgggtgccctggacatggcccagatttctcggctggagcagacatgggtgaccctgcggcagcgacacacagagggtgccatcctgtacgagaagaagctcaagccttttctcaagagcctcaacgagggcaaagaaggcccgccgctgagcaacaccacgtttcctcatgtgctgcccctcatcaccctgctggagtgtgactcggccccaccagagggccctgagccctggggcagcacggagcacggcgtggaggtggtgctggctcacctggaggccgcccgcacagtggcacaccacggaggcctgtaccacaccaatgctgaagtcaagctgcaggggttccaggcccggccggagctcctggaggtgttcagcacggagttccagatgcgccttctctggggcagtcagggtgccagcagcagccaggcccggcgctatgagaagttcgacaaggtcctcactgccctgtcccacaagctggaacctgctgtccgctccagcgagctgtgaccccagggacatttcccctctgcagctgcggacagcgtcaggggcagaggggcacacaactttccccagagcaccccaaggacactgtgatcaacccgagaatgttctgggttcaactcaagcatctcccttgcacctccagggtcctgcgtggactctgggttccatcccacctgctacatgctcaccaggtctccattgaggaagaacaggaacgccggttcccccaccagcttttgctgctccccttcctgctggggttccctgttttcgagccatgggaggcaggctgctcacgcctcctcactctctgtctgtccctcaccaacaccaaggcctccatctcactgtaaataagtctctgttctgtaaatagatgtacagaagccatgttatttctttcatataataaacttttatgactcttt

SEQ ID NO: 1834 - DNA, 2750 bp, Homo sapiens
gaggcggagagcgtccttccctgccggtggagtaggcggtggagtggggccgggcaaggagcgcaggggcgtgtctgggggcgtggtctacaggtcagtctccgcccccggagtccggcactgagctctgcagctcagtggcccgagaaaggcaggagccgctgggtttaggaggtccccgggttgccggcggcgacagcgggggaagcatgactgctgtgggccgaaggtgccccgcgctggggtcccgaggggctgctggagagccagaggctggcagcgactatgtgaagttctccaaggagaagtacatcctggactcatcgccagagaaactccacaaggaattggaggaggagctcaaactcagcagcacggatctccgcagccatgcctggtaccatggccgcatcccccgagaggtctcggagaccttggtacaacgcaacggcgacttcctcatccgggactcactcaccagcctgggcgactatgtgctcacgtgccgctggcgcaaccaggccttgcacttcaagatcaacaaggtggtggtgaaggcaggcgagagctacacacacatccagtacctgtttgagcaggagagctttgaccacgtgcccgccctcgtgcgctatcatgtgggcagccgcaaggctgtgtcagagcagagtggtgccatcatctactgcccggtgaaccgcaccttcccactgcgctacctcgaggccagctatggcctgggacaggggagtagcaagcctgctagccccgtcagcccctcaggccccaagggcagccacatgaagcggcgcagcgtcaccatgaccgatgggctcactgctgacaaggtcacccgcagcgatggctgccccaccagtacgtcgctgccccgccctcgggactccatccgcagctgtgccctcagcatggaccagatcccagacctgcactcacccatgtcgcccatctccgagagccctagctcccctgcctacagcactgtaacccgtgtccatgccgcccctgcagccccttctgccacagcattgcctgcctcccctgtcgcccgccgttccagtgagccccagctgtgtcccggaagtgccccaaagacccatggggagtcagacaagggcccccacaccagcccctcccacacccttggcaaggcctccccgtcaccatcactcagcagctacagtgacccggactctggccactactgccagctccagcctcccgtgcgtggcagccgagagtgggcagcgactgagacctccagccagcaggccaggagctatggggagaggctaaaggaactgtcagaaaatggggcccctgaaggggactggggcaagaccttcacagtccccatcgtggaagtcacttcttccttcaacccggccaccttccagtcactactgatccccagggataaccggccactggaggtgggccttctgcgcaaggtcaaggagctgctggcagaagtggatgcccggacgctggcccggcatgtcaccaaggtggactgcctggttgctaggatactgggcgttaccaaggagatgcagaccctaatgggagtccgctggggcatggaactgctcaccctcccccatggccggcagctacgcctagacctgctggaaaggttccacaccatgtccatcatgctggccgtggacatcctgggctgcaccggctctgcggaggagcgggcagcgctgctgcacaagaccattcagctggcggccgagctgcgggggactatgggcaacatgttcagcttcgcggcggtcatgggtgccctggacatggcccagatttctcggctggagcagacatgggtgaccctgcggcagcgacacacagagggtgccatcctgtacgagaagaagctcaagccttttctcaagagcctcaacgagggcaaagaaggcccgccgctgagcaacaccacgtttcctcatgtgctgcccctcatcaccctgctggagtgtgactcggccccaccagagggccctgagccctggggcagcacggagcacggcgtggaggtggtgctggctcacctggaggccgcccgcacagtggcacaccacggaggcctgtaccacaccaatgctgaagtcaagctgcaggggttccaggcccggccggagctcctggaggtgttcagcacggagttccagatgcgccttctctggggcagtcagggtgccagcagcagccaggcccggcgctatgagaagttcgacaaggtcctcactgccctgtcccacaagctggaacctgctgtccgctccagcgagctgtgaccccagggacatttcccctctgcagctgcggacagcgtcaggggcagaggggcacacaactttccccagagcaccccaaggacactgtgatcaacccgagaatgttctgggttcaactcaagcatctcccttgcacctccagggtcctgcgtggactctgggttccatcccacctgctacatgctcaccaggtctccattgaggaagaacaggaacgccggttcccccaccagcttttgctgctccccttcctgctggggttccctgttttcgagccatgggaggcaggctgctcacgcctcctcactctctgtctgtccctcaccaacaccaaggcctccatctcactgtaaataagtctctgttctgtaaatagatgtacagaagccatgttatttctttcatataataaacttttatgactcttta

SEQ ID NO: 1835 - DNA, 2841 bp, Homo sapiens
tgccagcccatggccgagcctgccctcctccccgccgcccagatggagaggctggccccagggcccctagcctcaccgtgtcctcggatcccgcgggcccgcattgccaggcgctgcgcccagcgctgggccgacctgggctgcagctctggcccctcctcaggccgaatggatcagcttccccagaagaatctcctgcgactacaccctgctggctctgctggctgttccactggagtggagagctccagcatggatggcttttggatggaggtggaacagatccaacagagagatgagctgagggaagaggacagtggcgggaatgaaggccagcttccagaggaaggggaagctgaatcccagtggctgcaggacacaggcctgtcgggcctccttggtggcctgggcttggatggtgatcaccaggagctcctgtccaccctgacacagacccaggtggccgctgtgtgccgccggctggacatctatgctcgctcagtgcgaagacaacacaagacacctgtcagagatgtcagggatgtctttggggtcttcaattcagggaaaatgtcgtcagagaatggcgactccggtatgaagggggcccagctcagttccggggcctctaagtttcctccagcagcagagcctggggggctgcaggagcaggctgggagggaagaagccttcaacatggactctgcctactcagaacaagctgcggtgctcctgcagaggagcaggccatcccggggaggcacctctgcctggggcaagtgttccctgccgaagtttaccgtccccaaaggcagacttggcgtgacgaggataggagacttgtccctgcaggatatgaggaaggtaccttctctggccctcatagagctgaccgcgctctgtgacatcctcggcttggacctgaagaggagcaaggcggggaagtggaaagcggcagaaactcgcctctttggtgtgccccttgacagcctgctagaagctgaccacaaagtcctccccagcacacaggtcccgctggtccttcaagccctgctgtcctgtttggaaaagagaggactggacatggaaggcattctcagggtgcccggatcccaggccagggtcaaggggctggaacagaaactggagagagacttctatgctggcctttttagctgggacgaggttcatcacaatgacgcctctgatttgctcaaaaggttcatccggaagctgccgacacctttgctcacggctgagtacctcccggccttcgccgtggtgcctaacatccccaacctgaagcagcgcctgcaggttcttcacctgctcatcctcatcctcccagaacccaacagaaatgccttaaaggcactgctggaattcctcaggaaggtggtggcccgggaacagcacaacaagatgactctgaggaatgtttccaccgtgatggcccctaacctctttctgcaccaagggcggccccccaagctccccaaaggcaaggagaagcagctggcagaaggggcagccgaggtggtgcagataatggtgcactaccaggatctgctgtggacggtcgcctctttcctggtcgcccaggtgcgaaaactgaacgacagtagcagcaggcgcccccagctctgcgacgcaggcctcaagacttggctgcggaggatgcacgcagacagggacaaggcgggggacggcctcgaggcgactcccaaggtggcaaagatccaggtggtctggcctatcaaggaccccttgaaggtgcctctcacccccagcaccaaagtggcccacgtcctgaggcagttcacagagcacctcagccctggttccaagggtcaagaagacagtgaggacatggacagcctccttctacaccataggtccatggagtcagccaacatcctcctctatgaagttggagggaatatcaatgagcatcgcctggacccagatgcctacctcttagatctgtaccgtgccaacccgcatggtgagtgggtccttaaacagaaccccacctaaaccctgcgagtctcaggagcagcctggatgcctcctcctctcccctgctggctctgtgtccatgtacccagcatgagaacaaagctattccaggggagggtctgagttttattccaaggcttccttttctgaaatgcctctcagacccctcagaaatagactcaggggtggtgctctctccactcagaggggatgaggggctagggcctcagggaggggaggccaacactgtagccatgatcagccctggaagaactggacagaggaagaacttcccttcacagctctcatgttttaaccgtgcacacaatgccctcactcccctccaccctccagccctccagagagttgcttcctacaccaagcttgctgtatgacgccaccacttggggcgcttggatctccatgggcttctgtctgtggcttccagactggaggaaaattaaaaatgcagtacctttatcaagaggtagttggggtcttttccccccaggcaaaattgtttcgaaagtggccctacaatgtgtagtagcagcagcaccagagacaaaaccaggagagctctgtgaccttggacaagccccttgccctctcagaatcctttcaggatgaggggctagggcctcagggagaggaagccaagattgtagccatgaccagccccgggagaaatggacagaggaagactttgcttcacagctctcatgctttacatgttgatttgtacaatcttgtcattttgtaatatgatataatatgtaaacgtaattgtttaaacagtaaaggcacaacaagttcaatgtc

SEQ ID NO: 1836 - DNA, 2234 bp, Homo sapiens
gtgctaaaggaaaccaacagcggcctaggggtgaaaggacagccagggttagatgttctgaggaggcgggagcaaccgagagagcacgtgagcatctgtcctttctacccgttcctctttatctttagtgttcagtagcagcggggatagcccggggcccggtgtatggccacggagttacagtgtccggactccatgccctgtcacaaccagcaagtaaactctgcctcaaccccaagtcccgagcagctgcgacctggcgatctgatcctggaccacgcagggggaaacagagcctccagggccaaggtgattctcctcacggggtacgcccattctagcctgccggccgagctggactctggggcctgcggcggctccagcctcaactcagagggcaacagtggtagtggtgacagtagcagctatgacgcaccagctggcaactccttcctagaggactgcgaactctcccggcagatcggggcgcagcttaagctgctgcctatgaatgatcagatacgggagctacagaccatcatccgtgacaagacagccagtagaggtgacttcatgttttctgcggatcgtttgatcagacttgttgtggaagagggattgaatcagctgccatataaagaatgcatggtgaccactccaacagggtacaagtatgaaggagtgaaatttgagaagggaaattgtggggtcagcataatgagaagcggtgaggcaatggaacaaggtttacgagactgctgtcgatccatacgaattggaaagatcctgattcagagtgatgaggagacacaaagagccaaagtatattatgccaaattccccccagacatttaccggagaaaagtccttctgatgtatccaattctcagcactggaaatactgtaattgaagctgtaaaggttcttatagaacatggagttcaacccagtgttatcatcctactcagtctgttctccactcctcatggtgagttcagcatgaggcagtaactagggctccatatagtcctgaggtgggtgccaaatcaatcattcaggagtttccagagatcacaattttaactactgaagttcatcctgttgcacctacacattttggacagaaatactttggaacagactaagttatttaagtaaaataattatcttatgtaatattacaatcatgttttgattttctatttgttttactgattcacttgagggtggcagagaaaaatgtgttaaaatgctttttagttttggaagtgggtatatttgaggttatatctcatttagttatttgtttactgttggcaccgaattcaacaatgaagtatatgcaactcttacaaaacataaattttaataatattctaatgcaaattactgaaccctcagtgcattaaaattatttcctaatttatgagcctcttagtttggaggttgcttgaagccacaaataaaactcaaatgagagtcagttctttgtcccactgtagtttgcattttgtttagtttggttttagctctactaaggtttcacatatgtggctattgccacattcctctactgttttctttctgatactggacatgctagtaacttggagaggagaataaaagaatgtctcctggaattttacattcccattaatgtcctcattcagttggcagacctaggatgtatggttaactctcaggccattatgtttttcatggctcatttcccaaactgcattgttggtaggtgccttgctaagctgtaatgcagtgaagaagatggtggggcatttttagtaattggaactgtaacattaatttacaagattgaaccggggatgtctggatgctgacaagggagagccaagtactgttaatgccatcaatcctctaggaaggaattggtggtttttctgaagtgtgggggaaagggtggtttcttgctggatttcatggccagtaagtaaatttaaatgcttcatttttaatttggatgtttctgctagagacctttgatttggaaattagttattttgcatgtttgtcaactgtatatgtatgaaaatagaaaaaaaccatgctttttgtaaaaacccctaagatttgtatatgttcatctttaggcttctgaaagggagagaaatcatattggaaatcagtgttggtgttctgaaatctgcttgtaaaactctcatctcattttacattgatattaaaacattttaacagtg

SEQ ID NO: 1837 - DNA, 2186 bp, Homo sapiens
gtgtgctaaaggaaaccaacagcggcctaggggtgaaaggacagccagggttagatgttctgaggaggcgggagcaaccgagagagcacgtgagcatctgtcctttctacccgttcctctttatctttagtgttcagtagcagcggggatagcccggggcccggtgtatggccacggagttacagtgtccggactccatgccctgtcacaaccagcaagtaaactctgcctcaaccccaagtcccgagcagctgcgacctggcgatctgatcctggaccacgcagggggaaacagagcctccagggccaaggtgattctcctcacggggtacgcccattctagcctgccggccgagctggactctggggcctgcggcggctccagcctcaactcagagggcaacagtggtagtggtgacagtagcagctatgacgcaccagctggcaactccttcctagaggactgcgaactctcccggcagatcggggcgcagcttaagctgctgcctatgaatgatcagatacgggagctacagaccatcatccgtgacaagacagccagtagaggtgacttcatgttttctgcggatcgtttgatcagacttgttgtggaagagggattgaatcagctgccatataaagaatgcatggtgaccactccaacagggtacaagtatgaaggagtgaaatttgagaagggaaattgtggggtcagcataatgagaagcggtgaggcaatggaacaaggtttacgagactgctgtcgatccatacgaattggaaagatcctgattcagagtgatgaggagacacaaagagccaaagtatattatgccaaattccccccagacatttaccggagaaaagtccttctgatgtatccaattctcagcactggaaatactgtaattgaagctgtaaaggttcttatagaacatggagttcaacccagtgttatcatcctactcagtctgttctccactcctcatggtgccaaatcaatcattcaggagtttccagagatcacaattttaactactgaagttcatcctgttgcacctacacattttggacagaaatactttggaacagactaagttatttaagtaaaataattatcttatgtaatattacaatcatgttttgattttctatttgttttactgattcacttgagggtggcagagaaaaatgtgttaaaatgctttttagttttggaagtgggtatatttgaggttatatctcatttagttatttgtttactgttggcaccgaattcaacaatgaagtatatgcaactcttacaaaacataaattttaataatattctaatgcaaattactgaaccctcagtgcattaaaattatttcctaatttatgagcctcttagtttggaggttgcttgaagccacaaataaaactcaaatgagagtcagttctttgtcccactgtagtttgcattttgtttagtttggttttagctctactaaggtttcacatatgtggctattgccacattcctctactgttttctttctgatactggacatgctagtaacttggagaggagaataaaagaatgtctcctggaattttacattcccattaatgtcctcattcagttggcagacctaggatgtatggttaactctcaggccattatgtttttcatggctcatttcccaaactgcattgttggtaggtgccttgctaagctgtaatgcagtgaagaagatggtggggcatttttagtaattggaactgtaacattaatttacaagattgaaccggggatgtctggatgctgacaagggagagccaagtactgttaatgccatcaatcctctaggaaggaattggtggtttttctgaagtgtgggggaaagggtggtttcttgctggatttcatggccagtaagtaaatttaaatgcttcatttttaatttggatgtttctgctagagacctttgatttggaaattagttattttgcatgtttgtcaactgtatatgtatgaaaatagaaaaaaaccatgctttttgtaaaaacccctaagatttgtatatgttcatctttaggcttctgaaagggagagaaatcatattggaaatcagtgttggtgttctgaaatctgcttgtaaaactctcatctcattttacattgatattaaaacattttaacagtg

SEQ ID NO: 1838 - DNA, 792 bp, Homo sapiens
atcccagaccaggctcgtgtggctccttcttcctccgaccctaaatcgaagttctttgagctaatccagggcactgagattgacatcttcagctacaagcccacactgctcacctctaaaaccctggagaagatccgccctgtgtttgactaccgctgcatggtatctggcagtgagcagaagttcctcatcggcctggggaaatcccagatctacacatgggatggccgccagtcagaccgctggatcaagctagacctgaagacagagctgccccgggacactctgctatctgtggaaattgtgcatgagctgaaaggggaggggaaggcccagaggaagatcagtgccatccacatcctcgatgtccttgtgctgaatggcaccgacgttcgggagcagcactttaaccagcgaattcagcttgccgagaaatttgtgaaagccgtttccaagcctagtcggcccgacatgaatcccatcagggtgaaggaggtgtacagactggaagagatggagaagatttttgtcaggttggagatgaagatcatcaagggctccagtggcaccccaaagctcagctacacagggcgtgatgaccggcactttgtacccatgggcctctacatcgtcaggacagtgaatgagccctggactatgggattcagcaaaagcttcaagaagaagttcttctacaacaagaaaaccaaggactctacttttgacctccctgcagactccattgccccatttcacctccccagccttgcctgcctgtcgaagatggattaa

SEQ ID NO: 1839 - DNA, 1116 bp, Homo sapiens
atgaagaggagaactgacccagaatgcactgcccccatcaagaaacagaaaaaaagagttgcagagcttgccctgagcctcagctccacgtccgatgatgaacctccctcctctgtcagtcatggagcaaaagcatctactacaagccttagtgggtctgatagtgagaccgaggggaaacaacacagctctgactcttttgacgatgcattcaaagcagactctcttgtggaaggaacttcttctcgctattccatgtataatagcgtctcccagaagcttatggccaagatgggcttcagggaaggtgaaggattgggtaaatacagccagggtcggaaggacatcgttgaggcttccagtcagaaaggtcgaagaggcttgggtctgacactccggggctttgaccaggagctgaacgtggactggcgagatgagccagagcccagtgcttgtgagcaggtgtcatggtttccagaatgtaccactgaaattcctgacactcaggaaatgagcgattggatggtggtgggaaagagaaagatgattattgaagatgaaacagagttttgtggggaagagctgcttcacagtgtgttgcagtgtaagaagccactggtgaaggaccgggaagctgagcttctgtactttgctgatgtctgcgcaggcccaggtggcttctcagagtatgtgctgtggaggaagaagtggcatgcaaagggctttggaatgactttgaagggccctaatgacttcaagctggaggacttctactctgcttccagtgaactcttcgaaccctactatggtgagggtgggattgatggagatggagatatcacccgcccagagaacatctctgcttttcggaattttgtcctggataacacagatcgcaagggtgtccattttctgatggctgatgggggtttctcggtggaggggcaggagaacctgcaggagatcctcagcaagcagctgcttctgtgtcagttcctcatggcgctgtccattgtccggacaggaggccacttcatctgtaaaacctttgacctgttcacaccgtttagtgtggggcttgtctacctgctgtactgctgctttgaacgagtttgt

SEQ ID NO: 1840 - DNA, 616 bp, Homo sapiens
atggctggctacctgagtgaatcggactttgtgatggtggaggagggcttcagtacccgagacctgctgaaggaactcactctgggggcctcacaggccaccacggacgaggtagctgccttcttcgtggctgacctgggtgccatagtgaggaagcacttttgctttctgaagtgcctgccacgagtccggcccttttatgctgtcaagtgcaacagcagcccaggtgtgctgaaggttctggcccagctggggctgggctttagctgtgccaacaagattgcttccgtgatcaactcagccttggacctgtacttcccagagggctgtggcgtggacatctttgctgagctggggcgctactacgtgacctcggccttcactgtggcagtcagcatcattgccaagaaggaggttctgctagaccagcctggcagggaggaggaaaatggttccacctccaagaccatcgtgtaccaccttgatgagggcgtgtatgggatcttcaactcagtcctgtttgacaacatctgccctacccccatcctgcagaagtctaagaaccactcaccctgctacatgtctctagagtccattcatttcattgccgtgtagc

SEQ ID NO: 1841 - DNA, 1443 bp, Homo sapiens
atggctggctacctgagtgaatcggactttgtgatggtggaggagggcttcagtacccgagacctgctgaaggaactcactctgggggcctcacaggccaccacggacgaggtagctgccttcttcgtggctgacctgggtgccatagtgaggaagcacttttgctttctgaagtgcctgccacgagtccggcccttttatgctgtcaagtgcaacagcagcccaggtgtgctgaaggttctggcccagctggggctgggctttagctgtgccaacaaggcagagatggagttggtccagcatattggaatccctgccagtaagatcatctgcgccaacccctgtaagcaaattgcacagatcaaatatgctgccaagcatgggatccagctgctgagctttgacaatgagatggagctggcaaaggtggtaaagagccaccccagtgccaagatggttctgtgcattgctaccgatgactcccactccctgagctgcctgagcctaaagtttggagtgtcactgaaatcctgcagacacctgcttgaaaatgcgaagaagcaccatgtggaggtggtgggtgtgagttttcacattggcagtggctgtcctgaccctcaggcctatgctcagtccatcgcagacgcccggctcgtgtttgaaatgggcaccgagctgggtcacaagatgcacgttctggaccttggtggtggcttccctggcacagaaggggccaaagtgagatttgaagagattgcttccgtgatcaactcagccttggacctgtacttcccagagggctgtggcgtggacatctttgctgagctggggcgctactacgtgacctcggccttcactgtggcagtcagcatcattgccaagaaggaggttctgctagaccagcctggcagggaggccccactaccaccccctcacattgctacttgtgctgcctctgaaccctcccctcctgcagaggaaaatggttccacctccaagaccatcgtgtaccaccttgatgagggcgtgtatgggatcttcaactcagtcctgtttgacaacatctgccctacccccatcctgcagaagaaaccatccacggagcagcccctgtacagcagcagcctgtggggcccggcggttgatggctgtgattgcgtggctgagggcctgtggctgccgcaactacacgtaggggactggctggtctttgacaacatgggcgcctacactgtgggcatgggttcccccttttgggggacccaggcctgccacatcacctatgccatgtcccgggtggcctgggaagcgctgcgaaggcagctgatggctgcagaacaggaggatgacgtggagggtgtgtgcaagcctctgtcctgcggctgggagatcacagacaccctgtgcgtgggccctgtcttcaccccagcgagcatcatgtga

SEQ ID NO: 1842 - DNA, 2048 bp, Homo sapiens
ggctgctgggctggcggggcgcaggccgcgggacccgagcccggggaagcgagagagcggaggcgccgaggatccgattcactccctggggagacctatgggccgaagccgtgtaaatgcgttttaagaggcctcggctccgcaactgccactcctcctcggggtgttgcacaagtttcgaggtcaccggcgaccccccctagcagcgcgcctggctctggcccccgcgaaggaggacggagtttgtgtgttgcatactttctaaggcggcggctgcagcagcggctccatccagcccgtcagctcctcctgcaaggcatggctggctacctgagtgaatcggactttgtgatggtggaggagggcttcagtacccgagacctgctgaaggaactcactctgggggcctcacaggccaccacggacgaggtagctgccttcttcgtggctgacctgggtgccatagtgaggaagcacttttgctttctgaagtgcctgccacgagtccggcccttttatgctgtcaagtgcaacagcagcccaggtgtgctgaaggttctggcccagctggggctgggctttagctgtgccaacaaggcagagatggagttggtccagcatattggaatccctgccagtaagatcatctgcgccaacccctgtaagcaaattgcacagatcaaatatgctgccaagcatgggatccagctgctgagctttgacaatgagatggagctggcaaaggtggtaaagagccaccccagtgccaagatggttctgtgcattgctaccgatgactcccactccctgagctgcctgagcctaaagtttggagtgtcactgaaatcctgcagacacctgcttgaaaatgcgaagaagcaccatgtggaggtggtgggtgtgagttttcacattggcagtggctgtcctgaccctcaggcctatgctcagtccatcgcagacgcccggctcgtgtttgaaatgggcaccgagctgggtcacaagatgcacgttctggaccttggtggtggcttccctggcacagaaggggccaaagtgagatttgaagagattgcttccgtgatcaactcagccttggacctgtacttcccagagggctgtggcgtggacatctttgctgagctggggcgctactacgtgacctcggccttcactgtggcagtcagcatcattgccaagaaggaggttctgctagaccagcctggcagggaggaggaaaatggttccacctccaagaccatcgtgtaccaccttgatgagggcgtgtatgggatcttcaactcagtcctgtttgacaacatctgccctacccccatcctgcagaagaaaccatccacggagcagcccctgtacagcagcagcctgtggggcccggcggttgatggctgtgattgcgtggctgagggcctgtggctgccgcaactacacgtaggggactggctggtctttgacaacatgggcgcctacactgtgggcatgggttcccccttttgggggacccaggcctgccacatcacctatgccatgtcccgggtggcctgggaagcgctgcgaaggcagctgatggctgcagaacaggaggatgacgtggagggtgtgtgcaagcctctgtcctgcggctgggagatcacagacaccctgtgcgtgggccctgtcttcaccccagcgagcatcatgtgagtgggcctcgttccccccggagaatcccagcggggcctcagagatgcatctgggagaggtggggaagatggcaggcaagggtacccttggccaggactctggtgcccaccctgccacccccgcgctccacctgcagtgtttctgccctgtaaataggaccagtcttacactcgctgtagttcaagtatgcaacataaatcctgttccttccagctgtgtctgcctcctctgcagtgcaaggggcctggtcagccaggtgtgggggtgttcttggggtctcctttggtctccttcccacctttgtaaatataatgcaaataaataaatatttaggtttttaaaaactg

SEQ ID NO: 1843 - DNA, 4033 bp, Homo sapiens
cgcagtactggacccgagcgcgacggtgcggctggcggacccgggctggcttgtggggaaacgaaactgagggaggaggcggcggctctggcagcggcggcgacagtgtcggcctgaccccccctccgctccccggcagctcgctctctcccctcagcttaacgatgaagaggagaactgacccagaatgcactgcccccatcaagaaacagaaaaaaagagttgcagagcttgccctgagcctcagctccacgtccgatgatgaacctccctcctctgtcagtcatggagcaaaagcatctactacaagccttagtgggtctgatagtgagaccgaggggaaacaacacagctctgactcttttgacgatgcattcaaagcagactctcttgtggaaggaacttcttctcgctattccatgtataatagcgtctcccagaagcttatggccaagatgggcttcagggaaggtgaaggattgggtaaatacagccagggtcggaaggacatcgttgaggcttccagtcagaaaggtcgaagaggcttgggtctgacactccggggctttgaccaggagctgaacgtggactggcgagatgagccagagcccagtgcttgtgagcaggtgtcatggtttccagaatgtaccactgaaattcctgacactcaggaaatgagcgattggatggtggtgggaaagagaaagatgattattgaagatgaaacagagttttgtggggaagagctgcttcacagtgtgttgcagtgtaagagcgtgtttgatgtcttggatggggaagagatgcggcgagctcggactcgggccaatccctatgagatgatccgaggagtcttctttctaaacagggcagcaatgaagatggctaacatggattttgtatttgatcgcatgttcacaaatccgcgggactcttatgggaagccactggtgaaggaccgggaagctgagcttctgtactttgctgatgtctgcgcaggcccaggtggcttctcagagtatgtgctgtggaggaagaagtggcatgcaaagggctttggaatgactttgaagggccctaatgacttcaagctggaggacttctactctgcttccagtgaactcttcgaaccctactatggtgagggtgggattgatggagatggagatatcacccgcccagagaacatctctgcttttcggaattttgtcctggataacacagatcgcaagggtgtccattttctgatggctgatgggggtttctcggtggaggggcaggagaacctgcaggagatcctcagcaagcagctgcttctgtgtcagttcctcatggcgctgtccattgtccggacaggaggccacttcatctgtaaaacctttgacctgttcacaccgtttagtgtggggcttgtctacctgctgtactgctgctttgaacgagtttgtctcttcaagcctattaccagccgtcctgccaactcagagaggtatgtggtgtgcaagggcctgaaggtgggcatagatgatgttcgggattacctcttcgcagtgaatattaaactcaatcagctgcggaacacggattccgacgtcaacttggtggtccccctggaggtgatcaagggagaccatgaatttactgactacatgatacggtccaatgagagccactgtagtctgcagatcaaagctctggcgaaaatccatgcctttgttcaagacacgacactgagtgagcctcgacaggcagagatacggaaggagtgcctccgactctgggggatcccagaccaggctcgtgtggctccttcttcctccgaccctaaatcgaagttctttgagctaatccagggcactgagattgacatcttcagctacaagcccacactgctcacctctaaaaccctggagaagatccgccctgtgtttgactaccgctgcatggtatctggcagtgagcagaagttcctcatcggcctggggaaatcccagatctacacatgggatggccgccagtcagaccgctggatcaagctagacctgaagacagagctgccccgggacactctgctatctgtggaaattgtgcatgagctgaaaggggaggggaaggcccagaggaagatcagtgccatccacatcctcgatgtccttgtgctgaatggcaccgacgttcgggagcagcactttaaccagcgaattcagcttgccgagaaatttgtgaaagccgtttccaagcctagtcggcccgacatgaatcccatcagggtgaaggaggtgtacagactggaagagatggagaagatttttgtcaggttggagatgaagatcatcaagggctccagtggcaccccaaagctcagctacacagggcgtgatgaccggcactttgtacccatgggcctctacatcgtcaggacagtgaatgagccctggactatgggattcagcaaaagcttcaagaagaagttcttctacaacaagaaaaccaaggactctacttttgacctccctgcagactccattgccccatttcacatttgctactatggccggctcttctgggagtggggggatggcattcgtgtgcatgactcccagaagccccaggaccaggacaagctgtccaaggaggacgtcctctccttcatccagatgcacagggcctaagagcctcagaatgtgccacccctgcagaatgccctgtcattcctgagatggggccacctggggcccacagtgctggcttcttccccctcttgaaaagggactggggagcattgcacctggcatgaggagtgggtggcctcctctccatcccctgaagagctcaggcagggccctgcagagaacactcatgttccttctgggacacctgcctgggaactttcccctgccaggactcagcctgaaggaagctgctcctgaggcaggtatgaggtcagtgcctagggcacgtgggactgatggaggacatatcagagtggcagagctgtgggctctgctgttctctcctgcatcctgtagactcacttttctgagttccatgcactgccctgagggtagccatgcccttgctttgcccaactttttattgggccatccctgagtgggtggagacctgctgtcatgagctggccaggagaacctgctataaaaaaatcaaggttttgtttctttgaacttactctgttttgatgccaaattggagaccattttcttgtctccttcccccactcatcctggccttccctggagttcttcctagcccagagctctgacagtccagcagggtgggaaggagggagtttgggcaaactctcatccctgataccacattgagatcctgggagccctcttttcgtactgagtatggagttgtagagccatcctaggtgccatccccttttggtccaaacattgggcagcgctagatggcaggaagcagccttgaagacccgtctttcccccacagcagcaggggccccagcagtaacaaagggtacctccaggggtttgggtagcgctgccctctggcagtcatgcaccgctgtctgccatagccgctctagggtcttggcagaattctgagcttgaagtgcagctcccttactaccctttcccttcctttttcttccctaataggaggtacaatctgcttttgtttgtcgttaagtggtcactcccatttcctttatcttggccgacaacacagagaggagggggagctgggcagtagcttggggtgggggtgggcacctgtggttgtttttaatgggaaatacctctcagagatgttcatgcaggctccctagggccccatcccagtgccaggctggtttccatggagatagggcactgaggctcccgtgaggttggaatcgacttcaccatgggggtccttcagccagcatccagctccccacccccaggctggcagtagcactgctgagatgctgtatttccacccaattctgggtatatcagtgtgtcttgcagaatcttggatcattaaagataaacatattttt

SEQ ID NO: 1844 - DNA, 522 bp, Homo sapiens
gcaagaactcctgaaagagaaaacacttgctgagcagaatttggaggataccagacaacagctcttggcagccagaagcagccaggctaaggccattaacaccctggagactcgggtgagagaactggagcagaccttgcaggcctctgaggagcagctccaacagagcaagggcattgtggctgcccaggaaactcagatacaggagctcgtaagtgcttattggagctgctgcattccaggcccttaatgctttctctccaggcctttgcagatgctccaaactcattccgaacttcggcaacggtacctggacctgcccatagatacagttcttgtgctggatgtgagcaggccagcagcagggggtggagggagtcaggacctaatggtgggcctgagttacctgggaggtgcaccagcagctcctttccaccttacatcccaccttctggtccagcctggtcctggggctgtcagaggtggcagctccgctaggagtcaagcctcaacttgcaatca

SEQ ID NO: 1845 - DNA, 4801 bp, Homo sapiens
gcgctgggagacgtgcggttccgggtcgctgctcggctcgccggctgggcggtgggggttggtgacgcgggccggggctcacgagaggcccgggaggcggggctttgctggcttcccagagagaggcaggacagaatgctttgacctccaagctgttttaaatctagtagataagccagatcctgtgttgccataagcccttggcccacatttaagtgggaatgcagctagcttggatgtctgaaactttgtaggcgcctctgtctgaatcctgaacacaggcaccaggactactgagagctcgtcatctgtgcaggatagccacacagcaaacatgtttgcaaaactgaagaagaaaattgcagaagagactgctgttgctcagaggccaggaggtgctactaggatcccacggtctgtgagcaaggaatcagttgcctcaatgggagctgactcaggagatgactttgcttccgatggaagcagctccagagaagatctttcatcccagcttctgagaaggaatgaacagatacggaagttagaggccagactttctgactatgctgaacaggtccgaaacttgcagaagataaaagagaagcttgaaattgcattagaaaaacaccaggattcttccatgcggaaatttcaagagcagaatgagacattccaagccaacagagccaaaatggcagaaggactggctttggcattagccagaaaggaccaggaatggtcagaaaagatggatcagcttgaaaaggagaaaaatattctgacagcccagttacaggaaatgaagaaccagagtatgaatcttttccaaaggagagatgaaatggatgaattagaggggttccagcagcaggaactaagtaaaataaagcacatgcttttaaaaaaagaagaaagtctagggaaaatggaacaagaattggaggcacgaaccagagaacttagtcgtacccaggaggagttgatgaactccaatcagatgtcatcagacttaagccagaagctagaagaattgcagagacactactcaacgctggaagagcagagagatcatgtgatagcttcaaaaacaggtgcagaaagtaagatcacagccctggaacaaaaggaacaagagctccaagcactcattcagcagctttccattgatttgcaaaaggtcactgctgaaactcaagagaaagaagacgttatcacacatttgcaagagaaggttgcatccttggagaagagactagaacagaacttatcaggagaagaacacttgcaagaactcctgaaagagaaaacacttgctgagcagaatttggaggataccagacaacagctcttggcagccagaagcagccaggctaaggccattaacaccctggagactcgggtgagagaactggagcagaccttgcaggcctctgaggagcagctccaacagagcaagggcattgtggctgcccaggaaactcagatacaggagctcgctgccgccaaccaggagagcagccatgtgcagcagcaggcccttgctctggagcagcagttcttggagcgcacccaggcgctagaagcccagatagtggccctggagagaacgcgggcagctgaccagaccaccgcagagcaagggatgagacaactggagcaagaaaatgcagcccttaaagaatgcaggaatgaatatgaacgttctttacaaaatcaccaatttgaactaaagaagctgaaggaagaatggagccaaagagaaattgtgagcgtggccatggctcaagccctggaggaggtgcggaagcaaagggaagagttccagcaacaggcagctaacctgacagccataatagacgagaaggaacagaatctgcgggaaaaaaccgaagtgcttctccagaaagagcaggagattctccagctggagcgaggtcacaactctgccctgctgcagatacaccagctgcaggccgagctggaggccctgaggaccctcaaggcggaggaggctgcagtggtcgcggagcaggaggacctgctgaggctgcggggcccattgcaggccgaagcactctcagtcaatgagtcgcacgtgacctcgagggccatgcaggaccctgtgttccagcttccaactgcaggaagaacaccaaatggtgaggttggggccatggatctcacacagctacagaaggagaaacaggacttggagcagcaacttctggagaaaaataagaccataaagcagatgcagcagcggatgctggagctccggaagactctgcagaaggagctgaaaatcagacccgataatgagctcttcgaagtccgggagaaacctggacctgagatggcaaacatggcgccttccgtcacgaataacactgacctgacagatgcccgcgagatcaactttgagtaccttaaacatgtggttttaaaattcatgtcttgtcgcgaatccgaggcttttcatcttataaaagctgtgtcagtgttgctgaacttttcccaagaggaggagaacatgctcaaggaaactctggaatataagatgtcatggtttgggtccaaaccagctcccaagggcagcatccggccgtctatctcaaaccctcggataccatggtcctagaggggactacccaaggatggagctccgtgggttgacactttttctgtgaaaagaacactgacacaccagtctgggtgggtttttaatcactgtaactgcagtattttgtacaagtgtctaaacattgtttacaagactaaggcccacttccctgcaggctgacctgaacctcagggggtagctgatcctgtcattctggtcaccaaacaggagggtcctggcactacccagatttccacagtgctgctaatatcccagctccagccagcaccccatctgcacctgaatcctctaacttcacggtagcacttacagctgaagccatcagcatctggcaggcacacctgagtcaccatgtagcgctgctactggaggtagagacggccctttgagatggtgcccagcaggccaaacccacctgcctctgccaggaacagccaactccatgggaactctatgggagtggcttttaaaaattcagatgagttagaagctttttatcccttcctctcaagaaaatattctttcaccctgtctctcaaaccacctagaactttagaggatccatctttaagggtcggtgtggatgaatgagaaaatgcacctttctgacagtatctccactttacttaagaaaactagcaaatatatgaaaagacccttagtaccaaatacactcaattgcctttttaatgaatgtacttgtcttggataggttgctggtaaaccattttaaactattttttatagctgaagttcttcactactataaacatgtcttctgtactataaaatccatttaactggtgttcttaaaatcagagcgtccagaggaaattcttcctaaaactaggattcctgttcctttgtcttctcactcgcactctggcactgctccctctgaagtgcagtgggatctcgtgtgctttgtcttgattctgtgctgcgctgccgctgggcgatgcagaccacctgtcttctactgaaggacagtccgctgtctccagtgggggcagcagctgtcccccagcctcgatggagacactggggcagtctgccttgtctgtggagctgctctctctccctcatcccaccccaaatacttaaaatgacactacacccagacggcgcccagctggctgcagcacttgtagcatgcacatgactctggtagtaaccaacaaaaacttgttttatggattcctcgtttactgaggaaagggaacatgctggttctggaaaagccacaatattgaatctaaaaggaaaccgtttattgtttgatgaaagtttcactggttaaataaaaaactaaattaataactggagcctctaaatttattatccattatccagtgatggaaagttgtatttctcaatcatgcttagggccaaaataggtatataaaatgtgtcacagaaaaacacgcatttgcaacgttaacctaacgaaatttccatgaagaaccaagtcagggcagcatctccttagtcccagctcaggctctctgccttccagaggccgcttctccagtgactaacctcctcctctggctcctccttgcagacagttatcccttgtttagaacacgaatttccatttacctggtgggaacacgaaacaggagtctcttctgttctgcaagtttgatgggtaagaggtagccttttttcaaagtaggatttcctttttcaactgttccaggaaagaatctctaagactgggtagctcacagccagccaaaggcagctacatttccacagaagcccatccgctgcctccgtggcttctccagccattgaactggtcccacacgcaccccaggccccactcctcggcagtttcaggtgtagctgtggggcccgttcctaggtctgtactcactttagggaggcttcactgactaggctttcctcctgcatgttgaatttccttcagctttaagaggaagagtggaataaatattctaagtgatttaatgcactttgacttgtataaaactttctgtgttagcgacggtatctatagccctttatacgagcgatggatcttgagctctccttccatgttgtaaatagggattgtattcttgaaaactgctgtagcaaattcatctgtggtgcaatacactttttgattaaagctcttcaatccagatgcaa

SEQ ID NO: 1846 - DNA, 488 bp, Homo sapiens
ggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaaggcagcagctggtgggccctgcatacagatggacagagtactgcctcagcccccagcatgctcttgctaaccagagccgagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagactg

SEQ ID NO: 1847 - DNA, 3821 bp, Homo sapiens
gaaagctgccgctgaagctgccgccgttgcctccgccgccaagagtgagcgagcggacccgcgatggagaccatggcgagcccagggaaagacaattatcgaatgaagagctataagaacaatgctctaaaccctgaagaaatgagacgaagaagagaggaagagggcattcagctccggaagcagaagcgagagcaacaactttttaaacggagaaatgtggagctgattaatgaagaagctgccatgttcgatagtcttctcatggactcttatgtgagctctaccactggggagagtgtgatcacaagagagatggtggagatgctcttttctgatgattctgacctgcagttagcaaccacacagaaattccggaaactgctctccaaagagcctagtcctccaatagatgaagttatcaacactccaagagtggtggatcggttcgtggagtttctgaagaggaatgagaattgtacattacaggcagtctgggcactgggaaacatagctggagatagctctgtttgccgagattacgtcttgaactgttccatccttaatcctttgttaacactccttaccaagtccacacgactgacgatgacacggaatgcagtctgggccctgtcaaatctctgccgagggaaaaacccacccccagagtttgcaaaggtctctccttgtttgcctgtactgtctcgcctactcttcagcagcgactcggacttgctggcagatgcttgctgggccctttcttatctgtctgatggccccaatgagaagatccaggcagtcatagactccggagtctgccggagattggtagagctgctgatgcacaatgattacaaagtggcttctcctgccctgagagccgtgggtaacatcgtcactggggatgacatccagacccaggtcattcttaactgttcagccctaccttgccttctccacttgttgagcagtcccaaggagtcaatccggaaggaagcttgctggactatttcaaatattactgctggcaacagggctcaaatacaggctgttatagatgcaaatatcttccctgtgttgatcgaaatccttcagaaagcagagtttcgtacaaggaaagaggcagcctgggccatcaccaatgccacatcaggaggaacccctgagcagatcaggtacctggtctcactgggctgcatcaaacccctatgtgacttgctgactgtaatggattcgaagattgtgcaagtggccctcaatggactggagaacatcctgcggcttggagagcaagagggcaagcgcagtggctcaggggtcaatccttattgtggcctcatagaggaagcctatggcttggataaaattgagtttctccagagccacgagaaccaggagatctaccagaaggccttcgacctcattgagcactactttggtgtagaagacgatgatagcagcctggctccccaagtcgatgaaacgcaacagcagttcatcttccagcagcctgaggcccccatggagggcttccagctataatatctgcctccagggaggggaggggatgggaagcaccaccagccagcggaagagcagccctctggtgggcgggaaaccagtgtccccaccatcagccaccacacacctctgctgccctggagactgtgctcttgacctgctccgcccccttccctggagggagcaccctctggacagacagaaccatctgaggctcacctttgggttttgtgacaagaaggggacgtgttgggtttttcttccttacactatattttggctgcacacatgtctttaacccaggagcccaggggtagacaaaggaggactaaggtaatcaatttgcacctttttttatttttattttttttctttttttcttcagtggtgacttccttccctttatcttttttcattcttcccggtcctctgccctgatctgtgtaactcttatcttgggtacttgagcagacggtatattccagaggtgggaggtgggaggggaagggagaaatccaaaacaaagtgttcttgctctgacagaatattaatcttgtacgcttggattgagttatttaatttttttttcttttgcacatttttcttgtattaagattgctcttcccaagagccacaagttcctggttttagtaaacccagctgcctgcattgcctgggactagaggctggggaggctaccatgaaacaaaggtccctccctccctctgactctttgcccagacctctttagtttgggggatcctcctcactctcctgaagtgtctcaagtataccagtgggagtgcaggggaggagcacaggccttcagatggggcttcccacgtgtagctactgatcccatatttcctactcaccttccaaatggtgcgacccaacttcatttgtttacttgaaaattccccctcgaggttgagagaacctctgaggtggctgtattttctcctaagcttgagatagggggctgtggtccttcctttctcctgaggagaaagtccttgctctggtgacctgtaagttgcagaggagggtggagtgagagtgtcatgtattgggatagtcagggatccctgcctttggcctttcttcttcttcttcttcctcttccatagttggatcatgtatattttacttctaaaggagagaatgtcaaaaagttctgtatttttttatattctatatattaggtaggtcaatcttaattggtctcaagaggaagaactgtctgtcatttcggtaagtaggatactgtgaggaagaccaaaaagagatatggatgcttcctcgctcaggaggcctgagcttggtccttttcctctctgcttggattctggaccaccacctgggaccaaccttcagctctggaaccttcataaagcaggtcagcgtggcctgattgtcccaggacctgaagggagcaaggatggcctcagggcctggtgaagtctgctactctgtccttactgctgaacatcctgcttgtatcaggaaactcagaagcagtttgccttgtcaaattcaatctcaatggccattgtccacataactgatcacccatggctgcctctcctattatctattatcactgaaacttagtagcctgctttttttttttttttttttagagctattgcgtatcttccctgtttgggatccttgtacctggtttgggttttcccttccttgtgacaattataatccagatgcctcttctttctgtttgaattacggtagtgcattgccttagtggcttgcctgtgcctctgggtggattacatatgatagtaaagcccacctgtttggatgggagtagaggaagttggtgtagaccagctgtggagctgaaggcacagtctgccccacccccacctccccactgtggttagtcagaggcatcctgctccaagctctgcttttccttcctctgaaacaatgccattcttgcttctattgctacacatctccttctggctcaggtgaaatccatgcccttctgcttatagacctaaagttcaggtacttattattggccattgatcttgaatttgccctctcctagtgctgcagtcccacttcaaagccattttctgaggaggatggtttaggtctggcaattgtccttgaaaaatcccacccatgttgtaccaccttggtgagtcatatgccactcatcagcttgggaatgatggctgccaactcccaatctcccaggaaggcagggggcagaatctttttttcacttggcctgctacctccattaaaaaaccattctcttacagttt

SEQ ID NO: 1848 - DNA, 886 bp, Homo sapiens
ctataaaaatgtgcccggcggcaaagctgcagaaggggcaccgctgagctgccgagaggaagctcgctctgcccggctgccctcttgtagtccgccggcgaggggcagttctcggtgaggaggaagagagcagcggacggcacagcacccgcgcgggccctcccacaacagctccagctggcagcatcacttcccgccaatttatccaacttctgccaaggctctgaaatgccaacaacgtcgaggcctgcacttgatgtcaagggtggcacctcacctgcgaaggaggatgccaaccaagagatgagctccgtggcctactccaaccttgcggtgaaagatcgcaaagcagtggccattctgcactaccctggggtagcctcaaatggaaccaaggccagtggggctcccactagttcctcgggatctccaataggctctcctacaaccacccctcccactaaacccccatccttcaacctgcaccccgcccctcacttgctggctagtatgcacctgcagaaacttaatagccagtatcaggggatggctgctgccactccaggccaacccggggaggcaggacccctgcaaaactgggactttggggcccaggcgggaggggcagaatcactctctccttctgctggtgcccagagccctgctatcatcgattcggacccagtggatgaggaagtgctgatgtcgctggtggtggaactggggttggaccgagccaatgagcttccggagctgtggctggggcagaatgagtttgacttcactgcggactttccatctagctgctaatgccaagtgtccctaaagatggaggaataaagccaccaattctgttgtaaataaaaataaagttacttacaaagag

SEQ ID NO: 1849 - DNA, 7378 bp, Homo sapiens
ccgtcctacagatccgccatattgtctactgaaagctgccgctgaagctgccgccgttgcctccgccgccaagagtgagcgagcggacccgcgatggagaccatggcgagcccagggaaagacaattatcgaatgaagagctataagaacaatgctctaaaccctgaagaaatgagacgaagaagagaggaagagggcattcagctccggaagcagaagcgagagcaacaactttttaaacggagaaatgtggagctgattaatgaagaagctgccatgttcgatagtcttctcatggactcttatgtgagctctaccactggggagagtgtgatcacaagagagatggtggagatgctcttttctgatgattctgacctgcagttagcaaccacacagaaattccggaaactgctctccaaagagcctagtcctccaatagatgaagttatcaacactccaagagtggtggatcggttcgtggagtttctgaagaggaatgagaattgtacattacagtttgaagctgcctgggctctaacgaatattgcctctggaacctctcagcagaccaaaattgtcattgaagcaggggctgtccccatttttatagagctgcttaattcagactttgaggatgttcaggaacaggcagtctgggcactgggaaacatagctggagatagctctgtttgccgagattacgtcttgaactgttccatccttaatcctttgttaacactccttaccaagtccacacgactgacgatgacacggaatgcagtctgggccctgtcaaatctctgccgagggaaaaacccacccccagagtttgcaaaggtctctccttgtttgcctgtactgtctcgcctactcttcagcagcgactcggacttgctggcagatgcttgctgggccctttcttatctgtctgatggccccaatgagaagatccaggcagtcatagactccggagtctgccggagattggtagagctgctgatgcacaatgattacaaagtggcttctcctgccctgagagccgtgggtaacatcgtcactggggatgacatccagacccaggtcattcttaactgttcagccctaccttgccttctccacttgttgagcagtcccaaggagtcaatccggaaggaagcttgctggactatttcaaatattactgctggcaacagggctcaaatacaggctgttatagatgcaaatatcttccctgtgttgatcgaaatccttcagaaagcagagtttcgtacaaggaaagaggcagcctgggccatcaccaatgccacatcaggaggaacccctgagcagatcaggtacctggtctcactgggctgcatcaaacccctatgtgacttgctgactgtaatggattcgaagattgtgcaagtggccctcaatggactggagaacatcctgcggcttggagagcaagagggcaagcgcagtggctcaggggtcaatccttattgtggcctcatagaggaagcctatggcttggataaaattgagtttctccagagccacgagaaccaggagatctaccagaaggccttcgacctcattgagcactactttggtgtagaagacgatgatagcagcctggctccccaagtcgatgaaacgcaacagcagttcatcttccagcagcctgaggcccccatggagggcttccagctataatatctgcctccagggaggggaggggatgggaagcaccaccagccagcggaagagcagccctctggtgggcgggaaaccagtgtccccaccatcagccaccacacacctctgctgccctggagactgtgctcttgacctgctccgcccccttccctggagggagcaccctctggacagacagaaccatctgaggctcacctttgggttttgtgacaagaaggggacgtgttgggtttttcttccttacactatattttggctgcacacatgtctttaacccaggagcccaggggtagacaaaggaggactaaggtaatcaatttgcacctttttttatttttattttttttctttttttcttcagtggtgacttccttccctttatcttttttcattcttcccggtcctctgccctgatctgtgtaactcttatcttgggtacttgagcagacggtatattccagaggtgggaggtgggaggggaagggagaaatccaaaacaaagtgttcttgctctgacagaatattaatcttgtacgcttggattgagttatttaatttttttttcttttgcacatttttcttgtattaagattgctcttcccaagagccacaagttcctggttttagtaaacccagctgcctgcattgcctgggactagaggctggggaggctaccatgaaacaaaggtccctccctccctctgactctttgcccagacctctttagtttgggggatcctcctcactctcctgaagtgtctcaagtataccagtgggagtgcaggggaggagcacaggccttcagatggggcttcccacgtgtagctactgatcccatatttcctactcaccttccaaatggtgcgacccaacttcatttgtttacttgaaaattccccctcgaggttgagagaacctctgaggtggctgtattttctcctaagcttgagatagggggctgtggtccttcctttctcctgaggagaaagtccttgctctggtgacctgtaagttgcagaggagggtggagtgagagtgtcatgtattgggatagtcagggatccctgcctttggcctttcttcttcttcttcttcctcttccatagttggatcatgtatattttacttctaaaggagagaatgtcaaaaagttctgtatttttttatattctatatattaggtaggtcaatcttaattggtctcaagaggaagaactgtctgtcatttcggtaagtaggatactgtgaggaagaccaaaaagagatatggatgcttcctcgctcaggaggcctgagcttggtccttttcctctctgcttggattctggaccaccacctgggaccaaccttcagctctggaaccttcataaagcaggtcagcgtggcctgattgtcccaggacctgaagggagcaaggatggcctcagggcctggtgaagtctgctactctgtccttactgctgaacatcctgcttgtatcaggaaactcagaagcagtttgccttgtcaaattcaatctcaatggccattgtccacataactgatcacccatggctgcctctcctattatctattatcactgaaacttagtagcctgctttttttttttttttttttagagctattgcgtatcttccctgtttgggatccttgtacctggtttgggttttcccttccttgtgacaattataatccagatgcctcttctttctgtttgaattacggtagtgcattgccttagtggcttgcctgtgcctctgggtggattacatatgatagtaaagcccacctgtttggatgggagtagaggaagttggtgtagaccagctgtggagctgaaggcacagtctgccccacccccacctccccactgtggttagtcagaggcatcctgctccaagctctgcttttccttcctctgaaacaatgccattcttgcttctattgctacacatctccttctggctcaggtgaaatccatgcccttctgcttatagacctaaagttcaggtacttattattggccattgatcttgaatttgccctctcctagtgctgcagtcccacttcaaagccattttctgaggaggatggtttaggtctggcaattgtccttgaaaaatcccacccatgttgtaccaccttggtgagtcatatgccactcatcagcttgggaatgatggctgccaactcccaatctcccaggaaggcagggggcagaatctttttttcacttggcctgctacctccattaaaaaaccattctcttacagtttaaaaaaaaaaaaaaaaaaaaagccttcccctacccaacctccgcccattgttctcttccaaagggcaatttagtaggatctactttgtacatctcaagtaagagttaagtccctgatacagggaccagtttcttagtgtaagacatacacatcctgcttgtccagctgttcctccaaaatctactttggcttcagctccgggtcctgtaccagatggaaaatgtttttggtgatctggctgctgcttaaagccagttttccctaagaactccaaaggctaaagtctactaggggcagagtgtgaggatagatttctaatcagagaaaagtggcctccaggagctttcatttatgtcttctccagaccaggttttcctgttatcttcctttaatcccctttcaaccaacaggtgaagttcttccagcccacagaggtagtaatatcatcttttctatctcctcctctcctttggccatgtaatgaagcaaaatattatttatttagcccaggcttgagagccactgtttgtggacagtcttcatctagattccataccctggcctaggcgaggtaaggctctctggttattgccaggatggagcccctctaccccagtctgctgtagggaataccctaattagttgaggcatgcttttggaatcctggcatgttggcatatggctggtctatcctttttaagatctctggttgggggtatctggatatggattaggagggacaaggagcctttttcttggctaatgttttccaatacttttttgaatggtgccagcccctccaggcatcccacccccaaatcatcatctttagtactaacagggtgtctggtcttagaagcctcccttcagatcccagctgaccctggtgactgcctggccttgatgttggctgcagccttctgatagaaccacatggattccacccacagctggccaggcttgttacatgggtcagggaatacaaatggcccccccccagggagcaggtgttggcctcagttttcagggacccttggtgttgctccttacctagagcccattaatctaccccatcaactctctgccatgaaagccatcttccaggagccctgttttttggagctgaactgcacagattatagctgctattgtacttaaataagggagaggaaaagaaggttctcaggcacagactttctatttttctcaagccaaaccagtttaaaatgtctagcagaatgaactgtatttccatttcttcatgtctacctgccttccccccacaccctaaagttgtacttgtttctagcaaactagaaggaaaagataggaaagcctggcactactaacctcacctctcatacacctctttgaaggccccagctcttttgttcaggcctctcttctcccctagactcactcagcttggtatccatcatcttgagcattcttcagtagattcatctagggttcagattccagactctcagctgaagacagggagccaatttcccccaggtccctgcaggtaatccagggaccccatagggagaacaggctgactggggcattaggaatgtttgtacctctctgcttccctggcagcctggggaagggtgcagggctcagtgcgctaaaccatggtaaacatcttcaatagaactaccctagaatttagtgagtgtgagactgagatattgctcagaataaatttattccatagccatttaggattgcatgttctggaccaaccttgtccagtatgttttctgtttgagctttttcattcttttgttaagccaacaagttgagaatttggccctgctgggatccatgtagtgggcactagctgctctttggccaaggccttcataaatgattcagtctctcattatctgtcctctagccccacaccctgatttagaccgtggcaaaggaagaacttgaggtcaagaccaaccaaatctgtgaattaaagctgttatttttttctctgcaagggcgctttgcttcaggtctgggctatgtgcagaacctaagcaggctgtgagagttagaagaggcagtattacatgttaggcccagaacaccatgggaaaaggtttatgtagtgtatcttagtggcctgcctagctgcctctgggccaggctgacttctgatgtccacattagctcgtacctgaaccctgttgctgaatgccagccctgttctcctgtaactattatatacgccatggcctggggggcattgaaggaagtaagctctcagagatcctaacactggctgggaacctctgactcagagcatgtctttaaagagtccacatctggccaggcgcggtggcacatgcctgtaatcccagcactttgggaggccgaggcgggtggatcacgaggtcaggagtttgagaccagcctggcaacatagtgaaaccccatctctaataaaaatacaaaaaattagctgggcgtggtggcaggcgcctgtaatcccagctacttgggaggctgagacaggagaatcacttgaacccaggaggcggaggttgcagtgagccaagatcatgccactgcactccagcttgggtgacagtgcgagactccatctcaaaaaaaaaaaaaaaaaaaaaatccacatcttcagctgggcgcggtggctcatgcctgtaatcctagcactttgggaggctgaggcgggcagatcacttgaggttaggggttcaaaaccagcctgaccaacatagtaaaaccccgtccctacaaaaataaaaaaataaaaaaaataagccaggtgtggtggtgggcacctgtgatctcagctacgtgggaggctgaggcaggagaatctcttgaacctaggaggcagaggttgcagtgagccaagattgtgccagcctgggcgacagggtgaggctcttgtctcaaaaaaaaaagtccacatcttcatgaaccctcagactctggagttgggtgtcggcttttttagccagcttttgtgggaattgcctttgacctattaaagaaggaaagtgggtaatggagtcccagccactcaagagactggatatcccccgagaatggcttgggttaccagctatggacccttggaagatgaatctaatccttctcactggtttttctttgcaaattcatttgcttttatttttctaataacaataaactctattttccatgttctcagggcccctgggtagacagacacagcttgatttcagagcagacataggcgaagaaaacatggcattgagtgtgctgagtccagacaaatgttatttatatacacatccaaatttgaagagaaaatgtatttctttaggtttcaaacactgtaatagatataaagcaaaaataaaaacctgttgcaaagttctaaa

SEQ ID NO: 1850 - DNA, 3230 bp, Homo sapiens
ggggtcctggcgagaagcgagccggcggcctgaggaggcgactgactgagcagcgcacccggggagcaaggaggcgcggtgaactgagcggcccctgagctgacagatacactgcgcagctggaacggcgagcgagccgacgggcgagtgaggggcgcagccatgatcacctcggccgctggaattatttctcttctggatgaagatgaaccacagcttaaggaatttgcactacacaaattgaatgcagttgttaatgacttctgggcagaaatttccgagtccgtagacaaaatagaggttttatacgaagatgaaggtttccggagtcggcagtttgcagccttagtggcatctaaagtattttatcacctgggggcttttgaggagtctctgaattatgctcttggagcaggggacctcttcaatgtcaatgataactctgaatatgtggaaactattatagcaaaatgcattgatcactacaccaaacaatgtgtggaaaatgcagatttgcctgaaggagaaaaaaaaccaattgaccagagattggaaggcatcgtaaataaaatgttccagcgatgtctagatgatcacaagtataaacaggctattggcattgctctggagacacgaagactggacgtctttgaaaagaccatactggagtcgaatgatgtcccaggaatgttagcttatagccttaagctctgcatgtctttaatgcagaataaacagtttcggaataaagtactaagagttctagttaaaatctacatgaacttggagaaacctgatttcatcaatgtttgtcagtgcttaattttcttagatgatcctcaggctgtgagtgatatcttagagaaactggtaaaggaagacaacctcctgatggcatatcagatttgttttgatttgtatgaaagtgctagccagcagtttttgtcatctgtaatccagaatcttcgaactgttggcacccctattgcttctgtgcctggatccactaatacgggtactgttccgggatcagagaaagacagtgactcgatggaaacagaagaaaagacaagcagtgcatttgtaggaaagacaccagaagccagtccagagcctaaggaccagactttgaaaatgattaaaattttaagtggtgaaatggctattgagttacatctgcagttcttaatacgaaacaataatacagacctcatgattctaaaaaacacaaaggatgcagtacggaattctgtatgtcatactgcaaccgttatagcaaactcttttatgcactgtgggacaaccagtgaccagtttcttagagataatttggaatggttagccagagccactaactgggcaaaatttactgctacagccagtttgggtgtaattcataagggtcatgaaaaagaagcattacagttaatggcaacataccttcccaaggatacttctccaggatcagcctatcaggaaggtggaggtctctatgcactaggtcttattcatgccaatcatggtggtgatataattgactatctgcttaatcagcttaagaacgccagcaatgatatcgttagacacggtggcagtctgggccttggtttggcagccatgggaactgcacgtcaagatgtttatgatttgctaaaaacaaacctttatcaggatgatgcagtaacaggggaagcagctggcctggccctaggtttggttatgttgggctctaaaaatgctcaggctattgaggacatggttggttatgcacaagaaactcaacatgagaagattctgcgtggtcttgcagttggcatagctttagtaatgtatgggaggatggaagaggctgatgctctcattgaatctctctgtcgtgacaaggacccaattcttcgaaggtctggaatgtatactgtagccatggcttattgtggctctggtaacaacaaagcaattcgacgcctgctacatgttgctgtaagtgatgttaatgatgatgtcaggagggcagcagtagaatcacttgggttcattctattcagaacccctgaacagtgcccaagtgttgtctctttgttgtcagagagttacaaccctcatgtgcgctacggagctgcaatggccttggggatatgctgtgctggtacaggaaacaaggaagccattaatttgctagaaccaatgacaaacgaccccgtgaactacgtgaggcaaggggcactcatagcttcagctctcatcatgatccagcagactgaaatcacttgtccaaaggtgaatcagttcagacagctgtattccaaagtcatcaatgataagcatgatgatgtcatggccaagtttggcgctattctggcccagggcatactggatgcaggtggtcataatgtcacaatctccttgcagtccaggactgggcatactcatatgccttctgtggttggcgtccttgtatttacccagttttggttctggtttcctctttcacacttcctgtcattggcttatacccctacctgtgtcattggccttaacaaggacttaaaggtttctactgctgtattatctataactgccaaggctaaaaagaaggaaaaagaaaaggaaaaaaaggaggaggagaaaatggaagtggatgaggcagagaaaaaggaggaaaaagagaagaaaaaagaacctgagccaaacttccagttattggataacccagcccgagttatgcctgcccagcttaaggtcctaaccatgccggagacctgtagataccagcctttcaaaccactctctattggaggcatcatcattctgaaggataccagtgaagacattgaggagctggtggaacctgtggcagcacatggcccaaaaatcgaggaggaggaacaagagccagaacccccagaaccatttgagtatattgatgattaagggccagaggatctcacttgcttatctgaagaagattgtccaggctcatattgggaatgcttatgaggaaattcatgccgagacctgctattcaatgcatgtatcgttgcctctgcactgacctgaagaaccctgtctccaagtctttggttgaagagaagatatatgactgttgagtgtgctctttcacagaacttggttttcaaataaatataagatctccagatggacaagacatttgtttttcagcctgggtttttaataaatgtatctaatcctccccacaccatgaaatgcct

SEQ ID NO: 1851 - DNA, 2003 bp, Homo sapiens
aattagttgctaaagatgccagagtgtgtgcacgtacaggctttttctttcccctccccctttcttccttttcccaagccccctcttctccctgtttcccctcctactcctttatctcctccctccgtgtcttagttctgcagtacgcgggttgaagcacattcctgctttgcaaggctttctgctaaggatgtattgtggcttttgtttggattgcagcatgcagaattacaggagtctccccaggacagtgctatcacccgggatattaaccgaacattcccagcccatgactactttaaggacacaggaggagatggacaagattccttatataaaatatgcaaggcttattctgtgtatgatgaagagattggttattgccagggccagtcatttcttgctgctgtgctccttctccatatgcctgaagaacaggcattcagtgttctggtcaagatcatgtttgactatgggctcagggaacttttcaagcaaaacttcgaagatttgcattgcaaattttaccagttggagcgcctcatgcaggaatacattcctgacctgtacaaccacttcctggatataagccttgaagcacacatgtatgcctcccagtggtttcttactcttttcactgcaaaattccctctctacatggtcttccatatcatcgacctgcttttatgtgagggaataagtgttatttttaatgtcgcccttggattattaaagacttcgaaagatgacctgctgttgacagactttgaaggtgccttgaagttctttagggttcagcttcctaagagataccgctcagaagaaaatgcaaaaaaactaatggaattagcctgcaacatgaagattagtcagaagaagttgaaaaaatacgagaaagaatatcacaccatgagggaacagcaggcccagcaagaagaccccatcgagcgatttgagcgggagaataggcgtctacaagaagctaacatgaggttggaacaggaaaacgatgacttagcccatgagctggtgaccagcaagattgcactacggaaggacctggataacgctgaggaaaaggcagatgctctgaataaggagctgctgatgaccaaacagaagttgattgatgcagaagaagagaaaagacggctggaagaagagtctgctcagttaaaagaaatgtgccgtcgggaactcgacaaggcagaatctgagattaaaaaaaacagttctatcattggtgactataagcagatttgttctcagttgagtgaaagattggagaagcagcagacagccaataaggtggaaattgagaaaattcggcaaaaagtggatgactgtgagcggtgccgggaatttttcaacaaagaagggcgtgtaaaaggcataagctcaaccaaggaggttttagatgaggacacggatgaagagaaagagacgctcaagaaccagctgagagaaatggagctagaactggcacagaccaaactccagctggtggaggccgagtgtaagatacaggacttggaacaccatttagggcttgccctcaatgaggtgcaggcagccaagaagacgtggtttaaccgaacactgagctccataaagacagcaaccggggttcaagggaaagagacttgctgagagcagctgccgcctcccgacaccttcagaaaacacgacaccttttgttgccttctttggccagatgtgtgattctgtgacttgtcccaggaccagaatgtacctaagtcagatccatagacgcatgttggtaggtcactggaccagagcttgtgaagcaggcaacctctggggtaagactactgatactaacaggcctgctagctcagccgacgctctggacactctagaaatcactcctcagtgtgacctcccaggcctcttccccgtgtacgtcaacacctcacccagcctaaaggctgagtttacatgatcagagttaggggatccttcagtctgttgattttttttct

SEQ ID NO: 1852 - DNA, 4997 bp, Homo sapiens
ggggacagggcggtttgggaggcccaggcggcggagcctccgggacggcgagcggcgggcggcggaggaggagacggcaggtcgggcattaaaaaatatttaatcattcatgtgttgagactcattcttgagttatggatgacaaggcttctgttggaaaaatcagtgtctcttcagactcagtatctactcttaatagtgaagattttgtcttggtttccaggcaaggagatgagacaccatctacaaataatggaagtgatgatgagaaaacaggactcaagattgtagggaatggaagtgaacagcagctgcaaaaagagctagcagatgtactgatggatcctccaatggacgaccagccaggggaaaaggagcttgtgaaaaggtcacaactggatggtgaaggagatgggcctctttctaatcagctctccgcttcatccaccattaaccctgtgccattagtagggctccaaaaaccagagatgagcctaccagtgaaacctggacaaggagattctgaagcttcaagtcctttcacaccagtggccgatgaggacagcgtagttttcagtaaactgacttacttaggctgtgcctcggtaaatgctcccaggagtgaagtggaagccttaaggatgatgtccatcttaagaagccagtgtcagatttcactagatgttaccctttcagtgccgaatgtgtctgaaggaattgtgagactcttagatcctcagacaaacactgaaatagcaaactaccctatctacaaaatcctcttctgtgtcagagggcatgatggaactcctgagagtgactgttttgctttcactgaaagtcattacaatgcagagctcttcagaatacacgtcttccggtgtgaaatacaagaagctgtaagccggatactttacagttttgccactgccttccgccgttctgccaagcagaccccactttcagccactgctgcaccccagactcctgacagtgacatctttaccttctctgtgtctttagaaataaaagaagatgatggtaaaggttattttagtgcagttcccaaagataaggacagacagtgctttaaactacgccaaggaattgataagaagattgtcatctatgtgcagcaaacaactaataaagaacttgccattgaaaggtgttttggtcttctccttagtccaggaaaagatgtacgaaatagtgacatgcacttattagatttggaatctatgggcaaaagttcagatggaaagtcgtatgttattacggggagctggaatccaaaatccccacattttcaagttgtaaatgaagaaactcctaaagataaagtcctgtttatgaccacagctgtagatttggtaataacagaagtacaggagcctgttcgatttctcctggagacaaaagtccgcgtttgctcacctaatgaaagattattctggcccttcagcaaacgtagtactactgaaaatttctttttgaaactaaaacagataaagcaaagggagagaaagaataatactgacactttatatgaagttgtatgcttggaaagtgaatcagaaagagagaggaggaaaactacagccagtccttcagttcgcctgccacagtctggatcgcaaagttcagtgataccttctcctccagaagatgatgaagaggaagataatgatgaacctctcctgagtggatctggtgatgtatccaaagaatgtgcagaaaaaattcttgaaacatggggagaactgttgtcaaaatggcatctcaacttgaatgtgagaccgaagcagttgtcatccttagtaagaaacggtgtccctgaagctcttcgaggagaagtctggcagctgctagcaggctgtcataacaatgaccacctggtagagaaataccgcattcttatcacaaaggagtctccccaggacagtgctatcacccgggatattaaccgaacattcccagcccatgactactttaaggacacaggaggagatggacaagattccttatataaaatatgcaaggcttattctgtgtatgatgaagagattggttattgccagggccagtcatttcttgctgctgtgctccttctccatatgcctgaagaacaggcattcagtgttctggtcaagatcatgtttgactatgggctcagggaacttttcaagcaaaacttcgaagatttgcattgcaaattttaccagttggagcgcctcatgcaggaatacattcctgacctgtacaaccacttcctggatataagccttgaagcacacatgtatgcctcccagtggtttcttactcttttcactgcaaaattccctctctacatggtcttccatatcatcgacctgcttttatgtgagggaataagtgttatttttaatgtcgcccttggattattaaagacttcgaaagatgacctgctgttgacagactttgaaggtgccttgaagttctttagggttcagcttcctaagagataccgctcagaagaaaatgcaaaaaaactaatggaattagcctgcaacatgaagattagtcagaagaagttgaaaaaatacgagaaagaatatcacaccatgagggaacagcaggcccagcaagaagaccccatcgagcgatttgagcgggagaataggcgtctacaagaagctaacatgaggttggaacaggaaaacgatgacttagcccatgagctggtgaccagcaagattgcactacggaaggacctggataacgctgaggaaaaggcagatgctctgaataaggagctgctgatgaccaaacagaagttgattgatgcagaagaagagaaaagacggctggaagaagagtctgctcagttaaaagaaatgtgccgtcgggaactcgacaaggcagaatctgagattaaaaaaaacagttctatcattggtgactataagcagatttgttctcagttgagtgaaagattggagaagcagcagacagccaataaggtggaaattgagaaaattcggcaaaaagtggatgactgtgagcggtgccgggaatttttcaacaaagaagggcgtgtaaaaggcataagctcaaccaaggaggttttagatgaggacacggatgaagagaaagagacgctcaagaaccagctgagagaaatggagctagaactggcacagaccaaactccagctggtggaggccgagtgtaagatacaggacttggaacaccatttagggcttgccctcaatgaggtgcaggcagccaagaagacgtggtttaaccgaacactgagctccataaagacagcaaccggggttcaagggaaagagacttgctgagagcagctgccgcctcccgacaccttcagaaaacacgacaccttttgttgccttctttggccagatgtgtgattctgtgacttgtcccaggaccagaatgtacctaagtcagatccatagacgcatgttggtaggtcactggaccagagcttgtgaagcaggcaacctctggggtaagactactgatactaacaggcctgctagctcagccgacgctctggacactctagaaatcactcctcagtgtgacctcccaggcctcttccccgtgtacgtcaacacctcacccagcctaaaggctgagtttacatgatcagagttaggggatccttcagtctgttgattttttttctaaaccttttttttttaatatacatatatatatatatatatatatatatatatatatatatatatatatatagtgggggtggggcaagggatcagaaattcaaataattcttttctgcttcaatgccagcagaaggtcccccaggtagacatggagaagcactttgttttaaataggagggtttcatagttgcatctgaagccacctggttctgttaaactgtatggtgcaggttttgggtttggcattattcatgtttctgatcaattctatgcaactctcatagttcctgttactttttagcattagctgccaaatgacttcaaaaggctggggtgggtgacttgactgtgagactggattataacatggacaaatcttattttgcttaatgtgtttgtgtgtgtgtgtgtgtgtgtgtgtgtgtgtgtatgtatatatatatataaatatctttcccaatatgccccgttgacagtgtttaaattccagactaggactgctgatctgcacaatttaattatgtggttattcgagcacttaatttcactcaaggttcattgggctctgctctcctccctgccattacgggagctgtggacagagctccctcacttcaagattcctagtgtttttgcacaacaggttgtccaagtgagaaagactgagttgcgtgtctgtaaatgtctgcgcagggtgcacatgctgcgaggtctccatcctccgggcctgtccctcccagatgggctgggcctttgggccctcctcagagtatgcctgggtacaaacctcactgttcagatgggctgtaagttctcacttcaaagctatggaatggattttagcacctttaaaaaaaaaaaaaactttgacttttaatttatatagtgatatgctgacaggctgacacgcagatggttttgtcctcttttctgcgttcagtgttgaggcggctgcttacaagaggcactggttttgtatataaagacactcgggttgttttgtagctctttttcttattggctgtactaacgcttgctgaggttatctgtaataagggaggtaacaagtggcaaccccctccccaccaaccatcccctttgctgctttctgtgtctttcttgttcagttaccaaaatagctgtaagcctatctaatgctaggtgtgtggacattgtgctaaggtagtttcagtgtgtcaactttatgaattgaaatataaaccagtaaaattgtattactgtttcttttgttggttttattttaacagcatattgattaaatattttggtacaaacaaa

SEQ ID NO: 1853 - DNA, 2980 bp, Homo sapiens
taaaggtgtagctagcttgaaccagagtgcactgagccgtccaatgcaaaggaaactggtgacacttgtaaactgtcaactggtggaggaagaaggtcgtgtaagagccatgcgagcagctcgttcccttggagaaagaactgtaacagaactgatattacagcaccagaaccctcagcagttgtctgccaatctatgggccgctgtcagggctcgaggatgccagtttttagggccagctatgcaagaagaggccttgaagctggtgttactggcattagaagatggttctgccctctcaaggaaagttctggtactttttgttgtgcagagactagaaccaagatttcctcaggcatcaaaaacaagtattggtcatgttgtgcaactactgtatcgagcttcttgttttaaggttaccaaaagagatgaagactcttccctaatgcagctgaaggaggaatttcggagttatgaagcattacgcagagaacatgatgcccaaattgttcatattgccatggaagcaggactccgtatttcacctgaacagtggtcctctcttttgtatggtgatttggctcataaatcacacatgcagtctatcattgataagctacagtctccagagtcatttgcaaagagtgtccaggaattgacaattgttttgcaacgaacaggtgacccagctaacttaaatagactgaggcctcatttagagcttcttgcaaacatagaccctaatccagacgctgtttcaccaacttgggagcagctggaaaatgcaatggtagctgttaaaacagtagttcatggccttgtggacttcatacaaaattatagtagaaaaggccatgagacccctcagcctcagccaaacagcaaatacaagactagcatgtgccgagatttgcgacagcaagggggttgtccacgaggaacaaattgtacatttgcccattctcaggaagagcttgaaaagtatcgattaaggaacaaaaagatcaatgccactgtaagaacgtttcctcttctaaataaagttggtgtaaacaacactgtcacaaccacagccggaaatgtcatttctgtcataggaagtactgaaacaacagggaaaattgttccaagtacaaacggaatttcaaatgcagaaaacagtgtttcccagctaatctcacgtagtactgacagtaccttaagagctctggagaccgtgaagaaagtgggaaaggttggcgctaatggtcagaatgctgctgggccctctgcagattctgtaactgaaaataaaattggttctccacccaagactcctgtaagtaatgtagcagctacctcagctgggccctctaatgttggaacagagctgaattctgtgcctcaaaaatccagcccatttctaactagagtaccagtatatcctccgcattctgaaaacattcagtattttcaagatccaaggactcagataccctttgaagtcccacagtacccacagacaggatactatccaccacctccaacggtaccagctggtgtggctccctgtgttcctcgctttgtgaggtccaataacgttccagagtcctccctcccacctgcttccatgccatatgccgatcattacagtacattttcccctcgagatcgaatgaattcttctccttaccagcctcctcctccgcagccgtatggaccagttcctccagtaccttctggaatgtatgctcctgtgtacgacagcaggcgcatctggcgcccacctatgtaccaacgagatgacattattagaagcaattctttacctccaatggatgtgatgcactcatctgtctatcagacatctttgcgggaaagatataactcattagatggatattattcggtggcttgtcagccaccaagtgagccaaggacaactgtgcctttaccaagggaaccttgtggtcatttgaagaccagttgcgaggagcagataagaagaaagccagatcagtgggcacagtaccacactcagaaagcacctcttgtctcttcaactcttcctgtggcaacacagtcaccaacaccaccttctcctctgttcagtgtagactttcgtgcggatttctcagagagtgtgagtggtacaaaatttgaagaagatcatctttcccattattctccctggtcttgtggcaccataggctcctgtataaatgccattgattcagagcccaaagatgtcattgctaattcaaatgctgtgttaatggacctggacagtggtgatgttaagagaagagtacatttatttgaaacccagagaaggacaaaagaagaagatccaataattccctttagtgatggacccatcatctcaaaatggggtgcgatttccagatcttcccgtacaggttaccataccacagatcctgtccaggccactgcttcccaaggaagtgcgactaagcccatcagtgtatcagattatgtcccttatgtcaatgctgttgattcaaggtggagttcatatggcaacgaggccacatcatcagcacactatgttgaaagggacagattcattgttactgatttatctggtcatagaaagcattccagtactggggaccttttgagccttgaacttcagcaggccaagagcaactcattacttcttcagagagaggccaatgctttggccatgcaacagaagtggaattccctggatgaaggccgtcaccttaccttaaaccttttaagcaaggaaattgaactaagaaatggagaggtaaagaaactgaacctttcggcttcatgcttaatgtatttgttttctgctgctgcatcttggttataccattactgagtgcattttggtgtgcctatctctgatggatgattgattgcttttaaaacttataacagaaataaaattgtaatcccagatttcttaaataattctttaactagatcatcgggatttttgtttttttga

SEQ ID NO: 1854 - DNA, 1678 bp, Homo sapiens
gtcgcggccttcgccgccgccaacggggctgtccctgtagctcccgatggagtttgaggtcgtgaaacctccgccgagctctgccccggcgagacgaggcgcctccgtcgccaagccgcgccgtcgcggggctcccgggagcggcccttagcgaccccgcccgggccccctcagcttacaaaacactacacagcaaaataatgatctgctagactgctaacccgagcatccagcttccacaatgcctgtgcaggcagctcaatggacagaatttctgtcctgtccaatctgctataatgaatttgatgagaatgtgcacaaacccatcagtttaggttgttcacacactgtttgcaagacctgcttgaataaacttcatcgaaaagcttgtccttttgaccagactgccatcaacacagatattgatgtacttcctgtcaacttcgcacttctccagttagttggagcccaggtaccagatcatcagtcaattaagttaagtaatctaggtgagaataaacactatgaggttgcaaagaaatgcgttgaggatttggcactctacttaaaaccactaagtggaggtaaaggtgtagctagcttgaaccagagtgcactgagccgtccaatgcaaaggaaactggtgacacttgtaaactgtcaactggtggaggaagaaggtcgtgtaagagccatgcgagcagctcgttcccttggagaaagaactgtaacagaactgatattacagcaccagaaccctcagcagttgtctgccaatctatgggccgctgtcagggctcgaggatgccagtttttagggccagctatgcaagaagaggccttgaagctggtgttactggcattagaagatggttctgccctctcaaggaaagttctggtactttttgttgtgcagagactagaaccaagatttcctcaggcatcaaaaacaagtattggtcatgttgtgcaactactgtatcgagcttcttgttttaaggttaccaaaagagatgaagactcttccctaatgcagctgaaggaggaatttcggagttatgaagcattacgcagagaacatgatgcccaaattgttcatattgccatggaagcaggactccgtatttcacctgaacagtggtcctctcttttgtatggtgatttggctcataaatcacacatgcagtctatcattgataagctacagtctccagagtcatttgcaaagagtgtccaggaattgacaattgttttgcaacgaacaggtgacccagctaacttaaatagactgaggcctcatttagagcttcttgcaaacatagaccctaatccagacgctgtttcaccaacttgggagcagctggaaaatgcaatggtagctgttaaaacagtagttcatggccttgtggacttcatacaaaattatagtagaaaaggccatgagacccctcagcctcagccaaacagcaaatacaagactagcatgtgccgagatttgcgacagcaagggggttgtccacgaggaacaaattgtacatttgcccattctcaggaagagcttgaaaagtatcgattaaggaacaaaaagatcaatgccactgaagtactgaaacaacagggaaaattgttccaagtacaaacggaatttcaaatgcagaaaacagtgtttcccagctaa

SEQ ID NO: 1855 - DNA, 9248 bp, Homo sapiens
agccaagtcttgtcagagatttcctctttcaggtggcaaagctgttttcttcacacttgagtctctacaatattgtttggatcagtagtttccaaagttcattaactcctggccatactttattatgttttggggtactggttatccaagggaaacacttttttaaacaacaaaacaaaaaaaccgcccagcagtccaaagtaatttgtgttcctaaaaatggaatatggaaagttaatttgcttgtttgatgtggtcgttgagaaaaatacataaaagctttgatgtttattatgtgagcaaccaatataaatacagtttagttgaaaggaacactattaaggtattgtttccaggcagaatttcagaaatgtaattaattcagcaaataggttttttaaaaaagacatccaaaggttataaaattatttagaagtattttaggtctgaagctgtaatagttgacttaagcaattaactcttcaaaggtgaatgatgaatatgtggttaattcatacttttgtccatttctagcttacaaaacactacacagcaaaataatgatctgctagactgctaacccgagcatccagcttccacaatgcctgtgcaggcagctcaatggacagaatttctgtcctgtccaatctgctataatgaatttgatgagaatgtgcacaaacccatcagtttaggttgttcacacactgtttgcaagacctgcttgaataaacttcatcgaaaagcttgtccttttgaccagactgccatcaacacagatattgatgtacttcctgtcaacttcgcacttctccagttagttggagcccaggtaccagatcatcagtcaattaagttaagtaatctaggtgagaataaacactatgaggttgcaaagaaatgcgttgaggatttggcactctacttaaaaccactaagtggaggtaaaggtgtagctagcttgaaccagagtgcactgagccgtccaatgcaaaggaaactggtgacacttgtaaactgtcaactggtggaggaagaaggtcgtgtaagagccatgcgagcagctcgttcccttggagaaagaactgtaacagaactgatattacagcaccagaaccctcagcagttgtctgccaatctatgggccgctgtcagggctcgaggatgccagtttttagggccagctatgcaagaagaggccttgaagctggtgttactggcattagaagatggttctgccctctcaaggaaagttctggtactttttgttgtgcagagactagaaccaagatttcctcaggcatcaaaaacaagtattggtcatgttgtgcaactactgtatcgagcttcttgttttaaggttaccaaaagagatgaagactcttccctaatgcagctgaaggaggaatttcggagttatgaagcattacgcagagaacatgatgcccaaattgttcatattgccatggaagcaggactccgtatttcacctgaacagtggtcctctcttttgtatggtgatttggctcataaatcacacatgcagtctatcattgataagctacagtctccagagtcatttgcaaagagtgtccaggaattgacaattgttttgcaacgaacaggtgacccagctaacttaaatagactgaggcctcatttagagcttcttgcaaacatagaccctaatccagacgctgtttcaccaacttgggagcagctggaaaatgcaatggtagctgttaaaacagtagttcatggccttgtggacttcatacaaaattatagtagaaaaggccatgagacccctcagcctcagccaaacagcaaatacaagactagcatgtgccgagatttgcgacagcaagggggttgtccacgaggaacaaattgtacatttgcccattctcaggaagagcttgaaaagtatcgattaaggaacaaaaagatcaatgccactgtaagaacgtttcctcttctaaataaagttggtgtaaacaacactgtcacaaccacagccggaaatgtcatttctgtcataggaagtactgaaacaacagggaaaattgttccaagtacaaacggaatttcaaatgcagaaaacagtgtttcccagctaatctcacgtagtactgacagtaccttaagagctctggagaccgtgaagaaagtgggaaaggttggcgctaatggtcagaatgctgctgggccctctgcagattctgtaactgaaaataaaattggttctccacccaagactcctgtaagtaatgtagcagctacctcagctgggccctctaatgttggaacagagctgaattctgtgcctcaaaaatccagcccatttctaactagagtaccagtatatcctccgcattctgaaaacattcagtattttcaagatccaaggactcagataccctttgaagtcccacagtacccacagacaggatactatccaccacctccaacggtaccagctggtgtggctccctgtgttcctcgctttgtgaggtccaataacgttccagagtcctccctcccacctgcttccatgccatatgccgatcattacagtacattttcccctcgagatcgaatgaattcttctccttaccagcctcctcctccgcagccgtatggaccagttcctccagtaccttctggaatgtatgctcctgtgtacgacagcaggcgcatctggcgcccacctatgtaccaacgagatgacattattagaagcaattctttacctccaatggatgtgatgcactcatctgtctatcagacatctttgcgggaaagatataactcattagatggatattattcggtggcttgtcagccaccaagtgagccaaggacaactgtgcctttaccaagggaaccttgtggtcatttgaagaccagttgcgaggagcagataagaagaaagccagatcagtgggcacagtaccacactcagaaagcacctcttgtctcttcaactcttcctgtggcaacacagtcaccaacaccaccttctcctctgttcagtgtagactttcgtgcggatttctcagagagtgtgagtggtacaaaatttgaagaagatcatctttcccattattctccctggtcttgtggcaccataggctcctgtataaatgccattgattcagagcccaaagatgtcattgctaattcaaatgctgtgttaatggacctggacagtggtgatgttaagagaagagtacatttatttgaaacccagagaaggacaaaagaagaagatccaataattccctttagtgatggacccatcatctcaaaatggggtgcgatttccagatcttcccgtacaggttaccataccacagatcctgtccaggccactgcttcccaaggaagtgcgactaagcccatcagtgtatcagattatgtcccttatgtcaatgctgttgattcaaggtggagttcatatggcaacgaggccacatcatcagcacactatgttgaaagggacagattcattgttactgatttatctggtcatagaaagcattccagtactggggaccttttgagccttgaacttcagcaggccaagagcaactcattacttcttcagagagaggccaatgctttggccatgcaacagaagtggaattccctggatgaaggccgtcaccttaccttaaaccttttaagcaaggaaattgaactaagaaatggagagttacagagtgattatacagaagatgcaacagatactaaacctgatagggatatcgagttagagctttcagcacttgatactgatgaacctgatggacaaagtgaaccaattgaagagatcttggacatacagcttggtatcagttctcaaaatgatcagttgctaaatggaatggcagtggaaaatgggcatccagtacagcagcaccaaaaggagccaccaaagcagaagaaacagagtttaggtgaagaccatgtgattctggaggagcaaaaaacaattctgccggtaacttcttgctttagccagccactcccagtgtctattagcaatgcaagttgcctccccatcaccacatctgtcagtgctggcaacctcattctgaaaactcatgttatgtctgaagataaaaacgactttttaaaacctgttgcaaatgggaagatggttaacagctgaaaggaggttcatctttcaaatttgtgaccacaccatggaagcatttacactagctttttatatatataatatatattatataatgtatattttttttaaaaaaaagatattactgggggcatccatttcctgtggactctttgatacttcaagccctcttgcattagcattatgaaaaaaaaaaagaaaatttactttactagggtaacatgttcactttccagaaatgattggaatttggacaacatttaacttaagcttcaagcagctttttatgagtttgtagcaatccggtgcagtaactgagccatttcctattttaaatggcttctatagaaaattaacaactcagttattaaactagcaggatcctacaatgatacatctagtgaaagtagacttagttaacttatttatttctattttatgtttcactgagagaagtttccatctcattccagctgctttatttatctttttcatggaactttgcatggatttctttttctttttttaattttgaagagtggagttagatgttcttaccatagaattttacagggttatatactagcattctttactgcattatatgtaggagtgtggtgcagtgcttttatctgtagcatataatttttttttaattttccatttttcaagagtagtttctgctttgttaatatttatacacaggctacttgttgaagtaattaattaaaaatataaccaagtgcctaagtctttcagctgatgtactagatattaaattctcctaagttatgcagaatcgtttttacaattttgataaattatgcactaatgtaatggcagttttttaaaatgcagatttaagcctgtacattattgaatctgatgacttggcaaaagaatcaggtgctttcagctttcttgagaaaaccctgtatgtagcgtttgcactgactaacaagatggtattgctgggtttttaatttaaactaattaatttggttgttcattgcattatcttggttaaatattgtttattgttacttcatgttggggtttagtttttcttgttttttgactgttaggttgataagactatgaactgtgtaatagtagaacagtggctaacatttattcatacttaagaacatgaataatttctgccttgctaaaatgtgactgaaatggttttgacttggcatctgaaagtatacaatgtgttcaacaagtcatgcatcagatttgtgggaggtattgtactgaaacctaaatttcagtcaacatttgaaaagaagagctgggcattccttcctggtgatctttacctatagtttatctatctgtttttcttctgtttctttaagattagtttgacttttattattatttttttaattaacttctgtgaagttgtttactctgaaaattgtactggaatattttaagccaagctgatctttcaccaggtgtactgtatgtaagggcttttcctgctagcaagatgcttaaacaggatcatgttattggtcgtctgagctatttagttgttttacaaaaccacagcattgtatcagataagattttgataaaaagttttgtgcacatttccaggggcgggagggttgacatttccctgaaatttcttgattagaatgagtaaatactggtgtttgatacctgtcttaatgaacatgctcataaggtgactgataagttgtaaatatacctgagaaacaaaggggtagttttgatattctggtgtcagtatggaagatcttacacatttatttaatactcaaatgtatgaagatgtttgtttgtagcataacaacagcacagtagccttgacttagtttcctttggttagtactgtaccttttttgccatggccagtgctccccatccctatgaagacattttatttatttcactctgtaacctgaaatgaataggaacaagggttttaaaccatgttacattaacttttctgacattataaattagcctagaatattacaggaacatgattgttatataatttatatcagaacctttctataaatatgtgcttattacatttgaaatgcttccaatgtactttatttgctgtttgtaattccaaaaaggatatgcaaaccagtctgtctatttcatggatatttaatagtgagatcttccatgttgaaggtaatgtatttttttttaagattttaaaattgctattttgttacaaaatagagacctattaacagtttgagagctccttatgtgccctcagggaaagaaccctctgtgcaacagaactacacaaaacatcttcagcacgttctgagggtgaatatatactacataaattgatcttgtgtatttaaccttatctttttaattttaaaattgaaattttgaaacttggttgtgctctgctggagggggttgggataaactgcttagatgtttgcctacttgtccagtgaaattacatttgcatcagtatatgtatatacctgccaaccttattggtatgtctcagaacatttatattaaaataatgcttgtcttgcagcaggtgatcccataaaacaataactccctgttcttaaaaacttactctctttttcactaacaacataggaattgtttctgtgttgagattattctgtgttgcatccattctctatgtagtggtcaccttctgtctgtcatggtgggcttaatgtgaagtaaagccattggttctctgccactttcgaagaaagggcagttcatctgatccttcttcagaatggtacctactgatatcatcgaggaaaatgttacaaatcagacctaggatatgactttttaaaattgaggcatttcccgtcatttggcctttttaccaacaagatgtgatgtacaaatttggaatcaaaggatacaaagcaacaagagaggaaatgtgtaatgtgggtaaccaaactgcatatgttacctattgtctaatcagaaaaaatagtctgaggtctggaaagcaggaaagtggtggttattttctttcattttttgtgtttttgttttttaatttctaagttccattctgaaatccatgtgccgcattcagttactgtggttgtagcatcagtttttttgtggtttcatttcattttatgaattcagaggaagttacatatatattttttctagttggtacctgaacaaagcagattcccttgcctttgctgccacgtcttattttcaatgccatgtgataaaccagtgtcatacatgaaagttgtgcattgtaattttcaaaaaaaagggagttcattaggccagtggcactgatttttccttcccatcatagctatttattctagtaagaggataataaaagaaatttcctatacaagaactgaaattttccatttgtatggatctagtcactttcagatttcaatttgaggttaagtatataaagcacatcccaattttatatgctgccttgagaaaattacaggatgcacggcaatttgtaggaatttcaaatgggatcatttaaacatttgaaaaattattttaaaaaccatctagtttgcttttggattttagacattaaagcctatgttgtcttgttaacaggggtggaatgtataaccatcagattcagcatgtgatttcacctttgaatctgagtatttcttccctatcttctttgagtcatttttggagcagactgtcaccagtattgataactaagcattaaagggaaaagttgcattgcaactatgcattggtttcctggaagaacttttcttttgttttagtgaatgaagaggcttgatgggatcacttactgtaactccttctacataaggaccccttctgcaagcagaacacaaaagaacatgctcaaggagtatcccattttctggataaattgaagaagtttgctagtaatgtctttatactagcgtcttccttgtatccctttgctggcaagggaatacaaggcgtcaagaccacagatcaaaacaccccacatttgagtggagtcttatttttactccaagagcagttattcccttctagtctaaaattggcagttttttcttttttttaataaaatttttaaaatattcccaaaccagtggaacacagacactggctgcacttagtactgccaaaagccaaggtcatttgcacatattccatcaacctgtcgagaattaggcctcactttataacccaaggcatggaagtgcatgcattctcttagctgggcaaacaattatactgtagttgtgatacaacacatgtggcttttatttgtactgcacatatccactgtacagccacttgggagtatcgtggttagcttgcagcaactgctgtctgcatttatactgtttattgcatattcttttccctggaagtgaaagagaaatgtttttcttgttgcattgattacattttataaatttgcttagctggaaagtttgggaaaagaggcctgtttgtcaattgtacaaccgattgtgaagctctagtgtgaatatttttacgtctgtattagacattttctttgcaaatctattgttcgattgaaatgtaaatgaaattaaagatggtgtacacccatcatgtaaaaagcaggcaccatctctaagatggatttaatgctcatttttaaggcatatactcagcttctatttaaaactataatttaaaataattctgtacaatgaaatggggaatatatatgggaataaattctattccatttatttcaatttgaatttccaaattgtaatgtttccctttgtgctataggaataggattaaatgggggaagactaggatttataaggcctgtatatggggggagggcagagatggaacaatgagggttgtgatgatagtgaatagcaaagagtgaattctgtgtgtttttgctgtagcactgaagtgaagagatattagctttggctgttcacaaaatagagcatcatgattttcagtgtttgagagaaaattgatggaaaaagtttgcagtacttgacatgtatttgcatgcacaaaataaaattatttgtccaccttaaaa

SEQ ID NO: 1856 - DNA, 1669 bp, Homo sapiens
gcgctgcccggctcccggccctgccggcctcctcccttggcgccgcggccatggcggccagcgcgaagcggaagcaggaggagaagcacctgaagatgctgcgggacatgaccggcctcccgcacaaccgaaagtgcttcgactgcgaccagcgcggccccacctacgttaacatgacggtcggctccttcgtgtgtacctcctgctccggcagcctgcgaggattaaatccaccacacagggtgaaatctatctccatgacaacattcacacaacaggaaattgaattcttacaaaaacatggaaatgaagtctgtaaacagatttggctaggattatttgatgatagatcttcagcaattccagacttcagggatccacaaaaagtgaaagagtttctacaagaaaagtatgaaaagaaaagatggtatgtcccgccagaacaagccaaagtcgtggcatcagttcatgcatctatttcagggtcctctgccagtagcacaagcagcacacctgaggtcaaaccactgaaatctcttttaggggattctgcaccaacactgcacttaaataagggcacacctagtcagtccccagttgtaggtcgttctcaagggcagcagcaggagaagaagcaatttgaccttttaagtgatctcggctcagacatctttgctgctccagctcctcagtcaacagctacagccaattttgctaactttgcacatttcaacagtcatgcaggtggaagtgctgcatcagtaaatgctaattttgctcattttgataacttccccaaatcctccagtgctgattttggaaccttcaatacttcccagagtcatcaaacagcatcagctgttagtaaagtttcaacgaacaaagctggtttacagactgcagacaaatatgcagcacttgctaatttagacaatatcttcagtgccgggcaaggtggtgatcagggaagtggctttgggaccacaggtaaagctcctgttggttctgtggtttcagttcccagtcagtcaagtgcatcttcagacaagtatgcagctctggcagaactagacagcgttttcagttctgcagccacctccagtaatgcgtatacttccacaagtaatgctagcagcaatgtttttggaacagtgccagtggttgcttctgcacagacacagcctgcttcatcaagtgtgcctgctccatttggagctacgccttccacaaatccatttgttgctgctgctggtccttctgtggcatcttctacaaacccatttcagaccaatgccagaggagcaacagcggcaacctttggcactgcatccatgagcatgcccacaggattcggcactcctgctccctacagtcttcccaccagctttagtggcagctttcagcagcctgcctttccagcccaagcagctttccctcaacagacagctttttctcaacagcccaatggtgcaggttttgcagcatttggacaaacaaagccagtagtaaccccttttggtcaagttgcagctgctggagtatctagtaatccttttatgactggtgcaccaacaggacaatttccaacaggaagctcatcaaccaatcctttcttatagccttatatagacaatttactggaacgaacttttatgtggtcacattacat

SEQ ID NO: 1857 - DNA, 2126 bp, Homo sapiens
aaatgctctggctccggtggtgacaggttgtccagcttcttacagccatcttcactgaaactaaggttaactcctcactctctatggacggctactctctatttccaagggcgtgaagaatttccctcttctcctgtgctttcatctaaaagttctccctggataattatcattgcagtggagtgcctggattggacatcctcatctgggtcaactaaaaaaagaaagcatgcaagacgacagcatagaagcttctacttccatatctcagcttctaagagagagctatttagctgaaaccagacatcggggaaacaatgagaggagtcgagcggagccctcctccaacccttgccatttcggcagtccttctggggccgctgaaggaggcggaggccaagatgaccttccagatctttcagcctttctgagccaagaagaattagacgaaagtgtcaatttggcaagactggccatcaattacgaccctttggagaaggcagatgaaactcaagctagaaaacgactttctcctgatcagatgaaacactcacctaatttaagttttgagcctaacttctgccaggataaccctcgaagtcccaccagctctaaagaaagcccccaggaggcaaaaaggccacagtattgttctgaaacccagtccaaaaaagtatttttaaataaggctgccgacttcattgaagagctatcctcccttttcaaatcccacagctccaaaaggattagacctcgtgcctgcaaaaaccacaagagtaaactggaatctcaaaacaaagttatgcaggaaaacagctccagtttctcagatctgtcagaaagacgagaaagatcttctgttcccatccctatccctgcggataccagggataatgaagtgaatcacgccctggaacagcaggaagccaagaggcgtgaagcggagcaggctgccagtgaggcggctggtggagacactacaccagggtcttccccttcatctctgtactatgaagaacctctggggcaacctccccggttcactcaaaagttacggagcagagaagttccagaaggaactcgagtacagttggattgcatagtggtaggaattccaccacctcaagtaaggtggtactgtgaaggcaaggagcttgaaaattccccagatattcacatcgtccaggcaggaaatctgcactcactgaccattgcggaagcctttgaagaggacacaggacgctattcctgctttgcttctaacatctatgggacagattcgacttctgctgagatttatatagaaggggtttcttcttctgactcagaaggcgaccctaacaaggaagagatgaatcgaatccagaagccaaatgaggtgtcatctcctcccactacctctgcagtcattcctccagcagtaccccaagcccagcatttggtggcccaacctcgtgtggcaaccatccagcagtgtcagagccccaccaattacttgcagggattggatggaaaacctatcattgcagctcctgtgtttacaaagatgctacaaaatttgtcagcttctgagggtcagctggttgtctttgaatgcagagtaaaaggagctccatctcctaaggttgagtggtatagagaagggactttaatagaagattctccagattttaggattttacagaaaaaacctcgatccatggcagagccaggtaaagatgatttcaactttaatttattagtatatgagtgattttatatatacaagaatacataatgaagttacactgagatgaataaaaagtgaaaaataaagttttaggaaaaaaagatccaaatgggccgggtgcagtggctcatgtctgtaattccagcactttgcgaggccgaggcgggcggattacttgagatcagaagttcaagaccagcctggcctacatgacaaaatgaaaccccatctctactaaaaatataaaaattagccaggcatagtggcgcacgtctgtaatcccagctacctgggaggctgaggcaggagaatcacttgagcctgggaggtggaggttgcagtgagccgagatcgtgacactacagtccagctgcgcgacagaacaagaatctgtctc

SEQ ID NO: 1858 - DNA, 3905 bp, Homo sapiens
acttccggccagcccctcccccgcctccctcgcgtggccacctccccctctgccttctcctacccagtctcttccccaactctccccacccctggtgctctccgccccgcttgcctcccgttcttccccgcccgctccatccgggtcgctgacggctgtctctggactggacagcagtggcgtccgcttttctctaaggaacccgataagaactccattttctgttgatgtggagacatagggtacctccaactttccggggtttcagaagagaattttttattgaaactggaagaccaaaataattacaagcatgttgtgctggggaaatgcatcctttgggcagctaggtttgggtggaattgatgaagaaattgtactagagcccagaaaaagtgacttctttataaataaaagggtccgagatgtaggatgtggactcagacatactgtgtttgttctggatgatggaacagtgtacacatgtggatgtaatgatctaggacagctaggtcatgaaaaatccagaaagaaaccagagcaggttgttgccctggatgcccaaaatattgtagctgtttcatgtggagaagctcatacgttagcgctaaatgacaaaggccaggtgtatgcttggggtctcgattctgatggacagcttggcctggtaggatcagaggaatgcatcagagtacccagaaatattaaaagtttgtcagatatccagattgtacaggttgcttgtggttactatcattcacttgcactttctaaagcaagtgaagtcttctgttggggacagaataaatatggccaattgggtttaggtactgactgtaaaaagcaaacttcaccgcagctgcttaagtctttgcttggaatccctttcatgcaagttgcagcaggaggagcccatagttttgtactcaccctttctggagctatctttggatggggacgcaacaagtttggtcagctaggtcttaatgatgaaaatgataggtatgttcctaatttactaaagtcactaagatctcagaaaatagtttatatttgttgtggagaagatcatactgctgctctaaccaaggaaggtggagtgtttacttttggagctggagggtatggtcagttgggccataattctaccagtcatgaaataaacccaaggaaagtttttgaacttatgggaagcattgtcactgagattgcttgtggacggcagcacacttctgcttttgttccttcatcaggacgaatttactcttttgggcttggtggtaatgggcagctgggaaccggttcaacaagcaacaggaaaagcccctttactgtaaaaggaaattggtacccctataatgggcagtgtctaccagatattgattctgaagaatatttctgtgtaaaaagaattttctcagggggagatcaaagcttttcacattactctagtccccagaactgtgggccaccagatgacttcagatgtcccaatccgacaaagcagatctggacagtgaatgaagctctaattcagaaatggctgagctatccttctggaaggtttcctgtggagatagccaatgagatagatggaacgttttcttcctctggttgcctaaatggaagttttttagctgttagcaatgatgatcactatagaacaggtaccagattttcaggggttgatatgaatgctgctaggcttttattccacaaacttatacaacctgatcatccgcagatatctcagcaggtggcagctagtttggaaaagaatcttattcctaaactgactagctccttacctgatgttgaagcattgaggttttatcttactctaccagaatgtcccctgatgagtgattccaacaatttcacaacaatagcaattccctttggtacagctcttgtgaacctagaaaaggcaccactgaaagtacttgaaaactggtggtcagtacttgaacctccactattcctcaagatagtagaactttttaaggaagttgtggtacatcttttgaaactctacaagatcggtattcccccttctgaaagaagaattttcaacagttttcttcatactgcattaaaggttttagaaatactacatagggtaaatgagaaaatgggacagattatacagtatgataaattttatatacatgaagtacaagaattgatagacataagaaatgattatatcaactgggtccaacagcaggcctatggaatgttggcagatatccctgttacaatctgtacatatccatttgtatttgatgcccaagcaaaaactactctgttacagaccgatgcagtcttacagatgcagatggctattgatcaggcccacaggcagaatgtctcctctctttttctcccagtgattgaatctgtgaatccctgcttaattctagtggtgcgtagagaaaatattgtaggagatgcaatggaagtccttaggaaaacaaagaacatagattacaagaagccactcaaggttatatttgttggagaagatgctgtggatgcaggaggggtgcgcaaagaatttttcttgctcatcatgagggaattattggatcctaaatacggcatgtttaggtattatgaagattccaggctcatttggttttctgataagacatttgaagacagtgatttgttccatttgattggtgttatctgtggcttagcaatttataattgtaccattgtggacctccattttcctttggctttatataagaaactactgaaaaagaagccatccttggatgatttgaaagaactaatgcctgatgttgggagaagcatgcaacagttactggattatccagaagatgacatagaggaaacattttgtcttaattttacgatcacagttgaaaactttggtgcaacagaagtgaaagagctggttctaaatggtgcagacacagctgttaacaaacaaaatcggcaagagtttgtcgatgcttatgtggattacatattcaataaatcagtggcttccttatttgatgcttttcatgcgggctttcataaggtctgtggaggaaaagtccttctgctctttcagcctaatgaactacaagcaatggtcattggaaatacaaattatgattggaaggaactggaaaagaatacagaatacaaaggggaatattgggcagaacatcctacgataaaaattttttgggaagtatttcacgaattaccattggaaaagaagaaacagtttctgttatttttgacaggtagtgatcgcattcctattcttggtatgaagagtctgaaactagtcatccagtccacaggaggtggtgaggagtatctcccagtttcccatacttgttttaatcttctggatcttccaaaatatacagaaaaagaaactctacgctctaaactgatccaagctattgatcacaatgaaggcttcagtttaatataactttggagttataactattcagtttagtgcaaaagcattaaactatttgtgtttttcttgtggtgatgaattcagcaaggtgacagaggtactattataattcttacttgcagaatgttcaatctacgagtgttcatggaagccaaaaaatattaaaggaaaatgaacaaactgttaatattattgtacagaaccatggattttttttgaccatcttctaataaacatagcaagtattatgaatacattaaagttttactaacatgaattttaagagtttgcatatttcagaaatgatctggtgtgagtgcatggaaatattgcttaatttttcttcaatcattgagtgaaaaacctttaactttggcctgcaatagtcatttgattattttttcattttgtaaataatgttaagttttgtaataaaatagttatgttctga

SEQ ID NO: 1859 - DNA, 1730 bp, Homo sapiens
acgcgctggctgactggggtcggcgtttagttcagcgcagcgactcggggacctggagctgacgcctagtacgtatgaggaagaacggggtgggtggctgcctgagtctggaggcgacgcctcggttgtgcagtctgaacctgcccttctcagctgagggtgctgacagcaaggggtgggaggcgggccccgagtccccagctgtggacacttgtattagctttaatagaagagaaatggaggagccatagaatattaaggatgaattcaggaaggcctgagaccatggaaaacttgcctgctctctacactattttccaaggagaggttgctatggtgacagactatggggcctttatcaaaatcccaggctgtcggaagcaaggtctggtccatcgaactcatatgtcatcctgtcgggtggataagccctctgagatagtagatgttggagataaagtgtgggtgaagcttattggccgagagatgaaaaatgatagaataaaagtatccctctccatgaaggttgtcaatcaagggactgggaaagaccttgatcccaacaatgttatcattgagcaagaagagaggcggaggcgatccttccaggattacactgggcagaagatcacccttgaggctgtcttgaacactacctgcaagaagtgtggctgtaaaggccactttgcaaaagattgtttcatgcaaccaggtgggactaaatactctctgatacctgatgaggaagaggaaaaggaagaggcaaagtcagcagagtttgagaagcctgaccctacaaggaatccttctagaaaaagaaagaaggagaagaagaaaaagaaacatagagataggaagtcatctgactctgacagctcagactctgagagtgatacaggcaagagggcaaggcacacatcaaaagacagcaaggcagcaaagaagaagaaaaagaagaagaagcacaagaagaagcacaaggagtgagagtataaagagtgtagggggtggttgagagtaagaaaccaggagccttgtgccttgagactcctggaaagactcaatagtgagaatatagcctcccaccccattaacttcgctcccatgggagatggcttcccctcatgcaacaggcaggtttgggagttagaggtcaaaagcagctgcctgaatgagttgttgtttccttatcactcctggtccctttgcaagtgaaccctgcagctcacccattcattcacccaacttccttcattcagcaggaggtcctattaccctctccagctgccactgccagagctggattcctgtaaaggagtccaggctagagccacagagactgttgtggaggtgagttcggctgtagttagagtgattggacccttcctattggtctgtcctgggccaactggtgggtgatctctgctgcatccaacatgggagcagagactggcagcaggaggggggaacatggtgagaagtggtgctcacttttcccattcctcctaacatagttctactatgctagaagtggcatccagcggccacagctagaaaacagtctgcagtgtgacttaacttgtgtattgcattccagcagaccactgaaccagacagcgaagccaagatcattgttctactttgtatttactactgtgtgaatcagttgattctacttcaggtccttgcttaaattcctgtcactaaatggaaatgtgtttggttttaaa

SEQ ID NO: 1860 - DNA, 1867 bp, Homo sapiens
atgatcatcaattggaatcaagtctcagtcctgtggaagtgtttgctaaaacaatctgccagttatcaagacaggaggcaatcctggcggcgagcaagtatgaaagaaacgaaccggcggaagtcgctgcatcccattcaccagggcatcacagagctcagccggtctatcagtgtcgatttagcagaaagcaaacggcttggctgtctcctgctttccagtttccagttctctattcagaaacttgaacctttcctaagggacactaagggcttcagtcttgaaagttttagagccaaagcatcttctctttctgaagaattgaaacattttgcagacggactggaaactgatggaactctacaaaaatgttttgaagattcaaatggaaaagcatcagatttttctttggaagcatctgtggctgagatgaaggaatacataacaaagttttctttagaacgtcagacttgggatcagctcttgcttcactaccagcaggaggctaaagagatattgtccagaggatcaactgaggccaaaattactgaggtcaaagtggaacctatgacatatcttgggtcttctcagaatgaagttcttaatacaaaacctgactaccagaaaatattacagaaccagagcaaagtctttgactgtatggagttggtgatggatgaactgcaaggatcagtgaaacagctgcaggcctttatggatgaaagtacccagtgcttccagaaggtgtcagtacagctcggaaagagaagcatgcaacaattagatccctcaccagctcgaaaactgttgaagcttcagctacagaacccacctgccatacatggatctggatctggatcttgtcagtgactttatgagagtttctgccacaaggtgcccaagaggagaggaatgggaagagtgccccagcacgtggtgactgcgtgatttctgctcgttgcctttgaagataactggcaggactgactgtagaacactttgacttttttcaaaaagtgatggaatttgtacatccaaatgaatattgtatagacaattttcccaggaatgtgcaaaatgcttgaaagttcaaacttcttttttgaaatgatcttcagatccagtggcccattcttttatctttatcctgtgaaggtgtttttcaggttttgaaacaatccaaaaatcatttaggaccaagtctaaggaaacattttagtggccaagttggattccgattgtaaaggaatgatactaattttctagcatggctctgaaggtgattttaggtagaagagttttgaggctgggcgcaatggctcacgcctgtaatcctagcattttgggtgactgaggcgggtggattgcttgagcccagaagttgaagaccagcctgagaaataaggtgaaaccctgtctacaaaaaatacaaaaagttagctgggtgtggtggcgtgtgcctgtagtgctagctactcagaaggctgaggtgggaggattgtttgagcccaggaggttgaggctgcagtgagttctaattgcgccactgcactccagcctgagcgacagagtgagacactgtcttaaaaaaaattaaaaattgtaaaaaaatgaaaaaaaaagttttgagcattatttgcatcattgggatacatatgtcacttcacaagatgttcaatttgaaggaaataccactcattctctatgtcctgttgtctgtagtgtgcttcagtttttcatattgagttgacctaaatcctggattcatgacaagaaaggagtaagtactactattcattgttctatttgtttataatctgtattataaaattgcacataattaaaagctttcccttgtcttcatcta

SEQ ID NO: 1861 - DNA, 1915 bp, Homo sapiens
gcatgcgcccttggttggcgggagtttcggaggcggtgaccgtgacgtagaaggtggagaccgcttcaccctgatcagggagtatcggctgcgggtgcgcaaggcgtccaggagtgacctggggctgtggagagcgacccgtggccttgtgtttcagagtttaccacctaggatgacttcagtgactagatcagagatcatagatgagctcagccggtctatcagtgtcgatttagcagaaagcaaacggcttggctgtctcctgctttccagtttccagttctctattcagaaacttgaacctttcctaagggacactaagggcttcagtcttgaaagttttagagccaaagcatcttctctttctgaagaattgaaacattttgcagacggactggaaactgatggaactctacaaaaatgttttgaagattcaaatggaaaagcatcagatttttctttggaagcatctgtggctgagatgaaggaatacataacaaagttttctttagaacgtcagacttgggatcagctcttgcttcactaccagcaggaggctaaagagatattgtccagaggatcaactgaggccaaaattactgaggtcaaagtggaacctatgacatatcttgggtcttctcagaatgaagttcttaatacaaaacctgactaccagaaaatattacagaaccagagcaaagtctttgactgtatggagttggtgatggatgaactgcaaggatcagtgaaacagctgcaggcctttatggatgaaagtacccagtgcttccagaaggtgtcagtacagctcggaaagagaagcatgcaacaattagatccctcaccagctcgaaaactgttgaagcttcagctacagaacccacctgccatacatggatctggatctggatcttgtcagtgactttatgagagtttctgccacaaggtgcccaagaggagaggaatgggaagagtgccccagcacgtggtgactgcgtgatttctgctcgttgcctttgaagataactggcaggactgactgtagaacactttgacttttttcaaaaagtgatggaatttgtacatccaaatgaatattgtatagacaattttcccaggaatgtgcaaaatgcttgaaagttcaaacttcttttttgaaatgatcttcagatccagtggcccattcttttatctttatcctgtgaaggtgtttttcaggttttgaaacaatccaaaaatcatttaggaccaagtctaaggaaacattttagtggccaagttggattccgattgtaaaggaatgatactaattttctagcatggctctgaaggtgattttaggtagaagagttttgaggctgggcgcaatggctcacgcctgtaatcctagcattttgggtgactgaggcgggtggattgcttgagcccagaagttgaagaccagcctgagaaataaggtgaaaccctgtctacaaaaaatacaaaaagttagctgggtgtggtggcgtgtgcctgtagtgctagctactcagaaggctgaggtgggaggattgtttgagcccaggaggttgaggctgcagtgagttctaattgcgccactgcactccagcctgagcgacagagtgagacactgtcttaaaaaaaattaaaaattgtaaaaaaatgaaaaaaaaagttttgagcattatttgcatcattgggatacatatgtcacttcacaagatgttcaatttgaaggaaataccactcattctctatgtcctgttgtctgtagtgtgcttcagtttttcatattgagttgacctaaatcctggattcatgacaagaaaggagtaagtactactattcattgttctatttgtttataatctgtattataaaattgcacataattaaaagctttcccttgtcttca

SEQ ID NO: 1862 - DNA, 1922 bp, Homo sapiens
gcaaggcgtccaggagtgacctggggctgtggagagcgacccgtggccttgtgtttcagagtttaccacctaggatgacttcagtgactagatcagagatcatagatgaacaatctgccagttatcaagacaggaggcaatcctggcggcgagcaagtatgaaagaaacgaaccggcggaagtcgctgcatcccattcaccagggcatcacagagctcagccggtctatcagtgtcgatttagcagaaagcaaacggcttggctgtctcctgctttccagtttccagttctctattcagaaacttgaacctttcctaagggacactaagggcttcagtcttgaaagttttagagccaaagcatcttctctttctgaagaattgaaacattttgcagacggactggaaactgatggaactctacaaaaatgttttgaagattcaaatggaaaagcatcagatttttctttggaagcatctgtggctgagatgaaggaatacataacaaagttttctttagaacgtcagacttgggatcagctcttgcttcactaccagcaggaggctaaagagatattgtccagaggatcaactgaggccaaaattactgaggtcaaagtggaacctatgacatatcttgggtcttctcagaatgaagttcttaatacaaaacctgactaccagaaaatattacagaaccagagcaaagtctttgactgtatggagttggtgatggatgaactgcaaggatcagtgaaacagctgcaggcctttatggatgaaagtacccagtgcttccagaaggtgtcagtacagctcggaaagagaagcatgcaacaattagatccctcaccagctcgaaaactgttgaagcttcagctacagaacccacctgccatacatggatctggatctggatcttgtcagtgactttatgagagtttctgccacaaggtgcccaagaggagaggaatgggaagagtgccccagcacgtggtgactgcgtgatttctgctcgttgcctttgaagataactggcaggactgactgtagaacactttgacttttttcaaaaagtgatggaatttgtacatccaaatgaatattgtatagacaattttcccaggaatgtgcaaaatgcttgaaagttcaaacttcttttttgaaatgatcttcagatccagtggcccattcttttatctttatcctgtgaaggtgtttttcaggttttgaaacaatccaaaaatcatttaggaccaagtctaaggaaacattttagtggccaagttggattccgattgtaaaggaatgatactaattttctagcatggctctgaaggtgattttaggtagaagagttttgaggctgggcgcaatggctcacgcctgtaatcctagcattttgggtgactgaggcgggtggattgcttgagcccagaagttgaagaccagcctgagaaataaggtgaaaccctgtctacaaaaaatacaaaaagttagctgggtgtggtggcgtgtgcctgtagtgctagctactcagaaggctgaggtgggaggattgtttgagcccaggaggttgaggctgcagtgagttctaattgcgccactgcactccagcctgagcgacagagtgagacactgtcttaaaaaaaattaaaaattgtaaaaaaatgaaaaaaaaagttttgagcattatttgcatcattgggatacatatgtcacttcacaagatgttcaatttgaaggaaataccactcattctctatgtcctgttgtctgtagtgtgcttcagtttttcatattgagttgacctaaatcctggattcatgacaagaaaggagtaagtactactattcattgttctatttgtttataatctgtattataaaattgcacataattaaaagctttcccttgtcttca

SEQ ID NO: 1863 - DNA, 2354 bp, Homo sapiens
accctgatcagggagtatcggctgcgggtgcgcaaggcgtccaggagtgacctggggctgtggagagcgacccgtggccttgtgtttcaggtacggaggttccggactggacgggcgtcaggaagtcacagacttgtcctctgatgtggccccgcccgccgccgcactaatctcttcggcgtcgtacccgtcggcccagctcgacccgccgcagccccggccccgaccgtggacactgggggtccccgagggcgctgcgacctcctcccggagtttaccacctaggatgacttcagtgactagatcagagatcatagatgaaaaaggaccagtgatgtctaagactcatgatcatcaattggaatcaagtctcagtcctgtggaagtgtttgctaaaacatctgcctccctggagatgaatcaaggcgtttcagaggaaagaattcaccttggctctagccctaaaaaagggggaaattgtgatctcagccaccaggaaagacttcagtcgaagtcccttcatttgtctcctcaagaacaatctgccagttatcaagacaggaggcaatcctggcggcgagcaagtatgaaagaaacgaaccggcggaagtcgctgcatcccattcaccagggcatcacagagctcagccggtctatcagtgtcgatttagcagaaagcaaacggcttggctgtctcctgctttccagtttccagttctctattcagaaacttgaacctttcctaagggacactaagggcttcagtcttgaaagttttagagccaaagcatcttctctttctgaagaattgaaacattttgcagacggactggaaactgatggaactctacaaaaatgttttgaagattcaaatggaaaagcatcagatttttctttggaagcatctgtggctgagatgaaggaatacataacaaagttttctttagaacgtcagacttgggatcagctcttgcttcactaccagcaggaggctaaagagatattgtccagaggatcaactgaggccaaaattactgaggtcaaagtggaacctatgacatatcttgggtcttctcagaatgaagttcttaatacaaaacctgactaccagaaaatattacagaaccagagcaaagtctttgactgtatggagttggtgatggatgaactgcaaggatcagtgaaacagctgcaggcctttatggatgaaagtacccagtgcttccagaaggtgtcagtacagctcggaaagagaagcatgcaacaattagatccctcaccagctcgaaaactgttgaagcttcagctacagaacccacctgccatacatggatctggatctggatcttgtcagtgactttatgagagtttctgccacaaggtgcccaagaggagaggaatgggaagagtgccccagcacgtggtgactgcgtgatttctgctcgttgcctttgaagataactggcaggactgactgtagaacactttgacttttttcaaaaagtgatggaatttgtacatccaaatgaatattgtatagacaattttcccaggaatgtgcaaaatgcttgaaagttcaaacttcttttttgaaatgatcttcagatccagtggcccattcttttatctttatcctgtgaaggtgtttttcaggttttgaaacaatccaaaaatcatttaggaccaagtctaaggaaacattttagtggccaagttggattccgattgtaaaggaatgatactaattttctagcatggctctgaaggtgattttaggtagaagagttttgaggctgggcgcaatggctcacgcctgtaatcctagcattttgggtgactgaggcgggtggattgcttgagcccagaagttgaagaccagcctgagaaataaggtgaaaccctgtctacaaaaaatacaaaaagttagctgggtgtggtggcgtgtgcctgtagtgctagctactcagaaggctgaggtgggaggattgtttgagcccaggaggttgaggctgcagtgagttctaattgcgccactgcactccagcctgagcgacagagtgagacactgtcttaaaaaaaattaaaaattgtaaaaaaatgaaaaaaaaagttttgagcattatttgcatcattgggatacatatgtcacttcacaagatgttcaatttgaaggaaataccactcattctctatgtcctgttgtctgtagtgtgcttcagtttttcatattgagttgacctaaatcctggattcatgacaagaaaggagtaagtactactattcattgttctatttgtttataatctgtattataaaattgcacataattaaaagctttcccttgtcttcatcta

SEQ ID NO: 1864 - DNA, 2233 bp, Homo sapiens
tgcgcccttggttggcgggagtttcggaggcggtgaccgtgacgtagaaggtggagaccgcttcaccctgatcagggagtatcggctgcgggtgcgcaaggcgtccaggagtgacctggggctgtggagagcgacccgtggccttgtgtttcagagtttaccacctaggatgacttcagtgactagatcagagatcatagatgaaaaaggaccagtgatgtctaagactcatgatcatcaattggaatcaagtctcagtcctgtggaagtgtttgctaaaacatctgcctccctggagatgaatcaaggcgtttcagaggaaagaattcaccttggctctagccctaaaaaagggggaaattgtgatctcagccaccaggaaagacttcagtcgaagtcccttcatttgtctcctcaagaacaatctgccagttatcaagacaggaggcaatcctggcggcgagcaagtatgaaagaaacgaaccggcggaagtcgctgcatcccattcaccagggcatcacagagctcagccggtctatcagtgtcgatttagcagaaagcaaacggcttggctgtctcctgctttccagtttccagttctctattcagaaacttgaacctttcctaagggacactaagggcttcagtcttgaaagttttagagccaaagcatcttctctttctgaagaattgaaacattttgcagacggactggaaactgatggaactctacaaaaatgttttgaagattcaaatggaaaagcatcagatttttctttggaagcatctgtggctgagatgaaggaatacataacaaagttttctttagaacgtcagacttgggatcagctcttgcttcactaccagcaggaggctaaagagatattgtccagaggatcaactgaggccaaaattactgaggtcaaagtggaacctatgacatatcttgggtcttctcagaatgaagttcttaatacaaaacctgactaccagaaaatattacagaaccagagcaaagtctttgactgtatggagttggtgatggatgaactgcaaggatcagtgaaacagctgcaggcctttatggatgaaagtacccagtgcttccagaaggtgtcagtacagctcggaaagagaagcatgcaacaattagatccctcaccagctcgaaaactgttgaagcttcagctacagaacccacctgccatacatggatctggatctggatcttgtcagtgactttatgagagtttctgccacaaggtgcccaagaggagaggaatgggaagagtgccccagcacgtggtgactgcgtgatttctgctcgttgcctttgaagataactggcaggactgactgtagaacactttgacttttttcaaaaagtgatggaatttgtacatccaaatgaatattgtatagacaattttcccaggaatgtgcaaaatgcttgaaagttcaaacttcttttttgaaatgatcttcagatccagtggcccattcttttatctttatcctgtgaaggtgtttttcaggttttgaaacaatccaaaaatcatttaggaccaagtctaaggaaacattttagtggccaagttggattccgattgtaaaggaatgatactaattttctagcatggctctgaaggtgattttaggtagaagagttttgaggctgggcgcaatggctcacgcctgtaatcctagcattttgggtgactgaggcgggtggattgcttgagcccagaagttgaagaccagcctgagaaataaggtgaaaccctgtctacaaaaaatacaaaaagttagctgggtgtggtggcgtgtgcctgtagtgctagctactcagaaggctgaggtgggaggattgtttgagcccaggaggttgaggctgcagtgagttctaattgcgccactgcactccagcctgagcgacagagtgagacactgtcttaaaaaaaattaaaaattgtaaaaaaatgaaaaaaaaagttttgagcattatttgcatcattgggatacatatgtcacttcacaagatgttcaatttgaaggaaataccactcattctctatgtcctgttgtctgtagtgtgcttcagtttttcatattgagttgacctaaatcctggattcatgacaagaaaggagtaagtactactattcattgttctatttgtttataatctgtattataaaattgcacataattaaaagctttcccttgtcttca

SEQ ID NO: 1865 - DNA, 2012 bp, Homo sapiens
cgagtgttggcggggactgagcctcctgcttgaggtagttgtttttactcccagtccccaggctcacgagccccacgcgcgctcaatctgccctcccgcttctcctcgccactccgagttctgcgccctcgagatccagcgcatccgcggggtgggcgggtcctggcggctctttgccctcttccaacatggccgccgctgcctctgtgacaggcagggtcacgtgggcagcctcgcctatgaggtcgctggggctcggccggcgattgtcccttcccggaccccgtctcgatgcggtgactgccgctgtcaacccgagcctgagcgatcatggcaacgggctcgggcggggaacgcgtggcagcggctgcagcggcggcagtttggtggcggactggggcggcggagcggcggcggcggcggcggtggcactggcactggccccggccctgagcaccatgcggcggggcagctccgagagcgagctggcggcccggtgggaggcggaggcggtggctgcggccaaagcggcggccaaagctgaggccgaggccacagcggagacggtggcggaacaggtccgcgtggacgcgggcgcggccggggaaccggagtgcaaggcaggggaggagcagcccaaggtcctggccccggccccggcgcagcccagtgcggctgaggaggggaacacccaggtccttcagcggccgccgcccacgctgcccccgtccaagccgaagccggtgcagggcctctgcccgcacgggaagccccgggacaagggccgaagctgcaagcggagctcgggccacggttccggcgagaacggctcccagcggccggtcaccgtggacagctccaaggccaggacctccctggatgccctgaagatcagcatccgccagctcaagtggaaggagttcccatttggccggcgcttgccttgtgacatctactggcatggagtttcatttcacgacaatgacatattctccggtcaagtgaacaagtttccaggcatgacggagatggtgcgtaaaattactctgagcagagcagtgagaaccatgcagaatctctttcctgaggagtacaacttctaccctcgctcatggattctgcctgacgagttccagctctttgttgctcaggttcaaatggtgaaagacgatgacccctcctggaagcccacttttatcgtgaaacctgatggtggttgtcagggtgatggaatctacctcattaaagaccccagtgacatccgcctggcagggaccctccagagcaggccagcggtggtccaggagtacatctgcaaacctctccttatcgacaagctcaagtttgatattcgtctgtatgtcttactcaagtccttagaccccttagagatttatatagccaaagacggactctctaggttttgtaccgagccatatcaggagcccacccccaaaaacctgcaccgcatctttatgcacttaaccaactattcactgaacatccacagcggcaacttcatccactcggacagtgctagcactggcagcaaaaggactttttccagcatcctttgtagactgtcttccaaaggcgttgacatcaagaaggtctggtctgacatcatctccgtggtgattaagacggtcatcgcgctgactccagagctcaaagtcttctaccagtcagacatccccacggggaggccgggccccacgtgcttccaggtaaccattgccagttcccagcctgcgtttccagccttgaccggcctcaagagggctctctggcttcgtgtaggatgagtgatcggggtgggatggccagaggaggggacagtgttggtggtgctgtgggcttgggtgttaaacctgggcccaacttccaagctttctgtttgctccctgtgtgatttggggcaagctacttcccctctgttacctgtaaaatgaaatgaagaatacctatcttaaaaggttcttgtaagaattaaatgagataacacatgtaaa

SEQ ID NO: 1866 - DNA, 2193 bp, Homo sapiens
ggagctcgggccacggttccggcgagaacggctcccagcggccggtcaccgtggacagctccaaggccaggacctccctggatgccctgaagatcagcatccgccagctcaagtggaaggagttcccatttggccggcgcttgccttgtgacatctactggcatggagtttcatttcacgacaatgacatattctccggtcaagtgaacaagtttccaggcatgacggagatggtgcgtaaaattactctgagcagagcagtgagaaccatgcagaatctctttcctgaggagtacatctgcaaacctctccttatcgacaagctcaagtttgatattcgtctgtatgtcttactcaagtccttagaccccttagagatttatatagccaaagacggactctctaggttttgtaccgagccatatcaggagcccacccccaaaaacctgcaccgcatctttatgcacttaaccaactattcactgaacatccacagcggcaacttcatccactcggacagtgctagcactggcagcaaaaggactttttccagcatcctttgtagactgtcttccaaaggcgttgacatcaagaaggtctggtctgacatcatctccgtggtgattaagacggtcatcgcgctgactccagagctcaaagtcttctaccagtcagacatccccacggggaggccgggccccacgtgcttccagattttaggctttgacattcttctaatgaaaaatctgaagcctatactacttgaagtaaatgcaaatcccagtatgagaatcgaacatgagcacgaactttctccaggggtgtttgaaaatgtccccagcctcgttgatgaagaagtgaaagtggctgtgatcagagacactctgcgcctcatggacccacttaagaagaaaagagagaatcagtctcagcagcttgaaaaaccattcgctggaaaggaagatgctttggacggcgagctgaccagtgctccagactgcaacgccaaccccgaagcccacctgccttccatttgcctcaagcaggtgttccccaagtacgcaaaacagttcaactacctgcgcctggtggacaggatggcaaatttgtttatccggttcctgggcatcaaggggacaatgaagttggggccaacaggctttcgtaccttcataaggagctgcaaactcagcagcagcagcctgtccatggctgccgtggacatcctctacattgacatcacacggaggtggaactccatgaccctggaccagcgggactcagggatgtgtctgcaggccttcgtagaagctttctttttcctggctcagaggaagttcaagatgctgccacttcatgagcaggtggcctcactgattgacctttgcgagtaccacctgtccctgctggatgaaaaacgcctggtgtgtggccggggcgtcccgtcggggggccggcccccacaccgtggccctccccaggagccctccccctcggcccagccagcaggggacaaccccccaccccgcaccagctgtgccaataagctctcccatcccagacataccctgtcctgagggccactctgtcctcctggaaaacggaagacgagagcagctttcagggctggagcgccccaggcattctgcctgcagaggaatggcaggcaggctgccgaggggcccagctgaggtccccacgaactgtctctgtgtgcggctgagctgtgcttcaccaggctggctggttctcacctgccttcctcctcacacctcctggtgatacaccctgtttctgagtcatcagtcatcggacatatgacatctaaaacgtgacagatggcaccttctattctgggctcacaggaagcaccaactggggcaaatctgttgtatttggggcacaggacacaatcgatcccaaggcccggagctgtggagaggaagccgagtgttaggatctgctgccggggcctccacgcgcccaccgggaaaagcctgagaacatcgtgtttatttcctgccgcccgttccgagagaaggaagtggaaatatcaagtaggcatctgcgaatctcccatcccagtcatgtgctacatgggtgtagtgaacagattaacctcatttagttcattagcttgcctgttgctgcaatatttggtttgttattaattaagaaaaaattaattaagaa

SEQ ID NO: 1867 - DNA, 4358 bp, Homo sapiens
tcgtggggcgggggtggggcgggactgagggcggagtgtgagcgggctcggttttgggccgcggcgggagcgggagtcgccgccactcgagtgcgcaggcgcctggcgattaccggtctcaccatggagcggaaagtgcttgcgctccaggcccgaaagaaaaggaccaaggccaagaaggacaaagcccaaaggaaatctgaaactcagcaccgaggctctgctccccactctgagagtgatctaccagagcaggaagaggagattctgggatctgatgatgatgagcaagaagatcctaatgattattgtaaaggaggttatcatcttgtgaaaattggagatctattcaatgggagataccatgtgatccgaaagttaggctggggacacttttcaacagtatggttatcatgggatattcaggggaagaaatttgtggcaatgaaagtagttaaaagtgctgaacattacactgaaacagcactagatgaaatccggttgctgaagtcagttcgcaattcagaccctaatgatccaaatagagaaatggttgttcaactactagatgactttaaaatatcaggagttaatggaacacatatctgcatggtatttgaagttttggggcatcatctgctcaagtggatcatcaaatccaattatcaggggcttccactgccttgtgtcaaaaaaattattcagcaagtgttacagggtcttgattatttacataccaagtgccgtatcatccacactgacattaaaccagagaacatcttattgtcagtgaatgagcagtacattcggaggctggctgcagaagcaacagaatggcagcgatctggagctcctccgccttccggatctgcagtcagtactgctccccagcctaaaccagctgacaaaatgtcaaagaataagaagaagaaattgaagaagaagcagaagcgccaggcagaattactagagaagcgaatgcaggaaattgaggaaatggagaaagagtcgggccctgggcaaaaaagaccaaacaagcaagaagaatcagagagtcctgttgaaagacccttgaaagagaacccacctaataaaatgacccaagaaaaacttgaagagtcaagtaccattggccaggatcaaacgcttatggaacgtgatacagagggtggtgcagcagaaattaattgcaatggagtgattgaagtcattaattatactcagaacagtaataatgaaacattgagacataaagaggatctacataatgctaatgactgtgatgtccaaaatttgaatcaggaatctagtttcctaagctcccaaaatggagacagcagcacatctcaagaaacagactcttgtacacctataacatctgaggtgtcagacaccatggtgtgccagtcttcctcaactgtaggtcagtcattcagtgaacaacacattagccaacttcaagaaagcattcgggcagagataccctgtgaagatgaacaagagcaagaacataacggaccactggacaacaaaggaaaatccacggctggaaattttcttgttaatccccttgagccaaaaaatgcagaaaagctcaaggtgaagattgctgaccttggaaatgcttgttggcacaaacatttcactgaagatattcaaacaaggcaatatcgttccttggaagttctaatcggatctggctataatacccctgctgacatttggagcacggcatgcatggcctttgaactggccacaggtgactatttgtttgaacctcattcaggggaagagtacactcgagatgaagaccacattgtgcacattatagagctgataggcagaattccaagacgcttttccctcagtgggaaatattcacaagacttcttcagtcacagaggtgacctgaaacatatcacgaagctgaaaccttggggcctttttgaggttctagtggagaagtatgagtggtcgcaggaagaggcagctggcttcacagatttcttactgcccatgttggagctgatccctgagaagagagccactgccgccgagtgtctccggcacccttggcttaactcctaagcccctgcccagcaccacagcagagatcacacactgaccctccgcccttccccttcaagcattttcctcttcccttttcagggtgaagctcttccttcaagagtttctagatcttgttttttttttaatccaacatgttcatttgggtttgcttacttgaccctgtggagatccccacagccattgggcatcctaggtgaatttggccttggttgggctctgccaaagactaatggactaaaatgtgaaacagcctcttgccctgtacctttccttcccattaggacatcctttaaattataagcatcctttttgaaaagagctatgaaggtgtatgagcccatccttttattcattgactctaagagtcaaattttctagtgcatatcctattgccagcataaggatgaggagggggaaagggtcttaattctatgtacagcagagacattaaacttgctgtgtccgggctgcatcatcttcctggactgtttctgttgttctctgtgttcacattttttcctgcaacttttaagctactgtcttttttaaatagctatatgaacaccaaatttgggtaccattttatcactgttcaaagcactgtcaaattcctttcatcctttaatagttaagatctttgaatcttcagtctgatttttaatgtaagcaaaaacagaaccattgaatagtaatttcttgagaacctcaggtgttctataaacagtcctttcctgtatgtcttctattaccctaagaccagagttattttggttggttgttttgttttattttttgtttttgtatccatggctggcactttactcattgcacttgagtttattgccccataactaaaggatcaggatgatggtagaacggagatctgggtttcagagctttcccatttaagaaaaatagatcttgagattctgattcttttccaaacagtcccctgctttcatgtacagctttttctttaccttacccaaaattctggccttgaagcagttttcctctatggctttgcctttctgattttctcagaggctcgagtctttaatataaccccaaatgaaagaaccaaggggaggggtgggatggcacttttttttgttggtcttgttttgttttgttttttggttggttggttcgttattttttaagattagccattctctgctgctatttccctacataatgtcaatttttaaccataattttgacatgattgagatgtacttgaggcttttttgttttaattgagaaaagactttgcaattttttttttaggatgagcctctcctagacttgacctagaatattacatattcctccagtaagtaatactgaagagcaaaagagaggcaggattggggtcacagccgcttcttcagcatggaccaagtgggccttggggattgcagcgttctcgaagtggctgtaggactcgaatttacagaaagccacagaggtgcaacttgaggctctgctagcaagccaccagtgaggctattgggtaaccacctttctatacaggagattggaatctactttgtcatttatccaccacagtgacaaaggaaaagtggtgccgttatgcaatccatttaactcataaacatattactctgagtaactggccagccattcatcggatccttcattgggtactcctgaaatcagacatgttcctgtagaaagaattttaagttaggctttctatgcacctatcaagaatcaagagaatagattgtatcaaacaacggcagggaaatccttcagcaattctaatccactttgggttttcagctgtttttacatctaaagcaatagactagaactgaattatcttctacatagtaaaatcacaattgtggaattacaggaattctggtgatattaaggtgaaataacaaaacacaaaaggccctattttaacagttgatgtgacagtaagttttaatagaacctgtaacttcattttggaaatgcttctccaccaaataagggctttttcccctatttaaggagccagatggattgaaagatgtggaaataggcagctgtagatcttgatcttccaggtaccccatgtacctttattgagcttaattataatactgtcaaattgccacgatctcactaaaggatttctatttgctgtcagttaaaaataaagccctaaatacatttttattctttctactgagggcattgtctgttttctttgtaaatgccgtacaataaacaaattatttaataaccta

SEQ ID NO: 1868 - DNA, 4592 bp, Homo sapiens
aaatagaacaaaactaaccttgccaggtttccaagcttggatctctaacactccttcaacgttcaccccggcgttcctccccgctgcgccccctccctctccttgccgccccctcctcgggagcaggtggtaggctccgcgcccaacgcgcaagcgcgcggcatcgtggggcgggggtggggcgggactgagggcggagtgtgagcgggctcggttttgggccgcggcgggagcgggagtcgccgccactcgagtgcgcaggcgcctggcgattaccggtctcaccatggagcggaaagtgcttgcgctccaggcccgaaagaaaaggaccaaggccaagaaggacaaagcccaaaggaaatctgaaactcagcaccgaggctctgctccccactctgagagtgatctaccagagcaggaagaggagattctgggatctgatgatgatgagcaagaagatcctaatgattattgtaaaggaggttatcatcttgtgaaaattggagatctattcaatgggagataccatgtgatccgaaagttaggctggggacacttttcaacagtatggttatcatgggatattcaggggaagaaatttgtggcaatgaaagtagttaaaagtgctgaacattacactgaaacagcactagatgaaatccggttgctgaagtcagttcgcaattcagaccctaatgatccaaatagagaaatggttgttcaactactagatgactttaaaatatcaggagttaatggaacacatatctgcatggtatttgaagttttggggcatcatctgctcaagtggatcatcaaatccaattatcaggggcttccactgccttgtgtcaaaaaaattattcagcaagtgttacagggtcttgattatttacataccaagtgccgtatcatccacactgacattaaaccagagaacatcttattgtcagtgaatgagcagtacattcggaggctggctgcagaagcaacagaatggcagcgatctggagctcctccgccttccggatctgcagtcagtactgctccccagcctaaaccagctgacaaaatgtcaaagaataagaagaagaaattgaagaagaagcagaagcgccaggcagaattactagagaagcgaatgcaggaaattgaggaaatggagaaagagtcgggccctgggcaaaaaagaccaaacaagcaagaagaatcagagagtcctgttgaaagacccttgaaagagaacccacctaataaaatgacccaagaaaaacttgaagagtcaagtaccattggccaggatcaaacgcttatggaacgtgatacagagggtggtgcagcagaaattaattgcaatggagtgattgaagtcattaattatactcagaacagtaataatgaaacattgagacataaagaggatctacataatgctaatgactgtgatgtccaaaatttgaatcaggaatctagtttcctaagctcccaaaatggagacagcagcacatctcaagaaacagactcttgtacacctataacatctgaggtgtcagacaccatggtgtgccagtcttcctcaactgtaggtcagtcattcagtgaacaacacattagccaacttcaagaaagcattcgggcagagataccctgtgaagatgaacaagagcaagaacataacggaccactggacaacaaaggaaaatccacggctggaaattttcttgttaatccccttgagccaaaaaatgcagaaaagctcaaggtgaagattgctgaccttggaaatgcttgttgggtgcacaaacatttcactgaagatattcaaacaaggcaatatcgttccttggaagttctaatcggatctggctataatacccctgctgacatttggagcacggcatgcatggcctttgaactggccacaggtgactatttgtttgaacctcattcaggggaagagtacactcgagatgaagatcacattgcattgatcatagaacttctggggaaggtgcctcgcaagctcattgtggcaggaaaatattccaaggaatttttcaccaaaaaaggtgacctgaaacatatcacgaagctgaaaccttggggcctttttgaggttctagtggagaagtatgagtggtcgcaggaagaggcagctggcttcacagatttcttactgcccatgttggagctgatccctgagaagagagccactgccgccgagtgtctccggcacccttggcttaactcctaagcccctgcccagcaccacagcagagatcacacactgaccctccgcccttccccttcaagcattttcctcttcccttttcagggtgaagctcttccttcaagagtttctagatcttgttttttttttaatccaacatgttcatttgggtttgcttacttgaccctgtggagatccccacagccattgggcatcctaggtgaatttggccttggttgggctctgccaaagactaatggactaaaatgtgaaacagcctcttgccctgtacctttccttcccattaggacatcctttaaattataagcatcctttttgaaaagagctatgaaggtgtatgagcccatccttttattcattgactctaagagtcaaattttctagtgcatatcctattgccagcataaggatgaggagggggaaagggtcttaattctatgtacagcagagacattaaacttgctgtgtccgggctgcatcatcttcctggactgtttctgttgttctctgtgttcacattttttcctgcaacttttaagctactgtcttttttaaatagctatatgaacaccaaatttgggtaccattttatcactgttcaaagcactgtcaaattcctttcatcctttaatagttaagatctttgaatcttcagtctgatttttaatgtaagcaaaaacagaaccattgaatagtaatttcttgagaacctcaggtgttctataaacagtcctttcctgtatgtcttctattaccctaagaccagagttattttggttggttgttttgttttattttttgtttttgtatccatggctggcactttactcattgcacttgagtttattgccccataactaaaggatcaggatgatggtagaacggagatctgggtttcagagctttcccatttaagaaaaatagatcttgagattctgattcttttccaaacagtcccctgctttcatgtacagctttttctttaccttacccaaaattctggccttgaagcagttttcctctatggctttgcctttctgattttctcagaggctcgagtctttaatataaccccaaatgaaagaaccaaggggaggggtgggatggcacttttttttgttggtcttgttttgttttgttttttggttggttggttcgttattttttaagattagccattctctgctgctatttccctacataatgtcaatttttaaccataattttgacatgattgagatgtacttgaggcttttttgttttaattgagaaaagactttgcaattttttttttaggatgagcctctcctagacttgacctagaatattacatattcctccagtaagtaatactgaagagcaaaagagaggcaggattggggtcacagccgcttcttcagcatggaccaagtgggccttggggattgcagcgttctcgaagtggctgtaggactcgaatttacagaaagccacagaggtgcaacttgaggctctgctagcaagccaccagtgaggctattgggtaaccacctttctatacaggagattggaatctactttgtcatttatccaccacagtgacaaaggaaaagtggtgccgttatgcaatccatttaactcataaacatattactctgagtaactggccagccattcatcggatccttcattgggtactcctgaaatcagacatgttcctgtagaaagaattttaagttaggctttctatgcacctatcaagaatcaagagaatagattgtatcaaacaacggcagggaaatccttcagcaattctaatccactttgggttttcagctgtttttacatctaaagcaatagactagaactgaattatcttctacatagtaaaatcacaattgtggaattacaggaattctggtgatattaaggtgaaataacaaaacacaaaaggccctattttaacagttgatgtgacagtaagttttaatagaacctgtaacttcattttggaaatgcttctccaccaaataagggctttttcccctatttaaggagccagatggattgaaagatgtggaaataggcagctgtagatcttgatcttccaggtaccccatgtacctttattgagcttaattataatactgtcaaattgccacgatctcactaaaggatttctatttgctgtcagttaaaaataaagccctaaatacatttttattctttctactgagggcattgtctgttttctttgtaaatgccgtacaataaacaaattatttaataacctacatgtttccaaaaatctctgttcatttgttgtccaaattgctctgccctgagtaaaaggaggaaaaga

SEQ ID NO: 1869 - DNA, 1793 bp, Homo sapiens
gcaaagccccaccccggtgcgcgggtatggcggccagcctgtggatgggcgacctggaaccctacatggatgagaacttcatctccagagcctttgccaccatgggggagaccgtaatgagcgtcaaaattatccgaaaccgcctcactgggatcccagctggctactgctttgtagaatttgcagatttggccacagctgagaagtgtttgcataaaattaatgggaaaccccttccaggagccacacctgcgaaacgttttaaactgaactatgccacttacgggaaacaaccagataacagccctgagtattccctctttgtgggggacctgaccccggacgtggatgatggcatgctgtatgaattcttcgtcaaagtctacccctcctgtcggggaggcaaggtggttttggaccagacaggcgtgtctaagggttatggttttgtgaaattcacagatgaactggaacagaagcgagccctgacggagtgccagggagcagtgggactggggtctaagcctgtgcggctgagcgtggcaatccctaaagcgagccgtgtaaagccagtggaatatagtcagatgtacagttatagctacaaccagtattatcagcagtaccagaactactatgctcagtggggctatgaccagaacacaggcagctacagctacagttacccccagtatggctatacccagagcaccatgcagacatatgaagaagttggagatgatgcattggaagaccccatgccacagctggatgtgactgaggccaacaaggagttcatggaacagagtgaggagctgtatgacgctctgatggactgtcactggcagcccctggacacagtgtcttcagagatccctgccatgatgtagccaggccaaaggacaagccaggttgcatgatgtgagggagatgagagactcctttttaaaaattgtgaaacctttttggaaatatgatttgtaagattttaataatgactgtttttggagatcatgaatgtttctacaacactgctgcattcatttgaccatttgagtttgaagaccaagggaacaacttttaaacaaggttcaaattggtttccttcacaggaatcctttgtccaggtagttatccacataggacagtttgggattatccaaaactgggatgagcagcttgggataattcacacactaaagcctgagttcaaggtttctcagttgacaggtaggtatgtaaatcagggttctctggagtatttgtaggacctgccatatttgagtcctaacttggtgcaagtctggcagctaggtagaaaaggcactctagcaggtgtggtaggagcacgccccagaaggtagaatgtggtggggtgtgatggaacaggccagttggcctaagaattagtacttgctctaataatgggtttcatctattttcatgagttgcagcatctgcatatacaaggcctggatcactttaggatcaatattttgacacgggagaaggcagctcagaaaggattaaggaagatagctcaaagccaaagcagaccctccgtgtgaactttatactgctcacttccgtgtttcccaagtaaatggggaaactgtccaaccttgtcatgtgttgggacttactgcttgaggcaaagcattcatcctacatcataaaaaatctccaaagatctctttaagggctgggcatggtggctcactttgggagatggattgcttgagctcgggaagagaccagttcggtctctacaaaaaaatacaaacacaaatata

SEQ ID NO: 1870 - DNA, 713 bp, Homo sapiens
caatgtttaagcaagaagaaggaaaaactgacagaagagcttcagaaactacagaaagacatagagatggcagaacgcaatgaggatcaccacctgcaggtccttaaagaatctgaggtgcttcttcaggccaaaagagccgagctggaaaagctgaaaagccaggtgacaagtcagcagcaggagatggctgtcttggacaggcagttagggcataaaaaggaggagctgcatctactccaaggaagcatggtccaggcaaaagctgacctccaggaagctctgagactgggagagactgaagtaactgagaagtgcaatcacattagggaagtaaaatctcttctggaagaactgagttttcagaaaggagaactaaatgttcagattagtgaaagaaaaactcaacttacacttataaagcaggaaattgaaaaagaggaagaaaatcttcaggttgttttaaggcagatgtctaaacataaaaccgcttttctacagtaagcaagtatctctatgatcagaaaaaaagttaatatttaaatatctgtatttcaaaggccaaaaaattgttatataaatctcagtctgtatttcaaagtatttttaatttattttgatcaattttatataaaatgcttttagttgattcttttatgtagaagcaaatgctttggaaccagatctttgttaattaaatgtttttgttaaaa

SEQ ID NO: 1871 - DNA, 3920 bp, Homo sapiens
cacttttatacttcccttcgtttgcatgtgttacttcttcagcctaggtctttccccttccgttcgttcttcaaaacccaggcaaaacacctcttcctctgagcagccttctcagaacttttctcccatgtggccagaggaaggagagacttctgtctatctcttctgctagaccccgaactctttggaggcagaggttatccacaagaggcttggcaaatgtttctcagtcatagttggactgtttgaaaaattaaaggttctatttgtctgtcagtttcatccgtgacatttaactttttataccaaagtcttagaatctaccatcattttttgggccattgataccactttaaccacagttaatttcagcttttggcaggaaagagaggaaacatcctgtgatgtttcagcactgcatttttttccccatctcattcaggagaatgaagtttctagattagaagacataatgcagcatttaaaatcaaagaagcgggaagaaaggtggatgagagcatccaagcggcagtcggagaaagaaatggaagaactgcatcataatattgatgatcttttgcaagagaagaaaagcttagagtgtgaagtagaagaattacatagaactgtccagaaacgtcaacagcaaaaggacttcattgatggaaatgttgagagtcttatgactgaactagaaatagaaaaatcactcaaacatcatgaagatattgtagatgaaattgagtgcattgagaagactcttctgaaacgtcgctcagagctcagggaagctgaccgactcctggcagaggctgagagtgaactttcatgcactaaagaaaaggtttgtcttcttgtggtttggggtgtgagctcagtgtggacaaaaaatgctgttgaaaagttcactgatgccaagagaagtttattgcaaactgagtcagatgctgaggaattagaaaggagagctcaggaaactgctgttaacctcgtcaaagctgatcagcagctaagatcgctccaggctgatgcaaaggatttggagcagcacaaaatcaagcaagaagaaatcttgaaagaaataaacaaaattgtagcagcaaaagactcagacttccaatgtttaagcaagaagaaggaaaaactgacagaagagcttcagaaactacagaaagacatagagatggcagaacgcaatgaggatcaccacctgcaggtccttaaagaatctgaggtgcttcttcaggccaaaagagccgagctggaaaagctgaaaagccaggtgacaagtcagcagcaggagatggctgtcttggacaggcagttagggcataaaaaggaggagctgcatctactccaaggaagcatggtccaggcaaaagctgacctccaggaagctctgagactgggagagactgaagtaactgagaagtgcaatcacattagggaagtaaaatctcttctggaagaactgagttttcagaaaggagaactaaatgttcagattagtgaaagaaaaactcaacttacacttataaagcaggaaattgaaaaagaggaagaaaatcttcaggttgttttaaggcagatgtctaaacataaaaccgaactaaagaatattctggacatgttgcaacttgaaaaccatgagctacaaggtttgaagctacaacatgaccaaagggtatctgaattagagaagactcaggtggcagtgctagaggagaaactggagttagagaatttgcagcagatatcccagcagcagaaaggggaaatagagtggcagaagcagctccttgagagggataaacgagaaatagaacgaatgactgctgagtcccgagctttacaatcgtgtgttgagtgtttgagcaaagaaaaggaagatctccaagagaaatgtgacatttgggaaaaaaagttggcacaaaccaaaagggttttagcagcagcagaagaaaatagcaaaatggagcaatcaaacttagaaaagttggaattgaatgtcagaaaactgcagcaggaactagaccaactaaacagagacaagttgtcactgcataacgacatttcagcaatgcaacagcagctccaagaaaaacgagaagcagtaaactcactgcaggaggaactagctaatgtccaagaccatttgaacctagcaaaacaggacctgcttcacaccaccaagcatcaggatgtgttgctcagtgagcagacccgactccagaaggacatcagtgaatgggcaaataggtttgaagactgtcagaaagaagaggagacaaaacaacaacaacttcaagtgcttcagaatgagattgaagaaaacaagctcaaactagtccaacaagaaatgatgtttcagagactccagaaagagagagaaagtgaagaaagcaaattagaaaccagtaaagtgacactgaaggagcaacagcaccagctggaaaaggaattaacagaccagaaaagcaaactggaccaagtgctctcaaaggtgctggcagctgaagagcgtgttaggactctgcaggaagaggagaggtggtgtgagagcctggagaagacactctcccaaactaaacggcagctttcagaaagggagcagcaattggtggagaaatcaggtgagctgttggccctccagaaagaggcagattctatgagggcagacttcagccttctgcggaaccagttcttgacagaaagaaagaaagctgagaagcaggtggccagcctgaaggaagcacttaagatccagcggagccagctggagaaaaaccttcttgagcaaaaacaggagaacagctgcatacaaaaggaaatggcaacaattgaactggtagcccaggacaaccatgagcgggccaggcgcctgatgaaggagctcaaccagatgcagtatgagtacacggagctcaagaaacagatggcaaaccaaaaagatttggagagaagacaaatggaaatcagtgatgcaatgaggacacttaaatctgaggtgaaggatgaaatcagaaccagcttgaagaatcttaatcagtttcttccagaactaccagcagatctagaagctattttggaaagaaacgaaaacctagaaggagaattggaaagcttgaaagagaaccttccatttaccatgaatgagggaccttttgaagaaaaactgaacttttcccaagttcacataatggatgaacactggcgtggagaagcactccgggagaaactgcgtcaccgggaagaccgactcaaggcccaactccgacactgtatgtccaagcaagcagaagtattaattaaaggaaagcggcagacagagggcactttacacagtttgaggagacaagtagatgctttaggggaattggtcaccagcacctctgcagattcagcgtcatcacccagtctgtctcagctggagtcttccctcacagaggactctcaacttggacaaaatcaggaaaagaatgcctcagccagatgaggaatactgtcttgtgtaaatatattcaaggaaaacacctccactacctcactgacttcataattggaatgtcacatggtttttttaatcaagatgcagtgaactgagattctgaaactccactgtagtttactttgcctgtaccattaatgccaatgtttttataaatcacttgtacatagtacatatgggaatagttgcatatgggaatttaaaccaacatgtggctgagcctttttttttttaatcttcgtaacatgtttaaaaaaaaacagtgattttaactgcatatttgaacctacaaactggtaaatcttattaacaaaaagaatgtacttaaggccctctttatttatagtgtcgagttatttttgaattttgcttaaaatctatttttcatatgaaaataaaagataacaatcaa

SEQ ID NO: 1872 - DNA, 3372 bp, Homo sapiens
gcgaagttacagaggctcggaggcgcttgcaaaaatgtggctgtcagagagggaagtgcacatgaatttgaagacagcattagaaagcgttccgcccacagtttctctgttctcaacggctcagttttaacaggataaattttaagttaagtcccatatgaaggctcaaaagagcggtaaagaacaacagcttgacattatgaacaagcagtaccaacaacttgaaagtcgtttggatgagatactttctagaattgctaaggaaacggaagagattaaggaccttgaagaacagcttactgaaggccagatagcagcaaatgaagccctgaagaaggatttagaaggtgttatcagtgggttgcaagaatacctggggaccattaaaggccaggcaactcaggcccagaatgagtgcaggaagctgcgggatgagaaagagacattgttgcagagattgacagaagtcgagcaggagagagaccagctggaaatagttgccatggatgcagaaaatatgaggaaggagcttgcagagctagaaagtgccctccaagagcagcatgaggtgaatgcatctttgcagcagacccagggagatctcagtgcctatgaagctgagctagaggctcggctaaacctaagggatgctgaagccaaccagctcaaggaagagttggaaaaagtaacaagacttacccagttagaacaatcagcccttcaagcagaacttgagaaggaaaggcaagccctcaagaatgcccttggaaaagcccagttctcagaagaaaaggagcaagagaacagtgagctccatgcaaaacttaaacacttgcaggatgacaataatctgttaaaacagcaacttaaagatttccagaatcaccttaaccatgtggttgatggtttggttcgtccagaagaagtggcagctcgtgtggatgagctaagaagaaaactgaaattaggaactggggaaatgaacatccatagtccttcagatgtcttagggaaaagtcttgctgatttacagaaacaattcagtgaaattcttgcacgctccaagtgggaaagagatgaagcacaagttagagagagaaaactccaagaagaaatggctctgcagcaagagaaactggcaactggacaagaagagttcaggcaggcctgtgagagagccctggaagcaagaatgaattttgataagaggcaacatgaagcaagaatccagcaaatggagaatgaaattcactatttgcaagaaaatctaaaaagtatggaggaaatccaaggccttacagatctccaacttcaggaagctgatgaagagaaggagagaattctggcccaactccgagagttagagaaaaagaagaaacttgaagatgccaaatctcaggagcaagtttttggtttagataaagaactgaagaaactaaagaaagccgtggccacctctgataagctagccacagctgagctcaccattgccaaagaccagctgaagtcccttcatggaactgttatgaaaattaaccaggagcgagcagaggagttgcaggaagcagagaggttcagcagaaaggcagcacaagcagccagagatctcacccgagcagaagctgagatcgaactcctgcagaatctcctcaggcagaagggggagcagtttcgacttgagatggagaaaacaggtgtaggtactggagcaaactcacaggtcctagaaattgagaaactgaatgagacaatggaacgacaaaggacagagattgcaaggctgcagaatgtactagacctcactggaagtgacaacaaaggaggctttgaaaatgttttagaagaaattgctgaacttcgacgtgaagtttcttatcagaatgattacataagcagcatggcagatcctttcaaaagacgaggctattggtactttatgccaccaccaccatcatcaaaagtttccagccatagttcccaggccaccaaggactctggtgttggccttaagtactcagcctcaactcctgttagaaaaccacgccctgggcagcaggatgggaaggaaggcagtcaacctccccctgcctcaggatactgggtttattctcccatcaggagtgggttacataaactgtttccaagtagagatgcagacagtggaggagatagtcaggaagagagtgagctggatgaccaagaagaacccccatttgtgcctcctcctggatacatgatgtatactgtgcttcctgatggttctcctgtaccccagggcatggccctgtatgcaccacctcctcccttgccaaacaatagccgacctctcacccctggcactgttgtttatggcccacctcctgctggggcccccatggtgtatgggcctccaccccccaacttctccatccccttcatccctatgggtgtgctgcattgcaacgtccctgaacaccataacttagagaatgaagtttctagattagaagacataatgcagcatttaaaatcaaagaagcgggaagaaaggtggatgagagcatccaagcggcagtcggagaaagaaatggaagaactgcatcataatattgatgatcttttgcaagagaagaaaagcttagagtgtgaagtagaagaattacatagaactgtccagaaacgtcaacagcaaaaggacttcattgatggaaatgttgagagtcttatgactgaactagaaatagaaaaatcactcaaacatcatgaagatattgtagatgaaattgagtgcattgagaagactcttctgaaacgtcgctcagagctcagggaagctgaccgactcctggcagaggctgagagtgaactttcatgcactaaagaaaagacaaaaaatgctgttgaaaagttcactgatgccaagagaagtttattgcaaactgagtcagatgctgaggaattagaaaggagagctcaggaaactgctgttaacctcgtcaaagctgatcagcagctaagatcgctccaggctgatgcaaaggatttggagcagcacaaaatcaagcaagaagaaatcttgaaagaaataaacaaaattgtagcagcaaaagactcagacttccaatgtttaagcaagaagaaggaaaaactgacagaagagtaagtaaggcctctgtagggctacaaggggtttgtgctggaagacagctctggggttccgagtcccttaggatctgctctagtgttgctggtgctttgtaggcttcagaaactacagaaagacatagagatggcagaacgcaatgaggatcaccacctgcaggtccttaaagaatctgaggtgcttcttcaggccaaaagagccgagctggaaaagctgaaaagccaggtatg

SEQ ID NO: 1873 - DNA, 5824 bp, Homo sapiens
gccggaaagcagaaggagattaaggacctgcaaatagccatagatagcctggattccaaagacccaaaacattcccatatgaaggctcaaaagagcggtaaagaacaacagcttgacattatgaacaagcagtaccaacaacttgaaagtcgtttggatgagatactttctagaattgctaaggaaacggaagagattaaggaccttgaagaacagcttactgaaggccagatagcagcaaatgaagccctgaagaaggatttagaaggtgttatcagtgggttgcaagaatacctggggaccattaaaggccaggcaactcaggcccagaatgagtgcaggaagctgcgggatgagaaagagacattgttgcagagattgacagaagtcgagcaggagagagaccagctggaaatagttgccatggatgcagaaaatatgaggaaggagcttgcagagctagaaagtgccctccaagagcagcatgaggtgaatgcatctttgcagcagacccagggagatctcagtgcctatgaagctgagctagaggctcggctaaacctaagggatgctgaagccaaccagctcaaggaagagttggaaaaagtaacaagacttacccagttagaacaatcagcccttcaagcagaacttgagaaggaaaggcaagccctcaagaatgcccttggaaaagcccagttctcagaagaaaaggagcaagagaacagtgagctccatgcaaaacttaaacacttgcaggatgacaataatctgttaaaacagcaacttaaagatttccagaatcaccttaaccatgtggttgatggtttggttcgtccagaagaagtggcagctcgtgtggatgagctaagaagaaaactgaaattaggaactggggaaatgaacatccatagtccttcagatgtcttagggaaaagtcttgctgatttacagaaacaattcagtgaaattcttgcacgctccaagtgggaaagagatgaagcacaagttagagagagaaaactccaagaagaaatggctctgcagcaagagaaactggcaactggacaagaagagttcaggcaggcctgtgagagagccctggaagcaagaatgaattttgataagaggcaacatgaagcaagaatccagcaaatggagaatgaaattcactatttgcaagaaaatctaaaaagtatggaggaaatccaaggccttacagatctccaacttcaggaagctgatgaagagaaggagagaattctggcccaactccgagagttagagaaaaagaagaaacttgaagatgccaaatctcaggagcaagtttttggtttagataaagaactgaagaaactaaagaaagccgtggccacctctgataagctagccacagctgagctcaccattgccaaagaccagctgaagtcccttcatggaactgttatgaaaattaaccaggagcgagcagaggagttgcaggaagcagagaggttcagcagaaaggcagcacaagcagccagagatctcacccgagcagaagctgagatcgaactcctgcagaatctcctcaggcagaagggggagcagtttcgacttgagatggagaaaacaggtgtaggtactggagcaaactcacaggtcctagaaattgagaaactgaatgagacaatggaacgacaaaggacagagattgcaaggctgcagaatgtactagacctcactggaagtgacaacaaaggaggctttgaaaatgttttagaagaaattgctgaacttcgacgtgaagtttcttatcagaatgattacataagcagcatggcagatcctttcaaaagacgaggctattggtactttatgccaccaccaccatcatcaaaagtttccagccatagttcccaggccaccaaggactctggtgttggccttaagtactcagcctcaactcctgttagaaaaccacgccctgggcagcaggatgggaaggaaggcagtcaacctccccctgcctcaggatactgggtttattctcccatcaggagtgggttacataaactgtttccaagtagagatgcagacagtggaggagatagtcaggaagagagtgagctggatgaccaagaagaacccccatttgtgcctcctcctggatacatgatgtatactgtgcttcctgatggttctcctgtaccccagggcatggccctgtatgcaccacctcctcccttgccaaacaatagccgacctctcacccctggcactgttgtttatggcccacctcctgctggggcccccatggtgtatgggcctccaccccccaacttctccatccccttcatccctatgggtgtgctgcattgcaacgtccctgaacaccataacttagagaatgaagtttctagattagaagacataatgcagcatttaaaatcaaagaagcgggaagaaaggtggatgagagcatccaagcggcagtcggagaaagaaatggaagaactgcatcataatattgatgatcttttgcaagagaagaaaagcttagagtgtgaagtagaagaattacatagaactgtccagaaacgtcaacagcaaaaggacttcattgatggaaatgttgagagtcttatgactgaactagaaatagaaaaatcactcaaacatcatgaagatattgtagatgaaattgagtgcattgagaagactcttctgaaacgtcgctcagagctcagggaagctgaccgactcctggcagaggctgagagtgaactttcatgcactaaagaaaagacaaaaaatgctgttgaaaagttcactgatgccaagagaagtttattgcaaactgagtcagatgctgaggaattagaaaggagagctcaggaaactgctgttaacctcgtcaaagctgatcagcagctaagatcgctccaggctgatgcaaaggatttggagcagcacaaaatcaagcaagaagaaatcttgaaagaaataaacaaaattgtagcagcaaaagactcagacttccaatgtttaagcaagaagaaggaaaaactgacagaagagcttcagaaactacagaaagacatagagatggcagaacgcaatgaggatcaccacctgcaggtccttaaagaatctgaggtgcttcttcaggccaaaagagccgagctggaaaagctgaaaagccaggtgacaagtcagcagcaggagatggctgtcttggacaggcagttagggcataaaaaggaggagctgcatctactccaaggaagcatggtccaggcaaaagctgacctccaggaagctctgagactgggagagactgaagtaactgagaagtgcaatcacattagggaagtaaaatctcttctggaagaactgagttttcagaaaggagaactaaatgttcagattagtgaaagaaaaactcaacttacacttataaagcaggaaattgaaaaagaggaagaaaatcttcaggttgttttaaggcagatgtctaaacataaaaccgaactaaagaatattctggacatgttgcaacttgaaaaccatgagctacaaggtttgaagctacaacatgaccaaagggtatctgaattagagaagactcaggtggcagtgctagaggagaaactggagttagagaatttgcagcagatatcccagcagcagaaaggggaaatagagtggcagaagcagctccttgagagggataaacgagaaatagaacgaatgactgctgagtcccgagctttacaatcgtgtgttgagtgtttgagcaaagaaaaggaagatctccaagagaaatgtgacatttgggaaaaaaagttggcacaaaccaaaagggttttagcagcagcagaagaaaatagcaaaatggagcaatcaaacttagaaaagttggaattgaatgtcagaaaactgcagcaggaactagaccaactaaacagagacaagttgtcactgcataacgacatttcagcaatgcaacagcagctccaagaaaaacgagaagcagtaaactcactgcaggaggaactagctaatgtccaagaccatttgaacctagcaaaacaggacctgcttcacaccaccaagcatcaggatgtgttgctcagtgagcagacccgactccagaaggacatcagtgaatgggcaaataggtttgaagactgtcagaaagaagaggagacaaaacaacaacaacttcaagtgcttcagaatgagattgaagaaaacaagctcaaactagtccaacaagaaatgatgtttcagagactccagaaagagagagaaagtgaagaaagcaaattagaaaccagtaaagtgacactgaaggagcaacagcaccagctggaaaaggaattaacagaccagaaaagcaaactggaccaagtgctctcaaaggtgctggcagctgaagagcgtgttaggactctgcaggaagaggagaggtggtgtgagagcctggagaagacactctcccaaactaaacggcagctttcagaaagggagcagcaattggtggagaaatcaggtgagctgttggccctccagaaagaggcagattctatgagggcagacttcagccttctgcggaaccagttcttgacagaaagaaagaaagctgagaagcaggtggccagcctgaaggaagcacttaagatccagcggagccagctggagaaaaaccttcttgagcaaaaacaggagaacagctgcatacaaaaggaaatggcaacaattgaactggtagcccaggacaaccatgagcgggccaggcgcctgatgaaggagctcaaccagatgcagtatgagtacacggagctcaagaaacagatggcaaaccaaaaagatttggagagaagacaaatggaaatcagtgatgcaatgaggacacttaaatctgaggtgaaggatgaaatcagaaccagcttgaagaatcttaatcagtttcttccagaactaccagcagatctagaagctattttggaaagaaacgaaaacctagaaggagaattggaaagcttgaaagagaaccttccatttaccatgaatgagggaccttttgaagaaaaactgaacttttcccaagttcacataatggatgaacactggcgtggagaagcactccgggagaaactgcgtcaccgggaagaccgactcaaggcccaactccgacactgtatgtccaagcaagcagaagtattaattaaaggaaagcggcagacagagggcactttacacagtttgaggagacaagtagatgctttaggggaattggtcaccagcacctctgcagattcagcgtcatcacccagtctgtctcagctggagtcttccctcacagaggactctcaacttggacaaaatcaggaaaagaatgcctcagccagatgaggaatactgtcttgtgtaaatatattcaaggaaaacacctccactacctcactgacttcataattggaatgtcacatggtttttttaatcaagatgcagtgaactgagattctgaaactccactgtagtttactttgcctgtaccattaatgccaatgtttttataaatcacttgtacatagtacatatgggaatagttgcatatgggaatttaaaccaacatgtggctgagcctttttttttttaatcttcgtaacatgtttaaaaaaaaacagtgattttaactgcatatttgaacctacaaactggtaaatcttattaacaaaaagaatgtacttaaggccctctttatttatagtgtcgagttatttttgaattttgcttaaaatctatttttcatatgaaaataaaagataacaatcaa

SEQ ID NO: 1874 - DNA, 3137 bp, Homo sapiens
ctaaaacagaagaccatagaattaacacgagcatgtcagaagcaatatgagctggaacaggaattggccttttataaaattgatgctaaatttgagccactaaattattatccatcagagtatgctgaaattgataaagccccagatgaaagcccttacattggcaaatccagatacaagagaaatatgtttgccacagagagttatattattgacagtgctcaggcagtacagatcaagaagatggagccagatgaacaacttagaaatgatcacatgaacttgagaggccacacaccactggacacgcaactggaagacaaagaaaaaaaaataagtgcagcacaaactcgactatcagaactgcatgatgaaatagaaaaggcagaacaacaaattttgagagctactgaagaatttaaacaactggaagaagctatacaactaaaaaagattagatttcagaagcagggaaagaccttctttacaagcagttgagtggtagactacaacttgtaaataaattacgccaggaagctctggatctagaactgcagatggaaaagcaaaagcaggaaattgccggaaagcagaaggagattaaggacctgcaaatagccatagatagcctggattccaaagacccaaaacattcccatatgaaggctcaaaagagcggtaaagaacaacagcttgacattatgaacaagcagtaccaacaacttgaaagtcgtttggatgagatactttctagaattgctaaggaaacggaagagattaaggaccttgaagaacagcttactgaaggccagatagcagcaaatgaagccctgaagaaggatttagaaggtgttatcagtgggttgcaagaatacctggggaccattaaaggccaggcaactcaggcccagaatgagtgcaggaagctgcgggatgagaaagagacattgttgcagagattgacagaagtcgagcaggagagagaccagctggaaatagttgccatggatgcagaaaatatgaggaaggagcttgcagagctagaaagtgccctccaagagcagcatgaggtgaatgcatctttgcagcagacccagggagatctcagtgcctatgaagctgagctagaggctcggctaaacctaagggatgctgaagccaaccagctcaaggaagagttggaaaaagtaacaagacttacccagttagaacaatcagcccttcaagcagaacttgagaaggaaaggcaagccctcaagaatgcccttggaaaagcccagttctcagaagaaaaggagcaagagaacagtgagctccatgcaaaacttaaacacttgcaggatgacaataatctgttaaaacagcaacttaaagatttccagaatcaccttaaccatgtggttgatggtttggttcgtccagaagaagtggcagctcgtgtggatgagctaagaagaaaactgaaattaggaactggggaaatgaacatccatagtccttcagatgtcttagggaaaagtcttgctgatttacagaaacaattcagtgaaattcttgcacgctccaagtgggaaagagatgaagcacaagttagagagagaaaactccaagaagaaatggctctgcagcaagagaaactggcaactggacaagaagagttcaggcaggcctgtgagagagccctggaagcaagaatgaattttgataagaggcaacatgaagcaagaatccagcaaatggagaatgaaattcactatttgcaagaaaatctaaaaagtatggaggaaatccaaggccttacagatctccaacttcaggaagctgatgaagagaaggagagaattctggcccaactccgagagttagagaaaaagaagaaacttgaagatgccaaatctcaggagcaagtttttggtttagataaagaactgaagaaactaaagaaagccgtggccacctctgataagctagccacagctgagctcaccattgccaaagaccagctgaagtcccttcatggaactgttatgaaaattaaccaggagcgagcagaggagttgcaggaagcagagaggttcagcagaaaggcagcacaagcagccagagatctcacccgagcagaagctgagatcgaactcctgcagaatctcctcaggcagaagggggagcagtttcgacttgagatggagaaaacaggtgtaggtactggagcaaactcacaggtcctagaaattgagaaactgaatgagacaatggaacgacaaaggacagagattgcaaggctgcagaatgtactagacctcactggaagtgacaacaaaggaggctttgaaaatgttttagaagaaattgctgaacttcgacgtgaagtttcttatcagaatgattacataagcagcatggcagatcctttcaaaagacgaggctattggtactttatgccaccaccaccatcatcaaaagtttccagccatagttcccaggccaccaaggactctggtgttggccttaagtactcagcctcaactcctgttagaaaaccacgccctgggcagcaggatgggaaggaaggcagtcaacctccccctgcctcaggatactgggtttattctcccatcaggagtgggttacataaactgtttccaagtagagatgcagacagtggaggagatagtcaggaagagagtgagctggatgaccaagaagaacccccatttgtgcctcctcctggatacatgatgtatactgtgcttcctgatggttctcctgtaccccagggcatggccctgtatgcaccacctcctcccttgccaaacaatagccgacctctcacccctggcactgttgtttatggcccacctcctgctggggcccccatggtgtatgggcctccaccccccaacttctccatccccttcatccctatgggtgtgctgcattgcaacgtccctgaacaccataacttagtaagtggaaagacatacaactctctttccacactgcttccatgggtgactgataaggttatatacttaatgagttgacctatttatgactggattatatggcaaagtgtgtttgtaaggctgatgtttagaactgtgcaagcattctcttattaaaattctcttataaaa

SEQ ID NO: 1875 - DNA, 7660 bp, Homo sapiens
cgaacttctcccgctctacctcagcctgcgggactgctcggctcggcttctaggcgagacaggggctccctgtgtttcccaggctgcagtgcagtggccagtcacaaggttgatcatagcacattgtagcctggagctcctgggatcaagcaatcctcctgcctcatcctctggagtaactgggactgcaagtatacataccgtgcctgacgaaatatcacaatatttggttttgatgaacacctggctttattcttgcaatgaagaaaggttctcaacaaaaaatattctccaaagcaaagataccatcatcatctcactctcctatcccatcatctatgtccaatatgagatctaggtcactttcacctttgattggatcagagactctaccttttcattctggaggacagtggtgtgagcaagttgagattgcagatgaaaacaatatgcttttggactatcaagaccataaaggagctgattcacatgcaggagttagatatattacagaggccctcattaaaaaacttactaaacaggataatttggctttgataaaatctctgaacctttcactttctaaagacggtggcaagaaatttaagtatattgagaatttggaaaaatgtgttaaacttgaagtactgaatctcagctataatctaatagggaagattgaaaagttggacaagctgttaaaattacgtgaactcaacttatcatataacaaaatcagcaaaattgaaggcatagaaaatatgtgtaatctgcaaaagcttaaccttgcaggaaatgaaattgagcatattccagtatggttagggaagaagttaaaatctttgcgagtcctcaatttgaaaggcaacaagatatcatcgctccaagatataagcaagttgaaaccgcttcaagatttgatttctctgatcctagttgaaaatccagttgtgacccttcctcattacctccagtttaccattttccacctccgttcattggaaagtttggaaggtcagccagtaaccactcaggatagacaggaggcttttgagagattcagtttagaagaggtagaaagactggaaagagacctagaaaaaaagatgatagaaactgaagagcttaagagcaaacaaacaaggttccttgaggaaattaaaaatcaagataaattgaataaatcattaaaagaggaggccatgttacagaaacagagctgtgaggaactcaagagtgacttaaacacaaaaaatgaattgctaaaacagaagaccatagaattaacacgagcatgtcagaagcaatatgagctggaacaggaattggccttttataaaattgatgctaaatttgagccactaaattattatccatcagagtatgctgaaattgataaagccccagatgaaagcccttacattggcaaatccagatacaagagaaatatgtttgccacagagagttatattattgacagtgctcaggcagtacagatcaagaagatggagccagatgaacaacttagaaatgatcacatgaacttgagaggccacacaccactggacacgcaactggaagacaaagaaaaaaaaataagtgcagcacaaactcgactatcagaactgcatgatgaaatagaaaaggcagaacaacaaattttgagagctactgaagaatttaaacaactggaagaagctatacaactaaaaaagatttcagaagcagggaaagaccttctttacaagcagttgagtggtagactacaacttgtaaataaattacgccaggaagctctggatctagaactgcagatggaaaagcaaaagcaggaaattgccggaaagcagaaggagattaaggacctgcaaatagccatagatagcctggattccaaagacccaaaacattcccatatgaaggctcaaaagagcggtaaagaacaacagcttgacattatgaacaagcagtaccaacaacttgaaagtcgtttggatgagatactttctagaattgctaaggaaacggaagagattaaggaccttgaagaacagcttactgaaggccagatagcagcaaatgaagccctgaagaaggatttagaaggtgttatcagtgggttgcaagaatacctggggaccattaaaggccaggcaactcaggcccagaatgagtgcaggaagctgcgggatgagaaagagacattgttgcagagattgacagaagtcgagcaggagagagaccagctggaaatagttgccatggatgcagaaaatatgaggaaggagcttgcagagctagaaagtgccctccaagagcagcatgaggtgaatgcatctttgcagcagacccagggagatctcagtgcctatgaagctgagctagaggctcggctaaacctaagggatgctgaagccaaccagctcaaggaagagttggaaaaagtaacaagacttacccagttagaacaatcagcccttcaagcagaacttgagaaggaaaggcaagccctcaagaatgcccttggaaaagcccagttctcagaagaaaaggagcaagagaacagtgagctccatgcaaaacttaaacacttgcaggatgacaataatctgttaaaacagcaacttaaagatttccagaatcaccttaaccatgtggttgatggtttggttcgtccagaagaagtggcagctcgtgtggatgagctaagaagaaaactgaaattaggaactggggaaatgaacatccatagtccttcagatgtcttagggaaaagtcttgctgatttacagaaacaattcagtgaaattcttgcacgctccaagtgggaaagagatgaagcacaagttagagagagaaaactccaagaagaaatggctctgcagcaagagaaactggcaactggacaagaagagttcaggcaggcctgtgagagagccctggaagcaagaatgaattttgataagaggcaacatgaagcaagaatccagcaaatggagaatgaaattcactatttgcaagaaaatctaaaaagtatggaggaaatccaaggccttacagatctccaacttcaggaagctgatgaagagaaggagagaattctggcccaactccgagagttagagaaaaagaagaaacttgaagatgccaaatctcaggagcaagtttttggtttagataaagaactgaagaaactaaagaaagccgtggccacctctgataagctagccacagctgagctcaccattgccaaagaccagctgaagtcccttcatggaactgttatgaaaattaaccaggagcgagcagaggagttgcaggaagcagagaggttcagcagaaaggcagcacaagcagccagagatctcacccgagcagaagctgagatcgaactcctgcagaatctcctcaggcagaagggggagcagtttcgacttgagatggagaaaacaggtgtaggtactggagcaaactcacaggtcctagaaattgagaaactgaatgagacaatggaacgacaaaggacagagattgcaaggctgcagaatgtactagacctcactggaagtgacaacaaaggaggctttgaaaatgttttagaagaaattgctgaacttcgacgtgaagtttcttatcagaatgattacataagcagcatggcagatcctttcaaaagacgaggctattggtactttatgccaccaccaccatcatcaaaagtttccagccatagttcccaggccaccaaggactctggtgttggccttaagtactcagcctcaactcctgttagaaaaccacgccctgggcagcaggatgggaaggaaggcagtcaacctccccctgcctcaggatactgggtttattctcccatcaggagtgggttacataaactgtttccaagtagagatgcagacagtggaggagatagtcaggaagagagtgagctggatgaccaagaagaacccccatttgtgcctcctcctggatacatgatgtatactgtgcttcctgatggttctcctgtaccccagggcatggccctgtatgcaccacctcctcccttgccaaacaatagccgacctctcacccctggcactgttgtttatggcccacctcctgctggggcccccatggtgtatgggcctccaccccccaacttctccatccccttcatccctatgggtgtgctgcattgcaacgtccctgaacaccataacttagagaatgaagtttctagattagaagacataatgcagcatttaaaatcaaagaagcgggaagaaaggtggatgagagcatccaagcggcagtcggagaaagaaatggaagaactgcatcataatattgatgatcttttgcaagagaagaaaagcttagagtgtgaagtagaagaattacatagaactgtccagaaacgtcaacagcaaaaggacttcattgatggaaatgttgagagtcttatgactgaactagaaatagaaaaatcactcaaacatcatgaagatattgtagatgaaattgagtgcattgagaagactcttctgaaacgtcgctcagagctcagggaagctgaccgactcctggcagaggctgagagtgaactttcatgcactaaagaaaagacaaaaaatgctgttgaaaagttcactgatgccaagagaagtttattgcaaactgagtcagatgctgaggaattagaaaggagagctcaggaaactgctgttaacctcgtcaaagctgatcagcagctaagatcgctccaggctgatgcaaaggatttggagcagcacaaaatcaagcaagaagaaatcttgaaagaaataaacaaaattgtagcagcaaaagactcagacttccaatgtttaagcaagaagaaggaaaaactgacagaagagcttcagaaactacagaaagacatagagatggcagaacgcaatgaggatcaccacctgcaggtccttaaagaatctgaggtgcttcttcaggccaaaagagccgagctggaaaagctgaaaagccaggtgacaagtcagcagcaggagatggctgtcttggacaggcagttagggcataaaaaggaggagctgcatctactccaaggaagcatggtccaggcaaaagctgacctccaggaagctctgagactgggagagactgaagtaactgagaagtgcaatcacattagggaagtaaaatctcttctggaagaactgagttttcagaaaggagaactaaatgttcagattagtgaaagaaaaactcaacttacacttataaagcaggaaattgaaaaagaggaagaaaatcttcaggttgttttaaggcagatgtctaaacataaaaccgaactaaagaatattctggacatgttgcaacttgaaaaccatgagctacaaggtttgaagctacaacatgaccaaagggtatctgaattagagaagactcaggtggcagtgctagaggagaaactggagttagagaatttgcagcagatatcccagcagcagaaaggggaaatagagtggcagaagcagctccttgagagggataaacgagaaatagaacgaatgactgctgagtcccgagctttacaatcgtgtgttgagtgtttgagcaaagaaaaggaagatctccaagagaaatgtgacatttgggaaaaaaagttggcacaaaccaaaagggttttagcagcagcagaagaaaatagcaaaatggagcaatcaaacttagaaaagttggaattgaatgtcagaaaactgcagcaggaactagaccaactaaacagagacaagttgtcactgcataacgacatttcagcaatgcaacagcagctccaagaaaaacgagaagcagtaaactcactgcaggaggaactagctaatgtccaagaccatttgaacctagcaaaacaggacctgcttcacaccaccaagcatcaggatgtgttgctcagtgagcagacccgactccagaaggacatcagtgaatgggcaaataggtttgaagactgtcagaaagaagaggagacaaaacaacaacaacttcaagtgcttcagaatgagattgaagaaaacaagctcaaactagtccaacaagaaatgatgtttcagagactccagaaagagagagaaagtgaagaaagcaaattagaaaccagtaaagtgacactgaaggagcaacagcaccagctggaaaaggaattaacagaccagaaaagcaaactggaccaagtgctctcaaaggtgctggcagctgaagagcgtgttaggactctgcaggaagaggagaggtggtgtgagagcctggagaagacactctcccaaactaaacggcagctttcagaaagggagcagcaattggtggagaaatcaggtgagctgttggccctccagaaagaggcagattctatgagggcagacttcagccttctgcggaaccagttcttgacagaaagaaagaaagctgagaagcaggtggccagcctgaaggaagcacttaagatccagcggagccagctggagaaaaaccttcttgagcaaaaacaggagaacagctgcatacaaaaggaaatggcaacaattgaactggtagcccaggacaaccatgagcgggccaggcgcctgatgaaggagctcaaccagatgcagtatgagtacacggagctcaagaaacagatggcaaaccaaaaagatttggagagaagacaaatggaaatcagtgatgcaatgaggacacttaaatctgaggtgaaggatgaaatcagaaccagcttgaagaatcttaatcagtttcttccagaactaccagcagatctagaagctattttggaaagaaacgaaaacctagaaggagaattggaaagcttgaaagagaaccttccatttaccatgaatgagggaccttttgaagaaaaactgaacttttcccaagttcacataatggatgaacactggcgtggagaagcactccgggagaaactgcgtcaccgggaagaccgactcaaggcccaactccgacactgtatgtccaagcaagcagaagtattaattaaaggaaagcggcagacagagggcactttacacagtttgaggagacaagtagatgctttaggggaattggtcaccagcacctctgcagattcagcgtcatcacccagtctgtctcagctggagtcttccctcacagaggactctcaacttggacaaaatcaggaaaagaatgcctcagccagatgaggaatactgtcttgtgtaaatatattcaaggaaaacacctccactacctcactgacttcataattggaatgtcacatggtttttttaatcaagatgcagtgaactgagattctgaaactccactgtagtttactttgcctgtaccattaatgccaatgtttttataaatcacttgtacatagtacatatgggaatagttgcatatgggaatttaaaccaacatgtggctgagcctttttttttttaatcttcgtaacatgtttaaaaaaaaacagtgattttaactgcatatttgaacctacaaactggtaaatcttattaacaaaaagaatgtacttaaggccctctttatttatagtgtcgagttatttttgaattttgcttaaaatctatttttcatatgaaaataaaagataacaatc

SEQ ID NO: 1876 - DNA, 1894 bp, Homo sapiens
gggaaacgcctccgcgtcccttccaacagtaccggagagggagaggggcgtggctgagactagccccgaccacgcgcgcgcggcccctcggcaaccggcacaacacaacaaaatggctgccgcgccgctgggcccctgaggaaagagcccgaacttctcccgctctacctcagcctgcgggactgctcggctcggcttctaggcggttttgatgaacacctggctttattcttgcaatgaagaaaggttctcaacaaaaaatattctccaaagcaaagataccatcatcatctcactctcctatcccatcatctatgtccaatatgagatctaggtcactttcacctttgattggatcagagactctaccttttcattctggaggacagtggtgtgagcaagttgagattgcagatgaaaacaatatgcttttggactatcaagaccataaaggagctgattcacatgcaggagttagatatattacagaggccctcattaaaaaacttactaaacaggataatttggctttgataaaatctctgaacctttcactttctaaagacggtggcaagaaatttaagtatattgagaatttggaaaaatgtgttaaacttgaagtactgaatctcagctataatctaatagggaagattgaaaagttggacaagctgttaaaattacgtgaactcaacttatcatataacaaaatcagcaaaattgaaggcatagaaaatatgtgtaatctgcaaaagcttaaccttgcaggaaatgaaattgagcatattccagtatggttagggaagaagttaaaatctttgcgagtcctcaatttgaaaggcaacaagatatcatcgctccaagatataagcaagttgaaaccgcttcaagatttgatttctctgatcctagttgaaaatccagttgtgacccttcctcattacctccagtttaccattttccacctccgttcattggaaagtttggaaggtcagccagtaaccactcaggatagacaggaggcttttgagagattcagtttagaagaggtagaaagactggaaagagacctagaaaaaaagatgatagaaactgaagagcttaagagcaaacaaacaaggttccttgaggaaattaaaaatcaagataaattgaataaatcattaaaagaggaggccatgttacagaaacagagctgtgaggaactcaagagtgacttaaacacaaaaaatgaattgctaaaacagaagaccatagaattaacacgagcatgtcagaagcaatatgagctggaacaggaattggccttttataaaattgatgctaaatttgagccactaaattattatccatcagagtatgctgaaattgataaagccccagatgaaagcccttacattggcaaatccagatacaagagaaatatgtttgccacagagagttatattattgacagtgctcaggcagtacagatcaagaagatggagccagatgaacaacttagaaatgatcacatgaacttgagaggccacacaccactggacacgcaactggaagaccacaaactcgactatcagaactgcatgatgaaatagaaaaggcagaacaacaaattttgagagctactgaagaatttaaacaactggaagaagctatacaactaaaaaagatttcagaagcagggaaagaccttctttacaagcagttgagtggtagactacaacttgtaaataaattacgccaggaagctctggatctagaactgcagatggaaaagcaaaagcaggaaattgccggaaagcagaaggagattaaggacctgcaaatagccatagatagcctggattccaaagacccaaaacatgtgagtaaattaagaaattttgacttgttc

SEQ ID NO: 1877 - DNA, 3569 bp, Homo sapiens
gacgaggcgtttccgatctttgccgcagtccggatttcctgggtctctgggcactgaaggggaaatgccctcgggatgtttctagcaacccccttcccccaacacacacacactagttggcattctcttccagaaacttatcattttcttttttaaacctcccatcctcagactccccaaattaacaagtctttttagcctcttggattgggattaggatgacagtttttcagtgagggcgcagaaaaacagtgcatttcagcaccaaggacagacacaatcttcatggttcctgggctctgagtcagactgtcgaaaatattggcctaatatatgtgctgtgattcagactttgtggcgaggaacaaatcacaagacagtggcatagcagagatggaagaacttcctgtaccacataacatcaaaataagcaatataacgtgtgactcattcaagatttcatgggaaatggattcaaaatcaaaggatcgcattacacactattttattgacctcaacaagaaagagaacaagaactccaataaatttaaacacaaggatgttcccacaaaattggtggcaaaagctgttcccttgcctatgactgtccgtggacactggtttttaagcccaagaactgaatatacagtagcagtgcagactgcctcaaaacaagttgatggtgattatgttgtgtctgaatggagtgaaattatagaattctgcaccgcagactattcaaaagttcatctaacacaattgttggagaaggctgaagtgattgcaggacgcatgcttaagttttctgttttttatcgtaatcagcacaaagaatattttgactatgttcgagaacatcatgggaatgctatgcagccatctgtcaaggataacagtggtagccatggctctcctatcagtggaaaattagaaggcatcttcttcagctgcagcactgaattcaatactggaaagccaccccaggattcaccttatggaagatacaggtttgagattgccgcagaaaaactttttaaccccaatactaacttatactttggggacttctactgtatgtacactgcttatcattatgtgattcttgttattgctcctgtgggatcaccaggagatgaattttgtaagcagcgccttcctcaactaaattctaaggataataaatttttgacctgtacagaagaagatggggtgctggtttaccaccatgcccaggatgtcattttagaagtcatttacactgaccctgtggatctttctgtgggcaccgtggcagaaatcactggtcatcagctcatgagtttgtctactgcaaatgcaaagaaagatcccagctgcaaaacctgtaatatcagtgttggacgttaatgcccacttttcttattcttactcagccccttttcctcccttaggagcattggtcctctgttgtccatttttatcaccagatgttttccactgaagcatgcacatgccactgtcaccaaaacaaacaactaccactttccaaatttcattcagaaccattttagtgttttcctattccctacccctcccactactttcaatgatgaaataccctaagttaagttctccttttgacactttattgcctagatgctgcaatgtttttatgtttcctttatgccaaacataacaaaacagttatatagactgctttagcaaagtacacaataatggcttataaatggtgtttaaatatgcattcattttaatctactgaacaaatattgggataactccaaaccgcatgaaagggtgtaattgcagcatgagttaaatcttgaagcctagaattgtcagcacttccaacttcttgtttgacagtgttatttatgttatttatattagctaacaggaaacaactactgtgtttcaacataataaatataatagaaaaatattttatttgtattgttgtataaaatatttacaatcatatagaatatatagagttacattttaatagcaactgtgtacatgtcacgaaaccatttcccttatcaaagatgtaatttgtaaacctcaaatagttgtgtatctgtcctgttagaagtagatgacttcaattaaacaaatttatgaaggacattattctgattcataaaagttataaaatattaggtaaatacagagaaaacaataagcctctgaaataagtctgtttctgaaatagtcaatagtcttcccatccaaactataagagaatgtgaatttcttcaacatcatacttaaacattacagaaaatagaaatacaaacaaggttggtacatgagagaaaatgttgaccttttacttccttttacaaaaatgaaaataataaacatgttttcgtataaaataacacaaaatgatatacactgaagttgatgaagcaaataaatattctggcttctttttcaaggtatcagggcaaacaatttccaaacttttcattttgtacagaaggatgaataactacagctcatgggaaatgttttgactttacaaagtatagatgttggaacattaagaaaaatgtatattcccaatgaaaaaatagttatatcatcttatagtaaaccaaaagattagcaataatactatggacacattagattatatactacagacacatatctatccaaaatacctattttaaatttttaatacaatattttattttaatataaacatctgtcagttatagacaaagataataattcacaaagtacatgctatcagaatgaactttggtaaccagaaatgtaaaatttcaaataacggataaaataatgtgttatttttatagagaaagaaaaaaatagcaacacaatctagtttattttagggtactgagagcctagcagacttaaaggacaaggtagtaaatgttttatcactcaaaaatccattagaagtttcaaataaattgctttcttgctagctgtattccttcctacttgaaaagcgaatttcttttcctcctatgattgattttttaaaatcatgctcttttccatacatcaacataaacagtctttggatactaaataaactttccctaacaagtgtcctagctatgttatttagatttgataaaatattagacatttttaaaaatacttgtattgactatgagttttctgcttggcatggaggacactgaattttttcccaattatatggctacctgttgtattcttccccccgtttaaatcccttctccttgtatataattaaacttgctattccttcttaaaaacagctaatactaccactaaagtgcttccattttcattgtgtcaaaactacttagcaaggatggcagaggaaaataaactttactttatatcatgggtgaaagtgatcataacatttcctgaacctcaaatagttttggccacatcttgcttgctgatgaggacctctaatagtctcagtttggcttttatgtgcttatattcataatactcatctgccattggtatcctatcttccttttgtggacttctgcaaaacaaaaatacatttgttagttcacaatgaa

SEQ ID NO: 1878 - DNA, 3578 bp, Homo sapiens
cccgccgggagcgcgcgcctcccatcctcgcgccgggtcctgctcggtctctcagagccgcacactccgcggagctcctgccacagccgtcgccttcgcggcggctctccagccccgcgcctcagcctcggcgccgcatcaccgcgtcccaggcctccttccctccctctgccactccccctccctttcccgctcttcttgcccacccggccggcagagagagcctggatacgaagcaggcgggcttcagagtgggttggaaaaatggaggtgccgcgcctggatcatgccctcaacagccccaccagcccctgtgaggaggtgatcaaaaacctcagcctggaggccattcagctgtgcgaccgggacgggaacaaatcacaagacagtggcatagcagagatggaagaacttcctgtaccacataacatcaaaataagcaatataacgtgtgactcattcaagatttcatgggaaatggattcaaaatcaaaggatcgcattacacactattttattgacctcaacaagaaagagaacaagaactccaataaatttaaacacaaggatgttcccacaaaattggtggcaaaagctgttcccttgcctatgactgtccgtggacactggtttttaagcccaagaactgaatatacagtagcagtgcagactgcctcaaaacaagttgatggtgattatgttgtgtctgaatggagtgaaattatagaattctgcaccgcagactattcaaaagttcatctaacacaattgttggagaaggctgaagtgattgcaggacgcatgcttaagttttctgttttttatcgtaatcagcacaaagaatattttgactatgttcgagaacatcatgggaatgctatgcagccatctgtcaaggataacagtggtagccatggctctcctatcagtggaaaattagaaggcatcttcttcagctgcagcactgaattcaatactggaaagccaccccaggattcaccttatggaagatacaggtttgagattgccgcagaaaaactttttaaccccaatactaacttatactttggggacttctactgtatgtacactgcttatcattatgtgattcttgttattgctcctgtgggatcaccaggagatgaattttgtaagcagcgccttcctcaactaaattctaaggataataaatttttgacctgtacagaagaagatggggtgctggtttaccaccatgcccaggatgtcattttagaagtcatttacactgaccctgtggatctttctgtgggcaccgtggcagaaatcactggtcatcagctcatgagtttgtctactgcaaatgcaaagaaagatcccagctgcaaaacctgtaatatcagtgttggacgttaatgcccacttttcttattcttactcagccccttttcctcccttaggagcattggtcctctgttgtccatttttatcaccagatgttttccactgaagcatgcacatgccactgtcaccaaaacaaacaactaccactttccaaatttcattcagaaccattttagtgttttcctattccctacccctcccactactttcaatgatgaaataccctaagttaagttctccttttgacactttattgcctagatgctgcaatgtttttatgtttcctttatgccaaacataacaaaacagttatatagactgctttagcaaagtacacaataatggcttataaatggtgtttaaatatgcattcattttaatctactgaacaaatattgggataactccaaaccgcatgaaagggtgtaattgcagcatgagttaaatcttgaagcctagaattgtcagcacttccaacttcttgtttgacagtgttatttatgttatttatattagctaacaggaaacaactactgtgtttcaacataataaatataatagaaaaatattttatttgtattgttgtataaaatatttacaatcatatagaatatatagagttacattttaatagcaactgtgtacatgtcacgaaaccatttcccttatcaaagatgtaatttgtaaacctcaaatagttgtgtatctgtcctgttagaagtagatgacttcaattaaacaaatttatgaaggacattattctgattcataaaagttataaaatattaggtaaatacagagaaaacaataagcctctgaaataagtctgtttctgaaatagtcaatagtcttcccatccaaactataagagaatgtgaatttcttcaacatcatacttaaacattacagaaaatagaaatacaaacaaggttggtacatgagagaaaatgttgaccttttacttccttttacaaaaatgaaaataataaacatgttttcgtataaaataacacaaaatgatatacactgaagttgatgaagcaaataaatattctggcttctttttcaaggtatcagggcaaacaatttccaaacttttcattttgtacagaaggatgaataactacagctcatgggaaatgttttgactttacaaagtatagatgttggaacattaagaaaaatgtatattcccaatgaaaaaatagttatatcatcttatagtaaaccaaaagattagcaataatactatggacacattagattatatactacagacacatatctatccaaaatacctattttaaatttttaatacaatattttattttaatataaacatctgtcagttatagacaaagataataattcacaaagtacatgctatcagaatgaactttggtaaccagaaatgtaaaatttcaaataacggataaaataatgtgttatttttatagagaaagaaaaaaatagcaacacaatctagtttattttagggtactgagagcctagcagacttaaaggacaaggtagtaaatgttttatcactcaaaaatccattagaagtttcaaataaattgctttcttgctagctgtattccttcctacttgaaaagcgaatttcttttcctcctatgattgattttttaaaatcatgctcttttccatacatcaacataaacagtctttggatactaaataaactttccctaacaagtgtcctagctatgttatttagatttgataaaatattagacatttttaaaaatacttgtattgactatgagttttctgcttggcatggaggacactgaattttttcccaattatatggctacctgttgtattcttccccccgtttaaatcccttctccttgtatataattaaacttgctattccttcttaaaaacagctaatactaccactaaagtgcttccattttcattgtgtcaaaactacttagcaaggatggcagaggaaaataaactttactttatatcatgggtgaaagtgatcataacatttcctgaacctcaaatagttttggccacatcttgcttgctgatgaggacctctaatagtctcagtttggcttttatgtgcttatattcataatactcatctgccattggtatcctatcttccttttgtggacttctgcaaaacaaaaatacatttgttagttcacaatgaa

SEQ ID NO: 1879 - DNA, 1501 bp, Homo sapiens
cgggcggcagagctggagtgaagggagctagtggtagcagtcaccattatgctcaaagcggtgatcctgattggaggccctcaaaagggaactcgcttcagacctttgtcttttgaggtgcccaaaccattgtttcctgtggcaggggtccctatgatccaacaccatattgaagcctgtgcccaggtccctggaatgcaggagattctgctcattggcttctaccaacctgatgagcccctcacccagttcctagaagccgcccagcaggagtttaaccttccagtcaggtacctgcaggaatttgcccccctaggcacagggggtggtctttaccattttcgagaccagatcctggctgggagccccgaggcattcttcgtgctcaatgctgatgtctgctccgacttccccttgagtgctatgttggaagcccaccgacgccagcgtcaccctttcttactccttggcactacggctaacaggacgcaatccctcaactacggctgcatcgttgagaatccacagacacacgaggtattgcactatgtggagaaacccagcacatttatcagtgacatcatcaactgcggcatctacctcttttctcctgaagccttgaagcctcttcgggatgtcttccagcgtaatcagcaggatgggcaattggaggactcaccaggcttgtggccaggggcaggtaccatccgcctagagcaggatgtgttttcagccctggcagggcagggccagatatacgtgcatctcactgatggtatctggagtcagatcaagtccgcaggttcagccctctacgcctcccgcctctacctgagccgataccaggacactcacccagaacggctggccaagcacaccccagggggcccatggatccgagggaatgtgtacatccacccgaccgccaaggtggccccctcggctgtgctgggccccaacgtctccatcgggaagggggtgaccgtgggtgagggtgtgcggctccgggagagcatcgtcctccatggagccactttgcaggagcacacgtgtgttctgcatagcatcgtgggctgggggagcaccgtgggacgctgggcccgcgtggagggtacccccagtgaccctaaccccaacgatccccgagcccgcatggacagtgagagcctcttcaaggacgggaagctgctgcctgctatcaccatcctgggctgccgagtccggatccctgccgaggtgctcatcctgaactcgattgttctgccacacaaggagctgagccgaagcttcaccaaccagatcatcctctgagtagggctgccagaaggcccccagctcctacccactccccttgaggctgctgcctgcttggccagcctctgtccagaaaggaccagagaaagccaggctggatcgtcacatgccggggagcaatgtggatggcctggggactcctgggttttctccctcccgactccctaataaaccccgtgaaccttgg

SEQ ID NO: 1880 - DNA, 1242 bp, Homo sapiens
gatccactgagctggctctcgggtccctggggacaggtacctgcaggaatttgcccccctaggcacagggggtggtaccattttcgagaccagatcctggctgggagccccgaggcattcttcgtgctcaatgctgatgtctgctccgacttccccttgagtgctatgttggaagcccaccgacgccagcgtcaccctttcttactccttggcactacggctaacaggacgcaatccctcaactacggctgcatcgttgagaatccacagacacacgaggtattgcactatgtggagaaacccagcacatttatcagtgacatcatcaactgcggcatctacctcttttctcctgaagccttgaagcctcttcgggatgtcttccagcgtaatcagcaggatgggcaattggaggactcaccaggcttgtggccaggggcaggtaccatccgcctagagcaggatgtgttttcagccctggcagggcagggccagatatacgtgcatctcactgatggtatctggagtcagatcaagtccgcaggttcagccctctacgcctcccgcctctacctgagccgataccaggacactcacccagaacggctggccaagcacaccccagggggcccatggatccgagggaatgtgtacatccacccgaccgccaaggtggccccctcggctgtgctgggccccaacgtctccatcgggaagggggtgaccgtgggtgagggtgtgcggctccgggagagcatcgtcctccatggagccactttgcaggagcacacgtgtgttctgcatagcatcgtgggctgggggagcaccgtgggacgctgggcccgcgtggagggtacccccagtgaccctaaccccaacgatccccgagcccgcatggacagtgagagcctcttcaaggacgggaagctgctgcctgctatcaccatcctgggctgccgagtccggatccctgccgaggtgctcatcctgaactcgattgttctgccacacaaggagctgagccgaagcttcaccaaccagatcatcctctgagtagggctgccagaaggcccccagctcctacccactccccttgaggctgctgcctgcttggccagcctctgtccagaaaggaccagagaaagccaggctggatcgtcacatgccggggagcaatgtggatggcctggggactcctgggttttctccctcccgactccctaataaaccccgtgaaccttg

SEQ ID NO: 1881 - DNA, 1940 bp, Homo sapiens
agcaccggaagccgctcccctgtgaggctgcggaccgggagcagcggccgcaggtccgggcgccatggctgcggagcggacccggccgctgcaaggctctggcggtccgagcgtgcctagtagctgtgaacccggcgcgaggtcccgggccccggggcgctcgctcaggtaaatttttccataaccttatggagagaaaggactttgagacatggcttgataacatttctgttacatttctttctctgacggacttgcagaaaaatgaaactctggatcacctgattagtctgagtggggcagtccagctcaggcatctctccaataacctagagactctcctcaagcgggacttcctcaaactccttcccctggagctcagtttttatttgttaaaatggctcgatcctcagactttactcacatgctgcctcgtctctaaacagtggaataaggtgataagtgcctgtacagaggtgtggcagactgcatgtaaaaatttgggctggcagatagatgattctgttcaggacgctttgcactggaagaaggtttatttgaaggctattttgagaatgaagcaactggaggaccatgaagcctttgaaacctcgtcattaattggacacagtgccagagtgtatgcactttactacaaagatggacttctctgtacagggtcagatgacttgtctgcaaagctgtgggatgtgagcacagggcagtgcgtttatggcatccagacccacacttgtgcagcggtgaagtttgatgaacagaagcttgtgacaggctcctttgacaacactgtggcttgctgggaatggagttccggagccaggacccagcactttcgggggcacacgggggcggtatttagcgtggactacaatgatgaactggatatcttggtgagcggctctgcagacttcactgtgaaagtatgggctttatctgctgggacatgcctgaacacactcaccgggcacacggaatgggtcaccaaggtagttttgcagaagtgcaaagtcaagtctctcttgcacagtcctggagactacatcctcttaagtgcagacaaatatgagattaagatttggccaattgggagagaaatcaactgtaagtgcttaaagacattgtctgtctctgaggatagaagtatctgcctgcagccaagacttcattttgatggcaaatacattgtctgtagttcagcacttggtctctaccagtgggactttgccagttatgatattctcagggtcatcaagactcctgagatagcaaacttggccttgcttggctttggagatatctttgccctgctgtttgacaaccgctacctgtacatcatggacttgcggacagagagcctgattagtcgctggcctctgccagagtacaggaaatcaaagagaggctcaagcttcctggcaggcgaagcatcctggctgaatggactggatgggcacaatgacacgggcttggtctttgccaccagcatgcctgaccacagtattcacctggtgttgtggaaggagcacggctgacaccatgagccaccaccgctgactgactttgggtgccggggctgcgggttttgggtgcaacctctgcggcagccgactgcatgaaccaaagttctcacctaatggtatcatcacgcagtgcacaatcatttatctatgttttgccaggggccagggctcggggtgggggagggcttgttttattgacatacaacgcagcatgctaatggggtacaccattgacttcatttgtacttagttatgttggtcagtgttagaggatgcattttgggttcatctttcttgagtggagtattggttttaagtaaagaaagttaaatgatccattaatctgctaattggttgcctatgaaatcacattgtctgttattaaagctttttaccata

SEQ ID NO: 1882 - DNA, 663 bp, Homo sapiens
ggaaagatggaggcagcggagacagaggcggaagctgcagccctagaggtcctggctgaggtggcaggcatcttggaacctgtaggcctgcaggaggaggcagaactgccagccaagatcctggttgagtttgtggtggactctcagaagaaagacaagctgctctgcagccagcttcaggtagcggatttcctgcagaacatcctggctcaggagagaccctggtgtgtccttcaaggctgttggtctacaacctgctggagatgtaaatttgccatgacttcctggaggacagcagcatggagaaagatcctagaaaaggcctctgacttccctcacctcccaaccatcattacaggaaagactgtgaactcctgagttcagcttgatttctgactacatcccagcaagctctggcatctgtggattaaaatccctggatctctctcagttgtgtatttgttcatcttcatatgctggcaggaacaactattaatacagatactcagaagccaataacatgacaggagctgggactggtttgaacacagggtgtgcagatggggagggggtactggccttgggcctcctatgatgcagacatggtgaatttaattcaaggaggaggagaatgttttaggcaggtggttatatgtgggaaga

SEQ ID NO: 1883 - DNA, 1872 bp, Homo sapiens
gggattgtgggaaggcagctgaactcggcgcctggaaagatggaggcagcggagacagaggcggaagctgcagccctagaggtcctggctgaggtggcaggcatcttggaacctgtaggcctgcaggaggaggcagaactgccagccaagatcctggttgagtttgtggtggactctcagaagaaagacaagctgctctgcagccagcttcaggtagcggatttcctgcagaacatcctggctcaggaggacactgctaagggtctcgaccccttggcttctgaagacacgagccgacagaaggcaattgcagctaaggaacaatggaaagagctgaaggccacctacagggagcacgtagaggccatcaaaattggcctcaccaaggccctgactcagatggaggaagcccagaggaaacggacacaactccgggaagcctttgagcagctccaggccaagaaacaaatggccatggagaaacgcagagcagtccagaaccagtggcagctacaacaggagaagcatctgcagcatctggcggaggtttctgcagaggtgagggagcgtaagacagggactcagcaggagcttgacagggtgtttcagaaacttggaaacctgaagcagcaggcagaacaggagcgggacaagctgcagaggtatcagaccttcctccagcttctgtataccctgcagggtaagctgttgttccctgaggctgaggctgaggcagagaatcttccagatgataaaccccagcagccgactcgaccccaggagcagagtacaggagacaccatggggagagaccctggtgtgtccttcaaggctgttggtctacaacctgctggagatgtaaatttgccatgacttcctggaggacagcagcatggagaaagatcctagaaaaggcctctgacttccctcacctcccaaccatcattacaggaaagactgtgaactcctgagttcagcttgatttctgactacatcccagcaagctctggcatctgtggattaaaatccctggatctctctcagttgtgtatttgttcatcttcatatgctggcaggaacaactattaatacagatactcagaagccaataacatgacaggagctgggactggtttgaacacagggtgtgcagatggggagggggtactggccttgggcctcctatgatgcagacatggtgaatttaattcaaggaggaggagaatgttttaggcaggtggttatatgtgggaagataattttattcatggatccaaatgtttgttgagtcctttctttgtgctaaggttcttgcggtgaaccagaattataacagtgagctcatctgactgttttaggatgtacagcctagtgttaacattcttggtatctttttgtgccttatctaaaacatttctcgatcactggtttcagatgttcatttattatattcttttcaaagattcagagattggcttttgtcatccactattgtatgttttgtttcattgacctctagtgataccttgatctttcccactttctgttttcggattggagaagatgtaccttttttgtcaactcttacttttatcagatgatcaactcacgtatttggatctttatttgttttctcaaataaatatttaaggttatacatttcttctgacttcctttattttcacaatcattcaattcatagcatttcctatattctgttataattatttcattgattcataaatttctttgaaaaataatttggtcttctattgattgtgagaagataatctaagtttaatttggtcagagaatatcatctgtttaataaactttgaaatttggtgagtgaattatcttttttactgataa

SEQ ID NO: 1884 - DNA, 3603 bp, Homo sapiens
agggagggggtggtgtccccagccggtttggggggtgcgttgcccggagacggaaagtttgggagcccgagcaggctcggctgcagcctcggggagggggtccagcgggtggcggccctggggatggggaaggagcaggagctgctggaggcggcccgcaccgggcacctcccggcggtggagaagctgctgtccgggaagcggctctcctcaggctttgggggcggcggcggcggtggctctgggggcggcggcggcggcagcggcggcggcggcggcggcctcggctcttccagccaccccctctccagtctgctcagaaatcaagctccatgagggcagactttgtctttttccatctgcatctccagcccctagaaggcgcacttcacgtgtctgctgagtacatgccatgtggagagggccaaatgtgaactgtgttgacagcactggctacacacccctgcaccatgctgctttgaatggccataaggatgtggtcgaggttcttctgaggaacgatgcgctgaccaacgtggctgactcaaaaggctgctaccctctgcatttggcagcctggaaaggagatgcccagatagtgcggttgctcatccatcaagggccttcacacaccagagtcaatgaacagaacaatgacaacgagacagccctgcattgtgcagcgcagtatggccacacagaggtggtgaaggtgctcttagaggagctgacggaccccaccatgcgcaacaacaaattcgagacccctttggacctggcagcactgtacgggcgactggaggtggtgaaaatgctccttaatgcacaccccaacctcctgagctgcaacactaagaagcacacccctctgcacttggcagcaaggaatggccacaaagccgtggtccaggtcctcctcgatgctggcatggacagcaactaccagacggagatgggcagtgctttgcatgaggctgctttgtttggcaagaccgatgtggtgcaaatcctgctggctgcaggaactgacgtcaacataaaagataaccatggactgactgccctagacactgttcgggaactgccttctcaaaagagccagcaaatagcagcattaattgaagatcacatgactggaaaaagaagtacaaaagaagtagataaaacccccccaccccagccacctctcatctccagtatggactccatatcacagaagtctcagggtgacgtggagaaagcagtgactgaactgattatagattttgatgcaaatgctgaagaagagggtccctacgaagctctgtataatgccatctcctgccattcgttggacagcatggccagcgggcgatcatctgaccaagactccacgaacaaggaggctgaggcagcaggagtgaaacctgctggagtgaggcctagggaacgtccaccacctccagcaaagccaccgcccgatgaagaggaagaagaccacatagataagaagtattttcccttgacagcttctgaggttctgtccatgagacctaggattcatgggagtgcagcccgggaagaagacgaacacccttatgaactgttgttaacagcagagacaaagaaagtggtgttggtggatggaaaaacaaaaggctaagagaactgtcagaagcccatcagtctgggaagaaagggagcttcatgcctggcctccttgtggttaggaaggaaaatggcccacacacttaccaaattaaggggctactgccacgtgcgtccctgttgaagtgggacagcacagtgctctgcacagaagccattctcctgaaagagattgagaaaatcatgagttctattggagaagggattgacttttctcaggaacggcagaagatctcaggtttacggacgctggagcagagtgtcggggagtggctggagtcgattgggctgcagcagtatgagagcaagttgcttctgaatggctttgacgatgtccacttcctggggtctaatgtgatggaagagcaggacctgcgggacatcggcatcagcgacccacagcaccggcggaagctgctccaggcggcacgctccctacccaaggtgaaggctctgggttatgacgggaacagcccccctagcgtgccctcctggctggactccctggggctgcaggactacgtccattccttcttgtcaagtggttacagctccattgacaccgtgaagaacctctgggagctagagctcgtcaatgtcctgaaggtccagctgctcggccatcgcaagcgcatcatcgcctccctcgcagacagaccgtacgaggagccgccccagaagccccccagattctcccagctgaggtgccaagatttgctctcccagacgtcatccccactgagtcagaatgattcctgcactgggcggtcggcagatctgctgctgcctccaggggacacaggcaggaggcgccatgacagtctccatgaccctgcggcaccctcccgagcggagcgcttcaggatccaggaggagcaccgtgaggccaagctgaccctgcggcccccgagcctggcagccccctacgccccagtgcagagttggcaacaccagccagagaaactcatcttcgagtcctgtggttatgaagccaattatctgggctccatgctgatcaaagatctgcgagggacagaatccacgcaagacgcctgtgccaagatgcggaaatctacggagcacatgaagaagatccccaccatcatcctgtccatcacatacaaaggtgtcaagttcatcgatgcctccaacaagaacgtcattgcagagcacgagatccggaacatttcctgtgcggcccaggacccggaggacctctgtacctttgcctacatcaccaaggacctgcagaccagccaccactattgccatgtgttcagcaccgtggatgtgaacctgacctacgagatcatcctgacgctggggcaggccttcgaagtggcctatcagttggccctgcaggcccagaagtccagggcgacgggcgcctctgcagctgagatgattgaaacaaaatcttccaaaccggtgcctaagcctcgggtcggcgtgaggaaatccgcagtgccgctgccccccgatagtcgctgttgttactgtcacacctgcaccacccaccgtccttcctacctaccgctgccatctgttagtcctggagtcaagctggaaccacctgatatggaccaagatgcccaatcccatgccagtgtctcctgggttgtggaccccaaaccagactctaagcggagcctcagcaccaaccatactaggttggagctggtctgctgcagtcagcctgaaaatgagttggtctctacaatctcaggagacaagcccaaatccttcctagaacctctcttatttgtgatgccaacaacagcttacaaccacaactgcccagaatggagaagccagaaggatggaggctgctccacctctgaatgcccacatcacctctgcctggaaaaaccgggtgttctaagcttagagatgagggaaaggagacttactgggctagagaacaggaccagaataaacttgatacaagtgagtcac

SEQ ID NO: 1885 - DNA, 1997 bp, Homo sapiens
tgagcaaccctaattaacctgattttttgctgataatcactctcaatggaatcaaatcacaaatccggggatggattgagcggcactcagaaggaagcagccctccgcgcactggtccagcgcacaggatatagcttggtccaggaaaatggacaaagaaaatatggtggccctccacctggttgggatgctgcaccccctgaaaggggctgtgaaatttttattggaaaacttccccgagacctttttgaggatgagcttataccattatgtgaaaaaatcggtaaaatttatgaaatgagaatgatgatggattttaatggcaacaatagaggatatgcatttgtaacattttcaaataaagtggaagccaagaatgcaatcaagcaacttaataattatgaaattagaaatgggcgcctcttaggggtttgtgccagtgtggacaactgccgattatttgttgggggcatcccaaaaaccaaaaagagagaagaaatcttatcggagatgaaaaaggttactgaaggtgttgtcgatgtcatcgtctacccaagcgctgcagataaaaccaaaaaccgaggctttgccttcgtggagtatgagagtcatcgagcagctgccatggcgaggaggaaactgctaccaggaagaattcagttatggggacatggtattgcagtagactgggcagagccagaagtagaagttgatgaagatacaatgtcttcagtgaaaatcctatatgtaagaaatcttatgctgtctacctctgaagagatgattgaaaaggaattcaacaatatcaaaccaggtgctgtggagagggtgaagaaaattcgagactatgcttttgtgcacttcagtaaccgagaagatgcagttgaggctatgaaagctttaaatggcaaggtgctggatggttcccccattgaagtcaccctagcaaaaccagtggacaaggacagttatgttaggtatacccgaggcacaggtggaaggggcaccatgctgcaaggagagtatacctactctttgggccaagtttatgatcccaccacaacctaccttggagctcctgtcttctatgccccccagacctatgcagcaattcccagtcttcatttcccagccaccaaaggacatctcagcaacagagccattatccgagccccttctgttagagaaatttacatgaatgtacctgtaggggctgcgggagtgagaggactgggcggccgtggctatttggcatacacaggcctgggtcgaggataccaggtcaaaggagacaaaagagaagacaaactctatgacattttacctgggatggagctcaccccaatgaatcctgtcacattaaaaccccaaggaattaaactcgctccccagatattagaagagatttgtcagaaaaataactggggacagccagtgtaccagctgcactctgctattggacaagaccaaagacagctattcttgtacaaaataactattcctgctctagccagccagaatcctgcaatccaccctttcacacctccaaagctgagtgcctttgtggatgaagcaaagacgtatgcagccgaatacaccctgcagaccctgggcatccccactgatggaggcgatggcaccatggctactgctgctgctgctgctactgctttcccaggatatgctgtccctaatgcaactgcacccgtgtctgcagcccagctcaagcaagcggtaacccttggacaagacttagcagcatatacaacctatgaggtctacccaacttttgcagtgactgcccgaggggatggatatggcaccttctgaagatgcttttttaaatttaagaataagacacacaaaactctattaaaaaaaaaaaagaaataaacctctaactcggtccccaatgatcataaataatatgtttcctaaagaaatgcctttccagagactgtatagcttataccaattatagaatcatgaagtaagaa

SEQ ID NO: 1886 - DNA, 2211 bp, Homo sapiens
tttgatatgacgattagagcataacccgagtgacacgttgaattcgccataatcaaggaaaccttttccgggtggggatctctgaaattactcagtgagcaaccctaattaacctgattttttgctgataatcactctcaatggaatcaaatcacaaatccggggatggattgagcggcactcagaaggaagcagccctccgcgcactggtccagcgcacaggatatagcttggtccaggaatttagaggttcctatagatggaagcagtgtgtctgggcacatgcccagagccagaagcgagcatgagcacagcaattcctggcctcaaaaaaggaaataatgctttgcagtccatcattttgcaaactttgctggaaaaggaaaatggacaaagaaaatatggtggccctccacctggttgggatgctgcaccccctgaaaggggctgtgaaatttttattggaaaacttccccgagacctttttgaggatgagcttataccattatgtgaaaaaatcggtaaaatttatgaaatgagaatgatgatggattttaatggcaacaatagaggatatgcatttgtaacattttcaaataaagtggaagccaagaatgcaatcaagcaacttaataattatgaaattagaaatgggcgcctcttaggggtttgtgccagtgtggacaactgccgattatttgttgggggcatcccaaaaaccaaaaagagagaagaaatcttatcggagatgaaaaaggttactgaaggtgttgtcgatgtcatcgtctacccaagcgctgcagataaaaccaaaaaccgaggctttgccttcgtggagtatgagagtcatcgagcagctgccatggcgaggaggaaactgctaccaggaagaattcagttatggggacatggtattgcagtagactgggcagagccagaagtagaagttgatgaagatacaatgtcttcagtgaaaatcctatatgtaagaaatcttatgctgtctacctctgaagagatgattgaaaaggaattcaacaatatcaaaccaggtgctgtggagagggtgaagaaaattcgagactatgcttttgtgcacttcagtaaccgagaagatgcagttgaggctatgaaagctttaaatggcaaggtgctggatggttcccccattgaagtcaccctagcaaaaccagtggacaaggacagttatgttaggtatacccgaggcacaggtggaaggggcaccatgctgcaaggagagtatacctactctttgggccaagtttatgatcccaccacaacctaccttggagctcctgtcttctatgccccccagacctatgcagcaattcccagtcttcatttcccagccaccaaaggacatctcagcaacagagccattatccgagccccttctgttagaggggctgcgggagtgagaggactgggcggccgtggctatttggcatacacaggcctgggtcgaggataccaggtcaaaggagacaaaagagaagacaaactctatgacattttacctgggatggagctcaccccaatgaatcctgtcacattaaaaccccaaggaattaaactcgctccccagatattagaagagatttgtcagaaaaataactggggacagccagtgtaccagctgcactctgctattggacaagaccaaagacagctattcttgtacaaaataactattcctgctctagccagccagaatcctgcaatccaccctttcacacctccaaagctgagtgcctttgtggatgaagcaaagacgtatgcagccgaatacaccctgcagaccctgggcatccccactgatggaggcgatggcaccatggctactgctgctgctgctgctactgctttcccaggatatgctgtccctaatgcaactgcacccgtgtctgcagcccagctcaagcaagcggtaacccttggacaagacttagcagcatatacaacctatgaggtctacccaacttttgcagtgactgcccgaggggatggatatggcaccttctgaagatgcttttttaaatttaagaataagacacacaaaactctattaaaaaaaaaaaagaaataaacctctaactcggtccccaatgatcataaataatatgtttcctaaagaaatgcctttccagagactgtatagcttataccaattatagaatcatgaagtaagaa

SEQ ID NO: 1887 - DNA, 2116 bp, Homo sapiens
tttgatatgacgattagagcataacccgagtgacacgttgaattcgccataatcaaggaaaccttttccgggtggggatctctgaaattactcagataacagtgctgtgccaaaaacctgtggattttctctacaaaaattattgagcaaccctaattaacctgattttttgctgataatcactctcaatggaatcaaatcacaaatccggggatggattgagcggcactcagaaggaagcagccctccgcgcactggtccagcgcacaggatatagcttggtccaggaaaatggacaaagaaaatatggtggccctccacctggttgggatgctgcaccccctgaaaggggctgtgaaatttttattggaaaacttccccgagacctttttgaggatgagcttataccattatgtgaaaaaatcggtaaaatttatgaaatgagaatgatgatggattttaatggcaacaatagaggatatgcatttgtaacattttcaaataaagtggaagccaagaatgcaatcaagcaacttaataattatgaaattagaaatgggcgcctcttaggggtttgtgccagtgtggacaactgccgattatttgttgggggcatcccaaaaaccaaaaagagagaagaaatcttatcggagatgaaaaaggttactgaaggtgttgtcgatgtcatcgtctacccaagcgctgcagataaaaccaaaaaccgaggctttgccttcgtggagtatgagagtcatcgagcagctgccatggcgaggaggaaactgctaccaggaagaattcagttatggggacatggtattgcagtagactgggcagagccagaagtagaagttgatgaagatacaatgtcttcagtgaaaatcctatatgtaagaaatcttatgctgtctacctctgaagagatgattgaaaaggaattcaacaatatcaaaccaggtgctgtggagagggtgaagaaaattcgagactatgcttttgtgcacttcagtaaccgagaagatgcagttgaggctatgaaagctttaaatggcaaggtgctggatggttcccccattgaagtcaccctagcaaaaccagtggacaaggacagttatgttaggtatacccgaggcacaggtggaaggggcaccatgctgcaaggagagtatacctactctttgggccaagtttatgatcccaccacaacctaccttggagctcctgtcttctatgccccccagacctatgcagcaattcccagtcttcatttcccagccaccaaaggacatctcagcaacagagccattatccgagccccttctgttagaggggctgcgggagtgagaggactgggcggccgtggctatttggcatacacaggcctgggtcgaggataccaggtcaaaggagacaaaagagaagacaaactctatgacattttacctgggatggagctcaccccaatgaatcctgtcacattaaaaccccaaggaattaaactcgctccccagatattagaagagatttgtcagaaaaataactggggacagccagtgtaccagctgcactctgctattggacaagaccaaagacagctattcttgtacaaaataactattcctgctctagccagccagaatcctgcaatccaccctttcacacctccaaagctgagtgcctttgtggatgaagcaaagacgtatgcagccgaatacaccctgcagaccctgggcatccccactgatggaggcgatggcaccatggctactgctgctgctgctgctactgctttcccaggatatgctgtccctaatgcaactgcacccgtgtctgcagcccagctcaagcaagcggtaacccttggacaagacttagcagcatatacaacctatgaggtctacccaacttttgcagtgactgcccgaggggatggatatggcaccttctgaagatgcttttttaaatttaagaataagacacacaaaactctattaaaaaaaaaaaagaaataaacctctaactcggtccccaatgatcataaataatatgtttcctaaagaaatgcctttccagagactgtatagcttataccaattatagaatcatgaagtaagaa

SEQ ID NO: 1888 - DNA, 2068 bp, Homo sapiens
tttgatatgacgattagagcataacccgagtgacacgttgaattcgccataatcaaggaaaccttttccgggtggggatctctgaaattactcagtgagcaaccctaattaacctgattttttgctgataatcactctcaatggaatcaaatcacaaatccggggatggattgagcggcactcagaaggaagcagccctccgcgcactggtccagcgcacaggatatagcttggtccaggaaaatggacaaagaaaatatggtggccctccacctggttgggatgctgcaccccctgaaaggggctgtgaaatttttattggaaaacttccccgagacctttttgaggatgagcttataccattatgtgaaaaaatcggtaaaatttatgaaatgagaatgatgatggattttaatggcaacaatagaggatatgcatttgtaacattttcaaataaagtggaagccaagaatgcaatcaagcaacttaataattatgaaattagaaatgggcgcctcttaggggtttgtgccagtgtggacaactgccgattatttgttgggggcatcccaaaaaccaaaaagagagaagaaatcttatcggagatgaaaaaggttactgaaggtgttgtcgatgtcatcgtctacccaagcgctgcagataaaaccaaaaaccgaggctttgccttcgtggagtatgagagtcatcgagcagctgccatggcgaggaggaaactgctaccaggaagaattcagttatggggacatggtattgcagtagactgggcagagccagaagtagaagttgatgaagatacaatgtcttcagtgaaaatcctatatgtaagaaatcttatgctgtctacctctgaagagatgattgaaaaggaattcaacaatatcaaaccaggtgctgtggagagggtgaagaaaattcgagactatgcttttgtgcacttcagtaaccgagaagatgcagttgaggctatgaaagctttaaatggcaaggtgctggatggttcccccattgaagtcaccctagcaaaaccagtggacaaggacagttatgttaggtatacccgaggcacaggtggaaggggcaccatgctgcaaggagagtatacctactctttgggccaagtttatgatcccaccacaacctaccttggagctcctgtcttctatgccccccagacctatgcagcaattcccagtcttcatttcccagccaccaaaggacatctcagcaacagagccattatccgagccccttctgttagaggggctgcgggagtgagaggactgggcggccgtggctatttggcatacacaggcctgggtcgaggataccaggtcaaaggagacaaaagagaagacaaactctatgacattttacctgggatggagctcaccccaatgaatcctgtcacattaaaaccccaaggaattaaactcgctccccagatattagaagagatttgtcagaaaaataactggggacagccagtgtaccagctgcactctgctattggacaagaccaaagacagctattcttgtacaaaataactattcctgctctagccagccagaatcctgcaatccaccctttcacacctccaaagctgagtgcctttgtggatgaagcaaagacgtatgcagccgaatacaccctgcagaccctgggcatccccactgatggaggcgatggcaccatggctactgctgctgctgctgctactgctttcccaggatatgctgtccctaatgcaactgcacccgtgtctgcagcccagctcaagcaagcggtaacccttggacaagacttagcagcatatacaacctatgaggtctacccaacttttgcagtgactgcccgaggggatggatatggcaccttctgaagatgcttttttaaatttaagaataagacacacaaaactctattaaaaaaaaaaaagaaataaacctctaactcggtccccaatgatcataaataatatgtttcctaaagaaatgcctttccagagactgtatagcttataccaattatagaatcatgaagtaagaa

SEQ ID NO: 1889 - DNA, 2003 bp, Homo sapiens
ggaagacatcaggatgtaccatctgcccttctgtcggaccccagggtacgtcccatgagcgcggccgagctgcgtcgagggcagcagagcgtgctgcactgctcagggacccggactctgcagtttctcctgcactgttttcacctttggccagacgggctctgggaagacctacaccctgactggaccccctccccagggggagggggtgcctgtaccccccagcctggctggcatcatgcagaggaccttcgcctggctgttggaccgcgtgcagcacctgggtgcccctgtcacccttcgcgcctcttatctggagatctacaatgagcaggttcgggacttgctgagcctggggtctccccggcccctccctgttcgctggaacaagactcggggcttctatgtggagcagctgcgggtggtggaatttgggagtctggaggccctgatggaacttttgcaaacgggtctcagccgtcgaaggaactcagcccacaccctgaaccaggcctccagccgaagccatgccctgctcaccctttacatcagccgtcaaactgcccagcagatgccttctgtggaccctggggagccccctgttggtgggaagctgtgctttgtggacctggcaggcagtgagaaggtagcagccacgggatcccgtggggagctgatgcttgaggctaacagcatcaaccgaagcctgctggccctgggtcactgcatctccctgctgctggacccacagcggaagcagagccacatccctttccgggacagcaagctcaccaagttgctggcagactcactgggagggcgcggggtcaccctcatggtggcctgcgtgtccccctcagcccagtgccttcctgagactctcagcaccctgcgatatgcaagccgagctcagcgggtcaccacccgaccacaggcccccaagtctcctgtggcaaagcagccccagcgtttggagacagagatgctgcagctccaggaggagaaccgtcgcctgcagttccagctggaccaaatggactgcaaggcctcagggctcagtggagcccgggtggcctgggcccagcggaacctgtacgggatgctacaggagttcatgctagagaatgagaggctcaggaaagaaaagagccagctgcagaatagccgagacctggcccagaatgagcagcgcatcctggcccagcaggtccatgcactagagaggcgtctcctctctgcctgctaccatcaccagcagggtcctggcctgaccccaccgtgtccctgcttgatggccccagctcccccttgccatgcactgccacccctctactcctgcccctgctgccacatctgcccactgtgtcgagtgcccctggcccactgggcctgcctgccaggggagcaccacctgccccaggtgttggaccctgaggcctcaggtggcaggcccccatctgcccggcccccaccctgggcacccccatgcagccctggctctgccaagtgcccaagagagaggagtcacagtgactggactcagacccgagtcctggcagagatgttgacggaggaggaggtggtaccttctgcacctcccctgcctgtgaggcccccgaagacatcaccagggctcagaggtggggccggggttccaaacctggcccagagactggaggccctcagagaccagattggcagctccctgcgacgtggccgcagccagccaccctgcagtgagggcgcacggagcccaggccaagtcctccctccccattgaaggccaagtgggaacccaggagactgctgtgtgacctcagactgggctccacactcttgggcttcagtctgcccatctgctgaatggagacagcagctgctactccacctgcagctgggctaggggcggggactgggggtgctatttaggggaacaaggggattcaggagaaaccaggcagcaggggatgaaatacatgaataaagagaggcatcagctccaa

SEQ ID NO: 1890 - DNA, 1617 bp, Homo sapiens
tttttcatgatttttcctcacactgatcactatccaatcagaacaataaacttctaacactcccttactaaaagaacatggttaagggtgagaaaggccccaagggcaagaagatcaccctcaaggtggccaggaattgcatcaaaatcacttttgatgggaaaaagcgccttgacttgagcaagatgggaattaccaccttccccaagtgtattctgcgccttagtgacatggacgagctggaccttagccggaatcttatcaggaagatccctgactccatctccaagttccagaacctccggtggctggacctgcacagcaactacatagacaagctgcctgagtccattggccagatgaccagcctgctctacctcaacgtcagcaacaaccggctgaccagcaacgggctgcccgtggagctgaagcaactcaagaacatccgcgctgtgaacctaggcttgaaccacctggacagcgtgcccaccacactgggggccctgaaggagctccacgaggtagggctccatgacaacctactgaacaacatccccgtgagcatctccaagctccccaagctgaaaaagctcaacataaagcggaacccctttccaaagccaggtgagtcggaaatattcatagactccatcaggaggctggagaacttgtatgttgtggaggagaaggatctgtgtgcggcttgcctgagaaaatgccaaaacgcccgggacaacctgaatagaatcaagaacatggccacgacgacaccgagaaagaccatctttcccaatctgatctcacccaattccatggccaaggactcctgggaagactggagaatacgcttgacatcttcctagagtagctgtggcaaaatcttgaagactactcagctaacagaataaacgactctgaagaggagaagcccccagttaggagaagacagagtggcaagtgagatgttctggaaaccaggctcgccggagctggccaagccaccgacttgcttctcaaattcacttcacctcccttagctttagcccacctgtgtgtgaaaatgactttgggaaatatttgatgtggtttttaaaatgtatatagaaaaaaatttaagaaaattacagattatatattatagacaactaaatatttaagactttaagacttaaaaggcttactgcctctacatttcactcagactagtacatctcaatgccagtagtctgtgataaatttatgtaggtataatgagatactgatatggtttgggcatttgtctcctccaaacctcatgttgagatttgatccccagtgttggaggtggggcctaatggaaggtcatgggggtgggtccctcatgaatggcctggtgccatccttttggtaatgagtgagttctcactgtattagatcctgttgaaaattgattgttaaaaagaccttggcacctccctctcctctctctctcttcctctcactatgtgatgcctgctccccttcaccttccaccatgagtggaagcacctataccccaaagccctcaccagaaggaggtgccggcacctgtacagcttgtaagaaccatgactcaaataaacttcttttctttataaa

SEQ ID NO: 1891 - DNA, 2380 bp, Homo sapiens
gatgctccaaatatccctacaaagtactttattattcctgtttcacagacaaggaaactggggcacagacaggttgaacaatgttcctgtagctgagccaggatttgaacccagggatttatttctctacaagggacacaggtgactgaacttcctcctggccccgaggacccagggaagcacctctttgagatcagcccaggtggtgccggggagcgggagaaggtgccggccaaccccgaggcgctcctgctcatggccagctcccagcgtgacatggaggactgggtgcaggccatccgccgagtcatctgggccccgctgggcggaggtactgcccgtagatcgcatgcccaccctctagaacccttgcctccagggatctttgggcagcgcctagaggaaacagtccaccacgagcggaagtatggcccccgcctggcgcccctgctggtggagcagtgtgtggacttcatccgggagcgcgggctcactgaggaggggctgttccgcatgccaggccaggccaacctggtgagggacctgcaggattccttcgactgtggggagaagccactgtttgacagcacaacagacgtgcacacggtggcctccctgctgaagctgtacctgcgggagctccccgagcccgtggtccccttcgccaggtacgaggacttcctcagctgcgcccagctgctcaccaaggacgagggggagggcactctggagttggctaaacaagtgagcaaccttcctcaggcaaattacaacctgctcagatacatctgcaagtttctggatgaagttcaggcatactcaaatgtcaacaagatgagtgtccagaatctggcaaccgtttttggacctaacattctgcggccacaggtagaggacccagtaaccatcatggaaggcacttccctcgtccagcacctgatgaccgtcctcatccgcaaacacagccagctcttcacggcaccggtcccggaagggcccacctccccgcgcgggggcctgcaatgcgcagtggggtggggctccgaggaggtcaccagggacagccaaggagagcccggcggccccggcctgcccgcgcacaggacctcttccctggacggggcggccgtggcggtgctctccagaacagcccccacggggccggggagccggtgcagccctgggaagaaggtgcagaccctgcccagttggaagtcctccttccggcagccgaggtccctatcgggaagcccgaaggggggcggctcatccctggaggtgcccatcatctcctccggcgggaactggcttatgaacgggctgtcctccctgcgcggacaccgccgggcctcgtcgggagaccggctcaaggactcgggctccgtgcagagactctccacctacgacaatgtgcccgcgccgggcctggtccccggcatacccagcgtggccagtatggcgtggtccggggcctcgtccagcgagtcgtcggtggggggctcactcagcagctgcacggcctgccgcgccagcgactcgtctgcccgcagttccctgcacaccgactgggccctggagccctccccgctccccagcagcagcgaggaccccaagtccctggacctggaccacagcatggacgaggcgggcgcgggtgccagcaacagcgagcccagcgagccggacagccccacccgggaacacgcgcgccgctccgaggccttacaggggctggtcactgagctcagggccgagctgtgccgccagcggactgagtacgagaggagtgtgaaaagaatcgaagaagggagtgctgacctgagaaaacgaatgtcccggttagaagaagaactggaccaggaaaagaaaaaatacatcatgctggaaataaagctgcggaactctgaacgggcgcgggaggatgcggagaggaggaaccagctgttgcagagggaaatggaggagtttttttcgaccctaggaagcttgactgttggggcaaaaggtgccagggccccaaagtaaaaggaatggcagagctcacttctgtaccacgtctgctggtctccagccttgtatggagttagaagcgtctgtatctctggagcagccaggcgctctggagccagctggagagagagagatcctgatacctctgtggggactgtggggacttttgggaccccacacactccaggtgggatcagatgctgctccaaccatgcagttcctggtgagggtcagaaggggacggtaccaagagtagcgcttagcccttacccaggaaatatccttcatggccacagaaatggagggcgcccaggatccaggcagccaccgggaacagtcagctttctttattaaatgtgctcacaaagca

SEQ ID NO: 1892 - DNA, 2339 bp, Homo sapiens
acctgcgacaggtggagcgcacggggcgggcgcacggccatgtccgccgagggcgcggagccggggccggggtccgggtccgggcccgggccggggccactctgccccgaacacggccaggctctgagctggttctgcggctccgagcgacggcccgtgtgcgccgcctgcgcggggttgggcggtcgctgccgggggcaccgcatccgccgggcggaggagcgcgccgaggagctgcggaacaagattgtggaccagtgtgagaggctgcagttacagagtgctgccatcaccaagtatgtggcggacgtcctgccggggaagaatcaaagagcagtgagcatggccagtgcagcgagggaactggttatccagcggttgagtctggtgaggagtctttgcgagagcgaggagcagcggttactggaacaggtgcatggcgaagaggagcgggcccaccagagcatcctgacacagcgggtgcactgggccgaggcgctgcagaaacttgacaccatccgcactggcctggtgggcatgcttactcacctggatgacctccagctgattcagaaggagcaagagattttcgagaggaccgaagaagcagagggcattttggatccccaggagtcggaaatgttaaactttaatgagaagtgcactcggagcccactactgacccaactctgggcaacggcggttcttgggtctctctcaggcacagaggacatacggatcgatgagaggacagtcagccccttcctgcaattgtcagatgatcgaaagaccctgaccttcagcaccaagaagtcaaaggcctgtgcagatggcccggagcgcttcgaccactggcccaatgccctggctgccacctccttccagaatgggctccatgcctggatggtgaatgtccagaacagttgtgcctataaggtgggcgtggcttcaggccacctgccccgcaagggttctggcagtgactgccgtctgggccacaatgccttctcctgggtcttctctcgctatgatcaggagtttcgtttctcacacaatgggcagcacgagcccctggggctgctgcggggcccagcccagctgggtgtagtgctggacttgcaggttcaggagctgctcttctatgagccagcctccggcacagtgctctgtgcccatcatgtgtccttcccggggcccctcttcccagtctttgctgtggccgatcagaccatttctatcgtccgctgacctctggccacaggaagccaggtccaccgcccaccaccctttcaggccatgtttctactcagtgtgcttttcccaaatgatgtgtgtggtgtttctaagagaaacagggcccataaccagtgggcagctttaggagggatggggatctgtttcagatctaggcataacctgtaaatcacaggtgtccaaacttttggcttccctgggccacatttgaagaagaattttcttgggccacataaaatacactaacgatagctgatgagctaaaaaaaaaaaaaaagtctgtgtataatttttgtgatatctgccaccacagataagcaaaaaagtccttgcattcaaagggttggagattgctgctttgagtgctgggtacctgtggggaacctactactccctgggccttagtctcccaaatccaccatgcatctgcccctctgagggtgtcttcactttgtctctggcatctagcatggtgcctggtgcatagtgagcatgcaataaatatttggcaggtgagtggatggatagatggataggtgaatgtaggtggacaggtgactgggtggatgttgtggtctctggagaagcactgccattcagcctcctgctccagctgttcacatgcagaaatgctctcttcacaggcagagaagcctgtggctaaagtttccacatcccattaactcagtgcttttgtctttttcatgacatggcacatagagaaaatatttttttctagcacacaagagcaacctgaaaggctgctcctggccagaggactctgtcccgggggaccgtgtcctcccccatgtcctgcctaggccctcagaggaccaggggatcatgtctccaggtaacccgactgtagcccctgctggctgagctccagcctgtgcccactgataatagcagggacggccttttctcttagagcagctgataagtttccctacctgatggccccctctgacataaactgcacacctggggtgatggcttaaagccagaaagagctgagggagttaagagggccaaccttagggcacgtgggcattattaaaggtcttaaaagcattgaagattta

SEQ ID NO: 1893 - DNA, 872 bp, Homo sapiens
ggagcatgatggaagtcgtagtaggaaatggcgtcgtggcattgaggggcatccctcctagaacctccaggaaaagctcgcggaagacgaggttctgcggagagagaggctccaagcagtctgggaagtgtagtccagttggcttagcagtagtttcgttgggggggagccgaggttccgggaaggggctaggccggcttgaaaagagattatgactgtaccttttaactttgtagctggaacacaagaagtgtttgtttaatgaatgacgtacacatttaagatctgtttggacgcggaggataatcctgtgaattgctaatagttcactgggtttggcccttagtgttgacttcagtatgctgagacggaaaccaacacgcctagagctaaagcttgatgacattgaagagtttgagaacattcgaaaggacctggagacccgtaagaaacagaaggaagatgtggaagttgtaggaggcagtgatggagaaggagccattgggcttagcagtgatcccaagagccgggaacaaatgatcaatgatcggattggttataaaccccaacccaagcccaataatcgttcatctcaatttggaagtcttgaattttagagatggattatcttgcatgccagagcgctggaatggaataaaatgatggcagaagtacaaaccagatttagagaattgagtgcttgcagtcaagcagaatgtacctcctgcagagacaaatcttctgcatgagattactgatgcttcacttgcactctaagctggaatccaaactctggtttgtctcttgaaaatttgactctataaaactgatctgattttctgtttttaaaaataaatatatttttggaaaaa

SEQ ID NO: 1894 - DNA, 938 bp, Homo sapiens
ggctagcggccctgcgtgggagttcctgacagctggattctagaagtagaactatgagctcacctttggcctcccttagcaagacccgaaaagtgcccctgccctcggagcctatgaatcctgggaggcgaggaatccgcatctatggagatgagcggtgacctaggcatccctgtctgcagaagatgaggtggacatgttgagtgatgggtgtggctcagaagaaaagatctcagtcccttcctgctatggcggcataggtgcccctgtgagtcggcaagtccctgcatcccatgactcggagctgatggccttcatgacgaggaagttgtgggacctggagcagcaggtgaaggcccagactgatgagatactgtccaaggatcagaagatagcggccctagaggacctggtgcagaccctccggccacacccagccgaggcaaccctgcagcggcaggaggaactggagacgatgtgtgtgcagctgcagcggcaggtcagggagatggagcggttcctcagtgactatggcctgcagtgggtgggcgagcccatggaccaggaggactcagagagcaagacagtctcagagcatggcgagagggactggatgacagccaagaagttctggaagccaggggactcattggcgccccctgaggtggactttgacaggctgctggccagcctgcaggatcttagtgagctggtggtagagggtgacacccaagtgacaccagtgcccggcggggcacggctgcgtaccctcgagcccatcccgctgaagctctaccggaatggcatcatgatgttcgacgggcccttccagcccttctacgatccctccacacagcgctgcctccgagacatattggatggcttctttccctcagagctccagcgactgtaccccaatggggtcccctttaaggtga

SEQ ID NO: 1895 - DNA, 1846 bp, Homo sapiens
agtgcagccccagccagaagagctggaaggctgggcggccaggcccgctgtgtccccagttttcctgttggagtccatctgctgtgctctcaggagagaaggctgggtctctgggagctcacatcctgtatgccctccctccatgccaagcaactttggggagtcctggcagtggtgccaggcgttgctcttacctgtaccataaccaggaggctgatggttgctcaggcctccctcaaactagccaatgagaagtgcacgggtcctggtcgcctaggaaaccgcgtgacaacaagatggcggcgctgcgggacggctagcggccctgcgtgggagttcctgacagctggattctagaagtagaactatgagctcacctttggcctcccttagcaagacccgaaaagtgcccctgccctcggagcctatgaatcctgggaggcgaggaatccgcatctatggagatgtccctgcatcccatgactcggagctgatggccttcatgacgaggaagttgtgggacctggagcagcaggtgaaggcccagactgatgagatactgtccaaggatcagaagatagcggccctagaggacctggtgcagaccctccggccacacccagccgaggcaaccctgcagcggcaggaggaactggagacgatgtgtgtgcagctgcagcggcaggtcagggagatggagcggttcctcagtgactatggcctgcagtgggtgggcgagcccatggaccaggaggactcagagagcaagacagtctcagagcatggcgagagggactggatgacagccaagaagttctggaagccaggggactcattggcgccccctgaggtggactttgacaggctgctggccagcctgcaggatcttagtgagctggtggtagagggtgacacccaagtgacaccagtgcccggcggggcacggctgcgtaccctcgagcccatcccgctgaagctctaccggaatggcatcatgatgttcgacgggcccttccagcccttctacgatccctccacacagcgctgcctccgagacatattggatggcttctttccctcagagctccagcgactgtaccccaatggggtcccctttaaggtgagtgacttgcgcaatcaggtctacctggaggatggactggaccccttcccaggcgagggccgtgtggtgggcaggcagctgatgcacaaggccttggacagggtggaggagcacccaggctccaggatgactgctgagaaatttctgaacaggctccccaagtttgtgatccggcaaggcgaggtgattgacatccggggccccatcagggacaccttgcagaactgctgcccattgcctgcccggatccaggagattgtggtggagacgcccaccttggccgctgagcgagagaggagccaggagtcacccaacacgccggcacccccgctctccatgctgcgcatcaagtctgagaatggggaacaggccttcctactgatgatgcagcctgacaacaccattggggacgtgcgagctctgctagcgcaggccagggtcatggatgcctctgcctttgagatcttcagcacattcccgcccaccctctaccaggacgatacactcacgctgcaggctgcaggccttgtgcccaaagcagcactgctgctgcgggcacgccgagccccgaagtccagcctgaaattcagtcctggtccctgtcccggtcccggtcccggccccagtcccggtcccggtcccggccccagtcccggtcccggtcccggccccagtccctgtcctggacccagtcccagcccccaataaagcacccgccccctc

SEQ ID NO: 1896 - DNA, 2872 bp, Homo sapiens
tggacccaactggcgaggctgctggggttgcagcgggacagttggggcggccccgcaggcccagtaaacgattatgagggaaatgactctgaagcagaagacttgaatttcagggagactttgccttcatcaagtcaggaaaacacacctagatcaaaggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatggctttagaacttaagaatctgcctggtgagttcaactctgggaatcaaccaagcaacagagaaaaaaacagataccgagatattcttccatatgattcaacacgcgttcctcttggaaaaagcaaggactacatcaatgctagttatattagaatagtcaattgtggagaagagtatttttatatcgctactcaaggaccactgctgagcaccatagatgacttttggcaaatggtgttggaaaataattcaaatgttattgccatgataaccagagagatagaaggtggaattatcaaatgctaccattactggcccatttctctgaagaagccattggaattgaaacacttccgtgtattcctggagaactaccagatacttcaatatttcatcattcgaatgtttcaagttgtggagaagtccacgggaactagtcactctgtaaaacagttgcagttcaccaagtggccagaccatggcactcctgcctcagcagatagcttcataaaatatattcgttatgcaaggaagagccaccttacaggacccatggttgttcactgcagtgccggcataggccggacaggggtgttcctatgtgtggatgtcgtgttctgtgccatcgtaaagaactgttcattcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcacctcctcataaagaacatgtttgcactgtgctgaagggctttgctatgcatacaatctgctttcttggtttatcagtttattttctttctaaaagctccctgaagggcaatatcatttggcttggggtgatcagtgtttacttattgatcttgctagacaatatcaaaataacttcccacattttccagtgaaacagatgttacataaaacgattgcagcttggctatttggttgaagggattacagagcccaataaaggatttaaaatatattcattaagattttatttggaaaggtggctggagagagctgaggatttccaggactttgtaagttcttattctgggagaacataaggccaataatcatgacctcttccaggcatttttaagacagatgtctattcatgttctttagctagagcctgtactttttgctggcatttgaataacccagtttaaaaagagtccagttagggtggactaactttggacacaaattggcttccatttcctacattttcatactgctgccttcctacagctgctagaccaagacctgttggtctgggaagcatttcatggatagggagagctcctctcggtgaacagtccaaaactaaaatagatgtttatatagaaagcccaagaggagatttttgccatgcctgagttctttcctatcccaccctaacacttaacatattacttagtctgctttgttaaaagcaagtattacctttaacttgcctcttactctttgccctttagctaactaataaagtttgatataggcattattatataattctgagtcattcatggtatatctcatgtttgatgtatttttcaaactaagatctatgatagttttttttccagagttccattaaatcatttatttcctttactttctcacctctgttgaaacatttagaaactggatttgggaacccaattttggaaaaccagattcatagtcatgaaaatggaaacttccatattctgtttttgaaaagatgtggccattattacagtaattttattataggactttgcctcgtacaattaatagtgatattttggacaaggagttctggtgacaagctatacctaattataagctataaaacaatagatatgagtgtttgtacagtttaactcaatggagatcagaatattctatgtattgagaaaatgtttaatatcaatctataaatcttgaatttctaagaggcttattttgttcttttggctgaatgagtatatttgaattggttgaataattaataattctcattgtaaaaataattatatgccaaaaatatatttgatgttaaatcaaatagatgattctgtttacattgttcatatgaataataatctgtgttaatttcattttgataattggcctttaatatttgtatctctaattttattttctctctgttactgtaaaataatagctataatgtataacaattttcttcagaagaattctatgctattattaaaataaaatatttactgtg

SEQ ID NO: 1897 - DNA, 1792 bp, Homo sapiens
aaaccgcgtgacaacaagatggcggcgctgcgggacggctagcggccctgcgtgtactttcccaagcaccaccaggccaaaggtctctcagttcagagcagaaagccgtatacccagaggagcaggcagataacagaaacttccagaaacctctgtggagacagtggaagaggcaaaagggagttcctgacagctggattctagaagtagaactatgagctcacctttggcctcccttagcaagacccgaaaagtgcccctgccctcggagcctatgaatcctgggaggcgaggaatccgcatctatggagatgaagatgaggtggacatgttgagtgatgggtgtggctcagaagaaaagatctcagtcccttcctgctatggcggcataggtgcccctgtgagtcggcaagtccctgcatcccatgactcggagctgatggccttcatgacgaggaagttgtgggacctggagcagcaggtgaaggcccagactgatgagatactgtccaaggatcagaagatagcggccctagaggacctggtgcagaccctccggccacacccagccgaggcaaccctgcagcggcaggaggaactggagacgatgtgtgtgcagctgcagcggcaggtcagggagatggagcggttcctcagtgactatggcctgcagtgggtgggcgagcccatggaccaggaggactcagagagcaagacagtctcagagcatggcgagagggactggatgacagccaagaagttctggaagccaggggactcattggcgccccctgaggtggactttgacaggctgctggccagcctgcaggatcttagtgagctggtggtagagggtgacacccaagtgacaccagtgcccggcggggcacggctgcgtaccctcgagcccatcccgctgaagctctaccggaatggcatcatgatgttcgacgggcccttccagcccttctacgatccctccacacagcgctgcctccgagacatattggatggcttctttccctcagagctccagcgactgtaccccaatggggtcccctttaaggtgagtgacttgcgcaatcaggtctacctggaggatggactggaccccttcccaggcgagggccgtgtggtgggcaggcagctgatgcacaaggccttggacagggtggaggagcacccaggctccaggatgactgctgagaaatttctgaacaggctccccaagtttgtgatccggcaaggcgaggtgattgacatccggggccccatcagggacaccttgcagaactgctgcccattgcctgcccggatccaggagattgtggtggagacgcccaccttggccgctgagcgagagaggagccaggagtcacccaacacgccggcacccccgctctccatgctgcgcatcaagtctgagaatggggaacaggccttcctactgatgatgcagcctgacaacaccattggggacgtgcgagctctgctagcgcaggccagggtcatggatgcctctgcctttgagatcttcagcacattcccgcccaccctctaccaggacgatacactcacgctgcaggctgcaggccttgtgcccaaagcagcactgctgctgcgggcacgccgagccccgaagtccagcctgaaattcagtcctggtccctgtcccggtcccggtcccggccccagtcccggtcccggtcccggccccagtcccggtcccggtcccggccccagtccctgtcctggacccagtcccagcccccaataaagcacccgccccctc

SEQ ID NO: 1898 - DNA, 2043 bp, Homo sapiens
attattccacaacaccccttgggtgccccaacgcgcctagcaccctgtaagtgctccccagctgtggatacaggtttctctcagggcagcccgcaagcagtgcagccccagccagaagagctggaaggctgggcggccaggcccgctgtgtccccagttttcctgttggagtccatctgctgtgctctcaggagagaaggctgggtctctgggagctcacatcctgtatgccctccctccatgccaagcaactttggggagtcctggcagtggtgccaggcgttgctcttacctgtaccataaccaggaggctgatggttgctcaggcctccctcaaactagccaatgagaagtgcacgggtcctggtcgcctaggaaaccgcgtgacaacaagatggcggcgctgcgggacggctagcggccctgcgtgggagttcctgacagctggattctagaagtagaactatgagctcacctttggcctcccttagcaagacccgaaaagtgcccctgccctcggagcctatgaatcctgggaggcgaggaatccgcatctatggagatgaagatgaggtggacatgttgagtgatgggtgtggctcagaagaaaagatctcagtcccttcctgctatggcggcataggtgcccctgtgagtcggcaagtccctgcatcccatgactcggagctgatggccttcatgacgaggaagttgtgggacctggagcagcaggtgaaggcccagactgatgagatactgtccaaggatcagaagatagcggccctagaggacctggtgcagaccctccggccacacccagccgaggcaaccctgcagcggcaggaggaactggagacgatgtgtgtgcagctgcagcggcaggtcagggagatggagcggttcctcagtgactatggcctgcagtgggtgggcgagcccatggaccaggaggactcagagagcaagacagtctcagagcatggcgagagggactggatgacagccaagaagttctggaagccaggggactcattggcgccccctgaggtggactttgacaggctgctggccagcctgcaggatcttagtgagctggtggtagagggtgacacccaagtgacaccagtgcccggcggggcacggctgcgtaccctcgagcccatcccgctgaagctctaccggaatggcatcatgatgttcgacgggcccttccagcccttctacgatccctccacacagcgctgcctccgagacatattggatggcttctttccctcagagctccagcgactgtaccccaatggggtcccctttaaggtgagtgacttgcgcaatcaggtctacctggaggatggactggaccccttcccaggcgagggccgtgtggtgggcaggcagctgatgcacaaggccttggacagggtggaggagcacccaggctccaggatgactgctgagaaatttctgaacaggctccccaagtttgtgatccggcaaggcgaggtgattgacatccggggccccatcagggacaccttgcagaactgctgcccattgcctgcccggatccaggagattgtggtggagacgcccaccttggccgctgagcgagagaggagccaggagtcacccaacacgccggcacccccgctctccatgctgcgcatcaagtctgagaatggggaacaggccttcctactgatgatgcagcctgacaacaccattggggacgtgcgagctctgctagcgcaggccagggtcatggatgcctctgcctttgagatcttcagcacattcccgcccaccctctaccaggacgatacactcacgctgcaggctgcaggccttgtgcccaaagcagcactgctgctgcgggcacgccgagccccgaagtccagcctgaaattcagtcctggtccctgtcccggtcccggtcccggccccagtcccggtcccggtcccggccccagtcccggtcccggtcccggccccagtccctgtcctggacccagtcccagcccccaataaagcacccgccccctc

SEQ ID NO: 1899 - DNA, 1312 bp, Homo sapiens
cgctgcgggacggctagcggccctgcgtggaggcgaggaatccgcatctatggagatgtccctgcatcccatgactcggagctgatggccttcatgacgaggaagttgtgggacctggagcagcaggtgaaggcccagactgatgagatactgtccaaggatcagaagatagcggccctagaggacctggtgcagaccctccggccacacccagccgaggcaaccctgcagcggcaggaggaactggagacgatgtgtgtgcagctgcagcggcaggtcagggagatggaggggactcattggcgccccctgaggtggactttgacaggctgctggccagcctgcaggatcttagtgagctggtggtagagggtgacacccaagtgacaccagtgcccggcggggcacggctgcgtaccctcgagcccatcccgctgaagctctaccggaatggcatcatgatgttcgacgggcccttccagcccttctacgatccctccacacagcgctgcctccgagacatattggatggcttctttccctcagagctccagcgactgtaccccaatggggtcccctttaaggtgagtgacttgcgcaatcaggtctacctggaggatggactggaccccttcccaggcgagggccgtgtggtgggcaggcagctgatgcacaaggccttggacagggtggaggagcacccaggctccaggatgactgctgagaaatttctgaacaggctccccaagtttgtgatccggcaaggcgaggtgattgacatccggggccccatcagggacaccttgcagaactgctgcccattgcctgcccggatccaggagattgtggtggagacgcccaccttggccgctgagcgagagaggagccaggagtcacccaacacgccggcacccccgctctccatgctgcgcatcaagtctgagaatggggaacaggccttcctactgatgatgcagcctgacaacaccattggggacgtgcgagctctgctagcgcaggccagggtcatggatgcctctgcctttgagatcttcagcacattcccgcccaccctctaccaggacgatacactcacgctgcaggctgcaggccttgtgcccaaagcagcactgctgctgcgggcacgccgagccccgaagtccagcctgaaattcagtcctggtccctgtcccggtcccggtcccggccccagtcccggtcccggtcccggccccagtcccggtcccggtcccggccccagtccctgtcctggacccagtcccagcccccaataaagcacccgccccctcaa

SEQ ID NO: 1900 - DNA, 7622 bp, Homo sapiens
gccggcagagaccagccggcgggtggcggcggcccccagcacggccggtgcaaggcctcgggttaagcggcggccgagcggggctcggcccggggtgctcggggagctcgccgcggcgggcagcaggaggaagcggcggcggcgcgtcccgagcggtgcgcgccatggcgggcgggccccccaaggccctgccgtccacggggccccactccctgcgcgacatgccgcacccgctggccggctccagcagcgaggaggccgtgggtggtgacagcacgcccagcccggacctgctgatggcccgcagcttcggtgacaaggatctcattttgcccaacggtggtactccagcaggtacttcaagtccagcttcttcatcttcccttctcaacagacttcagcttgatgatgatattgatggtgagactagagatctcttcgttatagttgatgatcccaagaagcatgtgtgtacaatggagacttacatcacctataggatcaccaccaaaagtactcgggtggagtttgacctgccagaatattctgttcgtcgaagataccaggattttgactggttgaggagcaaactggaagaatcccagcccactcatctcattccccctcttcccgagaagtttgtggtaaaaggtgttgtggatcgtttttcagaagagtttgtggagaccagaagaaaagctttggataaatttctaaaaagaattacggaccatcctgtgctgtctttcaatgaacactttaatattttccttactgctaaggacctgaacgcctacaagaagcaagggatagcattgctgaccagaatgggcgagtcagtcaagcacgtcactggcggctacaagctgaggactcggccgcttgagtttgctgccataggtgactacttagatacatttgcactcaaactgggaaccattgatcgaatagcccagcggatcatcaaagaagaaatagagtaccttgtggagctgagagaatacgggcctgtgtactccacatggagcgccttggagggtgagctggctgaacccctggagggtgtgtcagcttgcattgggaactgctctacagccttagaagagctgacagatgacatgacagaagacttcctacctgtgctcagggaatatattttatactctgactccatgaagagtgtattgaagaagagggaccaagttcaagcagagtatgaagccaaactggaagctgtggctctgcggaaggaagaccgccccaaggtaccggcggacgtcgagaaatgtcaggatcggatggagtgtttcaatgctgacctgaaagctgacatggagaggtggcagaacaacaagaggcaggacttccggcagctactcatggggatggctgacaagaacatccagtattatgagaagtgcctcatggcgtgggagtcgattattccactactgcaggagaaacaagaggccaagtaaagttctttcttgggacggagactcttctacctacacagggcctggcaccctataccggaatgtccctgcagtgccagagacgcagtgctgggaaaacaaccacagaaacatctctcctttgtgtatttttccctcccccacctttcaccccacagtggttttcaattagtatttattccatggtggagtctgtgaggctagaatatctctcagcaagagcagcatacctccatgttgtgaaggcatctgttcagtgaagcactacgaaaatttgaaaccaagggacaagacaacctgcagctgacgctctgacatttcatgacagtttcctctttagggacagctgagttgccagttgtgggagagaacccggggcctgcttttcaaggatgaggaggaggcaggaacagaaggcagctgctgctttctgtggaaacctggcccctctggaattggcctctgtgggcattgactcgtcttggcctaggaggcattggtgcctccctggcaagtccttaacgtacagtacctgtagctgtgagtgtggcctgctgcctgcttgtgatgagtgataccgtcttactgtttctgtttcacatagggacatttaaatcaatgtcaatgtgcgtccatgcttgagtgagcaagccagcgtccttgtcctcctgcaatgcctttgggaagctcaggggaatgctccccaagcttgtttctgacactagaatgcaacagattggaaactttttgtgtaaaatgaaaaaaacaaagtgctggttttttttttttttctgtgaaggtcttcagtgttttgcttgttcactgtcatcagagcagggattagacctgttagggaatatctattgtcttgaagtcagagtagctccccattgttgagatcagtgggcatataccaagctccacccccagtgtcagctttgtgcaatttgcctttacctcaccaaaaatacctactttaatatttcctcctgtgtcctctgaatgtctgggcgagcttttggtgagagggctggtatgtcatgttgttatgatacagtcgaaatttgtcaatgcagtgtgaatgttctacataaagtgctttaacccttaacatttcctggtcaggaaggaaaatcagtacctggacgggcctcgaaaatgacaaatgcaacagcgagccctttgtgtccagctaagctaaagtctcctcagtgtgcagccagattcctggggactgctgagtgtggttacaggctgcatttcagacaatgaccaggtttacttttcagatcacaaagcaaacagtcaccaaggatctgtcttccaactcttttttttttctgctgaaatgaagctacatgtcatgtttgtgttctttcatctgtggctcatccctgtaaaactacgaatctgagcctcaaataagcagtagtttttttgttgtttatttttaatgaaacagctgtgttaaggcgctgcttcagatgcaagttcacctggaaatactggtcagcgggcagcacgtcaaggtcacttaagcccacttttaactgcaggtcatcctcgcatcagccaaggctgtggtgctgttgatgccgcagttggacagcataggacggcttggttctgtttcattgtgtttgacaatgttgcagtttaaatgataatgtttaaatcaattggtacttgcctgtagtgttaaaccctatttgtgccattctcaagtcctttgatgtgaattttcagtttggtacagttagaaatgactcattgatgcggacaggtaagaacaacccatgtacccccgagtgattgcatgctttattctacctctaagccatcgtgttgacgtgggtatggacgcctgggtctgacctgacactgtgctgggagaatcaggatgtgtgtctaatggcgagctgacagccctctgctgatatttggcagaaggcaccagaccagcccagcagcaaatgctcatctttgggaacataggaagctttaccttggggaaggtatgctttacaaatgtccagtgtaatgaatgtttggaaaaaactggagttacaggaaaatgaaatctgactatctgctagttgccaaaacccagaaacattcctgtgtaatggttagttgggaaagaaggcagcacttgaaaaaatttaccaggttcctcactgggagatgtgggaaggggcgtgggacgcacgcggtcactccctctcctagtgagaggcagatggctggctctgaagggaggcaggcaccgtgggatttgggcttgctctgcttggtccccatgtgatgccctgtgctgtaagatatcagaaagacctggaacaaggcaaactttatgtcctcctggcatgttattgataacagagccaggaagtccagtgtacattacagattttctgggagaaatagtccttccagagaaaggattccttcccagcctccaggctggtgtctcatgaggtgaggaggctggcccagaaggaaggggacgttaggtggtgaagcaggctcccctgggcctctgagggccagcagtcccaaccatttgcctcttcgttttgaccaagcacaaaagagatattccctagaagtgtcacacggaggcttctgtgccaaagactgccttgtagaggtctcatcacctcacacttcttgacttcacaaaattgtggccctgagatcagtactcctctcttaagtatttattattattattatttactttacctcaagcagacagacataggttttgaggcttgaatacatggcagtggaatacaaggccctccctagcagccgccccaggcctggaaagtgggagatttcattcgcccgggttaaaaatccagaggaagacagaagagaggagtcctaggaactgagcagattttagagacgcaaatgatgtttaagagagccttgtgatttgtagcaagcatgggcactgctttttcttactaatgtggtagatctacacgaacattctaggctgttctgctcagagcgaggaaccactgctcctcaatggggagggaacataccacccagccaggcttagcattgggttttatcctttaataaaagttttataatgaatcctgttcaccttaaagtgtgattatggagatgattggctccatattccaccacgtcattccttcaactcaccagacacctttctttagttgaaataaaccagcatgacctggagatcatggtgactgtaagctaagtctgttttcatgccagatttcagccccacccagagtgtgctctagatgttgttgatttgaatggttttcccagttcccactccacatggggaagttgaatgaatgcacacctgctgctcacttcttgtgaggctgccttttgtgatcaaataacaggaagttctgctttagaggagggcacgatgaccatgtggcagtctgcaagtggaattttgggatggcagcccgaggaacatccagagttactgtgtgacttggtcctgccatcgttagctttgaaatcacaggcattgggctctgttttgacaccattcattggactgcgggacagtcattctttacgttctctcttgagctggtgagagaggaggaagagggaagtcaagagcaacctccaaggcctatgtcagcctcttctccttgggtcttggggtgggttagaactgggttccagtctggccagatgggttgctggctgcactgagggtgattcttctcagaagatgggctgcctgtggtcaggacagggcataccagtctggactccaccttcccagacacctactttaaggacctgtggaaactgggtgatccaattatagggctggggcaaccctgctttggccaccctcatttacaaacttaggttgggagcttgggtttcctgtctcacttccaaaagccttcaagatggcagcagatggacacaccctctcatttcttgtgtcttgtctgtcagatggcaggaggcctgtatcagtaaatttgaggaaaatgttctctcctgggccagcctcacagcttgcgttgggtgtgttggaattgttctcttcggccttgttctgccttgtgatcttttcaattcagtgaataaaccaggaatccattttttcaccaacccaccctgtagattgtcagctttttgtttgagagatgcctggtctcacagttacatgtatcagagtgtgtgtaagttgtctgtgttagaaaggttggggtgggggctttgttgcaggggattagactgttctttcttcatcataatttgagatacatcctgagtatgactgtctaaccctttctgtgtggcagaaaaatatgttttccaggtagtttttactactacagagagtctgtaaataagtgctttaaaaaaataacaaaccaataagatatttgtctcctatataaacattctgtgtatttagcacttgaaaatcaacaaatccagaatttaaaaaaatgccacagacttttcaaagcccaactctacttttttgagaatttgtccgtacctactaatatgccttattcttcttcacctagtgttttaaaagtcctgggtagaaagagttttagaaatgtaatcagttgttcagcttcaataatatagagatctaacatagtcagtcctcaggccccctaaagaaacaagcaagaaagtgagggccatcactagggttggctttggggaggggaaaactaaggactgcttttgccaaatgatatttttgataatgtaaggaaacacagggaccacaaaaccttttttttttttttaagtgtgaaagattagtgccttttggcatacttttgattttagaggatatagtatcggcattgacaaatcacgtagaaacaaagaatgctatagatgacaacagtattaaatgttactcctgattctgcagaacagcttttgaagatactggggggtatcttcaagcctcagagcagcttgtttcagatagaaattctctatgggttgaaatgccaaaaacagaaaacatgatgttgactcatgtaatttagtccattttagcagagcctttagtgttaacaccagtggcgaggagcattgcatattctctgtcagcagcagcactcccacaccaggtggttctgggctctctgtaggctggtcctagtaggtgacacccagcaacacccctgttggacaggattgattgttcgcagtcttagaccaacacttcagtcagaaatgttactgggaggaggaaaggaaaatcactttttttcctccatgtggaaatgaggagagaggaaagtggattgcaaaccaaaatgtgagtcagtgtgatgaagcagtggctctgtcatctcggcctttatccaataacaaaccagcatctcttaaaggcgcttttggcctagacacccctgaagtttggatgaagtctggtggattccctgtctgttgtatttctgtgtgcctgttcccttcattgctgtgagttgggagtgcattgagagatgatgtccatctgatatattcctgtgaaataaactgccagcaaactttctaacttgtattttaactgttaaagaagagattaaaaacttcggctttggacatgtccacattatggactgtcatcttatttttaaaagtcattctttacgtttaaaattttaaaataaaaaccttctgaggtattgatgtagtccaccgtgtaaatgttaccttctctccatgctgccattatgccaaaacaaaagctgtgataaaaaaagtgcttgagagagtgtgttgataagaaagtgatttatttacagatggaagtctttgtttcatgaagctaccaaactttaaaaagaatgtcacccttttttttgtttgttatggaaaccagagattgtaaaatggaaaaagaatcgtttttttgttgactttttgatgctggcacgaggtttttgtccacttttttcatatatctgtgtataaaaaaattgttgtttactatggaattagtattacattttgaggtaaacaaaagaatttgtattgcttgataaatattagcttgtaaatttaaagtttctttacttcaattaacttaaaggaccaataaacccataaaagatgctttcttta

SEQ ID NO: 1901 - DNA, 1388 bp, Homo sapiens
tggcctgactcacaggacactaaggctccttttctgaagaagccttttaccagtctcatttaggggatgggaacaacatgtcttcacctagggactttagagcagagcctgtaaacgattatgagggaaatgactctgaagcagaagacttgaatttcagggagactttgccttcatcaagtcaggaaaacacacctagatcaaaggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatggctttagaacttaagaatctgcctggtgagttcaactctgggaatcaaccaagcaacagagaaaaaaatagataccgagatattcttccatatgattcaacacgcgttcctcttggaaaaagcaaggactacatcaatgctagttatattagaatagtcaattgtggagaagagtatttttatatcgctactcaaggaccactgctgagcaccatagatgacttttggcaaatggtgttggaaaataattcaaatgttattgccatgataaccagagagatagaaggtggaattatcaaatgctaccattactggcccatttctctgaagaagccattggaattgaaacacttccgtgtattcctggagaactaccagatacttcaatatttcatcattcgaatgtttcaagttgtggagaagtccacgggaactagtcactctgtaaaacagttgcagttcaccaagtggccagaccatggcactcctgcctcagcagatagcttcataaaatatattcgttatgcaaggaagagccaccttacaggacccatggttgttcactgcagtgccggcataggccggacaggggtgttcctatgtgtggatgtcgtgttctgtgccatcgtaaagaactgttcattcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcac

SEQ ID NO: 1902 - DNA, 2539 bp, Homo sapiens
gtgaacaaaaattgtttgctggcccccaggatactaactagacctttggcctgactcacaggacactaaggctccttttctgaagaagccttttaccagtctcatttaggggatgggaacaacatgtcttcacctagggactttagagcagagcctgtaaacgattatgagggaaatgactctgaagcagaagacttgaatttcagggagactttgccttcatcaagtcaggaaaacacacctagatcaaaggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatgacgggaactagtcactctgtaaaacagttgcagttcaccaagtggccagaccatggcactcctgcctcagcagatagcttcataaaatatattcgttatgcaaggaagagccaccttacaggacccatggttgttcactgcagtgccggcataggccggacaggggtgttcctatgtgtggatgtcgtgttctgtgccatcgtaaagaactgttcattcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcacctcctcataaagaacatgtttgcactgtgctgaagggctttgctatgcatacaatctgctttcttggtttatcagtttattttctttctaaaagctccctgaagggcaatatcatttggcttggggtgatcagtgtttacttattgatcttgctagacaatatcaaaataacttcccacattttccagtgaaacagatgttacataaaacgattgcagcttggctatttggttgaagggattacagagcccaataaaggatttaaaatatattcattaagattttatttggaaaggtggctggagagagctgaggatttccaggactttgtaagttcttattctgggagaacataaggccaataatcatgacctcttccaggcatttttaagacagatgtctattcatgttctttagctagagcctgtactttttgctggcatttgaataacccagtttaaaaagagtccagttagggtggactaactttggacacaaattggcttccatttcctacattttcatactgctgccttcctacagctgctagaccaagacctgttggtctgggaagcatttcatggatagggagagctcctctcggtgaacagtccaaaactaaaatagatgtttatatagaaagcccaagaggagacttttgccatgcctgagttctttcctatcccaccctaacacttaacatattacttagtctgctttgttaaaagcaagtattacctttaacttgcctcttactctttgccctttagctaactaataaagtttgatataggcattattatataattctgagtcattcatggtatctctcatgtttgatgtatttttcaaactaagatctatgatagttttttttccagagttccattaaatcatttatttcctttactttctcacctctgttgaaacatttagaaactggatttgggaacccaattttggaaaaccagattcatagtcatgaaaatggaaacttccatattctgtttttgaaaagatgtggccattattacagtaattttattataggactttgcctcgtacaattaatagtgatattttggacaaggagttctggtgacaagctatacctaattataagctataaaacaatagatatgagtgtttgtacagtttaactcaatggagatcagaatattctatgtattgagaaaatgtttaatatcaatctataaatcttgaatttctaagaggcttattttgttcttttggctgaatgagtatatttgaattggttgaataattaataattctcattgtaaaaataattatatgccaaaaatatatttgatgttaaatcaaatagatgattctgtttacattgttcatatgaataataatctgtgttaatttcattttgataattggcctttaatatttgtatctctaattttattttctctctgttactgtaaaataatagctataatgtataacaattttcttcagaagaattctatgctattattaaaataaaatatttactgtg

SEQ ID NO: 1903 - DNA, 2481 bp, Homo sapiens
gcgtggacccaactggcgaggctgctggggttgcagcgggacagttggggcggccccgcaggcccaggtgaacaaaaattgtttgctggcccccaggatactaactagacctttggcctgactcacaggacactaaggctccttttctgaagaagccttttaccagtctcatttaggggatgggaacaacatgtcttcacctagggactttagagcagagcctgtaaacgattatgagggaaatgactctgaagcagaagacttgaatttcagggagactttgccttcatcaagtcaggaaaacacacctagatcaaaggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatggctttagaacttaagaatctgcctggtgagttcaactctgggaatcaaccaagcaacagagaaaaaaatagataccgagatattcttccatttcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcacctcctcataaagaacatgtttgcactgtgctgaagggctttgctatgcatacaatctgctttcttggtttatcagtttattttctttctaaaagctccctgaagggcaatatcatttggcttggggtgatcagtgtttacttattgatcttgctagacaatatcaaaataacttcccacattttccagtgaaacagatgttacataaaacgattgcagcttggctatttggttgaagggattacagagcccaataaaggatttaaaatatattcattaagattttatttggaaaggtggctggagagagctgaggatttccaggactttgtaagttcttattctgggagaacataaggccaataatcatgacctcttccaggcatttttaagacagatgtctattcatgttctttagctagagcctgtactttttgctggcatttgaataacccagtttaaaaagagtccagttagggtggactaactttggacacaaattggcttccatttcctacattttcatactgctgccttcctacagctgctagaccaagacctgttggtctgggaagcatttcatggatagggagagctcctctcggtgaacagtccaaaactaaaatagatgtttatatagaaagcccaagaggagacttttgccatgcctgagttctttcctatcccaccctaacacttaacatattacttagtctgctttgttaaaagcaagtattacctttaacttgcctcttactctttgccctttagctaactaataaagtttgatataggcattattatataattctgagtcattcatggtatctctcatgtttgatgtatttttcaaactaagatctatgatagttttttttccagagttccattaaatcatttatttcctttactttctcacctctgttgaaacatttagaaactggatttgggaacccaattttggaaaaccagattcatagtcatgaaaatggaaacttccatattctgtttttgaaaagatgtggccattattacagtaattttattataggactttgcctcgtacaattaatagtgatattttggacaaggagttctggtgacaagctatacctaattataagctataaaacaatagatatgagtgtttgtacagtttaactcaatggagatcagaatattctatgtattgagaaaatgtttaatatcaatctataaatcttgaatttctaagaggcttattttgttcttttggctgaatgagtatatttgaattggttgaataattaataattctcattgtaaaaataattatatgccaaaaatatatttgatgttaaatcaaatagatgattctgtttacattgttcatatgaataataatctgtgttaatttcattttgataattggcctttaatatttgtatctctaattttattttctctctgttactgtaaaataatagctataatgtataacaattttcttcagaagaattctatgctattattaaaataaaatatttactgtg

SEQ ID NO: 1904 - DNA, 1653 bp, Homo sapiens
cctggaccagggggacatctgagaagcatgatgttgagtgccagacagctaggtctccaaagttgggctcgttgctggagtctgccccctcaaccgctgaattcttgctgggagtagtagcagtttgggaatgccatctgcagcatggagctggggttgagcttggaccaccccaagacctggggtggatcttaagggtcagcttgagcctaggctctcgagtcctgacatcatcctctaccgccacgctttccagctgtcagccttggtctccatctggttccttgagggtgtggcctctgcgtcctgctatcacccttccttgtctaaaccttcccacctgagtggagaggaacttgggggaaaatctctaagcatgggctcttcctgctgtcctatgcttcctatcccctagggttagtggtgcgtgttgggtggtggagcgagggatcccttggagcaaggttcttagagaactttgggtctgaaagcagctcaaaccttccaaagccccaagcttccctgtgctattagagcacctcctcctggagagagcggctctcgtggctggggagttggatgcaccaaacctgtgtgcggctggagagggaggcttctgccagaccctctcccgggcctgtcctgccacccaggcccctccccagtcacactgagctccagatcagggaagggccgaaaaggacgatcagggcagccgcagaaggggcgccctgcgtgggacgggtccgttgcgcgcctggtaaccgagggggaagggaaggggcctctggcgtgcggggcggtgtcgcgcaggtcccaccccgcctgcccgcgccgcccattggtcccgagcgcgatgacttggcgggcggagcaggaaggaaaccgctcccgagcacggcggcggcgtcgtctcccggcagtgcagctgccgctaccgccgccctctgcccgccggcccgtctgtctacccccagcatgagcggcctgcgcgtctacagcacgtcggtcaccggctcccgcgaaatcaagtcccagcagagcgaggtgacccgaatcctggatgggaagcgcatccaataccagctagtggacatctcccaggacaacgccctgagggatgagatgcgagccttggcaggcaaccccaaggccaccccaccccagattgtcaacggggaccagtactgtggggactatgagctcttcgtggaggctgtggaacaaaacacgctgcaggagttcctgaagctggcttgagtcaagcctgtccagagttcccctgctggactccatcaccacactccccccagccttcacctggccatgaaggaccttttgaccaactccctgtcattcctaacctaaccttagagtccctcccccaatgcaggccacttctcctccctcctctctaaatgtagtcccctctcctccatctaaaggcaacattccttacccattagtctcagaaattgtcttaagcaacagccccaaatgctggctgcccccagccaagcattggggccgccatcctgcctggcactggctgatgggcacctctgttggttccatcagccagagctctgccaaaggccccgcagtccctctcccaggaggaccctagaggcaattaaatgatgtcctgttcca

SEQ ID NO: 1905 - DNA, 3301 bp, Homo sapiens
caatatatgaggggatacagtgcctcaggtttaaaagagcaggaagctgagtgagaggttgcagaaaaagtgtcttcgctcggcagaggttacaggtggcatctcagaaagagctttgaggctacaggctgtagtcgggaaggggatcggagaactgtgtgaagggacagcttagggactagcgtcctgggactagggggaagttcgcgactttctgaagactggcaggaatgtgcctcctggccctcgatgcttcccccctgaggggaggcatcgtgagggactgtggcaggcttcactgaacgctgagccggggaggtccaactccacgtatggatccggggaatgagaattcagccacagaggctgccgcgatcatagacctagatcccgacttcgaaccccagagccgtccccgctcctgcacctggccccttccccgaccagagatcgctaaccagccgtccgagccgcccgaggtggagccagatctgggggaaaaggtacacacggaggggcgctcagagccgatcctgttgccctctcggctcccagagccggccgggggcccccagcccggaatcctgggggctgtaacaggtcctcggaagggaggctcccgccggaatgcctggggaaatcagtcatatgcagaactcatcagccaggccattgaaagcgccccggagaagcgactgacacttgcccagatctacgagtggatggtccgtactgtaccctacttcaaggacaagggtgacagcaacagctcagcaggatggaagaactcgatccgccacaacctgtccctgcacagcaagttcatcaaggttcacaacgaggccaccggcaaaagctcttggtggatgctgaaccctgagggaggcaagagcggcaaagccccccgccgccgggccgcctccatggatagcagcagcaagctgctccggggccgcagtaaagcccccaagaagaaaccatctgtgctgccagctccacccgaaggtgccactccaacgagccctgtcggccactttgccaagtggtcaggcagcccttgctctcgaaaccgtgaagaagccgatatgtggaccaccttccgtccacgaagcagttcaaatgccagcagtgtcagcacccggctgtcccccttgaggccagagtctgaggtgctggcggaggaaataccagcttcagtcagcagttatgcagggggtgtccctcccaccctcaatgaaggtctagagctgttagatgggctcaatctcacctcttcccattccctgctatctcggagtggtctctctggcttctctttgcagcatcctggggttaccggccccttacacacctacagcagctcccttttcagcccagcagaggggcccctgtcagcaggagaagggtgcttctccagctcccaggctctggaggccctgctcacctctgatacgccaccaccccctgctgacgtcctcatgacccaggtagatcccattctgtcccaggctccgactcttctgttgctgggggggcttccttcctccagtaagctggccacgggcgtcggcctgtgtcccaagcccctagaggctccaggccccagcagtctggttcccaccctttctatgatagcaccacctccagtcatggcaagtgcccccatccccaaggctctggggactcctgtgctcacaccccctactgaagctgcaagccaagacagaatgcctcaggatctagatcttgatatgtatatggagaacctggagtgtgacatggataacatcatcagtgacctcatggatgagggcgagggactggacttcaactttgagccagatccctgagtcatgcctggaagctttgtcccctgcttcagatgtggagccaggcgtgttcatatctactctttacccttgagccctccccaggaatttgggaccctgctttagagctagggtggggtctggtcacacacaggtgttgaagaaattataaagataaagctgccccatctggggacgatatggggagggagatgggaggggaaaggggagagggtttttctcactgtgccaattagggggtaaggccccctctcaggagccatcatcggctttccccattcctacccacttaggctttgtagcaagatgagcaatgctgttggaaatgtgaagtcaccagtggccttacccctgcctttgggagcaggatttttttgtagagagtcttatctgagctgagccaggctagctggagcctgggatttctatgcagtggccccttaggccagtgatgtgcggtgggtgggctgtttaggggatctggaagggccaaggtctgagcactggagtggctcgccaggccaaatcacccttagaaggctgcagataacagaaaggctttttataaacttttaaagaaatataaacacaaatatagagattttttaaccatggcagggtgctagtggtgggcagaatgcttttttttctttctgaaggctttgtgatagtgacatgatacaaacactacagacaataaatattaggagacacagggaagtggggagaggtggggagtaatagtaaacacagggaagagctcccctacggaccaggtatagagaaaggtctatgcagaaataggttagagtttccctaacaaaaaagctaacccaggtcccctcattccttcaacttgtgcctgggagtgtgtggtgttagggtgcagccacactcttctatgacccagcatgggttagtgctatggtgggagagtacattgaaggcctggaattagcttggggccagggaagggactgggaggggagagaagagaaggagggaaggatttaggatggtaaagttaggtacagagacctccctgttcaaggcccctgacagctgtccctgcccttcttccccttccctgactgcaggggttatgtggaagtgtgtgtggcagcaggcagcggggaggggaggaacagggaagggggagctggggagcttggctgagggtctgggaaatgagcagggatggggggggatgtggatcaggtttactagcacctgccagggaggccatctggggctccttctccaccccagcccccaaagcagcccttcccccagtgccctttgcatcgtcccctcccccacccctgctgtgggttcccatcatttcctgtgtcagcgcctggcctacccagattgtatcatgtgctagattggagtggggaagtgtgtcaaatcaataaatgaataaattcaataaatgcctataaccagct

SEQ ID NO: 1906 - DNA, 1770 bp, Homo sapiens
gacagaattcgggcaccaggagaaggaagccaacaggatccgacccggtgttttgtgacaaaggcaagacccccaggtctacttagagcaaagttagtagaggaggcagctaggcgtggctctcattccttcccacagaatggattataagtcgagcctgatccaggatgggaatcccatggagaacttggagaagcagctgatctgccctatctgcctggagatgtttaccaagccagtggtcatcttgccgtgccagcacaacctgtgccggaagtgtgccaatgacatcttccaggctgcaaatccctactggaccagccggggcagctcagtgtccatgtctggaggccgtttccgctgccccacctgccgccacgaggtgatcatggatcgtcacggagtgtacggcctgcagaggaacctgctggtggagaacatcatcgacatctacaaacaggagtgctccagtcggccgctgcagaagggcagtcaccccatgtgcaaggagcacgaagatgagaaaatcaacatctactgtctcacgtgtgaggtgcccacctgctccatgtgcaaggtgtttgggatccacaaggcctgcgaggtggccccattgcagagtgtcttccagggacaaaagactgaactgaataactgtatctccatgctggtggcggggaatgaccgtgtgcagaccatcatcactcagctggaggattcccgtcgagtgaccaaggagaacagtcaccaggtaaaggaagagctgagccagaagtttgacacgttgtatgccatcctggatgagaagaaaagtgagttgctgcagcggatcacgcaggagcaggagaaaaagcttagcttcatcgaggccctcatccagcagtaccaggagcagctggacaagtccacaaagctggtggaaactgccatccagtccctggacgagcctgggggagccaccttcctcttgactgccaagcaactcatcaaaagcattgtggaagcttccaagggctgccagctggggaagacagagcagggctttgagaacatggacttctttactttggatttagagcacatagcagacgccctgagagccattgactttgggacagatgaggaagaggaagaattcattgaagaagaagatcaggaagaggaagagtccacagaagggaaggaagaaggacaccagtaaggagctggatgaatgagaggcccccagatgcagagagactggagagggtggggaggggcccagcggccttggtgacaggcccagggtgggaggggtcggggcccctggaggggcaatggggaggtgatgtcttctctctgctcagagagcagggactagggtaggaccctcaccgctgcgtccagcagacactgaaccagaattggaaacgtgcttgaaacaatcacacaggacacttttctacattggtgcaaaatggaatattttgtacatttttaaaatgtgatttttgtatatacttgtatatgtatgccaatttggtgctttttgtaaaggaacttttgtataataatgcctggtcgttgggtgacctgcgattgtcagaaagaggggaaggaagccaggttgatacagctgcccacttcctttcctgagcaggaggatggggtagcactcacagggacgatgtgctgtatttcagtgcctatcccagacatacggggtggtaactgagtttgtgttatatgttgttttaataaatgcacaatgctctcttcctgttcttcaaa

SEQ ID NO: 1907 - DNA, 3581 bp, Homo sapiens
cgagaagtgcttccaagcgtccattttgagccttggaaactacgacgaccaaagggccacgggttcatgggtcgtttctcatttccgtcgagttaaacgtctggggctgcttctgaggaatcagcttgactggccagcaagttcagctccggcaagtcatttgattcacccggtgatgaaatgggggtcaaccagtctgtgggctttccacctgtcacaggaccccacctcgtaggctgtggggatgtgatggagggtcagaatctccaggggagcttctttcgactcttctacccctgccaaaaggcagaggagaccatggagcagcccctgtggattccccgctatgagtactgcactggcctggccgagtacctgcagtttaataagcgctgcgggggcttgctgttcaacctggcggtgggatcttgtcgcctgcctgttagctggaatggcccctttaagacaaaggactctggataccccttgatcatcttctcccatggcctaggagccttcaggactttgtattcagccttctgcatggagctggcctcacgtggctttgtggttgctgtgccagagcacagggaccggtcagcggcaaccacctatttctgcaagcaggccccagaagagaaccagcccaccaatgaatcgctgcaggaggaatggatccctttccgtcgagttgaggaaggggagaaggaatttcatgttcggaatccccaggtgcatcagcgggtaagcgagtgtttacgggtgttgaagatcctgcaagaggtcactgctgggcagactgtcttcaacatcttgcctggtggcttggatctgatgactttgaagggcaacattgacatgagccgtgtggctgtgatgggacattcatttggaggggccacagctattctggctttggccaaggagacccaatttcggtgtgcggtggctctggatgcttggatgtttcctctggaacgtgacttttaccccaaggcccgaggacctgtgttctttatcaatactgagaaattccagacaatggagagtgtcaatttgatgaagaagatatgtgcccagcatgaacagtctaggatcataaccgttcttggttctgttcatcggagtcaaactgactttgcttttgtgactggcaacttgattggtaaattcttctccactgaaacccgtgggagcctggacccctatgaagggcaggaggttatggtacgggccatgttggccttcctgcagaagcacctcgacctgaaagaagactataatcaatggaacaaccttattgaaggcattggaccgtcgctcaccccaggggccccccaccatctgtccagcctgtaggcacaactggccatttgtaaagtcacttcagccaagttttcatttgggagctacccaagggcacccatgagctcctatcaagaagtgatcaacgtgaccccttttcacagattgaaaggtgtaatcacactgctgcttggataactgggtactttgatcttagatttgatcttaaaatcactttgggactgggatcccttgctgattgacaaacagactttctgggaccttgatggagtggggaacaagcagtagagtgggactgggggagacccaggccccgggctgagcactgtgaggcctggatgtgaagactcagcccagcgaagctcattcccttacccccggccagtgctgctgcttcagtggaagagatgaagccaaaggacagaatgaaaatccctaccttcagagactctagcccagcccaacaccatctcttcctacctctcagccttctccctccccagggccacttgttgaagtctgagcactttatgtaaatttctaggtgtgagccgtgatcacattttctatttatttccaagtcttctcattgtatggaacatagtactacttatacttacagtagtaagttatacttgtgagcccacagagtggcagacagcatggctctcacagcacagggagaaaaactgaggtacacagaggtacctcagaagctctggatgtctttgggggttttgctaagtgtatcttgataggaaacaacaaaagcaggttgagatggggaagatgacagaacaacagtgttaaatggccatttgcacaggcctttgccacaacagagaagtagtttggtcagctaaaactcagctgcagcctggacagtagagcgagaccccatcttaaaaataaagaaggctgggcgtggtggctcatgcctgtaatcccaacactttgggaggccaaggcaggcagatcacttaaggccaggagttcaagaccacctggccaacatggtgaaaccccgtctctactaaaaatacaaaaaattagcctggcgtaatggcaggcgcctataatcccagctactcaggaggctgaagcagaagaatcacttgaacctaggaggcggaggttgcagtgagtcaagatcgcgccactgcactccagcctgggtgacagagcaagactctgtcttaaaaaaaaaaaaaagaaaaagaaaaatttaaaataaataaaatttaaaaacgcagaaggccactcccagagaggcctaggagtaccttggtcattttttcttgcctcaaatattataaacctccaacttgctcagaatcagggtgcttttattgtctgttttctggctctgaggcccttgccccaaatttaagtcagatacagactgaatttccattctgttctgtttataatatgaatgatattaatactcttgtttgcttaatgttatgttggaattttctgtttaatctgcagtagagcaagatggagagccatctggaattgacttccttctgtctttcttctgtgttcgcttactacttgggcccatgtgggaaaaaaactttaaaaggaaggaagtcttcttagggatccagttcaaagctatttgggggcatcaaactgaaactctcttctccactactcaagacttcgtgcctcagtccaagtaggtaagagcaaaagggaaatgcatctctacacaatggcccatggtcagggccaccagagcaagctgggcctagatctccacctgtcagtgactggccattctaagaggtgaaacagcagatcgttgaggctgtgagggaggatctttgaattcccatgagacatagcataagaagggtatcattaaagccctgggctctaaagttacagagcctggttttgagtcctggctccaccactgccaactgggtaaatttgagcaaatggtattctctttcttatctcagctcctgcgtttctaaaatgagggtctgcgttatgaatagttaggaggattaagtgagaggatgtataacccatgggttacttaaaagtatatttcctaccttccaaacatgagatttttctagttatagtttcttttctagcttgattgctttgtggtcagagaaaatgacccatatggtttccatccttcaaaatttgttgaaacttggttgttggcctagtatgagatcaatgttgtaaatgtgccatgtatgtttaaaaagactatatattctgaa

SEQ ID NO: 1908 - DNA, 2523 bp, Homo sapiens
tgaggaatcagcttgactggcaacaggaagccgagaggaaaccagcaagcggctgctgttctgtgttcccccatccagccagcaagttcagctccggcaagtcatttgattcacccggtgatgaaatgggggtcaaccagtctgtgggctttccacctgtcacaggaccccacctcgtaggctgtggggatgtgatggagggtcagaatctccaggggagcttctttcgactcttctacccctgccaaaaggcagaggagaccatggagcagcccctgtggattccccgctatgagtactgcactggcctggccgagtacctgcagtttaataagcgctgcgggggcttgctgttcaacctggcggtgggatcttgtcgcctgcctgttagctggaatggcccctttaagacaaaggactctggataccccttgatcatcttctcccatggcctaggagccttcaggactttgtattcagccttctgcatggagctggcctcacgtggctttgtggttgctgtgccagagcacagggaccggtcagcggcaaccacctatttctgcaagcaggccccagaagagaaccagcccaccaatgaatcgctgcaggaggaatggatccctttccgtcgagttgaggaaggggagaaggaatttcatgttcggaatccccaggtgcatcagcgggtaagcgagtgtttacgggtgttgaagatcctgcaagaggtcactgctgggcagactgtcttcaacatcttgcctggtggcttggatctgatgactttgaagggcaacattgacatgagccgtgtggctgtgatgggacattcatttggaggggccacagctattctggctttggccaaggagacccaatttcggtgtgcggtggctctggatgcttggatgtttcctctggaacgtgacttttaccccaaggcccgaggacctgtgttctttatcaatactgagaaattccagacaatggagagtgtcaatttgatgaagaagatatgtgcccagcatgaacagtctaggatcataaccgttcttggttctgttcatcggagtcaaactgactttgcttttgtgactggcaacttgattggtaaattcttctccactgaaacccgtgggagcctggacccctatgaagggcaggaggttatggtacgggccatgttggccttcctgcagaagcacctcgacctgaaagaagactataatcaatggaacaaccttattgaaggcattggaccgtcgctcaccccaggggccccccaccatctgtccagcctgtaggcacaactggccatttgtaaagtcacttcagccaagttttcatttgggagctacccaagggcacccatgagctcctatcaagaagtgatcaacgtgaccccttttcacagattgaaaggtgtaatcacactgctgcttggataactgggtactttgatcttagatttgatcttaaaatcactttgggactgggatcccttgctgattgacaaacagactttctgggaccttgatggagtggggaacaagcagtagagtgggactgggggagacccaggccccgggctgagcactgtgaggcctggatgtgaagactcagcccagcgaagctcattcccttacccccggccagtgctgctgcttcagtggaagagatgaagccaaaggacagaatgaaaatccctaccttcagagactctagcccagcccaacaccatctcttcctacctctcagccttctccctccccagggccacttgttgaagtctgagcactttatgtaaatttctaggtgtgagccgtgatcacattttctatttatttccaagtcttctcattgtatggaacatagtactacttatacttacagtagtaagttatacttgtgagcccacagagtggcagacagcatggctctcacagcacagggagaaaaactgaggtacacagaggtacctcagaagctctggatgtctttgggggttttgctaagtgtatcttgataggaaacaacaaaagcaggttgagatggggaagatgacagaacaacagtgttaaatggccatttgcacaggcctttgccacaacagagaagtagtttggtcagctaaaactcagctgcagcctggacagtagagcgagaccccatcttaaaaataaagaaggctgggcgtggtggctcatgcctgtaatcccaacactttgggaggccaaggcaggcagatcacttaaggccaggagttcaagaccacctggccaacatggtgaaaccccgtctctactaaaaatacaaaaaattagcctggcgtaatggcaggcgcctataatcccagctactcaggaggctgaagcagaagaatcacttgaacctaggaggcggaggttgcagtgagtcaagatcgcgccactgcactccagcctgggtgacagagcaagactctgtcttaaaaaaaaaaaaaagaaaaagaaaaatttaaaataaataaaatttaaaaacgca

SEQ ID NO: 1909 - DNA, 847 bp, Homo sapiens
gttccttggagagcttggagccgcgcgccggagggaataggaaagcttggttacaacccgggacacccggagcttcaggatggttcgtactaagacatggaccctgaagaagcactttgttggctatcctactaatagtgactttgagttgaagacagctgagctcccacccttaaaaaatggagaggtcctgcttgaagctttgttcctcaccgtggatccctacatgagagtggcagccaaaagattgaaggaaggtgatacaatgatggggcagcaagtggccaagtaattatttccatttgtcccagtgcttggaaaatatgtctcctctttacctcctgctgggtcctgtctctgtccattgctcctacaatttcttcagcctatgttgttgactcactgtgtgatcttggaatcaacttgggaaattctgtctccttcctaactagctggaaaggagggaaggatgtgaaattgtcattttttcagcttcactttgccatccttacttttaattactaaaaaaaaaaaagtatttgtccaggtcatgatttattgcgggatctggccagcagcccacaatgcaacagggttctctctttgttcccaggtggatcggcaggttgagaaataatagacacacacaagatagtgaaagctgggtccaggggcgtcaccgccttctggttccgtggtgccaccaaagcactgaatatacccgcatttattattaagtttagtgagggcgggggtaggttagtgagggatttagggtcatttgattatgaggtgagatggtcacatggggatgaagtaattctttaacatacatctgtatgcagaa

SEQ ID NO: 1910 - DNA, 1061 bp, Homo sapiens
gagatacgcgcacacacacacacaaacgcactcagatttcccggaccctggttttcctcctgtgaccctttcggggccgggctctcaccctaaagaagcagccccgccctggggtggccccaccctctcttgggacctgtcataagtcggaccccgggcgcccggctgcgcagtcccagccgccttccccaggcagtggaaccttcgggctcctgagcttcaggatggttcgtactaagacatggaccctgaagaagcactttgttggctatcctactaatagtgactttgagttgaagacagctgagctcccacccttaaaaaatggagaggtcctgcttgaagctttgttcctcaccgtggatccctacatgagagtggcagccaaaagattgaaggaaggtgatacaatgatggggcagcaagtggccaagtaattatttccatttgtcccagtgcttggaaaatatgtctcctctttacctcctgctgggtcctgtctctgtccattgctcctacaatttcttcagcctatgttgttgactcactgtgtgatcttggaatcaacttgggaaattctgtctccttcctaactagctggaaaggagggaaggatgtgaaattgtcattttttcagcttcactttgccatccttacttttaattactaaaaaaaaaaaagtatttgtccaggtcatgatttattgcgggatctggccagcagcccacaatgcaacagggttctctctttgttcccaggtggatcggcaggttgagaaataatagacacacacaagatagtgaaagctgggtccaggggcgtcaccgccttctggttccgtggtgccaccaaagcactgaatatacccgcatttattattaagtttagtgagggcgggggtaggttagtgagggatttagggtcatttgattatgaggtgagatggtcacatggggatgaagtaattctttaacatacatctgtatgcagaagtacagtatacagagataagaatttacaatatagtgtgtgcatcagtaatttctaacagagccttaaaa

SEQ ID NO: 1911 - DNA, 2298 bp, Homo sapiens
gagcttcaggatggttcgtactaagacatggaccctgaagaagcactttgttggctatcctactaatagtgactttgagttgaagacagctgagctcccacccttaaaaaatggagaggtcctgcttgaagctttgttcctcaccgtggatccctacatgagagtggcagccaaaagattgaaggaaggtgatacaatgatggggcagcaagtggccaaccagttattataataccattggtagaaatcgtctatggatctttactggaatttcagtgaccttacagatttatttagaggaaactgacatctttacaatttctctctccaaacacaagagttgtggaaagtaaaaatgtagccctaccaaaaggaactattgtactggcttctccaggctggacaacgcactccatttctgatgggaaagatctggaaaagctgctgacagagtggccagacacaataccactgtctttggctctggggacagttggcatgccaggcctgactgcctactttggcctacttgaaatctgtggtgtgaagggtggagaaacagtgatggttaatgcagcagctggagctgtgggctcagtcgtggggcagattgcaaagctcaagggctgcaaagttgttggagcagtagggtctgatgaaaaggttgcctaccttcaaaagcttggatttgatgtcgtctttaactacaagacggtagagtctttggaagaaaccttgaagaaagcgtctcctgatggttatgattgttattttgataatgtaggtggagagttttcaaacactgttatcggccagatgaagaaatttggaaggattgccatatgtggagccatctctacatataacagaaccggcccacttcccccaggcccacccccagagattgttatctatcaggagcttcgcatggaagcttttgtcgtctaccgctggcaaggagatgcccgccaaaaagctctgaaggacttgctgaaatgggtcttagagcttccctactttgtaattgactgacttcaagcaaataatcttgtctataaatccatgaagagtgctaagccatcactggaatacattagcgaaaaacttgtatcaggtaactcaggtctctatataagaccccttaaaaaaatctgaaaatgtaaattagttcccattagtaggctgtgccttgtaggagaaagagaaatgaagaccctttctcactaacatgaacccttccttcccacactcccagataaaggttaaacacatgttaaaagaaccttggcttaaaggggagacagattattagactgtcctgccatttatatttcctgaataggacctgcctcttcaggggccagaggtaatgaagggtgctcttttctctgtctatttgtacctcctctgagatcattgtgttattaaactttactatgcatcttatttagaaattgcttaatcgctctgggcacggtggctcacgcctgtaatcccagcactttgggaggccgaggcaggcagatcacgaggtcaggagatcgagaccatcctggctaacacggtgaagccctgtccctactaaaaatacaaaacaattagccgggcatggtggtgagcacctgtagtcccagctagtcgggaggctgaggcaggagaatggcatgaacctgggaggcggagcttgcagtgagccaagatcgcggcactgcactccagcctgggcaacagagcgagactctgtctcaaaaaaaaaaaaaagaaagaaaaagagattgcttaatcactgccttatgacatttcgcactatgatccgacacctattatttcttcttaggtgtactttgtaatcttttttacatgtactgtgtaagtggatcttgccccaccttgacttcaagttcatggaggacaggacttccatctcttattttcaaggtttccaatgatgtacctgataaatttgttgctaggatgagaacagtatatcattgagaatattaaattaagttttaaaatttgttgttgctttgatacagggtaaaatccagtacaaggaatatatcattgaaggatttgaaaacatgccagctgcatttatgggaatgctgaaaggagataatttggggaagacaatagtgaaagcatgaaaaagaggacacatggaatctggaggccatttagatgattagttaatttgtttttcaccatttagcaaaaatgtatactaccttaaatgtcttaagaaatagtactcataatgagtttgagctacttaataaaatacatttaagtggt

SEQ ID NO: 1912 - DNA, 1388 bp, Homo sapiens
tggcctgactcacaggacactaaggctccttttctgaagaagccttttaccagtctcatttaggggatgggaacaacatgtcttcacctagggactttagagcagagcctgtaaacgattatgagggaaatgactctgaagcagaagacttgaatttcagggagactttgccttcatcaagtcaggaaaacacacctagatcaaaggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatggctttagaacttaagaatctgcctggtgagttcaactctgggaatcaaccaagcaacagagaaaaaaacagataccgagatattcttccatatgattcaacacgcgttcctcttggaaaaagcaaggactacatcaatgctagttatattagaatagtcaattgtggagaagagtatttttatatcgctactcaaggaccactgctgagcaccatagatgacttttggcaaatggtgttggaaaataattcaaatgttattgccatgataaccagagagatagaaggtggaattatcaaatgctaccattactggcccatttctctgaagaagccattggaattgaaacacttccgtgtattcctggagaactaccagatacttcaatatttcatcattcgaatgtttcaagttgtggagaagtccacgggaactagtcactctgtaaaacagttgcagttcaccaagtggccagaccatggcactcctgcctcagcagatagcttcataaaatatattcgttatgcaaggaagagccaccttacaggacccatggttgttcactgcagtgccggcataggccggacaggggtgttcctatgtgtggatgtcgtgttctgtgccatcgtaaagaactgttcattcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcac

SEQ ID NO: 1913 - DNA, 2539 bp, Homo sapiens
gtgaacaaaaattgtttgctggcccccaggatactaactagacctttggcctgactcacaggacactaaggctccttttctgaagaagccttttaccagtctcatttaggggatgggaacaacatgtcttcacctagggactttagagcagagcctgtaaacgattatgagggaaatgactctgaagcagaagacttgaatttcagggagactttgccttcatcaagtcaggaaaacacacctagatcaaaggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatgacgggaactagtcactctgtaaaacagttgcagttcaccaagtggccagaccatggcactcctgcctcagcagatagcttcataaaatatattcgttatgcaaggaagagccaccttacaggacccatggttgttcactgcagtgccggcataggccggacaggggtgttcctatgtgtggatgtcgtgttctgtgccatcgtaaagaactgttcattcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcacctcctcataaagaacatgtttgcactgtgctgaagggctttgctatgcatacaatctgctttcttggtttatcagtttattttctttctaaaagctccctgaagggcaatatcatttggcttggggtgatcagtgtttacttattgatcttgctagacaatatcaaaataacttcccacattttccagtgaaacagatgttacataaaacgattgcagcttggctatttggttgaagggattacagagcccaataaaggatttaaaatatattcattaagattttatttggaaaggtggctggagagagctgaggatttccaggactttgtaagttcttattctgggagaacataaggccaataatcatgacctcttccaggcatttttaagacagatgtctattcatgttctttagctagagcctgtactttttgctggcatttgaataacccagtttaaaaagagtccagttagggtggactaactttggacacaaattggcttccatttcctacattttcatactgctgccttcctacagctgctagaccaagacctgttggtctgggaagcatttcatggatagggagagctcctctcggtgaacagtccaaaactaaaatagatgtttatatagaaagcccaagaggagatttttgccatgcctgagttctttcctatcccaccctaacacttaacatattacttagtctgctttgttaaaagcaagtattacctttaacttgcctcttactctttgccctttagctaactaataaagtttgatataggcattattatataattctgagtcattcatggtatatctcatgtttgatgtatttttcaaactaagatctatgatagttttttttccagagttccattaaatcatttatttcctttactttctcacctctgttgaaacatttagaaactggatttgggaacccaattttggaaaaccagattcatagtcatgaaaatggaaacttccatattctgtttttgaaaagatgtggccattattacagtaattttattataggactttgcctcgtacaattaatagtgatattttggacaaggagttctggtgacaagctatacctaattataagctataaaacaatagatatgagtgtttgtacagtttaactcaatggagatcagaatattctatgtattgagaaaatgtttaatatcaatctataaatcttgaatttctaagaggcttattttgttcttttggctgaatgagtatatttgaattggttgaataattaataattctcattgtaaaaataattatatgccaaaaatatatttgatgttaaatcaaatagatgattctgtttacattgttcatatgaataataatctgtgttaatttcattttgataattggcctttaatatttgtatctctaattttattttctctctgttactgtaaaataatagctataatgtataacaattttcttcagaagaattctatgctattattaaaataaaatatttactgtg

SEQ ID NO: 1914 - DNA, 2481 bp, Homo sapiens
gcgtggacccaactggcgaggctgctggggttgcagcgggacagttggggcggccccgcaggcccaggtgaacaaaaattgtttgctggcccccaggatactaactagacctttggcctgactcacaggacactaaggctccttttctgaagaagccttttaccagtctcatttaggggatgggaacaacatgtcttcacctagggactttagagcagagcctgtaaacgattatgagggaaatgactctgaagcagaagacttgaatttcagggagactttgccttcatcaagtcaggaaaacacacctagatcaaaggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatggctttagaacttaagaatctgcctggtgagttcaactctgggaatcaaccaagcaacagagaaaaaaacagataccgagatattcttccatttcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcacctcctcataaagaacatgtttgcactgtgctgaagggctttgctatgcatacaatctgctttcttggtttatcagtttattttctttctaaaagctccctgaagggcaatatcatttggcttggggtgatcagtgtttacttattgatcttgctagacaatatcaaaataacttcccacattttccagtgaaacagatgttacataaaacgattgcagcttggctatttggttgaagggattacagagcccaataaaggatttaaaatatattcattaagattttatttggaaaggtggctggagagagctgaggatttccaggactttgtaagttcttattctgggagaacataaggccaataatcatgacctcttccaggcatttttaagacagatgtctattcatgttctttagctagagcctgtactttttgctggcatttgaataacccagtttaaaaagagtccagttagggtggactaactttggacacaaattggcttccatttcctacattttcatactgctgccttcctacagctgctagaccaagacctgttggtctgggaagcatttcatggatagggagagctcctctcggtgaacagtccaaaactaaaatagatgtttatatagaaagcccaagaggagatttttgccatgcctgagttctttcctatcccaccctaacacttaacatattacttagtctgctttgttaaaagcaagtattacctttaacttgcctcttactctttgccctttagctaactaataaagtttgatataggcattattatataattctgagtcattcatggtatatctcatgtttgatgtatttttcaaactaagatctatgatagttttttttccagagttccattaaatcatttatttcctttactttctcacctctgttgaaacatttagaaactggatttgggaacccaattttggaaaaccagattcatagtcatgaaaatggaaacttccatattctgtttttgaaaagatgtggccattattacagtaattttattataggactttgcctcgtacaattaatagtgatattttggacaaggagttctggtgacaagctatacctaattataagctataaaacaatagatatgagtgtttgtacagtttaactcaatggagatcagaatattctatgtattgagaaaatgtttaatatcaatctataaatcttgaatttctaagaggcttattttgttcttttggctgaatgagtatatttgaattggttgaataattaataattctcattgtaaaaataattatatgccaaaaatatatttgatgttaaatcaaatagatgattctgtttacattgttcatatgaataataatctgtgttaatttcattttgataattggcctttaatatttgtatctctaattttattttctctctgttactgtaaaataatagctataatgtataacaattttcttcagaagaattctatgctattattaaaataaaatatttactgtg

SEQ ID NO: 1915 - DNA, 3060 bp, Homo sapiens
ggacgcctggtgttctcgcgggaaagaaccgttgcgcccgactttgcgcggaggtaggagggggaagtggaggcgggagtgaagtctcgcgagaagagtcggttgccgtagcagagccctctagctgtgtgtgtctgaggctcggccgcctgagccgcggacggtttgctgagcccgttagtgcgcccggccgagacacgccgccgccatgtcccgctacctgcgtccccccaacacgtctctgttcgtcaggaacgtggccgacgacaccaggtctgaagacttgcggcgtgaatttggtcgttatggtcctatagttgatgtgtatgttccacttgatttctacactcgccgtccaagaggatttgcttatgttcaatttgaggatgttcgtgatgctgaagacgctttacataatttggacagaaagtggatttgtggacggcagattgaaatacagtttgcccagggggatcgaaagacaccaaatcagatgaaagccaaggaagggaggaatgtgtacagttcttcacgctatgatgattatgacagatacagacgttctagaagccgaagttatgaaaggaggagatcaagaagtcggtcttttgattacaactatagaagatcgtatagtcctagaaacagtagaccgactggaagaccacggcgtagcagaagccattccgacaatgatagattcaaacaccgaaatcgatctttttcaagatctaaatccaattcaagatcacggtccaagtcccagcccaagaaagaaatgaaggctaaatcacgttctaggtctgcatctcacaccaaaactagaggcacctctaaaacagattccaaaacacattataagtctggctcaagatatgaaaaggaatcaaggaaaaaagaaccacctagatccaaatctcagtcaagatcacagtctaggtctaggtcaaaatctagatcaaggtcttggactagtcctaagtccagtggccactgatagtataaaccatggtcatttttaggcatgtatcattcatttactcatagtttggtttacttaaattatcaggaatacaatgttgcaatgatgcttaaaaaacacttgttagttttccctgtaccaggcaatggttataattaaaatgatatgctgttgagaagccactcttaagagtccagtttgtttaatgttatgggcagctaccaatttgtggtgtctctgtatatttttgtaaagattctcattttttatgcttgaagtatttggtgaaaagatgttggttgaccataatttgcaacattgtctcattaaaaataaactttcatattcatatttggtagaactgttaacctagaaatgtagcttgctaataagatagaatgatacaaaagtgaagtagtagccacagtacaacactgactgctcagacacatttaggttcagggtggacctttatgtcttgtcaagatgtctaggcccggctgggcgtggtggctcacacctgtaatcccagcactttgggaggctgaggcgggcggatcacgaggtcaggagttcgagaccagcctgaccaacacggtgaaaccccgtctctactaaaaatacaaaaattatccgggcatggtggcacatgcctgtaatctcagctactcaggaggctgaggcaagagaatcgcttgaacctgggaggtagaagttgcagtgagccaaaatcacgccactgcactccagcctgggcaacagagtgagactccgtctcaaaaaaaaaaaaaaaaaaaccggatgtctaggccaatgataattatttttgatgcagtgtggattagttcttttgttaaccccactgtcttggggaatgatgccagctgggaaattgagtttttgactgaaacatggagccttcactgctttttttctggttcctatgaagatttggaacatagaaaacacaaaaactcaccttaaaatttgagcaggtcgttgatggcaaaaataattttaaggaaaaaggaatattcttatgtagttattctaaagtttaaggagcgttgttgaccataatattgcttagttttcttactgctgttaagtaagtaaattgtttcaaagtaggttttgtgtgtgtgtgcctagtgtaaaagaactgaaattttgatgcttacagcacttggctcgtgcatttgtatcaaaatttgcctgcctctttatgagggaggcctgcttttcacacctcagtttatttaatacgaggcaagttgtaagacaacactcattctaggtgattctgtggtgccatgaaatttaaggtaatttggggaaaaggattagtcagttttaagcaagagtcacatcttttgagctttcgattatcagtgtagtacctgactaaaaatgaagtaatacccttaaaccatttataatttctagtatttctctgaaagatcgttttggggacaaaagtgacttgacatgtccaatttcatttcagaataaaaagctagcatctttaaaaatctcagattgcttgcttacagatacaagtaagaattatggacaaacgattccttttagaggattacttttttcaatttcggttttagtaatctaggctttgcctgtaaagaatacaacgatggattttaaatactgtttgtggaatgtgtttaaaggattgattctagaacctttgtatatttgatagtatttctaactttcatttctttactgtttgcagttaatgttcatgttctgctatgcaatcgtttatatgcacgtttctttaatttttttagattttcctggatgtatagtttaaacaacaaaaagtctatttaaaactgtagcagtagtttacagttctagcaaagaggaaagttgtggggttaaactttgtattttctttcttatagaggcttctaaaaaggtatttttatatgttctttttaacaaatattgtgtacaacctttaaaacatcaatgtttggatcaaaacaagacccagcttattttctgcttgctgtaaattaagcaaacatgctataataaaaacaaaatgaagg

SEQ ID NO: 1916 - DNA, 2205 bp, Homo sapiens
ggacgcctggtgttctcgcgggaaagaaccgttgcgcccgactttgcgcggaggtaggagggggaagtggaggcgggagtgaagtctcgcgagaagagtcggttgccgtagcagagccctctagctgtgtgtgtctgaggctcggccgcctgagccgcggacggtttgctgagcccgttagtgcgcccggccgagacacgccgccgccatgtcccgctacctgcgtccccccaacacgtctctgttcgtcaggaacgtggccgacgacaccaggtctgaagacttgcggcgtgaatttggtcgttatggtcctatagttgatgtgtatgttccacttgatttctacactcgccgtccaagaggatttgcttatgttcaatttgaggatgttcgtgatgctgaagacgctttacataatttggacagaaagtggatttgtggacggcagattgaaatacagtttgcccagggggatcgaaagacaccaaatcagatgaaagccaaggaagggaggaatgtgtacagttcttcacgctatgatgattatgacagatacagacgttctagaagccgaagttatgaaaggaggagatcaagaagtcggtcttttgattacaactatagaagatcgtatagtcctagaaacagtagaccgactggaagaccacggcgtagcagaagccattccgacaatgatagccaagtaagcaagaagaaaaatgagagataatgcttcagtgagagaggaaaggtgctacatagagtatgagctgttaagttacaacccaggggaaagacctgggaactattgtattattctcttgaaaatttggcccagtaagctgctacatccagttcaactaacaaaatcctgtataccacagagaagaataaagaaaaccaaactgacaaacatccttcttttatttaagaccaaactgcagctggaatacccagtacagttctgcttactacacttcaagaaagatctgaaagcggaaaaagaaccaaagaagggcagttcaagcgaccaaagggtgggtggaaggtgctgcagtatgaatactgtacgaatattttgactctggtctgaaaagataaaagaatgttatcgaaaactacatggaataattgaagtcccttcaagtttgaaagtaagcattttaggacaaataaaaggaaattcaactttgtacttgtggaaactaatccctaaatatgaataggtttatattgattcatgggtaacaggtccataataaattattggaaactaggatgtctgaatatcaaggaagacagccatagtctcttacagtgcctctgttggtctgtctcaaactgaattgggtgggaaaaggtatggtccaatataaaagttccatttttgccattattggcaaatcttgcctttgtttattttggtgccagtgttttctgcttaatcatttgctttgttggcatctgtgtttatttacttgtacaccacatgcagtttacatctgtcttaactactccttcccaggtaaattccaattatatttgacatccagctaagagggcccatctcttctcacctctttcctagtcagtatattcagcaaatatttattgagcccttactgtgggcaaatcattgtactggataattgagaaaaatagataattcccttattcagtaaatgtctactgagcacaatctagtgaatcattacagtatggcctcattgttttgtttgaggtgtgttattcataacaatattttacaccattcgtatcaatgtaattatagaacacaatatacgatcaaggataagtaattgtgtggttatctgccatttaaaagtatccagtatttgatcacattattataaataatgaaaaaatgatttaatctgtaataaactggtttattgtgcagtgactgtaatatactagagttataataaattgtttactctgcctcaccaaacacatgctaggatataacccccaaaataagtatttaactttgcattaggtataaaggagactgggtgctataattagattattttgaggcagacagagagctgttatcctaactgatttagtatgttctgtaattgagaaaatgttcaccaaattatactttttagtgatttacatgtacattttataggggacatgttctgtgtatagcgaataaataacttttatagtatc

SEQ ID NO: 1917 - DNA, 1074 bp, Homo sapiens
caggctgagcgttggaagccattttggctgcaacctacctgaagcgatgtctgcctttggtcacgacgaggcctggatggaggccggaggctttggtctggaggctgccgaaagaacggaataccagtctctgtgcaaatctaaactcttattcctgggagagcagagcgtagggaagacatccatcatcagccgcttcatgtacaacagcttcggctgcgcctgccaggcaactgttggaattgacttcttgtctaagaccatgtacttggaggaccaaatagttcagctgcagctatgggacacagctggccaggagcgctttcacagcctaattcctagctacattcgtgattcaactattgcagtggttgtctatgacattacaaacatcaattcttttaaggagacagataagtgggtagaacacgtgcgagcagaaagaggtgacgatgttgtcatcatgttgttgggtaacaagattgatttggataacaaaagacaagtcactgcagaacagggtgaagaaaaatccagaaacctcaatgtgatgtttattgagaccagtgccaaaaccggttacaacgtgaaaaagctgttccggcgtgtggcttctgcccttctttccacaaggacttcacctccaccaaaagaggggacggttgaaatcgaactggaatccttcgaggagtcaggcaacagaagctattgttgacagcttaggctttctctgcctcatttgatggatttcttacatttgggcttgccataccagttctcctccccacctcgttttatgatacatggccacttactctcttccaattcctaggcttggggtaaaaacagaacccctgaaagtgctatcattttttcctgaccgcatctcacagctactgggtggaagcttcttgcagcacctgggaattctaccttaccttctccgacagctaaaagacatctgtagagaatacagttctacagcagctgacatacttcaaaggccaatacaattcattctccactgtttgttgttgtttacctacaccctcaataaatggttctttaacctaa

SEQ ID NO: 1918 - DNA, 453 bp, Homo sapiens
cctggtgtaatcatggtacagattattaaagacacgaatgaatttaaaacatttttgacagctgccggacacaaactcgcagtggttcaattttcttcgaaacggtgtggtccctgcaaaaggatgtttcctgttttccatgctatgtctgtgaaataccaaaatgtattttttgctaatgtggatgtgaacaattctccggagctggctgaaacttgtcacatcaaaacaatacccacatttcagatgttcaagaaaagccagaaggtaaccctattctcaagaatcaaaagaataatttgctgttatagaagtggattcatgagcaacctgtgtcttgcagatgatggaaatgagtaggatttaacttttcaatcaggaataaaattccttaaagcctcaacattttcgcagcacttgaatcaataaatgtttcacctttgtgcatttgtg

SEQ ID NO: 1919 - DNA, 433 bp, Homo sapiens
tccaactaaaccaacaggggattttcatcagcacttccctggtgtaatcatggtacagattattaaagacacgaatgaatttaaaacatttttgacagctgccggacacaaactcgcagtggttcaattttcttcgaaacggtgtggtccctgcaaaaggatgtttcctgttttccatgctatgtctgtgaaataccaaaatgtattttttgctaatgtggatgtgaacaattctccggagctggctgaaacttgtcacatcaaaacaatacccacatttcagatgttcaagaaaagccagaaggtaaccctattctcaagaatcaaaagaataatttgctgttatagaagtggattcatgagcaacctgatttttgagttttgtggagccgatgctaaaaaattggaagccaagactcaagaattaatgtaa

SEQ ID NO: 1920 - DNA, 2378 bp, Homo sapiens
tcgccgcccgccccgctgctgtctggcgggggaggagctcgggaccgggagcagcggctctggcggtcgtggcggtcggagatccgagagctctgcttctctgaaaagcgtgtggctttctggacttgtttcaggccacccacgagccagcgggaaaggattgccagccagagaaagacgaactccgaagtcccaatgcacagatcagcccccagtcaaaccaccaagaggagccgatcgccattttccactactcgtcgtagttgggacgacagcgagagttcgggaaccaacctgaatattgataatgaggactattccaggtatccgccaagagagtacagagcttcgggtagcagaagaggaatggcctatggacatattgactcttatggggcagatgatagtgaggaggagggggctgggcctgttgagcgaccgccagtgagagggaaaactggcaagtttaaagatgataagctgtatgacccagagaaaggggcaaggtctttggctgggccacctccacatttctctagttttagccgtgatgtgagagaggagcgagacaagttagacccagtccctgcagcaagatgctcagctagcagagctgacttcctgccacaaagtagtgtggcctcacagtcgtcttctgaaggcaagctggctacaaaaggtgacagctcggagagggagagaagggagcaaaatttacctgcacgtcccagcagggctcctgtgagtatttgtggtggtggggaaaacacctcaaagagtgcagaggaacctgtggtcaggcccaaaatcagaaacctggcaagtccaaactgcgtgaaaccaaaaattttttttgatactgatgatgatgacgatatgccacacagtacttccaggtggagggataccgccaatgacaatgagggccactcggatggcctggcaagaagagggagaggcgagagttcaagtggctatcccgagccaaagtaccctgaagacaaacgggaagcgaggagtgaccaagtgaaaccagaaaaggtgccgagacgacgacgcaccatggccgaccctgacttctggacgcacagtgatgattactacaaatactgcgacgaagactctgacagtgacaaagagtggattgctgctctgcgtcggaaatatcgaagccgagagcaaaccctgtcctccagtggcgaaagctgggagactctgccggggaaagaagagcgggaacctccacaggctaaggtgagtgccagcactggcaccagccctggccccggtgctagtgccagtgccggggctggcgccggggccagtgctggcagcaatggcagcaattaccttgaagaagttcgagaaccatctcttcaggaagagcaggcatccctggaagaaggagaaattccttggctccagtaccatgagaatgacagtagcagtgagggggataatgattctggtcacgagttgatgcaacctggggtattcatgctggatggaaacaacaaccttgaagatgactccagtgtgagcgaagacctagaagtggattggagcctctttgatggatttgcagatgggttaggagtggctgaagccatttcctatgtggaccctcagttcctcacctacatggcacttgaagaacgcctggcccaggcaatggaaactgcccttgcgcacttggagtctctcgcagtggatgtagaggtggccaatccaccagcaagcaaggagagcattgacgctcttcccgagatcctggtcactgaagatcatggcgcagttggtcaggagatgtgctgccccatctgctgtagcgaatatgtgaagggggaggtggcaactgagctgccgtgccaccactatttccacaagccgtgtgtgtccatctggcttcagaagtcaggcacctgccccgtgtgccgctgcatgttccctcccccactctaaagaccaaggccgtttactcctggtctgattattttccccatctgaaatccacaatactgcaggagccctcttgaaattaacaatggaaataaaaccaatcagtcagttagcctaaacctattgattcctcgtgattatttccaatgtgaaaacagttgtgtatgattgcattaaaaatcatatcatcttttagaggttagaaaagggaaaactaaactttctaaatgctacttgagattgcagtaagaagatacgttttctaacctgaaagttaaatcgcatttgttttcttcagtagaatgggaatgtgttgctgttacttgtaatgtcaagtttatctgttaaatatgtccaaaaggcaaaatcatttttgttgcatgttatgggtcgatgttcctgtaattgcagtgccgtaa

SEQ ID NO: 1921 - DNA, 736 bp, Homo sapiens
gtgcggaggggcggggcgtgtggaggccgggacggcgcccccggccggcggtgaggccggctcagcgcggagcagctcagtgccccccgcgccccgctccggcagctccacgctcgcgcccgccatgccggagcagttcagcgtcgccgagttcctggccgtcaccgcggaggacctcagctccccggctggggccgccgccttcgccgccaagatgccccggtaccgaggggcggcgctggcgcgggaggagatcttggaaggagaccaagccatcctgcagagaataaagaaggctgtgcgggcaatccatagctccggccttggccatgtggagaatgaagagcagtaccgagaggccgtggaatccttaggcaacagccacctgtcccagaacagccatgagctgtccacaggcttcctaaacttggccgtgttcacccgcgaggttgctgcgctcttcaagaacctgattcagaacttgaacaacattgtctctttccccctggacagtctgatgaaggggcagctgagggacggtcgacaggattccaaaaaacagctggagaaggcatggaaggactatgaagccaaaatggccaagctggagaaggagcgcgatcgggccagggtgacaggagggatccctgcttggaacctggggatcccagccaagccccacccaactctgaagagggcctccgagagcccccaggcacctccagacccagcctga

SEQ ID NO: 1922 - DNA, 2692 bp, Homo sapiens
gtcagattctcctctaagtctggctttcctgcaaacccagtcttgtaatcattttgccaacattaaaaatgtgttccaggtctacacctgacagtcactggaatgctactccaggccttagaagaaagtgaaactaattttaaaggccccttattctttctgttacctgcctgctgaagtgaaaataaatctccctgctcctttattctaaactgattttactttcccatctcaaaaacgtgtgcagggagcaggagccctcctacccgagccccagctgtattggaaaccctcctaagtcagagtgatgggtcaggaatctagcaagcctgtatggcccaatccaacaggagggtatcagtccaatacaggtaggaggtatggaagaaggcatgcttatgtcagtttcaggccacccacgagccagcgggaaaggattgccagccagagaaagacgaactccgaagtcccaatgcacagatcagcccccagtcaaaccaccaagaggagccgatcgccattttccactactcgtcgtagttgggacgacagcgagagttcgggaaccaacctgaatattgataatgaggactattccaggtatccgccaagagagtacagagcttcgggtagcagaagaggaatggcctatggacatattgactcttatggggcagatgatagtgaggaggagggggctgggcctgttgagcgaccgccagtgagagggaaaactggcaagtttaaagatgataagctgtatgacccagagaaaggggcaaggtctttggctgggccacctccacatttctctagttttagccgtgatgtgagagaggagcgagacaagttagacccagtccctgcagcaagatgctcagctagcagagctgacttcctgccacaaagtagtgtggcctcacagtcgtcttctgaaggcaagctggctacaaaaggtgacagctcggagagggagagaagggagcaaaatttacctgcacgtcccagcagggctcctgtgagtatttgtggtggtggggaaaacacctcaaagagtgcagaggaacctgtggtcaggcccaaaatcagaaacctggcaagtccaaactgcgtgaaaccaaaaattttttttgatactgatgatgatgacgatatgccacacagtacttccaggtggagggataccgccaatgacaatgagggccactcggatggcctggcaagaagagggagaggcgagagttcaagtggctatcccgagccaaagtaccctgaagacaaacgggaagcgaggagtgaccaagtgaaaccagaaaaggtgccgagacgacgacgcaccatggccgaccctgacttctggacgcacagtgatgattactacaaatactgcgacgaagactctgacagtgacaaagagtggattgctgctctgcgtcggaaatatcgaagccgagagcaaaccctgtcctccagtggcgaaagctgggagactctgccggggaaagaagagcgggaacctccacaggctaaggtgagtgccagcactggcaccagccctggccccggtgctagtgccagtgccggggctggcgccggggccagtgctggcagcaatggcagcaattaccttgaagaagttcgagaaccatctcttcaggaagagcaggcatccctggaagaaggagaaattccttggctccagtaccatgagaatgacagtagcagtgagggggataatgattctggtcacgagttgatgcaacctggggtattcatgctggatggaaacaacaaccttgaagatgactccagtgtgagcgaagacctagaagtggattggagcctctttgatggatttgcagatgggttaggagtggctgaagccatttcctatgtggaccctcagttcctcacctacatggcacttgaagaacgcctggcccaggcaatggaaactgcccttgcgcacttggagtctctcgcagtggatgtagaggtggccaatccaccagcaagcaaggagagcattgacgctcttcccgagatcctggtcactgaagatcatggcgcagttggtcaggagatgtgctgccccatctgctgtagcgaatatgtgaagggggaggtggcaactgagctgccgtgccaccactatttccacaagccgtgtgtgtccatctggcttcagaagtcaggcacctgccccgtgtgccgctgcatgttccctcccccactctaaagaccaaggccgtttactcctggtctgattattttccccatctgaaatccacaatactgcaggagccctcttgaaattaacaatggaaataaaaccaatcagtcagttagcctaaacctattgattcctcgtgattatttccaatgtgaaaacagttgtgtatgattgcattaaaaatcatatcatcttttagaggttagaaaagggaaaactaaactttctaaatgctacttgagattgcagtaagaagatacgttttctaacctgaaagttaaatcgcatttgttttcttcagtagaatgggaatgtgttgctgttacttgtaatgtcaagtttatctgttaaatatgtccaaaaggcaaaatcatttttgttgcatgttatgggtcgatgttcctgtaattgcagtgccgtaaaagcttattaaagttgttcttttggttttacatggta

SEQ ID NO: 1923 - DNA, 2115 bp, Homo sapiens
gcggtcgtggcggtcggagatccgagagctctgcttctctgaaaagcgtgtggctttctggacttggtctacacctgacagtcactggaatgctactccaggccttagaagaaagtgaaactaattttaaaggccccttattctttctgttacctgcctgctgaagtgaaaataaatctccctgctcctttattctaaactgattttactttcccatctcaaaaacgtgtgcagggagcaggagccctcctacccgagccccagctgtattggaaaccctcctaagtcagagtgatgggtcaggaatctagcaagcctgtatggcccaatccaacaggagggtatcagtccaatacaggtaggaggtatggaagaaggcatgcttatgtcagtttcaggccacccacgagccagcgggaaaggattgccagccagagaaagacgaactccgaagtcccaatgcacagatcagcccccagtcaaaccaccaagaggagccgatcgccattttccactactcgtcgtagttgggacgacagcgagagttcgggaaccaacctgaatattgataatgaggactattccagtacttccaggtggagggataccgccaatgacaatgagggccactcggatggcctggcaagaagagggagaggcgagagttcaagtggctatcccgagccaaagtaccctgaagacaaacgggaagcgaggagtgaccaagtgaaaccagaaaaggtgccgagacgacgacgcaccatggccgaccctgacttctggacgcacagtgatgattactacaaatactgcgacgaagactctgacagtgacaaagagtggattgctgctctgcgtcggaaatatcgaagccgagagcaaaccctgtcctccagtggcgaaagctgggagactctgccggggaaagaagagcgggaacctccacaggctaaggtgagtgccagcactggcaccagccctggccccggtgctagtgccagtgccggggctggcgccggggccagtgctggcagcaatggcagcaattaccttgaagaagttcgagaaccatctcttcaggaagagcaggcatccctggaagaaggagaaattccttggctccagtaccatgagaatgacagtagcagtgagggggataatgattctggtcacgagttgatgcaacctggggtattcatgctggatggaaacaacaaccttgaagatgactccagtgtgagcgaagacctagaagtggattggagcctctttgatggatttgcagatgggttaggagtggctgaagccatttcctatgtggaccctcagttcctcacctacatggcacttgaagaacgcctggcccaggcaatggaaactgcccttgcgcacttggagtctctcgcagtggatgtagaggtggccaatccaccagcaagcaaggagagcattgacgctcttcccgagatcctggtcactgaagatcatggcgcagttggtcaggagatgtgctgccccatctgctgtagcgaatatgtgaagggggaggtggcaactgagctgccgtgccaccactatttccacaagccgtgtgtgtccatctggcttcagaagtcaggcacctgccccgtgtgccgctgcatgttccctcccccactctaaagaccaaggccgtttactcctggtctgattattttccccatctgaaatccacaatactgcaggagccctcttgaaattaacaatggaaataaaaccaatcagtcagttagcctaaacctattgattcctcgtgattatttccaatgtgaaaacagttgtgtatgattgcattaaaaatcatatcatcttttagaggttagaaaagggaaaactaaactttctaaatgctacttgagattgcagtaagaagatacgttttctaacctgaaagttaaatcgcatttgttttcttcagtagaatgggaatgtgttgctgttacttgtaatgtcaagtttatctgttaaatatgtccaaaaggcaaaatcatttttgttgcatgttatgggtcgatgttcctgtaattgcagtgccgtaaaagcttattaaagttgttcttttggttttacatggta

SEQ ID NO: 1924 - DNA, 740 bp, Homo sapiens
gggtttattactactgaaggaagaacgtgagtaggttaggatttcggttgagaggcttggggtcttgcgtttcgcccaccatctcctggggacagggtggagtcgatatccgggacgggggggaggttgcggtgcccctcagggctacctctcaagagtgctatcatttccgcaggccagatcagaaaagggagctcaggtaccttccagagagtgagacccagcgcccttgtctcgcacccagtaggctttcatccccgccatggcggagctgatccagaagaagctacagggagaagtggagaaatatcaacagctacagaaggacttaagtaaatccatgtcggggaggcagaaacttgaagcacaactaacagaaaataatatcgtgaaagaggaactggccctgctggatgggtccaacgtggtctttaaacttctgggtccggtgctagtcaaacaggagctgggggaggctcgggccacagtagggaagaggctggactatatcacagctgaaattaagcgatacgaatcccagcttcgggatcttgagcggcagtcagagcaacagagggagacccttgctcagctgcagcaggagttccagcgggcccaggcagcaaaggcaggggctcctggcaaggcctgaccccatggtggggggaggggaggggaggggagggaatgaggcagctctaggatctatactgtagctaataaaatgtaaaaacacctgg

SEQ ID NO: 1925 - DNA, 581 bp, Homo sapiens
attactactgaaggaagaacgtgagtaggccagatcagaaaagggagctcaggtaccttccagagagtgagacccagcgcccttgtctcgcacccagtaggctttcatccccgccatggcggagctgatccagaagaagctacagggagaagtggagaaatatcaacagctacagaaggacttaagtaaatccatgtcggggaggcagaaacttgaagcacaactaacagaaaataatatcgtgaaagaggaactggccctgctggatgggtccaacgtggtctttaaacttctgggtccggtgctagtcaaacaggagctgggggaggctcgggccacagtagggaagaggctggactatatcacagctgaaattaagcgatacgaatcccagcttcgggatcttgagcggcagtcagagcaacagagggagacccttgctcagctgcagcaggagttccagcgggcccaggcagcaaaggcaggggctcctggcaaggcctgaccccatggtggggggaggggaggggaggggagggaatgaggcagctctaggatctatactgtagctaataaaatgt

SEQ ID NO: 1926 - DNA, 521 bp, Homo sapiens
gtttattactactgaaggaagaacgtgagtagatcagaaaagggagctcaggtaccttccagagagtgagacccagcgcccttgtctcgcacccagtaggctttcatccccgccatggcggagctgatccagaagaagctacagggagaagtggagaaatatcaacagctacagaaggacttaagtaaatccatgtcggggaggcagaaacttgaagcacaactaacagaaaataatatcgtgaaagaggaactggccctgctggatgggtccaacgtggtctttaaacttctgggtccggtgctagtcaaacaggagctgggggaggctcgggccacagtagggaagaggctggactatatcacagctgaaattaagcgatacgaatcccagcttcgggatcttgagcggcagtcagagcaacagagggagacccttgctcagctgcagcaggagttccagcgggcccaggcagcaaaggcaggggctcctggcaaggcctgaccccatggtggggggag

SEQ ID NO: 1927 - DNA, 1760 bp, Homo sapiens
attggccgagcgcggccgttgggggtgaggccgcgtcgggggaggacaacaaagggccgcgggcggcgggcagtggtgtcccagtctcccggtgcttccctgaggctgaggcgcccggcctcccgcccgccgcgctccagatgaagtgtgagcactgcacgcgcaaggaatgtagtaagaaaacaaaaactgatgaccaagagaatgtgtcagccgatgcaccgagtccagcccaggaaaatggagagaagggagaattccacaagttggctgatgccaagatatttttgagcgactgcctggcatgtgacagctgtatgactgcagaggaaggagtccaactttcccagcaaaatgccaaggacttcttccgcgttctgaaccttaacaagaaatgtgatacctcaaagcacaaagtgctggtagtgtctgtgtgtcctcaatctttgccttattttgctgctaaattcaacctcagtgtaactgatgcatccagaagactctgtggtttcctcaaaagtcttggggtgcactatgtatttgatacgacgatagctgcggattttagtatcctggagagtcaaaaagaattcgtgcgtcgctatcgccagcacagtgaggaggaacgcaccctgcccatgctgacctctgcctgtcctggctgggtccgatacgccgagcgggtgctgggtcgccccatcactgcccacctctgcaccgccaagtccccccagcaggtcatgggctctttggtgaaggattatttcgccagacagcagaacctgtctccagagaagattttccacgtcattgtggccccttgttatgacaagaagctggaggctcttcaggaaagccttccccctgctttgcatggctcccggggcgctgactgcgtgttaacatcaggtaaggtacttatctcttggtggtgcacacctgtaatcacagctactcaggaggctgcggcaagagaatcacttgaacccgggaggcagaggttacagcgagacaagattgcaccactggactccagcctgggcggcggaggtgaaattgctcaaataatggagcaaggtgacctctcagtgagagatgctgccgtcgacactctgtttggagacttgaaggaggacaaagtgacgcgtcatgatggagccagctcagacgggcacctggcacacatcttcagacatgcggccaaggagctgttcaacgaggatgtggaggaggtcacttaccgagccctgagaaacaaagacttccaagaggtcacccttgagaagaacggagaggtggtgttacgctttgctgcagcctatggctttcgaaacatccagaacatgatcctgaagcttaagaagggcaagttcccattccactttgtggaggtcctcgcctgtgctggaggatgcttaaatggcagaggccaagcccagactccagacggacatgcggataaggccctgctgcggcagatggaaggcatttacgctgacatccctgtgcggcgtccggagtccagtgcacacgtgcaggagctgtaccaggagtggctggaggggatcaactcccccaaggcccgagaggtgctgcataccacgtaccagagccaggagcgtggcacacacagcctggacatcaagtggtgaagtcaggccagggccttccagctgctcttggggccagagccaagagcctctcagtagagggaggggctgccctgagtggagtattaaagacacttaagaaaaccgctc

SEQ ID NO: 1928 - DNA, 499 bp, Homo sapiens
atggctaccgagcccgaagccgcggagccggtggtgccttcgctcgtggatcgatacttcactcgctggtacaaaccggatgtcaaaggaaaattttgtgaggaccactgtatactacagcactctaaccgaatatgtgtcatcacattggcagaatctcatccagttcttcaaagtggaaaaacaattaaaagcatttcctatcagatcagtaccaactgtagcagacttcagaacaaggtctctgggaaatttaagcggagaattatctatctagaaaaggtagaagacgtcatcaagaggaaaatgatgcctctaagcttgggactgcatcttccccactcttaatcctccttctataggaaggaatcttcacgagcacaggatccctcacttctgtctgctgcctcacctatcccatcccataaaaggaggtggatgctcatcttttcagtctttctggtgactttgcaaaaataaattgaacacattaaccctt

SEQ ID NO: 1929 - DNA, 3037 bp, Homo sapiens
aattgagatggtttactgtaaaattaaaatgggagttagttttctagacatgtaactctctggggagtataaaactggtcacaatgggctttgcgttgaagtatctgtccctcagatctcatcagaaggagtatataatacaaaaatataaattcaacctctgtatgttttcttctatgttttatgctgggactcactggagatctttgtaagtaatcaaagctggccctttatctttgattttggcttttagggaattctagggacttcctttccccaaattaaaactcattttgaggtgtttggttttgtcttttaatttttgcaacttcaaaattgatgactcagttctagtgtactttatcctcgaacttgtttaaaataggttactttcttgaaataaataataatataatgaagagatcatgacttggatttgggtgggggaattaaataccttttcaaaattgccatcagtatcatcttggatgaagaaagttcagtggttaaaagcgtcttctgaagtgtggtcatagtcggtgaggtttatttcagtttggcttctcattttaattttcagatgtatatcacatatatgtgaaaagtactgacaaaaataatttatgaaataaacacagtagggcatgaggttgtgttatttgtgaggcagcaatggagcatgacttgtagtcaacaaacatgggtgtcctgatcaaagctctgctgtgctattcggcaagactctatgtggatgcctcttgtagaatgtggttaataataccagccgatctcatagggcactgtgcagactcagcattatggtgcacagctccttgaactcataggagtggcacttaactggagctttgtgtcgtactcatcaaacatcttcccccagacaatgattcttctgattctgctaactctggacagagtttgcattgtcttttgagaaaaatgaatgtatcacttagtcaaaaaactgtaaaaatacataggctctttccgatgcttgctttctcagagccctatgagtttgtctctctggaatggctgcaaaagtggttggatgaatcaacacctaccaaacctattgataatcacgcttgcctgtgttcccatgacaagcttcacccggataaaatatcaattatgaagaggatatctgaatatgcagctgacattttctatagtagatatggaggaggtccaagactaactgtgaaagccctgtgtaaggaatgtgtagtagaacgttgtcgcatattgcgtctgaagaaccaactaaatgaagattataaaactgttaataatctgctgaaagcagcagtaaagggcgatggattttgggtggggaagtcctccttgcggagttggcgccagctagctcttgaacagctggatgagcaagatggtgatgcagaacaaagcaacggaaagatgaacggtagcaccttaaataaagatgaatcaaaggaagaaagaaaagaagaggaggaattaaattttaatgaagatattctgtgtccacatggtgagttatgcatatctgaaaatgaaagaaggcttgtttctaaagaggcttggagcaaactgcagcagtactttccaaaggctcctgagtttccaagttacaaagagtgctgttcacagtgcaagattttagaaagagaaggggaagaaaatgaagccttacataagatgattgcaaacgagcaaaagacttctctcccaaatttgttccaggataaaaacagaccgtgtctcagtaactggccagaggatacggatgtcctctacatcgtgtctcagttctttgtagaagagtggcggaaatttgttagaaagcctacaagatgcagccctgtgtcatcagttgggaacagtgctcttttgtgtccccacgggggcctcatgtttacatttgcttccatgaccaaagaagattctaaacttatagctctcatatggcccagtgagtggcaaatgatacaaaagctctttgttgtggatcatgtaattaaaatcacgagaattgaagtgggagatgtaaacccttcagaaacacagtatatttctgagcccaaactctgtccagaatgcagagaaggcttattgtgtcagcagcagagggacctgcgtgaatacactcaagccaccatctatgtccataaagttgtggataataaaaaggtgatgaaggattcggctccggaactgaatgtgagtagttctgaaacagaggaggacaaggaagaagctaaaccagatggagaaaaagatccagattttaatcaaatcatgcatgcattttcagttgctccttttgaccagaatttgtcaattgatggaaagattttaagtgatgactgtgccaccctaggcacccttggcgtcattcctgaatctgtcattttattgaaggctgatgaaccaattgcagattatgctgcaatggatgatgtcatgcaagtttgtatgccagaagaagggtttaaaggtactggtcttcttggacattaatctttgaatacttgctgactgctaagaaatgaccagaggggaagaggagtttgacatgttagggcattaaagcaaaggtggatttaagaattaaaccattacatgccccttccaaaaggcagaaatccattcaaacgtgactgtcccaaatgccttatgtcaaataaagcagattgcactgatggacatcagacttgaaggaaatgtttccaattttatatttaaggggggtggtgggtgggagggggcaagtaaagacggaacaagtttagtagcagtaatagtaaatcatgtttacatatgagatttatagtcgtgggaggggaataaagttctgttatatttccttgctcgagtttcataccagatgcgttggtccataaaggattgtatcaagtagatgggacaacattctgctctgaacgaaaagtaattttagagacataacctgcttaccaatgcctgtctttgattcatattctactttcaataaagcatgaaagtgaagaacttg

SEQ ID NO: 1930 - DNA, 1328 bp, Homo sapiens
cggccgcgttgccaaggtgacccgggcgcgggaaggcggctccggctcgcgcgggccgggccgggcggcggcggcggcaccatgagcggccggaagcgcagcttcaccttcggggcctacggcgggtagggcgtggcgcggcgcggggcggggcgcgtgcgcgcgtgtgcgtgtgcacgcgtgggggggagcccgtgcggggtgtgctcgcgtttgggcgggtgggcctgggctatgactgctgtgggggctgagcgtttgacctcagtgcgcgcatggctgtcgtgctgtggcgcctgtgtgtgtgtgtttctgtttctgtgtctgtgtgtgttcccattgcgtgtccatgtgcatgtgtggggaggtgagtgcagggtggacattgctgtgtttgtgtctaagcacatgatagtggcgcttatgcatgtgactggggctgcggggctactccgcctgtgtgtgcgcgcgtgtgtgtgcatgcgtgtgtgcgcaactgctcacatgtatagggtggacaagtccttcacttctcgccggagtgtgtggaggagcgatgggcagaaccagcacttccctcaggcactagacctgtcacgagtgaacttagttccctcctatactccttcactctaccctaagaacacagatctatttgagatgattgagaagatgcagggaagcaggatggatgaacaacgctgctccttcccgccgcccctcaaaacagaggaggactacattccatacccgagcgtgcacgaggtcttggggcgagaaggacccttccccctcatcctgctgccccagtttgggggctactggattgagggcaccaaccacgaaatcaccagcatccccgagacagagccactgcagtcgcccacaaccaaggtgaagctcgagtgcaaccccacagcccgcatctaccggaagcactttctcggcaaggagcatttcaattactactcactggacgctgccctcggccaccttgtcttctcactcaagtacgatgtcatcggggaccaagagcacctgcggctgctgctcaggaccaagtgccggacataccatgatgtcatccccatctcctgcctcaccgagttccctaatgttgtccagatggcaaagttggtgtgtgaagacgtcaatgtggatcggttctatcctgtgctctaccccaaggtatggctggatctgggcacagctcactgagggtgggtgagtaactggaagactgagcatttattaagcaccttctgtgtgccagatactttcccaaggttctctcatttaatcctcacaataaccctgtgaagtccaca

SEQ ID NO: 1931 - DNA, 3328 bp, Homo sapiens
ctatttgagatgattgagaagatgcagggaagcaggatggatgaacaacgctgctccttcccgccgcccctcaaaacagaggaggactacattccatacccgagcgtgcacgaggtcttggggcgagaaggacccttccccctcatcctgctgccccagtttgggggctactggattgagggcaccaaccacgaaatcaccagcatccccgagacagagccactgcagtcgcccacaaccaaggtgaagctcgagtgcaaccccacagcccgcatctaccggaagcactttctcggcaaggagcatttcaattactactcactggacgctgccctcggccaccttgtcttctcactcaagtacgatgtcatcggggaccaagagcacctgcggctgctgctcaggaccaagtgccggacataccatgatgtcatccccatctcctgcctcaccgagttccctaatgttgtccagatggcaaagttggtgtgtgaagacgtcaatgtggatcggttctatcctgtgctctaccccaaggcttcccggctcatcgtcacctttgacgagcatgtcatcagcaataacttcaagtttggcgtcatttatcagaagcttgggcagacctccgaggaagaactcttcagcaccaatgaggaaagtcccgctttcgtggagttccttgaatttcttggccagaaggtcaaactgcaggactttaaggggttccgaggaggcctggacgtgacccacgggcagacggggaccgaatctgtgtactgcaacttccgcaacaaggagatcatgtttcacgtgtccaccaagctgccatacacggaaggggacgcccagcagttgcagcggaagcggcacatcgggaacgacatcgtggctgtggtcttccaggatgagaacactcctttcgtgcccgacatgatcgcgtccaacttcctgcatgcctacgtcgtggtgcaggctgagggcgggggccctgatggccccctctacaaggtctctgtcactgcaagagatgatgtgcccttctttggaccccccctcccggaccccgctgtgttcaggaaggggcctgagttccaggaatttttgctgacaaagctgatcaatgctgaatatgcctgctacaaggcagagaagtttgccaaactggaggagcggacgcgggccgccctcctggagacgctctatgaggaactacacatccacagccagtccatgatgggcttgggcggcgacgaggacaagatggagaatggcagtgggggcggcggcttctttgagtctttcaagcgggtcatccggagccgcagccagtccatggatgccatggggctgagcaacaagaagcccaacaccgtgtccaccagccacagcgggagcttcgcgcccaacaaccccgacctggccaaggcggctggaatatcattgcttattcctgggaaaagtgcgagtagattcggacgccggggcagtgccataggcataggaaccgtggaagaggttgtcgtccgcggggccgccggctctggaggctgcctgcacgcgctgttctctgctcgctctcaggacggaggccatattggggacgttgcccctctgcccccgggacaggccccagggcgtgcgggatggagtggcggcagctccgatggcactcagcacctgctttggggcctgtcactgattgtccctgggaagagccccacgaggaagaagtcgggcccgttcggctcccgccgcagcagcgccattggcatcgagaacatacaggaggtgcaggagaagagggagagccctccggctggtcagaagaccccagacagcgggcacgtctcacaggagcccaagtcggagaactcatccactcagagctccccagagatgcccacgaccaagaacagagcggagaccgcagcgcagagagcagaggcgctcaagctcccgctcctcgtccagtgccagcagcttcgccagcgtggtggaggagacggagggtgtggacggagaggacacaggcctggagagcgtgtcatcctcaggaacaccccacaagcgggactccttcatctatagcacgtggctggaggacagtgtcagcaccactagtgggggcagctccccaggcccctctcgatcaccccacccagacgccggcaagttgggggaccctgcgtgtcccgagatcaagatccagctggaagcatctgagcagcacatgccccagctgggctgttagccgggccaccccctctgaaggtgaaactgagcagatgaggccacagaagcacaaggggaaggtgccgtgtcaagcccaggcagacgagacctctgccctgaagaccaacaccagcccgtgggctgccccctgcctccccaccctccccatggcccacccatctgggctgtctctgcagggcagagccgtccagacctgggatcagggaagctgctggcatcgtccccacccccagcctgggggtctgggctggggcagggattgctcagtggaagcaggactgggggtctggcttgccccctccctgggcctccatcacccctgagcatccctctggactcagagggaacaaggtgggagagagagtttgagacagctccgtgtggagagcttagcccctggaggcagcacaaggaggatgtgatatgtgggggagtgagcactgggttgggagccgggtcctggtttccaatttgggttctgctgtgtgactctgggcaagtcactctccctctctgggcatgtctgctacaaatggacaagattatttcagaggtcactgaagactgtgattacatgcacctgccttagaaggtaggattttcttcccagggacctcctatcaccctaccctgcttcttgaggtccctggagccccaggtgggctgaggggcagggagccggctgtgcccagtatgcctcctggaccctccagttctgccacaggtctgccgatgccctgtccactgcctacacatgacagacaagtaaccccctcatgggggatggggacctacctggctcctcagccagcacccagcttaacccctgccatcccatgctgggccctccaggccaagagtctcagctggccgagagtccaggccttgcctcccccgaccgccatggagggggcagcccggcacagctgctgggagcccttgtgtgtctggtcacactttttaggcgtcacgccaaaggccagcctcctggccccaatacccattttggaagcccctgtggccgtgtggatgtcggtaacagttgtataaaataaattctatttatcgctattgt

SEQ ID NO: 1932 - DNA, 3169 bp, Homo sapiens
atggcacagctgcggcccgcggtgccacccggccgtccgcggaggggctcgctgcccgcgggggccagctggcagaacacagatctatttgagatgattgagaagatgcagggaagcaggatggatgaacaacgctgctccttcccgccgcccctcaaaacagaggaggactacattccatacccgagcgtgcacgaggtcttggggcgagaaggacccttccccctcatcctgctgccccagtttgggggctactggattgagggcaccaaccacgaaatcaccagcatccccgagacagagccactgcagtcgcccacaaccaaggtgaagctcgagtgcaaccccacagcccgcatctaccggaagcactttctcggcaaggagcatttcaattactactcactggacgctgccctcggccaccttgtcttctcactcaagtacgatgtcatcggggaccaagagcacctgcggctgctgctcaggaccaagtgccggacataccatgatgtcatccccatctcctgcctcaccgagttccctaatgttgtccagatggcaaagttggtgtgtgaagacgtcaatgtggatcggttctatcctgtgctctaccccaaggcttcccggctcatcgtcacctttgacgagcatgtcatcagcaataacttcaagtttggcgtcatttatcagaagcttgggcagacctccgaggaagaactcttcagcaccaatgaggaaagtcccgctttcgtggagttccttgaatttcttggccagaaggtcaaactgcaggactttaaggggttccgaggaggcctggacgtgacccacgggcagacggggaccgaatctgtgtactgcaacttccgcaacaaggagatcatgtttcacgtgtccaccaagctgccatacacggaaggggacgcccagcagttgcagcggaagcggcacatcgggaacgacatcgtggctgtggtcttccaggatgagaacactcctttcgtgcccgacatgatcgcgtccaacttcctgcatgcctacgtcgtggtgcaggctgagggcgggggccctgatggccccctctacaaggtctctgtcactgcaagagatgatgtgcccttctttggaccccccctcccggaccccgctgtgttcaggaaggggcctgagttccaggaatttttgctgacaaagctgatcaatgctgaatatgcctgctacaaggcagagaagtttgccaaactggaggagcggacgcgggccgccctcctggagacgctctatgaggaactacacatccacagccagtccatgatgggcttgggcggcgacgaggacaagatggagaatggcagtgggggcggcggcttctttgagtctttcaagcgggtcatccggagccgcagccagtccatggatgccatggggctgagcaacaagaagcccaacaccgtgtccaccagccacagcgggagcttcgcgcccaacaaccccgacctggccaaggcggctggaatatcactgattgtccctgggaagagccccacgaggaagaagtcgggcccgttcggctcccgccgcagcagcgccattggcatcgagaacatacaggaggtgcaggagaagagggagagccctccggctggtcagaagaccccagacagcgggcacgtctcacaggagcccaagtcggagaactcatccactcagagctccccagagatgcccacgaccaagaacagagcggagaccgcagcgcagagagcagaggcgctcaaggacttctcccgctcctcgtccagtgccagcagcttcgccagcgtggtggaggagacggagggtgtggacggagaggacacaggcctggagagcgtgtcatcctcaggaacaccccacaagcgggactccttcatctatagcacgtggctggaggacagtgtcagcaccactagtgggggcagctccccaggcccctctcgatcaccccacccagacgccggcaagttgggggaccctgcgtgtcccgagatcaagatccagctggaagcatctgagcagcacatgccccagctgggctgttagccgggccaccccctctgaaggtgaaactgagcagatgaggccacagaagcacaaggggaaggtgccgtgtcaagcccaggcagacgagacctctgccctgaagaccaacaccagcccgtgggctgccccctgcctccccaccctccccatggcccacccatctgggctgtctctgcagggcagagccgtccagacctgggatcagggaagctgctggcatcgtccccacccccagcctgggggtctgggctggggcagggattgctcagtggaagcaggactgggggtctggcttgccccctccctgggcctccatcacccctgagcatccctctggactcagagggaacaaggtgggagagagagtttgagacagctccgtgtggagagcttagcccctggaggcagcacaaggaggatgtgatatgtgggggagtgagcactgggttgggagccgggtcctggtttccaatttgggttctgctgtgtgactctgggcaagtcactctccctctctgggcatgtctgctacaaatggacaagattatttcagaggtcactgaagactgtgattacatgcacctgccttagaaggtaggattttcttcccagggacctcctatcaccctaccctgcttcttgaggtccctggagccccaggtgggctgaggggcagggagccggctgtgcccagtatgcctcctggaccctccagttctgccacaggtctgccgatgccctgtccactgcctacacatgacagacaagtaaccccctcatgggggatggggacctacctggctcctcagccagcacccagcttaacccctgccatcccatgctgggccctccaggccaagagtctcagctggccgagagtccaggccttgcctcccccgaccgccatggagggggcagcccggcacagctgctgggagcccttgtgtgtctggtcacactttttaggcgtcacgccaaaggccagcctcctggccccaatacccattttggaagcccctgtggccgtgtggatgtcggtaacagttgtataaaataaattctatttatcgctattgtacccaga

SEQ ID NO: 1933 - DNA, 3264 bp, Homo sapiens
ggagctcagcgctgcggggcccggacccgggcgcgcgcgggccaggagccggctgggccagctgaagtgccgccccggcgggggccgggccgggccgcgctcaggatggcacagctgcggcccgcggtgccacccggccgtccgcggaggggctcgctgcccgcgggggccagctggcagaacacagatctatttgagatgattgagaagatgcagggaagcaggatggatgaacaacgctgctccttcccgccgcccctcaaaacagaggaggactacattccatacccgagcgtgcacgaggtcttggggcgagaaggacccttccccctcatcctgctgccccagtttgggggctactggattgagggcaccaaccacgaaatcaccagcatccccgagacagagccactgcagtcgcccacaaccaaggtgaagctcgagtgcaaccccacagcccgcatctaccggaagcactttctcggcaaggagcatttcaattactactcactggacgctgccctcggccaccttgtcttctcactcaagtacgatgtcatcggggaccaagagcacctgcggctgctgctcaggaccaagtgccggacataccatgatgtcatccccatctcctgcctcaccgagttccctaatgttgtccagatggcaaagttggtgtgtgaagacgtcaatgtggatcggttctatcctgtgctctaccccaaggcttcccggctcatcgtcacctttgacgagcatgtcatcagcaataacttcaagtttggcgtcatttatcagaagcttgggcagacctccgaggaagaactcttcagcaccaatgaggaaagtcccgctttcgtggagttccttgaatttcttggccagaaggtcaaactgcaggactttaaggggttccgaggaggcctggacgtgacccacgggcagacggggaccgaatctgtgtactgcaacttccgcaacaaggagatcatgtttcacgtgtccaccaagctgccatacacggaaggggacgcccagttgcagcggaagcggcacatcgggaacgacatcgtggctgtggtcttccaggatgagaacactcctttcgtgcccgacatgatcgcgtccaacttcctgcatgcctacgtcgtggtgcaggctgagggcgggggccctgatggccccctctacaaggtctctgtcactgcaagagatgatgtgcccttctttggaccccccctcccggaccccgctgtgttcaggaaggggcctgagttccaggaatttttgctgacaaagctgatcaatgctgaatatgcctgctacaaggcagagaagtttgccaaactggaggagcggacgcgggccgccctcctggagacgctctatgaggaactacacatccacagccagtccatgatgggcttgggcggcgacgaggacaagatggagaatggcagtgggggcggcggcttctttgagtctttcaagcgggtcatccggagccgcagccagtccatggatgccatggggctgagcaacaagaagcccaacaccgtgtccaccagccacagcgggagcttcgcgcccaacaaccccgacctggccaaggcggctggaatatcactgattgtccctgggaagagccccacgaggaagaagtcgggcccgttcggctcccgccgcagcagcgccattggcatcgagaacatacaggaggtgcaggagaagagggagagccctccggctggtcagaagaccccagacagcgggcacgtctcacaggagcccaagtcggagaactcatccactcagagctccccagagatgcccacgaccaagaacagagcggagaccgcagcgcagagagcagaggcgctcaaggacttctcccgctcctcgtccagtgccagcagcttcgccagcgtggtggaggagacggagggtgtggacggagaggacacaggcctggagagcgtgtcatcctcaggaacaccccacaagcgggactccttcatctatagcacgtggctggaggacagtgtcagcaccactagtgggggcagctccccaggcccctctcgatcaccccacccagacgccggcaagttgggggaccctgcgtgtcccgagatcaagatccagctggaagcatctgagcagcacatgccccagctgggctgttagccgggccaccccctctgaaggtgaaactgagcagatgaggccacagaagcacaaggggaaggtgccgtgtcaagcccaggcagacgagacctctgccctgaagaccaacaccagcccgtgggctgccccctgcctccccaccctccccatggcccacccatctgggctgtctctgcagggcagagccgtccagacctgggatcagggaagctgctggcatcgtccccacccccagcctgggggtctgggctggggcagggattgctcagtggaagcaggactgggggtctggcttgccccctccctgggcctccatcacccctgagcatccctctggactcagagggaacaaggtgggagagagagtttgagacagctccgtgtggagagcttagcccctggaggcagcacaaggaggatgtgatatgtgggggagtgagcactgggttgggagccgggtcctggtttccaatttgggttctgctgtgtgactctgggcaagtcactctccctctctgggcatgtctgctacaaatggacaagattatttcagaggtcactgaagactgtgattacatgcacctgccttagaaggtaggattttcttcccagggacctcctatcaccctaccctgcttcttgaggtccctggagccccaggtgggctgaggggcagggagccggctgtgcccagtatgcctcctggaccctccagttctgccacaggtctgccgatgccctgtccactgcctacacatgacagacaagtaaccccctcatgggggatggggacctacctggctcctcagccagcacccagcttaacccctgccatcccatgctgggccctccaggccaagagtctcagctggccgagagtccaggccttgcctcccccgaccgccatggagggggcagcccggcacagctgctgggagcccttgtgtgtctggtcacactttttaggcgtcacgccaaaggccagcctcctggccccaatacccattttggaagcccctgtggccgtgtggatgtcggtaacagttgtataaaataaattctatttatcgctattgt

SEQ ID NO: 1934 - DNA, 3271 bp, Homo sapiens
ggccgcgggcaccagagtgccgagcccaggacgcccccggcccaggcccttggggtggacaagtccttcacttctcgccggagtgtgtggaggagcgatgggcagaaccagcacttccctcaggcactagacctgtcacgagtgaacttagttccctcctatactccttcactctaccctaagaacacagatctatttgagatgattgagaagatgcagggaagcaggatggatgaacaacgctgctccttcccgccgcccctcaaaacagaggaggactacattccatacccgagcgtgcacgaggtcttggggcgagaaggacccttccccctcatcctgctgccccagtttgggggctactggattgagggcaccaaccacgaaatcaccagcatccccgagacagagccactgcagtcgcccacaaccaaggtgaagctcgagtgcaaccccacagcccgcatctaccggaagcactttctcggcaaggagcatttcaattactactcactggacgctgccctcggccaccttgtcttctcactcaagtacgatgtcatcggggaccaagagcacctgcggctgctgctcaggaccaagtgccggacataccatgatgtcatccccatctcctgcctcaccgagttccctaatgttgtccagatggcaaagttggtgtgtgaagacgtcaatgtggatcggttctatcctgtgctctaccccaaggcttcccggctcatcgtcacctttgacgagcatgtcatcagcaataacttcaagtttggcgtcatttatcagaagcttgggcagacctccgaggaagaactcttcagcaccaatgaggaaagtcccgctttcgtggagttccttgaatttcttggccagaaggtcaaactgcaggactttaaggggttccgaggaggcctggacgtgacccacgggcagacggggaccgaatctgtgtactgcaacttccgcaacaaggagatcatgtttcacgtgtccaccaagctgccatacacggaaggggacgcccagcagttgcagcggaagcggcacatcgggaacgacatcgtggctgtggtcttccaggatgagaacactcctttcgtgcccgacatgatcgcgtccaacttcctgcatgcctacgtcgtggtgcaggctgagggcgggggccctgatggccccctctacaaggtctctgtcactgcaagagatgatgtgcccttctttggaccccccctcccggaccccgctgtgttcaggaaggggcctgagttccaggaatttttgctgacaaagctgatcaatgctgaatatgcctgctacaaggcagagaagtttgccaaactggaggagcggacgcgggccgccctcctggagacgctctatgaggaactacacatccacagccagtccatgatgggcttgggcggcgacgaggacaagatggagaatggcagtgggggcggcggcttctttgagtctttcaagcgggtcatccggagccgcagccagtccatggatgccatggggctgagcaacaagaagcccaacaccgtgtccaccagccacagcgggagcttcgcgcccaacaaccccgacctggccaaggcggctggaatatcactgattgtccctgggaagagccccacgaggaagaagtcgggcccgttcggctcccgccgcagcagcgccattggcatcgagaacatacaggaggtgcaggagaagagggagagccctccggctggtcagaagaccccagacagcgggcacgtctcacaggagcccaagtcggagaactcatccactcagagctccccagagatgcccacgaccaagaacagagcggagaccgcagcgcagagagcagaggcgctcaaggacttctcccgctcctcgtccagtgccagcagcttcgccagcgtggtggaggagacggagggtgtggacggagaggacacaggcctggagagcgtgtcatcctcaggaacaccccacaagcgggactccttcatctatagcacgtggctggaggacagtgtcagcaccactagtgggggcagctccccaggcccctctcgatcaccccacccagacgccggcaagttgggggaccctgcgtgtcccgagatcaagatccagctggaagcatctgagcagcacatgccccagctgggctgttagccgggccaccccctctgaaggtgaaactgagcagatgaggccacagaagcacaaggggaaggtgccgtgtcaagcccaggcagacgagacctctgccctgaagaccaacaccagcccgtgggctgccccctgcctccccaccctccccatggcccacccatctgggctgtctctgcagggcagagccgtccagacctgggatcagggaagctgctggcatcgtccccacccccagcctgggggtctgggctggggcagggattgctcagtggaagcaggactgggggtctggcttgccccctccctgggcctccatcacccctgagcatccctctggactcagagggaacaaggtgggagagagagtttgagacagctccgtgtggagagcttagcccctggaggcagcacaaggaggatgtgatatgtgggggagtgagcactgggttgggagccgggtcctggtttccaatttgggttctgctgtgtgactctgggcaagtcactctccctctctgggcatgtctgctacaaatggacaagattatttcagaggtcactgaagactgtgattacatgcacctgccttagaaggtaggattttcttcccagggacctcctatcaccctaccctgcttcttgaggtccctggagccccaggtgggctgaggggcagggagccggctgtgcccagtatgcctcctggaccctccagttctgccacaggtctgccgatgccctgtccactgcctacacatgacagacaagtaaccccctcatgggggatggggacctacctggctcctcagccagcacccagcttaacccctgccatcccatgctgggccctccaggccaagagtctcagctggccgagagtccaggccttgcctcccccgaccgccatggagggggcagcccggcacagctgctgggagcccttgtgtgtctggtcacactttttaggcgtcacgccaaaggccagcctcctggccccaatacccattttggaagcccctgtggccgtgtggatgtcggtaacagttgtataaaataaattctatttatcgctattgta

SEQ ID NO: 1935 - DNA, 1633 bp, Homo sapiens
gcgtctgccaatgatccaggagccgctcctttccactcgggaaaccttcagaggagtctcagaaaggacacggctggctgcttttctcagcgccgaagccgcgccatgctcgtcctcagaagcgccctgactcgggcgctggcctcacggacgctggcgcctcagatgtgctcatcttttgctacgggacccagacaatacgatggaatattctatgaatttcgttcttattaccttaagccctcaaagatgaatgagttcctggaaaattttgagaaaaacgctcatcttcggacagctcactctgaattggttggatactggagtgtagaatttggaggcagaatgaatacagtgtttcatatttggaagtatgataattttgctcatcgaactgaagttcggaaagccttggccaaagataaggaatggcaagaacaattcctcattccaaatttggctctcattgataaacaagagagtgagattacttatctggtaccatggtgcaaattagaaaaacctccaaaagaaggagtctatgaactggccacttttcagatgaaacctggtgggccagctctgtggggtgatgcatttaaaagggcagttcatgctcatgtcaatctaggctacacaaaactagttggagtgttccacacagagtacggagcactcaacagagttcatgttctttggtggaatgagagtgcagatagtcgtgcagctgggagacataagtcccatgaggatcccagagttgtggcagctgttcgggaaagtgtcaactacctagtatctcagcagaatatgcttctgattcctacatcgttttcaccactgaaatagttttctactgaaatacaaaacatttcattaactgctataggatctgtctgctaatggtgcttaaattctcccaagaggttctcacttttatttgaaggaggtgttaagttaatttgctatgtttcttgcattatgaaggctacatctgtgctttgtaagtaccacttcaaaaaatagttctgtttactttctgcatggtatttcagtgtctgtcatacattaaaaatacttgtcactgttttaagatcttgactcttcatttgtttcagaatagctcttctactgtattctgacaactctttgctttatagcattttgttgtattcaaatgataatggtagcatttccatgcttgtgacagcatttttaagttattaatatattttatcaacctttccatcatgtctgttttcctggttttttttggttgttttttgaccagtaaaatttattttgtaataccaaataggatttaagaaaattaacgtatttctttactatggaaaaccacattgtcatttgtgacatcatctatattaaatatggttttcacattagttatttgtcacttacttggaaaatgatgctgttaggtcctggtattaaaaatctagaaaagacttgttggtttatgtgctgaaatgtctttatttataattaattttaactactatttacttcatttcggatcctgtttaacaaagatacttgagacatccatttgttttaatgaaatctgtatggatatggaaatgcttgccctaataaaagcctacatatacct

SEQ ID NO: 1936 - DNA, 4266 bp, Homo sapiens
gggggctgtagggagggggaccagtggcagagggaccttaggtgatccttagaaataaaggctagcttctgttcgaccttggagtagggcgaagaggtgtagacaggcctggagaagcgaggtaaaagcctgagtaaaagcaagaagttggagaatatgagatacatctcatctctagtaaatacttaaatgacttcccctcctcccggagtcaagcacaattcggggatgcaatgacggacgtaggtgaagacactgcgggaacttacagacaaaactggtttgtggcctgtttgattcctgtcagaggtttgctgacccaagacagtatcgaaaatgcatattaagtcaattattctagagggattcaagtcctatgctcagaggaccgaagtcaatggttttgaccccctcttcaatgctatcactggcttaaatggtagtgggaaatccaacatattggactccatctgctttttgctgggcatctccaacctgtctcaggttcgggcttctaatttacaagatttagtttacaaaaatgggcaggctggtattaccaaagcctctgtgtcaatcacttttgataattctgacaaaaagcaaagtcctttaggatttgaggttcatgatgaaatcacagtaacaaggcaggtggttattggtggtagaaataaatatttaatcaatggagtcaatgccaacaacaccagagtacaggatctcttctgttctgttggccttaatgttaacaaccctcactttctcatcatgcagggccgaattacaaaagtattgaatatgaaacctccagagattttatccatgatagaagaagcagctggaaccaggatgtatgaatacaaaaaaatagctgcacagaaaactatagaaaaaaaggaggctaagctgaaagaaattaagacgatacttgaagaagagattactccaaccattcaaaaattaaaagaggaaagatcgtcctacttggagtaccaaaaagtaatgagagaaatagaacatttgagtcgtttatatattgcttatcagtttttgctggctgaagataccaaagtacgctcagctgaggaattaaaagaaatgcaagataaagttataaagcttcaggaagaattgtctgagaatgataaaaaaataaaagcacttaatcatgaaatagaagaattggaaaaaagaaaagataaggaaactggaggtatacttcgatctttagaagatgctcttgcagaggctcagcgagttaatactaaatctcaaagcgcatttgatctcaagaagaaaaatctggcatgtgaggaaagcaaacgcaaagagctggaaaaaaatatggttgaggactcaaaaactttagcagcaaaggaaaaagaggttaaaaagataacagatggactgcatgcccttcaagaagcaagtaataaagatgctgaagctctggcagctgcacagcagcacttcaatgctgtttccgctggcctgtccagtaatgaagatggagcagaagcaactcttgctggtcaaatgatggcctgtaaaaatgatataagtaaagctcagacagaagccaaacaggctcagatgaagttgaagcatgctcaacaggaattaaagaataaacaagctgaagttaagaagatggatagtggctacaggaaggatcaagaagctctagaagctgtaaaaagacttaaagaaaaacttgaagctgaaatgaaaaagctaaattatgaagaaaataaagaggaaagccttttggaaaagcgcaggcagctgtctcgtgatattggtagattgaaagaaacatatgaagctctattagccagatttcccaatcttcgatttgcatacaaggatccagagaagaactggaatagaaattgtgtgaaaggacttgtggcttctctgattagtgtgaaagacacttctgcaaccacagctttagaattagtggctggagaacgactctacaatgttgtagtagacacagaagttactggtaaaaagctactagaaaggggggaactgaaacgtcgatacactataattccactcaataaaatttcagccagatgtattgcaccagaaactctgagagttgctcagaatcttgttggccctgacaacgttcatgtggctctttccttggttgaatataaaccagaacttcagaaagcaatggagtttgtctttggaacaacatttgtttgtgacaatatggataatgccaaaaaagtggcctttgataagaggataatgactagaactgtaactctcggaggtgatgtgtttgatcctcatgggacattgagtggaggtgctcgatcccaggcagcttccattttaaccaagtttcaagaactcaaagatgttcaggatgaactgagaatcaaagagaatgagctgcgggctctagaagaggaattagcaggtcttaaaaacactgctgaaaagtatcgccaactaaaacagcagtgggagatgaaaactgaagaggcagatttattacaaaccaagctccagcaaagctcatatcacaagcaacaagaagaattagatgcccttaaaaaaaccattgaggaaagtgaggagactttgaaaaacactaaagaaatccaaagaaaagcagaagaaaaatatgaagtattggaaaataaaatgaaaaatgcagaagctgaaagagagcgagaactgaaagatgctcagaaaaaactggattgtgccaaaacaaaggcagatgcatctagcaagaagatgaaagaaaaacaacaggaagttgaagctatcactctggaactggaagagctcaagagagagcatacatcttacaaacaacagcttgaagctgtaaatgaagctatcaaatcctatgaaagtcagattgaagtaatggcagctgaggtggctaaaaataaggagtcagtaaataaagctcaagaagaggtgaccaagcaaaaagaggtgataacagcccaagacactgtaattaaagctaaatatgcagaagtggcaaaacacaaggagcaaaacaatgattctcagcttaaaattaaggaattagaccacaacatcagcaaacataaacgggaggctgaagatggtgctgcaaaggtatccaaaatgttgaaagattatgactggattaatgcagagagacacctctttggccaacccaatagtgcctatgatttcaaaactaacaaccctaaagaagctggtcagagacttcagaagttgcaagaaatgaaggagaaactaggaagaaatgtcaatatgagagctatgaatgtattgacagaagctgaagagcgatacaatgacttgatgaagaagaagagaattgtagaaaatgacaaatccaaaattcttacaactatagaagaccttgaccagaagaaaaaccaagccctaaatattgcatggcaaaaggtgaacaaggactttgggtctattttttctactcttttgcctggtgctaatgctatgcttgcaccaccagagggtcaaactgttttggatggtctggagttcaaggttgccttgggaaatacctggaaagaaaacctaactgaacttagtggtggtcagaggtctttagtggccttgtcattaatactgtccatgcttctcttcaaacctgctccaatttatatccttgatgaggtagatgcagccttggatctttctcatacccaaaacattggacagatgctgcgtactcatttcacacattctcagttcattgtggtgtcactaaaagaaggtatgttcaacaatgcaaacgttcttttcaaaaccaagtttgtggatggtgtttctacagtagccagatttactcaatgtcaaaatggaaagatttcaaaggaagcaaaatccaaggcaaaaccacccaaaggagcacatgtggaagtttaaactacaaagttatttcttcatcttgacctgtttttttaaatgtaaacttttaaggacttgagataactaatttgtttatatacaaaaattaatgttactgtgttacttaacccatgttttctctttatataatcacttatcgcttacaaatgagcatatattcctcatctcttaactagtctaattatggtccaattattgtggttgtgattttatgcatatcatcaaatgtttttttcttatgcgggtcttttatatattagggatcctgagatacccgattctatatgtaaaagctaatatacaaaaaagcagattaaattacatgataaatgt

SEQ ID NO: 1937 - DNA, 5909 bp, Homo sapiens
cggcgcgggtgttgagagcggtgtggcaggtgttgtagccgctatggtgaagttcgctttgtagcggccccggctagagagttgttctgttccctgcctttgtgacccggaggagcttttggggtgcgtcaagcccctggcctgaggcagcgaactggtttgtggcctgtttgattcctgtcagaggtttgctgacccaagacagtatcgaaaatgcatattaagtcaattattctagagggattcaagtcctatgctcagaggaccgaagtcaatggttttgaccccctcttcaatgctatcactggcttaaatggtagtgggaaatccaacatattggactccatctgctttttgctgggcatctccaacctgtctcaggttcgggcttctaatttacaagatttagtttacaaaaatgggcaggctggtattaccaaagcctctgtgtcaatcacttttgataattctgacaaaaagcaaagtcctttaggatttgaggttcatgatgaaatcacagtaacaaggcaggtggttattggtggtagaaataaatatttaatcaatggagtcaatgccaacaacaccagagtacaggatctcttctgttctgttggccttaatgttaacaaccctcactttctcatcatgcagggccgaattacaaaagtattgaatatgaaacctccagagattttatccatgatagaagaagcagctggaaccaggatgtatgaatacaaaaaaatagctgcacagaaaactatagaaaaaaaggaggctaagctgaaagaaattaagacgatacttgaagaagagattactccaaccattcaaaaattaaaagaggaaagatcgtcctacttggagtaccaaaaagtaatgagagaaatagaacatttgagtcgtttatatattgcttatcagtttttgctggctgaagataccaaagtacgctcagctgaggaattaaaagaaatgcaagataaagttataaagcttcaggaagaattgtctgagaatgataaaaaaataaaagcacttaatcatgaaatagaagaattggaaaaaagaaaagataaggaaactggaggtatacttcgatctttagaagatgctcttgcagaggctcagcgagttaatactaaatctcaaagcgcatttgatctcaagaagaaaaatctggcatgtgaggaaagcaaacgcaaagagctggaaaaaaatatggttgaggactcaaaaactttagcagcaaaggaaaaagaggttaaaaagataacagatggactgcatgcccttcaagaagcaagtaataaagatgctgaagctctggcagctgcacagcagcacttcaatgctgtttccgctggcctgtccagtaatgaagatggagcagaagcaactcttgctggtcaaatgatggcctgtaaaaatgatataagtaaagctcagacagaagccaaacaggctcagatgaagttgaagcatgctcaacaggaattaaagaataaacaagctgaagttaagaagatggatagtggctacaggaaggatcaagaagctctagaagctgtaaaaagacttaaagaaaaacttgaagctgaaatgaaaaagctaaattatgaagaaaataaagaggaaagccttttggaaaagcgcaggcagctgtctcgtgatattggtagattgaaagaaacatatgaagctctattagccagatttcccaatcttcgatttgcatacaaggatccagagaagaactggaatagaaattgtgtgaaaggacttgtggcttctctgattagtgtgaaagacacttctgcaaccacagctttagaattagtggctggagaacgactctacaatgttgtagtagacacagaagttactggtaaaaagctactagaaaggggggaactgaaacgtcgatacactataattccactcaataaaatttcagccagatgtattgcaccagaaactctgagagttgctcagaatcttgttggccctgacaacgttcatgtggctctttccttggttgaatataaaccagaacttcagaaagcaatggagtttgtctttggaacaacatttgtttgtgacaatatggataatgccaaaaaagtggcctttgataagaggataatgactagaactgtaactctcggaggtgatgtgtttgatcctcatgggacattgagtggaggtgctcgatcccaggcagcttccattttaaccaagtttcaagaactcaaagatgttcaggatgaactgagaatcaaagagaatgagctgcgggctctagaagaggaattagcaggtcttaaaaacactgctgaaaagtatcgccaactaaaacagcagtgggagatgaaaactgaagaggcagatttattacaaaccaagctccagcaaagctcatatcacaagcaacaagaagaattagatgcccttaaaaaaaccattgaggaaagtgaggagactttgaaaaacactaaagaaatccaaagaaaagcagaagaaaaatatgaagtattggaaaataaaatgaaaaatgcagaagctgaaagagagcgagaactgaaagatgctcagaaaaaactggattgtgccaaaacaaaggcagatgcatctagcaagaagatgaaagaaaaacaacaggaagttgaagctatcactctggaactggaagagctcaagagagagcatacatcttacaaacaacagcttgaagctgtaaatgaagctatcaaatcctatgaaagtcagattgaagtaatggcagctgaggtggctaaaaataaggagtcagtaaataaagctcaagaagaggtgaccaagcaaaaagaggtgataacagcccaagacactgtaattaaagctaaatatgcagaagtggcaaaacacaaggagcaaaacaatgattctcagcttaaaattaaggaattagaccacaacatcagcaaacataaacgggaggctgaagatggtgctgcaaaggtatccaaaatgttgaaagattatgactggattaatgcagagagacacctctttggccaacccaatagtgcctatgatttcaaaactaacaaccctaaagaagctggtcagagacttcagaagttgcaagaaatgaaggagaaactaggaagaaatgtcaatatgagagctatgaatgtattgacagaagctgaagagcgatacaatgacttgatgaagaagaagagaattgtagaaaatgacaaatccaaaattcttacaactatagaagaccttgaccagaagaaaaaccaagccctaaatattgcatggcaaaaggtgaacaaggactttgggtctattttttctactcttttgcctggtgctaatgctatgcttgcaccaccagagggtcaaactgttttggatggtctggagttcaaggttgccttgggaaatacctggaaagaaaacctaactgaacttagtggtggtcagaggtctttagtggccttgtcattaatactgtccatgcttctcttcaaacctgctccaatttatatccttgatgaggtagatgcagccttggatctttctcatacccaaaacattggacagatgctgcgtactcatttcacacattctcagttcattgtggtgtcactaaaagaaggtatgttcaacaatgcaaacgttcttttcaaaaccaagtttgtggatggtgtttctacagtagccagatttactcaatgtcaaaatggaaagatttcaaaggaagcaaaatccaaggcaaaaccacccaaaggagcacatgtggaagtttaaactacaaagttatttcttcatcttgacctgtttttttaaatgtaaacttttaaggacttgagataactaatttgtttatatacaaaaattaatgttactgtgttacttaacccatgttttctctttatataatcacttatcgcttacaaatgagcatatattcctcatctcttaactagtctaattatggtccaattattgtggttgtgattttatgcatatcatcaaatgtttttttcttatgcgggtcttttatatattagggatcctgagatacccgattctatatgtaaaagctaatatacaaaaaagcagattaaattacatgataaatgtagctgatcatcagtgtttaattgatttaattcctaaggcaatattaatgtgttttctaaagtcattcaggtaaggaagaattataaatcaggtaactggaccaacaaagggaacacatataaagctattatgcatgcatggagccgtttgaggctagttttttaaggccacaactccagacccctgatttagactgagataggaaacagatcttgaaagaatccttattttaatgatacatgaatatcatgttcctatacgcttaataattggtctctacgttttaatgatacatgaatatcatgttcctatacgcttaataattggtctctacgactttaatgtttttgtttttttaagctgtgtaagtatttttaaatcaaagcttaggaggtgtgttgcgtggtactatctgctgcaaatttatctgaagtttgttaatattttccaagatttttgtcagccttttcataatccagtcattaacaacctattggtaaacaagaatgtaggtgccagtagactaaaccaaatttatttttccctgagtctgatatatatatgtataaatataaataactcaatccatctgttccaccaaaataactcaaaagttggatgattatttgtcttccgctttccagttcaaagggatgaaattcctttagaacttgaaagatgacactagcgaacaccatgagaatactgtctacagtttttggtacgtcatcactagaacagtgaccccaaactgaatcatgaaaggtctgacatgatgtaatctgatcttccatgtgttattttggccccacatctcttcttgattttttagtcttatttccttagtgttattatcatacttcccctgatatatggccgtacttcctggccctgggcttgacatttcccacccttcattctccatacatatgagatgtcagaaaacatgcagtaattgatattatgggacacattggaaaggattgaatctggaattagttctgtccactgtggaggggagaggaaataatgctgtaaatgttgagttacagaaagtccaatgtcaaatatagtttttttgtttcctttcaaatgtattacagactgtgccaaaacagttaccaattcacactgtcaatattaaagtataccatagtatacaaattagtcagtacttgctgttaattttaatatttctgatttaacagttagttattaagtggtacttcattgctgttttagccaacgttttaaaaataatttgggagtttgactattttggcttacgtactcatttccttttctctgctaaaaatgttttgcttgtgtgcgttcctgatttttgtcttgtataatcttgatctttgaaaaccctcaaacatgtattaaattgttgtaactttttttcattagagggaagacattaaggggattggggacatttgtttcacacatctgcagtaatatgagttaactaatatttaacaagctctttctttacattagctgctgttctcatttgtatgtattgtcatatttaatcctcagagtaacctagtgaggtaaatactgttgttgtcagcatggtgtaatcgaggaattgagtgagttgagcagaaaagttaggaaacttgctcagggtgataatacagttaggagtgtcagggcccatggacaaatcttgtcagtctccagaacctaagatatactacgtcactgacagcttgaacatttgtatttattgtacagaataaatttaagaaaaa

SEQ ID NO: 1938 - DNA, 2171 bp, Homo sapiens
gatgtcacctttcaacatcaccagtttgaacttacaatacttaagtcctggcaagtcataagtggggaaaatgtctctcccaagattccaaagagtaaactttgggccatatgataattacattccagtcagtgaattaagcaaaaaatcatggaatcagcaacactttgccctgttatttcccaaaccacaacggccaggaaccaaaaggagatcaaaaccttctcaaatacgggacaacacggtttctataattgatgaagaacaattaagaggagatcgtagacaaccattatggatgtaccgttctttaatgagaatttctgagagaccatctgtttatttagctgccaggaggcagcctctcaaaccaactcgtactgtcgaggtggattctaaagcagcagaaattggtaagaaaggtgaagacaagacaacacagaaggacacaacagattcggaatcagaattaaaacaaggaaaaaaagattcaaagaaaggcaaggatatagagaaaggaaaagaagaaaagctagatgcaaagaaagatagcaaaaaaggtaaaaaggatgcagagaagggcaaagactcagcaacagaatctgaagatgaaaaaggaggtgcaaagaaagataacaaaaaagataaaaaggattcaaacaaaggcaaagactcggcaacagaatctgaaggtgaaaaaggaggtacagagaaagatagcaaaaaaggtaaaaaggattcaaagaagggcaaggattcagccatagaattacaagctgtaaaagcagatgaaaagaaggatgaggatggaaaaaaagatgcaaacaaaggtgatgaatcgaaggatgccaagaaagatgcaaaggagattaaaaaaggtaagaaagataagaagaagcccagtagtacagacagtgactcaaaggatgatgtcaagaaagagtctaagaaggacgccacgaaagatgccaagaaagttgccaagaaagatactgagaaagaatctgctgattcaaagaaggatgcaaagaaaaatgctaagaaggatgcaaagaaggatgcaaagaagaatgcaaagaaggatgaaaagaaggatgcaaagaagaagggcaagtaggccttggataagaatttgaaccgaaagaataattcaaaagcatatttgatgaaacaatagtggtagtctgcagctgaatttgtgagaaaacaagaggcctcaaagaattaaataatttttaaaaggtggtaaagaaggatacaaaggagaactcagcagagatttataaaaatatataagaaagatgttaagaaaaattaaggggggatccattgaaagacttgaagaatacatatacttatattcggggatatgaaggattcaatgaatgatctctagaaagatttaaagaagaatattcagataaggatgttgaagataatgacactaaatctatggacacacacacacacacacacacacacacacacacacacacacacacacacacacagtttaatgaaggcttaaagaatccaaggagacagatgttgtatctatagatttaaaataatctcaagctgcatccacagatacaaaaaaatataggagccatgaaatgaagttaaacaccttgtagaaagcctactttcaagtaaatatagcattcctttggcaaaaagaaaaaaaaagtaaaagaaaagaaaaaaaatgtattaccacccgatgagcctacatctttctttctgaagtttaaacaaccacagtcatgtttatggttgttggatgtgccacttccaatccaaaagaagcacacttgtctcgctctgttgccctggctggagttcagtgacatgatctcaggcttactacagcctccaccttcaggttcaagtgattctcctgcctcagcctctctggtagctgggattacagggaaggaaaatagctggcatttcttgctggagaaagttatcacaagtggaaaggttaccctagaaacaaaagatgactaccgtgaggatggattggacattacaccacactggaaaagtgaaacatctcattcagttggtgatcttcctgtcatgaaagttgcttgacagctctaattacgaattgaacacattaaacacctggtgaaattatcaattaaaaacatctagtcaccata

SEQ ID NO: 1939 - DNA, 1910 bp, Homo sapiens
ctagaggacctgtgcaacaacctcttgaggatcgaatcttcactcccgctgtctcagcagtctacagcacggtaacacaagtggcaagacagccgggaacccctaccccatccccttattcagcacatgaaataaacaaggggcatccaaatcttgcggcaacgcccccgggacatgcatcgtcccctggactctctcaaaccccttatccctctggacagaatgcaggtccaaccacgctggtataccctcaaacccctcagacaatgaattcacaacctcaaacccgttctccgtttttccagaggcctcaaatacagcctcctagagctaccatcccgaacagcagtccttccattcgtcctggtgcacagacacccactgcagtgtaccaggctaatcagcacatcatgatggttaaccatctgcccatgccgtacccagtgccccaggggcctcagtactgtataccacagtaccgtcatagtggccctccttatgttgggcccccccaacaatatccagttcaaccaccggggccaggtcctttttatcctggaccaggacctggggacttccccaatgcttatggaacgcctttttacccaagtcagccggtgtatcagtcagcacctatcatagtgcctacgcagcaacagccgcctccagccaagagagagaaaaaaactataagaattcgggatccaaaccagggaggtaaagacataacagaggagattatgtctggaggtggcagcagaaatcctactccacccataggaagacccacgtccacacctactcctcctcagcagctgcccagccaggtccccgagcacagccctgtggtttatgggactgtggagagcgctcatcttgctgccagcacccctgtcactgcagctagcgaccagaagcaagaggagaagccaaaaccagatccagtgttaaagtctccttccccagtccttaggctagtcctcagtggagagaagaaagaacaagaaggccagacatctgaaactactgcaatagtatccatagcagagcttcctctgcctccatcacctaccactgtttcttctgttgctcgaagtacaattgcagcccccacctcttctgctcttagtagccaaccaatattcaccactgctatagatgacagatgtgaactctcatccccaagagaagacacaattcctatacccagcctcacatcttgcacagaaacatcagaccctttaccaacaaatgaaaatgatgatgatatatgcaagaaaccctgtagtgtagcacctaatgatattccactggtttctagtactaacctaattaatgaaataaatggagttagcgaaaaattatcagccacggagagcattgtggaaatagtaaaacaggaagtattgccattgactcttgaattggagattctcgaaaatcccccagaagaaatgaaactggagtgtatcccagctcccatcaccccttccacagttccttcctttcctccaactcctccaactcctccagcttctcctcctcacactccagtcattgttcctgctgctgccactactgttagttctccgagtgctgccatcacagtccagagagtcctagaggaggacgagagcataagaacttgccttagtgaagatgcaaaagagattcagaacaaaatagaggtagaagcagatgggcaaacagaagagattttggattctcaaaacttaaattcaagaaggagccctgtcccagaaacatcgaatgaatgctgaaattcctagtctggtttcttcagtggtgtgtttgtgttttagtacaacctgcaaaagagttactccattgtctaaaaatgcaaatgagaatttccaaatatacaaaatgcctccaaggtatatgtcacg

SEQ ID NO: 1940 - DNA, 1136 bp, Homo sapiens
cagaaacatcgaatgaatgctgaaattcctagtctggtttcttcagtggtgtgtttgtgttttagtacaacctgcaaaagagttactccattgtctaaaaatgcaaatgagaatttccaaatatacaaaatgcctccaagctcaaatagctataactgtaccaaagacatggaagaaaccaaaagatcggacccgaaccactgaagagatgttagaggcagaattggagcttaaagctgaagaggagctttccattgacaaagtacttgaatctgaacaagataaaatgagccaggggtttcatcctgaaagagacccctctgacctaaaaaaagtgaaagctgtggaagaaaatggagaagaagctgagccagtacgtaatggtgctgagagtgtttctgagggtgaaggaatagatgctaattcaggctccacagatagttctggtgatggggttacatttccatttaaaccagaatcctggaagcctactgatactgaaggtaagaagcagtatgacagggagtttctgctggacttccagttcatgcctgcctgtatacaaaaaccagagggcctgcctcctatcagtgatgtggttcttgacaagatcaaccaacccaaattgccaatgcgaactctggatcctcgaattttgcctcgaggaccagactttacaccagcctttgctgattttggaaggcagacacctggtggaagaggcgtacctgtaagtgcaagttccctacaactcacttagttagacactggcacagactccatgaaatcctacctcatggcaagacagcagcttttattcgttgattctagtcaagaagaagaagaagaggcaaagactatcctttccatactcatattaaagcagataaagaatacacttgagttctttttacttggcagaagctagtctgcattaatttggtcttgattttttttttccctattttttcaattgaggtgacctgcaaataggtttaaaaatagtgccaaccatggccagggatggtggctcaggtctgtaatgctagcactttgtggggtcaaggcaggaggatcacttgaggtcaggagttcaaggtcagcctgacaacaaagagagaccctgtctctaccac

SEQ ID NO: 1941 - DNA, 4675 bp, Homo sapiens
gcccccgggacatgcatcgtcccctggactctctcaaaccccttatccctctggacagaatgcaggtccaaccacgctggtataccctcaaacccctcagacaatgaattcacaacctcaaacccgttctccgtttttccagaggcctcaaatacagcctcctagagctaccatcccgaacagcagtccttccattcgtcctggtgcacagacacccactgcagtgtaccaggctaatcagcacatcatgatggttaaccatctgcccatgccgtacccagtgccccaggggcctcagtactgtataccacagtaccgtcatagtggccctccttatgttgggcccccccaacaatatccagttcaaccaccggggccaggtcctttttatcctggaccaggacctggggacttccccaatgcttatggaacgcctttttacccaagtcagccggtgtatcagtcagcacctatcatagtgcctacgcagcaacagccgcctccagccaagagagagaaaaaaactataagaattcgggatccaaaccagggaggtaaagacataacagaggagattatgtctggaggtggcagcagaaatcctactccacccataggaagacccacgtccacacctactcctcctcagcagctgcccagccaggtccccgagcacagccctgtggtttatgggactgtggagagcgctcatcttgctgccagcacccctgtcactgcagctagcgaccagaagcaagctcaaatagctataactgtaccaaagacatggaagaaaccaaaagatcggacccgaaccactgaagagatgttagaggcagaattggagcttaaagctgaagaggagctttccattgacaaagtacttgaatctgaacaagataaaatgagccaggggtttcatcctgaaagagacccctctgacctaaaaaaagtgaaagctgtggaagaaaatggagaagaagctgagccagtacgtaatggtgctgagagtgtttctgagggtgaaggaatagatgctaattcaggctccacagatagttctggtgatggggttacatttccatttaaaccagaatcctggaagcctactgatactgaaggtaagaagcagtatgacagggagtttctgctggacttccagttcatgcctgcctgtatacaaaaaccagagggcctgcctcctatcagtgatgtggttcttgacaagatcaaccaacccaaattgccaatgcgaactctggatcctcgaattttgcctcgaggaccagactttacaccagcctttgctgattttggaaggcagacacctggtggaagaggcgtacctttgttgaatgttgggtcacgaagatctcaacctggccaaagaagagaacccagaaagatcatcacagtttctgtaaaagaagatgtacacctgaaaaaggcagaaaatgcctggaagccaagccaaaaacgagacagccaagccgatgatcccgaaaacattaaaacccaggagctttttagaaaagttcgaagtatcttaaataaattgacaccacagatgttcaatcaactgatgaagcaagtgtcaggacttactgttgacacagaggagcggctgaaaggagttattgacctggtctttgagaaggctattgatgaacccagtttctctgtggcttacgcaaacatgtgtcgatgtctagtaacgctgaaagtacccatggcagacaagcctggtaacacagtgaatttccggaagctgctactgaaccgttgccagaaggagtttgaaaaagataaagcagatgatgatgtctttgagaagaagcagaaagaacttgaggctgccagtgctccagaggagaggacaaggcttcatgatgaactggaagaagccaaggacaaagcccggcggagatccattggcaacatcaagtttattggagaactctttaaactcaaaatgctgactgaagccatcatgcatgactgtgtggtgaagctgctaaagaaccatgatgaagaatccctggagtgcctgtgtcgcctgctcaccaccattggcaaagacttggactttgaaaaagcaaagccacgtatggaccagtactttaatcagatggagaaaattgtgaaagaaagaaaaacctcatctaggattcggttcatgcttcaagatgttatagacctaaggctgtgcaattgggtatctcgaagagcagatcaagggcctaaaactatcgaacagattcacaaagaggctaaaatagaagaacaagaagagcaaaggaaggtccagcaactcatgaccaaagagaagagaagaccaggtgtccagagagtggacgaaggtgggtggaacactgtacaaggggccaagaacagtcgggtactggacccctcaaaattcctaaaaatcactaagcctacaattgatgaaaaaattcagctggtacctaaagcacagctaggcagctggggaaaaggcagcagtggtggagcaaaggcaagtgagactgatgccttacggtcaagtgcttccagtttaaacagattctctgccctgcaacctccagcaccctcagggtccacgccatccacgcctgtagagtttgattcccgaaggaccttaactagtcgtggaagtatgggcagggagaagaatgacaagccccttccatctgcaacagctcggccaaatactttcatgaggggtggcagcagtaaagacctgctagacaatcagtctcaagaagagcagcggagagagatgctggagaccgtgaagcagctcacaggaggtgtggatgtggagaggaacagcactgaggctgagcgaaataaaacaagggagtcagcaaaaccagaaatttcagcaatgtcagctcatgacaaggctgcattatcagaagaggaactggagaggaagtcgaaatctatcattgatgaatttctacacattaatgattttaaggaagccatgcagtgtgtggaagagctgaatgcccagggcctactacatgtttttgtgagagtgggagtggagtccaccctggaaaggagccagatcaccagggatcacatgggccaattactctatcagctggtacagtcagaaaaactcagcaaacaggactttttcaaaggtttttcagaaactttggaattggcagatgacatggccattgatattccccatatttggttgtaccttgctgaactggtgacccccatgttaaaagaaggtggaatctccatgagagaacttaccatagaatttagcaaacctttacttcctgttggaagagctggggtcttgctatctgaaatattgcacctactatgcaaacaaatgagccataagaaagtgggagccttatggagggaggctgacctcagctggaaggactttttaccagaaggagaagatgtacataattttcttttggagcagaagttggacttcatagagtctgacagtccctgttcctctgaagcactttcaaagaaagaactgtctgccgaagagctgtataagcgactcgagaaactcattattgaggacaaagcgaatgatgaacagatctttgactgggtagaggctaatctagacgaaatccagatgagttcacctacattccttagagctttaatgactgctgtttgtaaagcagctattatagccgactcttctaccttcagagtggacactgctgttatcaagcagagagtgccgatcttactcaagtacctagactcagatacagagaaggaactgcaagcactttatgcactacaagcatcgatagtaaaacttgatcaacctgccaatttgctgcggatgttttttgattgtctatatgacgaggaggtgatctccgaggatgccttctacaaatgggagagcagcaaggaccctgcagagcagaatgggaagggcgtggctctgaaatctgtcacggcattcttcacgtggctgcgggaagcagaagaggagtctgaggataactaaaacttcaaatacacaaaatgaaacaaaagaaacaatttaagtatttttttaaaaagtttcacgtcttcgccaatcacagtgcagcaaggccaattctcgcagaaacccccacgtgtgcacgagtgggagaggggaaagagaaaaaaaggtgatcatggaggaaaaaggtactggataaaagtaaacttcaaaccttagggcgggagcactaaaaccaaaatacatgtattatttatagaaaatattttctgttttaatcttttctttttaaacaaggactcatacttaaaaaaatgtttagcaaaaaaaaaaaaagttgagaacttttaatttattttaaggactgcaaatgccagtgtaattttttaatttgcagtttctgtaaacaacttgtataatagaaaagcagagaaataaatttccctccccttcaagatgcacctcatgtttgttttaaggtatagcatttagtccagatttgagaaagtttggggtgaacaaggtaagaaagatttttttttttttggcatcaaatctttctgcctgcctctcagcttgcttcagaaaatttaaaaaatcacaatagtaatcaaaacatacataacattgaaacagaaggaaatgctgtggaccacagaactccaagaattgttt

SEQ ID NO: 1942 - DNA, 5046 bp, Homo sapiens
ccccatccccttattcagcacatgaaataaacaaggggcatccaaatcttgcggcaacgcccccgggacatgcatcgtcccctggactctctcaaaccccttatccctctggacagaatgcaggtccaaccacgctggtataccctcaaacccctcagacaatgaattcacaacctcaaacccgttctccgggaggattcagacctatccagtttttccagaggcctcaaatacagcctcctagagctaccatcccgaacagcagtccttccattcgtcctggtgcacagacacccactgcagtgtaccaggctaatcagcacatcatgatggttaaccatctgcccatgccgtacccagtgccccaggggcctcagtactgtataccacagtaccgtcatagtggccctccttatgttgggcccccccaacaatatccagttcaaccaccggggccaggtcctttttatcctggaccaggacctggggacttccccaatgcttatggaacgcctttttacccaagtcagccggtgtatcagtcagcacctatcatagtgcctacgcagcaacagccgcctccagccaagagagagaaaaaaactataagaattcgggatccaaaccagggaggtaaagacataacagaggagattatgtctggaggtggcagcagaaatcctactccacccataggaagacccacgtccacacctactcctcctcagctgcccagccaggtccccgagcacagccctgtggtttatgggactgtggagagcgctcatcttgctgccagcacccctgtcactgcagctagcgaccagaagcaagaggagaagccaaaaccagatccagtgttaaagtctccttccccagtccttaggctagtcctcagtggagagaagaaagaacaagaaggccagacatctgaaactactgcaatagtatccatagcagagcttcctctgcctccatcacctaccactgtttcttctgttgctcgaagtacaattgcagcccccacctcttctgctcttagtagccaaccaatattcaccactgctatagatgacagatgtgaactctcatccccaagagaagacacaattcctatacccagcctcacatcttgcacagaaacatcagaccctttaccaacaaatgaaaatgatgatgatatatgcaagaaaccctgtagtgtagcacctaatgatattccactggtttctagtactaacctaattaatgaaataaatggagttagcgaaaaattatcagccacggagagcattgtggaaatagtaaaacaggaagtattgccattgactcttgaattggagattctcgaaaatcccccagaagaaatgaaactggagtgtatcccagctcccatcaccccttccacagttccttcctttcctccaactcctccaactcctccagcttctcctcctcacactccagtcattgttcctgctgctgccactactgttagttctccgagtgctgccatcacagtccagagagtcctagaggaggacgagagcataagaacttgccttagtgaagatgcaaaagagattcagaacaaaatagaggtagaagcagatgggcaaacagaagagattttggattctcaaaacttaaattcaagaaggagccctgtcccagctcaaatagctataactgtaccaaagacatggaagaaaccaaaagatcggacccgaaccactgaagagatgttagaggcagaattggagcttaaagctgaagaggagctttccattgacaaagtacttgaatctgaacaagataaaatgagccaggggtttcatcctgaaagagacccctctgacctaaaaaaagtgaaagctgtggaagaaaatggagaagaagctgagccagtacgtaatggtgctgagagtgtttctgagggtgaaggaatagatgctaattcaggctccacagatagttctggtgatggggttacatttccatttaaaccagaatcctggaagcctactgatactgaaggtaagaagcagtatgacagggagtttctgctggacttccagttcatgcctgcctgtatacaaaaaccagagggcctgcctcctatcagtgatgtggttcttgacaagatcaaccaacccaaattgccaatgcgaactctggatcctcgaattttgcctcgaggaccagactttacaccagcctttgctgattttggaaggcagacacctggtggaagaggcgtacctttgttgaatgttgggtcacgaagatctcaacctggccaaagaagagaacccagaaagatcatcacagtttctgtaaaagaagatgtacacctgaaaaaggcagaaaatgcctggaagccaagccaaaaacgagacagccaagccgatgatcccgaaaacattaaaacccaggagctttttagaaaagttcgaagtatcttaaataaattgacaccacagatgttcaatcaactgatgaagcaagtgtcaggacttactgttgacacagaggagcggctgaaaggagttattgacctggtctttgagaaggctattgatgaacccagtttctctgtggcttacgcaaacatgtgtcgatgtctagtaacgctgaaagtacccatggcagacaagcctggtaacacagtgaatttccggaagctgctactgaaccgttgccagaaggagtttgaaaaagataaagcagatgatgatgtctttgagaagaagcagaaagaacttgaggctgccagtgctccagaggagaggacaaggcttcatgatgaactggaagaagccaaggacaaagcccggcggagatccattggcaacatcaagtttattggagaactctttaaactcaaaatgctgactgaagccatcatgcatgactgtgtggtgaagctgctaaagaaccatgatgaagaatccctggagtgcctgtgtcgcctgctcaccaccattggcaaagacttggactttgaaaaagcaaagccacgtatggaccagtactttaatcagatggagaaaattgtgaaagaaagaaaaacctcatctaggattcggttcatgcttcaagatgttatagacctaaggctgtgcaattgggtatctcgaagagcagatcaagggcctaaaactatcgaacagattcacaaagaggctaaaatagaagaacaagaagagcaaaggaaggtccagcaactcatgaccaaagagaagagaagaccaggtgtccagagagtggacgaaggtgggtggaacactgtacaaggggccaagaacagtcgggtactggacccctcaaaattcctaaaaatcactaagcctacaattgatgaaaaaattcagctggtacctaaagcacagctaggcagctggggaaaaggcagcagtggtggagcaaaggcaagtgagactgatgccttacggtcaagtgcttccagtttaaacagattctctgccctgcaacctccagcaccctcagggtccacgccatccacgcctgtagagtttgattcccgaaggaccttaactagtcgtggaagtatgggcagggagaagaatgacaagccccttccatctgcaacagctcggccaaatactttcatgaggggtggcagcagtaaagacctgctagacaatcagtctcaagaagagcagcggagagagatgctggagaccgtgaagcagctcacaggaggtgtggatgtggagaggaacagcactgaggctgagcgaaataaaacaagggagtcagcaaaaccagaaatttcagcaatgtcagctcatgacaaggctgcattatcagaagaggaactggagaggaagtcgaaatctatcattgatgaatttctacacattaatgattttaaggaagccatgcagtgtgtggaagagctgaatgcccagggcctactacatgtttttgtgagagtgggagtggagtccaccctggaaaggagccagatcaccagggatcacatgggccaattactctatcagctggtacagtcagaaaaactcagcaaacaggactttttcaaaggtttttcagaaactttggaattggcagatgacatggccattgatattccccatatttggttgtaccttgctgaactggtgacccccatgttaaaagaaggtggaatctccatgagagaacttaccatagaatttagcaaacctttacttcctgttggaagagctggggtcttgctatctgaaatattgcacctactatgcaaacaaatgagccataagaaagtgggagccttatggagggaggctgacctcagctggaaggactttttaccagaaggagaagatgtacataattttcttttggagcagaagttggacttcatagagtctgacagtccctgttcctctgaagcactttcaaagaaagaactgtctgccgaagagctgtataagcgactcgagaaactcattattgaggacaaagcgaatgatgaacagatctttgactgggtagaggctaatctagacgaaatccagatgagttcacctacattccttagagctttaatgactgctgtttgtaaagcagctattatagccgactcttctaccttcagagtggacactgctgttatcaagcagagagtgccgatcttactcaagtacctagactcagatacagagaaggaactgcaagcactttatgcactacaagcatcgatagtaaaacttgatcaacctgccaatttgctgcggatgttttttgattgtctatatgacgaggaggtgatctccgaggatgccttctacaaatgggagagcagcaaggaccctgcagagcagaatgggaagggcgtggctctgaaatctgtcacggcattcttcacgtggctgcgggaagcagaagaggagtctgaggataactaaaacttcaaatacacaaaatgaaacaaaagaaacaatttaagtatttttttaaaaagtttcacgtcttcgccaatcacagtgcagcaaggccaattctcgcagaaacccc

SEQ ID NO: 1943 - DNA, 2656 bp, Homo sapiens
gaagcgcgctaggttggctcttctgcgcgcctgcgccttggcgagctctgcgcaggcgcatttccaacgcttggaggagagggcggggtgtcgtttcctttcgctgatgcaagagcctagtgcggtggtgggagaggtatcggcaggggcagcgctgccgccggggcctggggctgacccgtctgacttcccgtccgtgccgagcccactcgagccgcagccatgtctggggacgagatgatttttgatcctactatgagcaagaagaaaaagaagaagaagaagccttttatgttagatgaggaaggggatacccaaacagaggaaacccagccttcagaaacaaaagaagtggagccagagccaactgaggacaaggatttggaagctgatgaagaggacactaggaaaaaagatgcttctgatgatctagatgacttgaacttctttaatcaaaagaaaaagaagaaaaaaactaaaaagatatttgatattgatgaagctgaagaaggtgtaaaggatcttaagattgaaagtgatgttcaagaaccaactgaaccagaggatgaccttgacattatgcttggcaataaaaagaagaaaaagaagaatgttaagttcccagatgaggatgaaatactagagaaagatgaagctctagaagatgaagacaacaaaaaagatgatggtatctcattcagtaatcagacaggccctgcttgggcaggctcagaaagagactacacatacgaggagctgctgaatcgagtgttcaacatcatgagggaaaagaatccagatatggttgctggggagaaaaggaaatttgtcatgaaacctccacaagtcgtccgagtaggaaccaagaaaacttcttttgtcaactttacagatatctgtaaactattacatcgtcagcccaaacatctccttgcatttttgttggctgaattgggtacaagtggttctatagatggtaataaccaacttgtaatcaaaggaagattccaacagaaacagatagaaaatgtcttgagaagatatatcaaggaatatgtcacttgtcacacatgccgatcaccggacacaatcctgcagaaggacacacgactctatttcctacagtgcgaaacttgtcattctagatgttctgttgccagtatcaaaaccggcttccaggctgtcacgggcaagcgagcacagctccgtgccaaagctaactaatttgctaatcactgattttgcaaagcttgttgtggagatgtggctggacaggtttgccatcagagtggatataccgttgtattaaaaacaagataaaaaagctgccaagatttttggcgagtggttggtctgaagtccttgcaagacgctgatgctcaagctgttgacatactcattgcctactttaacacctgtcagagaaacgtgatatggggtaaggaggtgcttttttaaaatcgttcatagacttctgtaaaatgcaagataaattaaagttattataacagtgattctttcaatttggtttgtccttcagttttcttttctataaatgtgcttggtgaaatcagcaagaaaccaaccatataaaacagtgtgtgccgggctctgactgagaaactgaacaatggcaggcgcttcatctgggcagccatttttcttctctgcttctcttgagatacatagttaaagtagacacggcctcccacgcgagtgtggtgggaccttgagacttaggaggattgcctgttttcagtgtccagggaatgactccatagatttgaattcttttccgtatgtggggatggttgctactacctcaccgccaagtcctcccccagctgttaccacatgagggaatacaaggtgctaggtaccctccttcctcgttggccactaagaggtcttagaaacatagcctgtaaatgtgtcttgtaactggcacactaaaaaagatcctagttgagcatctctcttggtgaggaagcgatgtgtgtgcggttcaggaaactcctccaagaggaggaggagtccaaacagggatgccagaggaagctttccgttttcctagccaacttgtgttctgggtttgaaaaagacccaccacaaatgctttttctattttctgatttaaaagtcgcttttgaatatgaccatgagaaaccaagaaatgctgcttgtgtggtgctctgcttcctgaggatttggctggaaggggattctccgctggcacatgggagaaggccatcttctgtgtcggtgctgtgatctgccttgttctcacttgctgaggataagggcatacacgctgctcctcgctttcttgttgcccgacttcgtactaagcagctcaggagcagtcactcagacccaaatgtcttgactgtgttgtttttaatcactgtgacccttaaagtacaggccaagtgttgtcaaacaccttggctaaaacagtggagggtgatgggtaaagcagtagagggccctcaacccacacactggctgaaactgccaccaactgccacgatgaacccaactgctgtttatgcccccattttcctttttttgtatctacacccacacgattcccaatgttggatatttctacatgaataaagcaaggatcagtgcctcttatgtaattaacgctcca

SEQ ID NO: 1944 - DNA, 7150 bp, Homo sapiens
gggccgcgcgtggcggcggcgatgggcgagggcgggctgcccccggccttccagctgctgctgcgcgcgtgtgaccagggcgacacggagacggcgcggcggctgctggagccgggggcggcggagccagccgagcgcggcgcggagccggaggcgggcgcggagccggcgggggccgaggtggccgggcccggggccgcagcggcgggggcagtcggggctccggtgcccgtggattgctcggacgaggcgggcaacaccgcactgcagttcgccgcggccgggggccacgaaccgctggtgcgcttcctgctgcgccgcggtgcctcggtcaacagccgcaaccactacggctggagcgcgctcatgcaggcggccagatttgggcatgtgagtgtggcacacctcctgttggatcacggggctgatgtcaatgcccagaaccggctgggggccagtgtgctcactgtggcttctcggggcggccacctgggtgtggtgaagctgctcctggaagccggtgcctttgtggaccatcaccacccttcaggcgagcaactggggttgggcggcagcagggatgagcccttggacatcacagccctgatggctgccatccagcacgggcacgaggccgtggtgcgtctactgatggagtggggcgcggaccccaaccacgcagcccggaccgtgggctggagcccgctgatgctggccgcactcactgggcggcttggagtggcccagcagctggtggagaagggcgccaaccctgaccacctcagcgtgctggagaagaccgccttcgaggttgcactggactgcaagcacagggaccttgtagactacctggacccgctgaccaccgtcaggcccaaaacagatgaggagaaaaggcgacctgatattttccatgcattgaaaatgggaaacttccagctggtcaaagagattgccgatgaagaccccagccacgtgaacttggtcaatggggacggggcgacgccactgatgctagcagctgttacggggcagctggctctggtgcagctgctggtggagaggcacgcggatgttgacaagcaggacagcgtgcatggctggacggccctcatgcaggcaacctaccatgggaataaggaaattgtgaaatatctgctaaaccaaggggccgatgtcactcttcgtgcaaaaaatggatacacggcctttgacctggtgatgctgctgaatgatcccgacacggaacttgttcgactgctggcatctgtctgcatgcaggtgaataaagacaaaggccggccgagccaccagcctcccctgccccactcgaaggtccgacagccctggagcatcccagtgctgcccgatgacaagggtggactgaagtcctggtggaaccgaatgtccaatcggttccgaaagctcaaactgatgcagacgctgccccgtgggctgtccagcaaccagcctttgcctttctctgacgagcctgagccagctctggactccacaatgagggctgccccccaggacaagacaagccgctctgcactccctgatgcggcccctgtgaccaaagacaatggtcctgggagcacaagaggagaaaaggaagacacgttattgacaaccatgcttcgaaacggagctcccctcaccagactcccgagtgacaagctgaaagcagtcatccccccattcctacccccttccagttttgagctgtggagctctgatcggtcccggacgcgtcacaacgggaaggcagaccccatgaagactgcgctgccccagagagccagcaggggccaccccgtgggcggcgggggcacagacactacacccgtcaggcctgttaaatttccaagcctccccagaagcccagcctcttctgccaattctggaaacttcaaccactcgcctcattcatcgggcggctccagtggggtaggtgtgagccggcacggtggggagctgcttaaccgctcaggtggcagcatagacaatgtcttgtcccaaatcgctgcccagaggaaaaaagcagccggattattggagcagaaacccagccatcggtcaagccctgtggggccagcaccggggtccagcccgtctgagcttccagcctcccctgcaggtggcagcgctcctgttggcaagcagaaattggagaccagcaaaaggcctccatctggaacttccactacctccaagagcacctctccaaccctcacgccctccccctcacccaaagggcacactgcagagtcctcagtgtcttcctcgtcatcccatcggcagtccaagagcagtgggggctccagcagtggcaccatcacagatgaggatgaactgactggaatccttaagaaattatcacttgagaaatatcagcccatttttgaggaacaagaggtggacatggaagcgttcctcacactgactgacggtgacttgaaggagctgggaattaagacagatgggtccaggcagcagattctggcagcgatttctgaactgaacgcaggcaagggacgcgagagacaaattttacaggaaaccattcacaactttcactcttcctttgagagcagtgccagcaacaccagggcccctggcaacagcccctgtgcgtgatcctccttcccgcagccaccagcgtgagctctctgaatcccgggaccccttcacgtggccacagccccagccctgcccccgtcacactgctgtgccttagtcatgttgttccctttgctcgggatgcccacttcacgtcgacggcattcattggtagtacttcttgctgcaacaaacttcaacacacagagacagattcccatgtaacagtccagtgggggtgcttctgcttggcaggttggttcacacagtgatgcagggactcagctcctttcatcctgtgctctgccctccccgggagcctcagagtttgcttctggctggcggcaagggaaagggacgatggagaaggcacggctgcttcttacctgccttgctcttaactgacacacatcactcctgctcacgtcctcttggccactggtagtcatgtggccccacctggatgcagaggaggccaggatgtgcagtctccacatagtggcttcccagcaacaacttttgacttagatggggggtatgtattatggtgagaggttagccttcctggcacatcttcccttaaaacttctaacttgcccctcctagtccaagtcacctctcagatgaagtcttttttgaccccctttcagccactgggtcccttagtgctgtgtatgtgactgctgtagcattccactgcacctgctgcatacagcttacattggagatgtgtatgtcaaacgcatttttctttattgcaaagagagtctattatagaaggaaagaagtggaggcctgctgtgtggatcccttcttcttcctagctttcagtttccttatctgcaaagtggaaggtcagaccagatgatgctctggtactccacagtgctcacctgtatcactgcagggctttctgcactgaaagtggaagcagaaggctaatgggtcacattgtgtaaaggtctctggtgctcaaagtttctaggcaaagaagtgaaaatttggaattttgtctacatcctattaatgctgtgttcctcaaaagggaattggcttgtgtagtttcctaccatatcatattttattaaattagaggggccctgacttttaaaacccactggctttctgaagtgttttccagtgaatgactcattcagccagtgcttgttgcatttatgttagctaccaggtgccaagtgtgcagacacaatacagagccttcaggctctcgacaggcaagagaacacctgtaaatagatggtcccgacattgagaggcagcatggtagagtgggcagaccttgtgctctggactcaggttcaaagttcagatgaagctcaatggcctcttagttggagcttagaaccagtatgcccaaagtgctgggtctgcaggaagtacccagtcgatggtaggctgcacagaattctgatctctaccttgagccatgctgagccacaagttggtctccttgggaggtgccatctctcatctgtccctcccccagccatgaaagcccattcccctatgctggctttcagaggctgtcgttaacttactgcccagagcctcgtagttttcttcccctgccctgatggttgggtgtttttcctttaaattctctcagccttacactcacagaagccaactttccacaggactgaagacaaagtgtttcatttagctgttactgatagacacctttacaaaggttactaatgtcccagcctttttaaggagacacactcattcatcccctactatgtgctggcagctttacctttgtcatttcatcctcatggccaccctggaggtggcattgtgtaacctcatcttgcacattcgggaaacggatgcttaggagagggaagcagcttgccagttaaacagcccagaaggagcagatctggggtcagaaccggacctggtgggcttgcaagcctgtgccttttccactaactcctatagactcctggagctagaagcacttgtgattcttgttttaatttactgatggcttcaggggttaacagtaggcctagaattgtttgcctctgaaattcatggcccctgacgttatgtgctttgaggttttgtgcctgctttttgctgtggtcctgtttttttcataacaatatactggtatagcttccactcaggtaagtttgattgaacaatgatacacagctgcaccggggggtcaccttttcacaaatgtagacctccatgaactcattggatgaccctggacagagcggggctattcccattttgcagacaggacagcagaggctccagacaatgcctttcctttctttttcactggactcaagtgtccaaggcttttcatcctaggaagtttgtgtgctggttcacaagaggtccctggcaccctttctggggatgtttggatgcggctggtaggcagggaagagaaagggcaccccagcgggggcatgtgtggaggcagcacggaacatgtaggttatagatcgtcagggaggaggggtcagttgggtgcttgtttttctgatttttggtccttgatcacccccttcccttcccacacgtgtccccagcctgcctgtggctgttccccccacaagaagcacctcccttgcttggcaaccttcaccagcatttcccaaaagtatgctcctgggaaccctagttccacaggataataggtttttcataaagaaacgtagggtgtgtatgtgaaagtggggtgaggttccctggttgagtaggtttggcagacactaaagcgagctacacgatcatctttgctacaggcctctcacaaccttcagcatgccagcatgggtcaggcctcttcacagggccaagaaactcatagcatctcccacattactctcatcacttctccaaggtgcttttgcaagactggaattccttggacaccattggagaagccccgctttttctggaacagcggcaaccaagaggccttgcagccctggaagtgggtcagggcccttggtggtcacctttttctccccagcagctctgcagaggtggcctgcttggcagtgggacatcaggggaccggtcctgctttgagatggcagggtccctgttctgagagctctccagcctgagggcattgagctgaggctccaccctgagctctcctgcagggtggagggcattgtttcccagcacccaggcagtgtcttgctggtgtgtcgtgagtgctggatgtccaagtccctgctggccacggagggctcctgcctctcttcttcagcgccacaaaattacatggaggccagctggttttgtgaggagattgtttattttttaattcttttgtttaccgaacgtttactgagcatctaccctgtgccagccctactcgtacgctctgtctccaaagatgaaaaaggacttctctgccctcaagggaaccccacagtatcttagaggagacaatcatgtcggtgagatggtgtggtgatgaagcctgctgggtatacagctcagggaaagtcatcgatgatggctcaggctcagcctgggcacgccccagaggagagagatggagtggggcctcaaagggcaggtttaggcagaaaagaaaaagggcattccagctggggcatgtgcaaaggcagcacgtaatgtgtaagttctagatcgtcagggaggaagggtcagttgggtgcctgtttttctgtttttagtcctttaaaatgagtagaagcaacctgttaccctggaaagagcactggacatagacctagtgctgcgtgatgttgagcacgtttcttcttccctttgagtcccagtttcccttttggttacagggggatagtagcccccagggatcatgtgaaagtgagaaagcccttttcacactgtggagcggtgcagatgtgggaaacctcaaagatggttgcccattttaaatcctttcatctctcatctctctttcttctctcccttctgccctgacgtagccatggttgggtgggtgaggccagaagaaactgcctccggcaagaggtagcagccgctcaggtggctctgctggcatcggagcccacagaagtgaggagtggccgatggacctgccctccaaatgtgcctgactctgggtcttgctgtcactggatttcctggcatggcagacagaaagaaagatagtttgaccaagtcgtagaagctgatccagcgggtaaaaagggggcagggaactcgtcccttttattcttgcctcagagctgcctgaagacatgggccaggccggaggctggacaactttggataacgctgacctgtacttccaagtaaatgcctcctgaagagcccgggacccttcctgggagaattctgcagccagaatgaaggtgccatcagcaggaggcactgtgaagcaccatcctgtcgctgtccttgtccattcctagcaagttaatcgtgtcttgttaaccagcagttcctgttcaacgtgtaaagagacctgatgttttccctaataaagctgataacagattttgcagga

SEQ ID NO: 1945 - DNA, 1476 bp, Homo sapiens
gaaagagcagaagaggaggtggggtggagggagcagagccagggattaggggactactgaggctctggagatgagaccgccaggagtccttccccaccatgagccccctccactcctgcagctggaggagtttttcccagtctcagtgctgccctggggcgagagagactgaacaagctgtttgggtgggaagagaatggaggaagttgacagggatgggcggggcccgtgggggggctgaccaggaacccagcttcctgctcagtacccaggcatccagcccccagctcacccccaccccttccagcccccactcccctcaggaacccaaggttccagccctcctcccaaatcccagccacccctcccccaccagtttctcccctctaggggatggaggctgagagaccccaggaagaagaggatggtgagcagggcccccctcaggatgaggaaggctggccccctccaaactccaccactcggccttggcgatctgctcctccatcccctcctcctccagggacccgccacacagccctgggaccccgctcggcctccctgctctccctgcagactgaactccttctggacctggtggctgaagcccagtcccgccgcctggaggagcagagggccaccttctacaccccccaaaacccctcaagcctagcccctgccccactccgtcctctcgaggacagagaacagctttacagcactatcctcagtcaccagtgccagcggatggaagcccagcggtcagagcctcccctccctccaggggggcaagagctcctggagttgctgctgagagttcagggtgggggtcgaatggaggagcaaaggtcccggccccccacacacacctgctgagacttgagccccaaccagcccttccttgccactggtctcaaagctgggcagcccattgcatgccctcaactcttgcttggcaggggtaccagagactgaaagacacggcacaaatctcaatattcatctcccacatcaccttccctgggaactggacagggtgaaagtcctcaaactctgggaacaggcgagatggaacagggatttaactccccgcccacaggtccatgggagcttgaggcagtaagggggatcccaggcacccatctcaaggagtggctgggagtcttttccctaacttgtggggacaccaccagttgtcaagctactaggcagtagggtctgagggctcaggcctccacctgagaggttataacctgagagacagctctacccttcctcccagtaagaagggaaggtgggtgggcacctgagagattaagactattctcccagtcccactaccagcacccccgatccctgagactgaggggtttacgggctgtgaatggaccttcagccctgcccaccctccctccccactgctgctgagtctgtctgatgttttggttgtgtgaataaatataattcccctctgga

SEQ ID NO: 1946 - DNA, 1456 bp, Homo sapiens
ccggagcggggatcacctcaacttgactgtggtcccccagccctccaagaaatgcccataaaccaaggaggagagggtaaaaaatagaagaatacatggaattggggagaagaatgggaaaaaagatgggagtgactgcataatgtcagcattttgtgcttttggctcagcatttggattggatggaggattttcatcctgaaaccagccctccgtcgccaccgaccatggaataattgtcttccacgaaactcttccctggtgccaaaaagggttttatgtatatatttgagagctccacatccctggatctgaatcctccacttcccactggaaccatgcccctcccagtcccgtttctcccctctaggggatggaggctgagagaccccaggaagaagaggatggtgagcagggcccccctcaggatgaggaaggctggccccctccaaactccaccactcggccttggcgatctgctcctccatcccctcctcctccagggacccgccacacagccctgggaccccgctcggcctccctgctctccctgcagactgaactccttctggacctggtggctgaagcccagtcccgccgcctggaggagcagagggccaccttctacaccccccaaaacccctcaagcctagcccctgccccactccgtcctctcgaggacagagaacagctttacagcactatcctcagtcaccagtgccagcggatggaagcccagcggtcagagcctcccctccctccaggggggcaagagctcctggagttgctgctgagagttcagggtgggggtcgaatggaggagcaaaggtcccggccccccacacacacctgctgagacttgagccccaaccagcccttccttgccactggtctcaaagctgggcagcccattgcatgccctcaactcttgcttggcaggggtaccagagactgaaagacacggcacaaatctcaatattcatctcccacatcaccttccctgggaactggacagggtgaaagtcctcaaactctgggaacaggcgagatggaacagggatttaactccccgcccacaggtccatgggagcttgaggcagtaagggggatcccaggcacccatctcaaggagtggctgggagtcttttccctaacttgtggggacaccaccagttgtcaagctactaggcagtagggtctgagggctcaggcctccacctgagaggttataacctgagagacagctctacccttcctcccagtaagaagggaaggtgggtgggcacctgagagattaagactattctcccagtcccactaccagcacccccgatccctgagactgaggggtttacgggctgtgaatggaccttcagccctgcccaccctccctccccactgctgctgagtctgtctgatgttttggttgtgtgaataaatataattcccctctgga

SEQ ID NO: 1947 - DNA, 3572 bp, Homo sapiens
ctatccgctggtggaggtgagggcgcccggcaggccgccctgcaggcggcagggcatgaggccgccccgagagtccccagggggctgcgctgccccccagccaggaggaaaggccctcgaggggcgcaggcggacgggaacagggcgtcactgagggctacaatggcaccatctttgcctacggccagacaggcagcgggaagtccttcaccatgcagggcctgccggatccgccctcccagagaggcatcatccccagggccttcgagcacgtgttcgagagcgtccagtgtgcagagaacactaagttcctggtccgggcctcctacctggagatctacaatgaagatgtccgggacctccttggggctgacaccaagcagaagctggagctgaaggagcacccagagaagggcgtgtacgtgaaggggctgtccatgcacacggtgcacagcgtggcccagtgtgagcacatcatggagactggctggaagaaccgttcggtcggctacacgctgatgaacaaggattcctcacgctcgcactccatcttcaccatcagcatcgagatgtctgccgtggatgagcggggcaaggaccacctccgggcgggcaagctgaacctggtggacctggcgggcagcgagcggcagtccaagaccggggccacgggcgagcggctcaaggaggccaccaagatcaacctgtcgctctcggcactgggcaatgtcatctcggcgctggtggacgggcgctgtaagcacgtcccctaccgtgactcgaagctgacgcggctgctgcaggactcactgggcggcaacaccaagacgctcatggtggcctgcctgtcgcctgcggacaacaactacgatgagacactcagcacgctgcgctacgccaaccgggccaagaacatcaggaacaagccgcgcatcaatgaggaccccaaggatgcgctgcttcgcgagtaccaggaggagatcaagaagctcaaggccatcctgacacagcagatgagccccagcagcctgtcagccctgctgtccaggcaggtgcccccagaccctgtgcaggtggaggagaagctgttgccccaacctgtgatccagcatgacgtggaggccgagaagcagctgatccgggaggagtatgaagagcgcctggcccggctgaaagccgactataaggccgagcaggagtctcgggccaggctggaggaagacatcactgccatgcgcaactcatatgacgtcaggctgtccacgctggaggagaacctgcggaaggagacagaggctgtcctgcaggtgggagtcctctacaaggctgaggtcatgtccagggctgagtttgccagcagcgctgagtacccgcctgcttttcagtatgagacagtggtgaaacccaaggtcttctccacgactgacactctgcccagtgacgatgtctccaagactcaggtttcctccaggtttgcggagctgcccaaggtggaaccctccaaatctgagatttctctgggctccagtgagtcatcctcgctcgaagaaacctctgtgtccgaggctttccctgggcctgaggagccctccaacgtggaggtctccatgcccactgaggagtccaggagcagatacttcctggatgagtgcctcgggcaggaggccgctgggcacctgctgggggaacagaactacctcccgcaagaggagccgcaggaggtgcccctgcaggggttactaggcctgcaggacccgtttgccgaggtggaagccaagctggccagactctcctccaccgtggccaggacagatgcaccccaggcagacgtccccaaggtccctgtgcaggtccctgcgccgacagacctgctggagcccagtgatgccaggcccgaagccgaggcggctgatgacttcccgcccaggcctgaggtagatctggcctcggaagtggccttagaggtggtgcggacagcagagcctggcgtgtggttggaggctcaggccccggtggccctggtggctcagcctgagcccctgccggccacagctggtgtgaagagggagagcgtgggcatggaggtggcagtgctgactgatgacccgctgcccgttgtggaccagcagcaggtgctggcccgtctgcagctgttggagcagcaggttgtgggtggagagcaggccaagaacaaggacctgaaggagaagcacaagcggcgcaagcgctacgcagacgagcgcaggaagcagctggtggctgccctgcagaactcggatgaggacagcggggactgggtgctgcttaacgtctacgactccatccaggaggaagtgcgggccaagagcaagctgctggagaagatgcagaggaagcttcgggcagcagaggtggagatcaaagatctgcagtccgagtttcagctggagaagatcgattacttggccaccatccgccggcaggagcgtgactccatgctcttgcagcagctcctggagcaggtgcagcccctgattcgcagggactgtaactacagcaacctggagaagattctgcgtgagtcctgctgggacgaagataacggcttctggaagatcccacatcccgtcatcacaaaaaccagcctcccagtagcagtttcaactgggccacagaacaaaccagcccgcaaaacctctgcagcagacaatggcgagccgaacatggaggacgaccgctacaggctcatgctcagtcggagcaacagtgaaaacattgccagcaactacttccgatctaagcgggccagccagatcctcagcacagacgccaggaagagcctcacacatcacaactcgccaccaggcctcagctgcccactcagcaacaactctgccatcccacccacccaggcccctgaaatgccccagccccggcccttccgcctcgagtccctcgacatccctttcaccaaggccaagcgtaagaaaagcaaaagcaactttggcagtgagcctctgtgagcacagctgcttgccattgcctgccttataggcatgtagagactgccaggccctcccagggcagccccaaccaggtctcctcccacctgccacacagcgctccggggcctgagggctccctcagccctgggaagacacattcccttccctgttccccagagagcccacctccgccctgggcaggagcccctcggaggctgtatagtcctccttagagaggcctgctccagctgttcataccacatcagtgtttccgtctgctcacctgccacagagcccacacccatgcccaccagtgttggtctttgcctcaaagcctgagacctgcttcacggccttcaccagccctgatggagagggcagcagctgccacgtggaggaagctcaatatcagctgggaaggaactgtgcctctgtctgactggccccacttcctaagcactgccctgccccatggggtggcacaggggtcccacagcaggtcttcctgcactgcccacccctggctggtctgtggcccaaggaaggccactccacattaagctgcccaataaactgcttttaagataa

SEQ ID NO: 1948 - DNA, 730 bp, Homo sapiens
agattgtttgtttgggaaattttgcactctacaattcgtaagatgaacaaacatgtcctgaagatccagaaagagctggaagaagctaaagagaaacttgctaggcaacacaaacggcgaagtgatgatgacgacagaagcagtgacaggaaagacggggttcttgaggaacaaatagaacgacttcaggaaaaagtggaatctgctcagagtgaacaaaagaatcttttcctcgttatatttcagcggtttatcatgatcttgaccgagcacctagtacgatgcgaaactgatgggaccagtgtattaacaccatggtataagaactgtatagagaggctgcagcagatcttcctacaggtatgtggggaacttcgattaggtaataacactattctcagccacaaagatttttcattaaaaaaaatccttgtcaaatttgttaggaggttatatagtacctgttagaccctttagttcatgtccatttgctgctaccattgctcatcagaatatttaggcttaaactgattctgtaccacttagattcctaattgccacccccccaacaaccccccgccccaccttttttttgagatggcatctcactctgttgcccaggctggagttcagtgacacgatctcagctcactgcaacctccacctcctaggtttaagcaattcttctgcctcagcctcccatattgctgggattacaggcacccgtcac

SEQ ID NO: 1949 - DNA, 5178 bp, Homo sapiens
ggcggaggcagcccgagggggcggttgcatgtgtgccagacgttcgtagcccactgagcttcctcacgccggctgtcgcagcgcctagccccacccggcggcctctcctgcgcttccggggccgtggcgagctagtgcgcctgcgtgccggcccatccgcgcgccttgcagctgtccttgcgtcggccagcggccagacagttcctgcagcgcttaccgcctggcctctcggttccgcggcgcaccggagggcagcatgtcgcggcggcggcacagcgacgagaacgacggtgggcagcctcacaaaaggagaaagacctctgatgcaaatgaaactgaagatcatttggaatctttaatatgtaaagtaggagaaaagagtgcctgctctttggagagcaacctagaaggcttggctggtgttttggaagctgatcttcctaactacaagagcaagatcttaaggcttctttgtacagttgcacgcctattacctgagaagctgacaatttatacaacattagttggactactgaatgccaggaattacaattttggtggagaatttgtagaagccatgattcgtcaacttaaagaatcattgaaagcaaacaattataatgaagccgtgtatttggtccgttttttatctgatcttgtgaattgtcatgtgattgccgccccatcaatggttgctatgtttgaaaattttgtaagcgtaactcaggaagaagatgtacctcaggtgcgacgagattggtatgtgtatgcatttctgtcatctttgccctgggttggaaaggagttgtacgaaaagaaagatgcagagatggaccgcatctttgccaacactgaaagctatcttaaaagacgccaaaagactcatgtacccatgttacaggtatggactgctgataaaccacatccacaagaagagtatttagattgcctgtgggcccagattcagaaattgaaaaaggatcgctggcaggaacggcacatcctaagaccttatcttgcctttgacagcatcctgtgtgaagcactgcagcacaatctgcctccttttacaccacctcctcacactgaagattcagtgtacccaatgccaagggtcatcttcagaatgtttgattacacagatgatcccgagggtcctgtcatgccagggagtcattcagtggaaagatttgtaatagaagagaatcttcactgcatcattaagtcccactggaaggaaaggaagacttgtgctgcacagttagtgagctatccagggaagaacaagatccccttgaactaccacatagttgaggtgatctttgcagagctgtttcaacttccagcaccccctcacattgatgtgatgtacacaacactcctcattgaactgtgcaaacttcaacctggctctctaccccaagttcttgcacaggcaactgaaatgctatacatgcgtttggacacaatgaacactacctgtgtagacaggtttattaattggttttctcatcatctaagtaacttccagttccgttggagctgggaagattggtcagattgtcttagtcaagatcctgaaagtcccaaaccgaagtttgtaagagaagttctagaaaaatgtatgaggttgtcttaccatcagcgtatattagatattgttcctcctaccttctcagctctgtgtcctgcaaacccaacctgcatttacaagtatggagatgaaagtagcaattctcttcctggacattctgttgccctctgtttagctgttgcctttaaaagtaaggcaaccaatgatgaaatcttcagcattctgaaagatgtaccaaatcctaaccaggatgatgacgacgatgaaggattcagttttaacccattgaaaatagaagtctttgtacagactctgctacacttggcagccaaatcattcagccactccttcagtgctcttgcaaagtttcatgaagtcttcaaaaccctagctgaaagtgatgaaggaaagttacatgtgctaagagttatgtttgaggtctggaggaaccatccacagatgattgctgtactagtggataagatgattcgtacacaaatagttgattgtgctgccgtagcaaattggatcttctcttcagaactatctcgtgactttaccagattgtttgtttgggaaattttgcactctacaattcgtaagatgaacaaacatgtcctgaagatccagaaagagctggaagaagctaaagagaaacttgctaggcaacacaaacggcgaagtgatgatgacgacagaagcagtgacaggaaagacggggttcttgaggaacaaatagaacgacttcaggaaaaagtggaatctgctcagagtgaacaaaagaatcttttcctcgttatatttcagcggtttatcatgatcttgaccgagcacctagtacgatgcgaaactgatgggaccagtgtattaacaccatggtataagaactgtatagagaggctgcagcagatcttcctacagcatcaccaaataatccagcagtacatggtgaccctggagaaccttctcttcactgctgaattagaccctcatatcttggccgtgttccagcagttctgtgccctgcaggcctaagggtcattttttcctcatgtcaaggttttttttgatatcttaaaataatttgtcttattttttgatggtttgaatgcttgctttcttgtagtatcctttcacttcttaaaggaaacaaaggggaagaggacagtgaatgaacatggcattacttttaattgccctgaaaagcaaatacttcctaacggcagtaatgtgactatgaccatgatatattatatatgtgacagatacaaattctctgtgatcagtttgttattttttttctccttaaggcacaaaataattggtttgaggtatgtgaaacactagaggtcaaccttacatagtatatagaactgatgggtttacccagctacccagtagcataacttttcacagctcggggatgaattaacatggctgaaataaaactaaaagtatggtttttaaactttggcatttcatgatttatcatctcactctactctaaaactggtggtttcttactgaaggtgttctccatttgaaattttatcttcaaagtatttttaagtagtatctttaagacatgacttgttagtaataaaagtgttactagttggaagagtagctctcaaatttgtcttaatgtaaatcacctgggaatctttcaagttattttgaaatttaaaccaccgtctgggggtggaacgcagacatcctcagtaatccttaaagtttccccaggtgattccaggtttggtcaccattatcttagagcatctactcacttcctctagccttggggttatttgtccaaggtcttgtagtgagttacagaatactaaagtggatgtagaagtggtcagattgactgaaactataccctgaattagatgtgagtttagattttgtttatatggaacctgatccaaaaaactacgaagtcctgagcttgtttcctgtatagtactgatgctgaaataagatgacagcagtttgtaaaataatacacaaatatgaggaattgtctgacattccaaatttcgaggatttttagacttttttcattaaaccttagaaaaaaattaccagtaatcctacaactactggtagtgttgttgtgcatttgcacaaaataggtataattttttcttattacatcccaagtttatgatgcattaagcgttttgcatattttgatatatttttgctttggtttaccatacattttagtggctacagaatgtagtctgcttaataaatgggaattcctagaatgtttaaataccatactatttaagacaaaatacaaaatatccagaaaaatccaggttgcgtggctggttagtaaaggactaaaacccaggttcttggctaaatgttttcgtttatactgtttatctttcccattgcttaagcacagcacaaactatgtaattatatataattacagttgacccttgaacaacatgggtttgaactgtgtgagtctccttacacacaggttttcttccacccctgagatggcaagaccagccccttgtcttcctcagcctgctcaacgtgaagatgatgaggatgaagacctttatgatgatccacttctacttattaaatagtaaatatatttttttcttatgattttattttcttttctctagcttcataagaatatagcatatgggctgggcgcagtggctcacgcctgtaatcccagcactttgggaggctgaggcgggcggatcacaaggtcaggagattgagaccatcctggctaacacagtgaaaccctgtctctactaaaaacacaaaaacttagccaggcgtggtggtacatggctgtagtcccagctacttgggaggctgagacaggagaatcgcttgaacctgggaggtggaggtttcagtgagccaagattgtgccactgcactccagcctgggtgatggagcgaggctctgtctcaaaaaagaaaaaaaatatatagcatataacatacaaaatgagtttatcaactgtttgttattggtaagtcagcagtgggctattggtggttaagttttgggggagtcaaaagttacatgcaaattttttactgtgcggggtgtcagcatccctaaccccatgttgttcaagggtcaactgtagtttaaaatgactcctgtctcaaaaaaccaaaggataacctttaagggattggtaactttgactcaaaactgctttgtaatcttttcacaatgtactgaaaagtgtggctagttatgtttgatccacattctagagaaatttgtaggttttaatttcttttctcttggtcctctcttcatgtataatggttgcttttaacagctgttcgctgatgtggtcctgctctgtcccagtctagcagctttagtgtatggaaaaattgaactaggaattgagttttgaagaaataaaggtgtaagagcaaacattcaacagttgctgtccccagtaatgaagttcatacagacaaaagatggcatgtcactgtacatcataccttgcaataaatattctgttaaattgtgctggtgcaatttaacatgcttttgtcaaagtaaa

SEQ ID NO: 1950 - DNA, 2516 bp, Homo sapiens
gtgccaggtcagagctgcaactctgtgctacgtttctgtgtggctttcttgaaactacttctctttatttttgttggcgtggctatttattgttatctgtaacgacgcaatatgctgccgaagtctgggaaggagaggggagctgtaagtctacaccagtgttaactggctaaccttggatgcctgtcatttgatgttggacatttgaaagatggcagcatctctggggaaggagggactgaacacttttgaccacctaccatgtcccaggttctatcgatcctgggcatgcacacgctcatgagtaaccagcagtactaccaggccctgagcagcagctccatcatgaacaaggaggggctcaacagcgtgattaaacccacacaatacaagcctgtgcccgacgaagaaccaaattcaacagacgtagaggaaacgctggaacggataaagaacaacgacccaaaacttgaagaagttaacctcaataatatccggaatatccccatccccaccctcaaggcatatgcagaagccctgaaagaaaactcatatgtgaagaagttcagcatcgtggggacacggagtaatgaccccgtggcgtatgcccttgctgagatgctcaaggagaacaaggtgttgaagacactgaatgtggaatccaacttcatttctggagctgggattctgcgcctggtagaagccctcccatacaacacttctctggtggaaatgaaaattgacaaccagagccagcccctgggcaacaaagtggaaatggagattgtgagcatgttggaaaaaaacgcaacacttctcaaattcggctaccactttacccagcaaggaccccggcttcgggcatccaacgcaatgatgaacaacaatgaccttgtgaggaagaggaggcttgcggacctgactgggcccatcattcccaagtgccggagtggtgtctagtgtgtggcggtggagtccatgcctttgaactggatgtgttctattgatgacctgtgctctgcaggggaaaccagaaggcaaaatgctggcagcatgaaacccttttgtggttcagttctttatgcactaaggttttaggttgactagtggttgtagttgaaaattttataaaataccgttaatgtgaagtttttctttagtcacagaagttgaatctggttattatttaaaaactagaagcccccaaaccagcagatcttactgaagatgatgttccagcagcagcgacttagccccaggagcccagtttcaatggccttgctgtgtggtgtttcaagtgcatttaaaatgtgtgacacagaaacggcacactcttccacatgcttttgaagtattataaaacactttattacaaatttgtcttagctattagcaaataaaactgattatcattctttattaaccctccttggaattttgaaaacctcgattaaagttgccaaattgattactggatccagaacacaattttcccctcagaacagatagacagactgaagccactgaactctgccaggagtcaacatgagattccttttgctggatatgcagaaatgataggaaaaaaaccaatggtgaaatttcaagtttcaaaaaccaacctttcattaccaatcccaggcaacaaacatgtccctgagtgttctttaagaacatttgggatttatgtacaatttaatactggagttagaactttttccttattgaatgccaaccttatgatggatgtgaaaatctacggccaaatacttttgaaaacacctttctatattgcacagtgggcaaatggcttatgtgaggtaagacactagagggataaatttccagatcaacatggctatggtatttagtaatggcccagcttagagacttcagctactgatctcatcacttattagacaaattgctgctgaccttacgcctgtatattaagcctccgcaggatgccggacaatggtgaagaaactccagatatcaaggaattgggaaatcctggccaaaccaccccaagatgattacactgaaatgtagtattagtactgctgccagatctctttttaacatcatgtgcgtctcttgggatccagcaaaagtgttaagccacaatgcccttgtgccttttaatataccacagtgccagttaaactaatatttttgtttgttgcttttgggagttattttcattagtgatttcagcaaatctcatgataaaggacaaggtcaagaactccagagcactgagcagagaggctggtgatgaaaaggtgaaggcctgcgcactgaactgtaaggcagtgggcagtacagggtaactggaggcggggccagggcctcagcgctatggaagagtgtccactgaggctgcacatggcccaggagtggcaccatgttgcagggacaaccatccccatttggcttctccttaaaacacaattgcagctgcattctgcatcgctgaaaactgcaatataatattaaatctgttggtctatgca

SEQ ID NO: 1951 - DNA, 3741 bp, Homo sapiens
cctccgcgcccccggctgctgctcacgccccgcccgggagccagattttgtggaagtataatactttgtcattatgagatgtcgtctctcggtgcctcctttgtgcaaattaaatttgatgacttgcagttttttgaaaactgcggtggaggaagttttgggagtgtttatcgagccaaatggatatcacaggacaaggaggtggctgtaaagaagctcctcaaaatagagaaagaggcagaaatactcagtgtcctcagtcacagaaacatcatccagttttatggagtaattcttgaacctcccaactatggcattgtcacagaatatgcttctctgggatcactctatgattacattaacagtaacagaagtgaggagatggatatggatcacattatgacctgggccactgatgtagccaaaggaatgcattatttacatatggaggctcctgtcaaggtgattcacagagacctcaagtcaagaaacgttgttatagctgctgatggagtattgaagatctgtgactttggtgcctctcggttccataaccatacaacacacatgtccttggttggaactttcccatggatggctccagaagttatccagagtctccctgtgtcagaaacttgtgacacatattcctatggtgtggttctctgggagatgctaacaagggaggtcccctttaaaggtttggaaggattacaagtagcttggcttgtagtggaaaaaaacgagagattaaccattccaagcagttgccccagaagttttgctgaactgttacatcagtgttgggaagctgatgccaagaaacggccatcattcaagcaaatcatttcaatcctggagtccatgtcaaatgacacgagccttcctgacaagtgtaactcattcctacacaacaaggcggagtggaggtgcgaaattgaggcaactcttgagaggctaaagaaactagagcgtgatctcagctttaaggagcaggagcttaaagaacgagaaagacgtttaaagatgtgggagcaaaagctgacagagcagtccaacaccccgctgctgccttcctttgagattggtgcatggacggaagacgatgtgtattgttgggttcagcagctcgtcagaaaaggtgactcttcagcagagatgagtgtatatgcaagcttgtttaaagaaaacaacattacagggaagcggctgctgctgctggaggaagaagacctgaaagacatgggcattgtctccaaggggcatatcattcacttcaagtcagccattgagaaattaacccatgattacataaatttgtttcacttcccaccactaattaaggactcaggaggtgaacctgaagaaaatgaggaaaaaatagtgaacctggaactggtttttggttttcacttgaaaccaggaactggcccacaggattgtaagtggaaaatgtatatggagatggatggggatgaaattgcaataacctacataaaagatgtgacattcaacactaacctacctgatgcggagattttaaagatgacaaagccaccatttgtaatggagaagtggattgtaggaatagcaaaaagtcagactgtggagtgcactgtcacatatgagagtgatgttagaactccaaaaagcactaaacatgtccattcgattcagtggagtagaacaaaacctcaggatgaagtgaaagcagtccaacttgccattcagacattattcaccaattcagatggcaaccctggaagcaggtccgactcaagtgctgattgccagtggttagatactctgaggatgcggcagattgcatccaacacttctttacagcgttcccagagcaatcctattctggggtcaccgttcttctcacactttgatggccaggattcctacgctgctgctgtgagacggccccaggtgcccattaagtatcaacagattacacctgtgaaccagtccagaagctcgtctcctactcagtatggactgaccaaaaacttctcttccctacatctcaactctagggacagtggcttttccagtggcaatactgacacctcttcagagaggggtcgatactcagacagaagcaggaacaaatatggacgtggtagtatatcactcaattcttctcctagaggaagatacagtggaaagagtcagcattccactccttcaagaggaagataccctggaaagttctacagggtttctcagtcagcactcaatcctcaccagtcgcctgacttcaagagaagccccagggacctccaccaacccaacaccataccagggatgcctttgcaccctgagactgactcaagagccagtgaagaggacagcaaagtcagcgaagggggctggacaaaagtggaataccggaaaaagccccacaggccatctcccgccaaaaccaataaagagagagccagaggggaccaccgtggatggagaaacttttgatgaattgaactacatagcttttctaagcaggttaaaaaaaaaaaaaaaaagaaatgtaatggtttttgataatatgatcccttcagattgaattaacgaaaagacaacacttccagtttttggattgggaaataccttctaattgagactatagccaaaccagggccaaaattatggatattggtcacccagtgatcataactaggcttgaaaatcactacacatattttctgccttgagtgaacatttttagaggaaaggttatgccatctttttaccctaaccactgatattctggttagcagggccaggacaaggggaaggaaaatgaggtcaacaaaaaaatcaaatttttaggaaaagataagatgaatgttactgatttttccttttggctgaggctgcaatatggcctggcaaggcactgttactgatcttgtctttaacattttgatattttgttcatcataatttttgcatttatttttttaaatattgcattaaaatatcatttagcttgattatcgagttttttggtttgaggttttttgttgcttcttttttcttttctttctttccccctcttttttttggatgtccccttaaattttgtgcccaaggcaggtacctcactcatctcatccttggctcagccctgctggttagtatttagtatttattttagtaagatatttgtgtctgtatgatggtcagagttgaactgatctggcttgtcatttttcagtaataaaaaaagttactgaatttaatgttgaatatgatgcatatctcattcattacgatttatcagaaaccaaagatttaaattgcctagatttgtggttctttctcttcctaagttcccagcgactgctttcaaatactattttctaaatttcaccaaaggagcaaagaggataaaacaacactccataaaggcctcttgggatgtcagaaatctaaaatctaaaagaaaacagacacagagcaagacaataacatcacaagctaaaagccagagaaatttaaaattaccaacatccttgttggagtaagacagtaaatatcagccttgcagcaagacagctctgagcagctgtgggcaaagaggtaaaccagtgggggtgcaaggagactgtctgcagcttagggcagaaatggtgggatccaacttgtgaaatgcttcatgttttacaaaccaaaaagtcaggtagcaacaaacttattgtatgtcaaatcaataaatgttactttcaatat

SEQ ID NO: 1952 - DNA, 1406 bp, Homo sapiens
ggaggtgagcaggaaggagacggccgcccagcagcccgtgggcaggcgcggcggagcgagcggggccggcggcgggcgccgagggacgccgaggcctcgggcgggggctggcccggggttccaggtctccagtgggggctgcagactaagcaaaatgaggcggttcctgaggccagggcatgaccctgtgcgggagaggctcaagcgggacctgttccagtttaacaagacggtggagcatggcttcccgcaccagcccagcgccctcggctacagcccgtccctgcgcatcctggccatcggcacccgttctggagccatcaagctctacggagccccaggcgtggagttcatggggctgcaccaggagaacaacgctgtgacgcagatccacctcctgcccggccagtgccagctggtcaccctgctggatgacaacagcctgcacctttggagcctgaaggtcaagggcggggcatcggagctgcaggaggatgagagcttcacactgcgtggacccccaggggctgcccccagtgccacacagatcaccgtggtcctgccacattcctcctgcgagctgctctacctgggcaccgagagtggcaacgtgtttgtggtgcagctgccagcttttcgtgcgctggaggaccggaccatcagctcggacgcggtgctgcagcggttgccagaggaggcccgccaccggcgtgtgttcgagatggtggaggcactgcaggagcaccctcgagaccccaaccagatcctgatcggctacagccgaggcctcgttgtcatctgggacctacagggcagccgcgtgctctaccacttcctcagcagccagcaactggagaacatctggtggcagcgggacggccgcctgctcgtcagctgtcactctgacggcagctactgccagtggcccgtgtccagcgaagcccagcaaccagagcccctccgcagcctcgtgccttacggtccctttccttgcaaagcgattaccagaatcctctggctgaccactaggcaggggttgcccttcaccatcttccagggtggcatgccacgggccagctacggggaccgccactgcatctcagtgatccacgatggccagcagacggccttcgacttcacctcccgtgtcatcggcttcactgtcctcacagaggcagaccctgcagccagtaggagagcttcgggagtgggtgcccagggttaggtgtgggaggcatggggcaggaccatcagtaaagacagggccaggtgcagtggctcctgcctgtaaccccagtgctgtgggaggccaaggtggtaggatcgcttgaacccaggagttcaagtccagcctggacaacgtagggagacccttgtctctacaaaaaataaaaaaattagccagg

SEQ ID NO: 1953 - DNA, 2526 bp, Homo sapiens
atgggagccagagctgctggaacatcctcaggaggtggccctcgcccctgcttggcaagaggcctctcagcaagcccatttccagccaagcagcagcaccctcaggcaggggctagtccagcagagctccagcagagggcttactacagagccaggcaagatgcagcatctcaaccaggccttgggttcctcattagccccagttcatgttcctcttgggggcctggctcctttacgaggtcttgtggataccccaccctctgctcttcgtggatctcaaagcgtgagcctggggagctcagtggagtctggacgtcagcttggagaactcatgctgccttcacagggtctcaagacctctgcttatacaaagggttgggctccatatatgaggacaagactgctctcagcctcttgggtttaggagaagaaaccaatgaggaggatgaggaggaaagtgacaaccagagtgtccacagctcaagtgagcctcttaggaacctacacctggacattggggcactggggggtgactttgagtatgaggagtctctgagaacaagccagccagaggagaagaaggatgtttctctggattcagatgctgccggtccccctactccctgcaagccctccagcccaggtgcagacagcagtctgagcagtgctgttggcaaagggcgacagggaagtggagcaagacctggtcttccagaaaaagaggaaaatgagaagagtgaacctaagatttgcaggaatctggtgacccccaaggcagaccctacaggcagtgagcctgccaaagcctctgaaaaggaagcaccagaggacacagtagatgcaggagaggagggttccaggagggaagaggcagccaaggagccaaagaagaaggcttctgctctggaagagggcagttcagacgccagccaagaactggaaattagtgaacacatgaaggaaccacagctctcagactccatagcttctgaccccaagtccttccatggcctggacttcggttttcgcagccggatctcggagcacctgctggatgttgatgtgctttccccagtcctgggtggagcttgtcggcaggcccagcaaccactgggaatagaagacaaggatgacagccagtccagccaagatgagctgcagagcaagcagtccaaaggcctggaggagaggtaccataggttatctcctccacttccacacgaggagcgggcccagagtccccctcgcagcctggccactgaagaagagcctccccagggccccgaggggcagcccgagtggaaggaggcagaggagcttggggaggactctgcagccagcctcagcctgcagctgtccctccagaggcgatccacagagcctgtggctcccccagagcagctctcagaggctgcactaaaggccatggaagaggcagtggcccaagtactcgagcaagaccagaggcacctgctggaatccaagcaagagaagatgcagcaactgcgggagaagctgtgccaagaggaggaagaggagatcctccggcttcaccagcagaaagagcaatctctcagttccttgagggagcggctgcagaaagccattgaggaggaggaggcccggatgagagaggaggaaagccagaggctatcctggctccgagctcaggtccagtccagcacacaagcagatgaggaccaaatcagggctgagcaagaggcttccctgcagaaactgagagaagagttggagtctcaacagaaggctgagagggccagcttggaacagaaaaataggcaaatgctggagcagctcaaggaagagatagaggcttcggagaagagcgagcaggctgccctgaatgctgcaaaggagaaggctctgcagcagctgagggagcagctggaaggggagaggaaagaagctgtggcaacgctggagaaggagcacagtgctgagctggagcggctctgctcctcattggaggccaagcaccgggaggtggtctccagcctccagaagaagatacaggaagctcaacagaaagaggaggcccagctgcagaagtgccttgggcaagtggagcacagagttcaccagaagtcttatcacgtggctgggtatgagcacgagctcagcagtctcctgcgagagaagcgccaggaagtggaaggggagcatgagaggaggttggacaagatgaaggaggagcaccagcaagtgatggctaaggccagagagcagtatgaagctgaggagaggaagcagcgggctgagcttctggggcacctgaccggagagctggagcgcctgcagagggcccatgaacgagaactggagactgtgaggcaggagcaacacaagcgtcttgaggacttgcggcgccggcacagggagcaggaaaggaagctccaggatttagagttggaccttgaaaccagagctaaagatgtcaaggccagattggctctgctggaggtccaggtgagggatctgcaggagtccttgacctcagagtcatag

SEQ ID NO: 1954 - DNA, 3646 bp, Homo sapiens
gcgtcctgctttcctgtcaccgcaagggccgggccgcccgctgcttcccacccctgcagcctgcgctgcggagtacaaagagcggagggcgcgcttgacctggggctggggtccagccctgcccgccggtgccgtctgctcaactagttaggtggctgctgcgcaggattccgggaaacgtcagtctgccatgagccggcaggactgagcctgcgactcggagcagagcgagtgaggggcagagcggtgctcaggagtgcggcccggggccgccggagctgggggtcgggccgggcgatgatccggggcttcgaggcgcccatggcggagaacccgccgccgccgccgccgcccgtcatcttctgccacgactccccgaagcgggtgctggtgtcggtcatcaggacgaccccgatcaagccaacgtgcggcggtggaggggagccggagccgccgccgccgctcatccccaccagccccggcttcagcgacttcatggtgtacccgtggcgctggggcgagaacgcacacaacgtgacgctcagccctggggccgcgggggccgccgcctcggccgccctgcctgcagccgcagccgccgagcactcggggcttcgtggccggggcgcgcccccgcccgccgcctcggcctccgccgccgcctcgggaggtgaggacgaggaggaagcgagcagcccagacagcggccacctcaaggatggaatccgacgtggtaggcccagagcagatactgtccgcgatttaataaatgaaggagagcattcatccagcagaatccgttgtaacatctgtaatagggtgtttccacgggagaaatcgctccaggctcacaaaaggactcatacaggtgagaggccctatctgtgtgactatccagactgtggaaaagcctttgttcaaagtggacagctcaaaacacatcagcgtcttcacaccggagagaaaccttttgtttgttcagaaaatggctgcctgagcagattcacccatgcaaaccgccactgtccgaagcacccctacgccaggctgaagagagaggagcccacggacacactcagcaaacatcaggctgccgacaacaaggccgcggccgagtggctggcgaggtattgggaaatgagagagcagcgcacccccactttgaaaggcaagctggttcagaaggctgatcaggagcagcaggaccctctggaataccttcagtctgatgaagaggacgacgagaagagaggggcccagcgccggctgcaggagcagcgggagcgcctgcatggagccctcgcgctcatagagcttgccaacctgactggggcgccactccgacagtagcttggacactgactcttccactgtacaaaagtactgcccagcatacttaaaaagtagatccttgggcataagctaagcaccttatttgcttatcataggctgctattctgtagaaatttatgaagaatgttattgccccagaatatggggtgagagagaactgcacttttttaatatggaaatgaattcatcgtaaagtttaaaatattttgtaaatatggactgcacagtacagggtagaaaactacatattgtgggaagctagattttgcaagtttaatgcattcattggaagcagttctcacaggaagcactttctgaataagacacttgtttgaaaaacagaatggtacaaatagccaaagaagattaaaacagattatttataagatcatttttaacaatatatattagtatgtttaacaatactgtaaacactgaagcaagcaagaaagtataaaatatgtaagatagataattttaattgcaaaatactgtgcccactaaggctagagaaatgggaggctattttggaagatgttctaagtaatggacttagaagaaaatagatatttgaggctcttggtaagatgcacaatagttcagaatttttgaaattggagcaaaatcagtcttattctatctggggctttacaactcagtataatgtttaagtttgaaaagcacttgtcatccctagcatgttaacttgggaacttttgcacatttcatatttctcatttgctgaaattgagtgattaatcttgcaaagtctaggtaacatagtaattggtaattttaaaaatacatattaagggccctgtaatgagatttggcacttggatttttactaaagggacacctgcagggttgttttgtagtgaaatgttttagatcttttgttagcaaacactacattttaattgtactgcttgtttagaattattagcaaatggaagcctccatatttatattttcagtgcataaagccaccttcttgctttacttcagagtaacatgccaagctattttgtgttcactaaatttagctatcagttaaacactgcagaaaatattagctactcaaataagtaggcttctgaaatagttttaactgcaagtgtgttaacttgtgtggtggtttgaagccatttttccaaataaagttattaaacaccactttatgtactgaagcatgaacagaaaaatcaagagctgagcagaccacctcctttatgtaggcaaaacttccatcattttggcttttgttctaaacagaactaaatgacatgcatagcatggtaacttacagatcgcttaattggagtaaaactcagagtaatagagggaaatatgggctcttcagtgcctttttagcttttttgagttgaagacgttcctacagatgtagtttaaacattacaaagtaggcttctttatccaaaaatcccaatgtgtcatagtacacagatagtttaaaatatgtagccacggggaaggggaggcatgtaaatgtcttgaagaggagaaaaagtatgaaagaagatacgatagttacgaataatgtgtatgatgaggacatactttaaaaatgtaattcctctgtacagtaaattacaaatctttagggatttttttgtaataagagaatttatatttgtaatggtctaagaatttttttgtaatgtggtatatagaattttaatttggagcacttataagctggtaagagagactatagcatctgaattatcttggtttatgtttcagcatttcctctagaatttttgctctcaaatatgtgatttaatgaactaaaaacaacactcatcagtcttgggaaatttgaactttgatcaacttaactaaagaaggaagggtagtaagaatttttcaaatacaaatatttgccaattcacagatgataacatttaaggccttcaaaagtaagggtttttccttgtttctccagtcagcttttgtcaactctaatagttttttcataaacattttttatttgtataattgcaacagtttaagaaattatcacaactatttagaaacatttaaaatgttctttttgatataagctatatacttggaaaaatacattggtatctaaaatttgaggtgtgttaagactgctttttgttttaaaaaatggtttacattcaaatttttgaagtgttttatgcttcatatggctaagttgtagtttggcagagttaacagcataagaataaacatgctgtaattttaaaagatgctttgaataaaaatttattttaatttaaaa

SEQ ID NO: 1955 - DNA, 1825 bp, Homo sapiens
gctgggcagagccctgggggcgcggtgctgccgcctccaggtctccgccccgtgtgtgcgccctgcacttagggatccctccctcactgccccggtactcacaagcttctcggccccgaccttcgccctgggaggttctggccaggtgccgggaggggcgctgtgtcgagggcgatccccccaaagcagcgtcccgtgctaaaggtactgcttaggatgaatatgatttggagaaattccatttcttgtctaaggctaggaaaggtgccacacagataccaaagtggttaccacccagtggcccctctgggatcaaggattttaactgacccagccaaagtttttgaacacaacatgtgggatcacatgcagtggtctaaggaagaagaagcagcagccagaaaaaaagtaaaagaaaactcagctgtgcgagtccttctggaagagcaagttaagtatgagagagaagctagtaaatactgggacacattttacaagattcataagaataagtttttcaaggatcgtaattggctgttgagggaatttcctgaaattcttccagttgatcaaaaacctgaagagaaggcgagagaatcatcatgggatcatgtaaaaactagtgctacaaatcgtttctcaagaatgcactgtcctactgtgcctgatgaaaaaaatcattatgagaaaagttctggttcttcagaaggtcaaagcaaaacagaatctgatttttccaacctagactctgaaaaacacaaaaaaggacctatggagactggattgtttcctggtagcaatgccactttcaggatactagaggttggttgtggagctggaaatagtgtgtttccaattttgaacactttggagaactctccggagtcctttctgtattgttgtgattttgcttctggagctgtggagctcgtaaagtcacactcgtcctacagagcaacccagtgttttgcctttgttcatgatgtatgtgatgatggcttaccttacccttttccagatgggatcctggatgtcattctccttgtctttgtgctctcttctattcatcctgacaggatgcaaggtgttgtaaaccgactgtccaagttactgaaacctgggggaatgctgttatttcgagactatggaagatatgataagactcagcttcgttttaaaaagggacattgtttatctgaaaatttttatgttcgaggagatggtaccagagcatatttctttacaaaaggggaagtccacagtatgttctgcaaagccagtttagatgaaaagcaaaatctggttgatcgccgcttacaagttaataggaaaaaacaagtgaaaatgcactgagtgtggattcaaggcaaattccagaaaccattgcaccagactcagaatagctccaatatggtatctacactcctttcacaagactgaactttgtaacatgttaaggtacaaagccagaggactgtgctattcaaggactactgtaagtctattgtttctcaaaagacaatgagaaaaaaagaagagaatttgtatttcctgccgttttgtcataggtgagctcctttgtgcattttaagcacatgtaagtggttcagcacagtatgcctttttctgtgctttgaaaacttgatatgctcaagcttgtttgaatttattacatctaaccattttgcttgttccttgatttttataagcattcaattaagttagtattatgtcaagtaattttgagaaaatgtaacttgacattttttgcaagtaaaaaaaattgtttatttgtttaggcttagtaaaccagttcccaaacaca

SEQ ID NO: 1956 - DNA, 5777 bp, Homo sapiens
cagccgcgtcccccagccccggcctcccgcggacccatgcccgcccgtatcggctactacgagatcgaccgcaccatcggcaagggcaacttcgcggtggtcaagcgggccacgcacctcgtcaccaaggccaaggttgctatcaagatcatagataagacccagctggatgaagaaaacttgaagaagattttccgggaagttcaaattatgaagatgctttgccacccccatatcatcaggctctaccaggttatggagacagaacggatgatttatctggtgacagaatatgctagtggaggggaaatatttgaccacctggtggcccatggtagaatggcagaaaaggaggcacgtcggaagttcaaacagatcgtcacagctgtctatttttgtcactgtcggaacattgttcatcgtgatttaaaagctgaaaatttacttctggatgccaatctgaatatcaaaatagcagattttggtttcagtaacctcttcactcctgggcagctgctgaagacctggtgtggcagccctccctatgctgcacctgaactctttgaaggaaaagaatatgatgggcccaaagtggacatctggagccttggagttgtcctctacgtgcttgtgtgcggtgccctgccatttgatggaagcacactgcagaatctgcgggcccgcgtgctgagtggaaagttccgcatcccattttttatgtccacagaatgtgagcatttgatccgccatatgttggtgttagatcccaataagcgcctctccatggagcagatctgcaagcacaagtggatgaagctaggggacgccgatcccaactttgacaggttaatagctgaatgccaacaactaaaggaagaaagacaggtggaccccctgaatgaggatgtcctcttggccatggaggacatgggactggacaaagaacagacactgcagtcattaagatcagatgcctatgatcactatagtgcaatctacagcctgctgtgtgatcgacataagagacataaaaccctgcgtctcggagcacttcctagcatgccccgagccctggcctttcaagcaccagtcaatatccaggcggagcaggcaggtactgctatgaacatcagcgttccccaggtgcagctgatcaacccagagaaccaaattgtggagccggatgggacactgaatttggacagtgatgagggtgaagagccttcccctgaagcattggtgcgctatttgtcaatgaggaggcacacagtgggtgtggctgacccacgcacggaagttatggaagatctgcagaagctcctacctggctttcctggagtcaacccccaggctccattcctgcaggtggcccctaatgtgaacttcatgcacaacctgttgcctatgcaaaacttgcaaccaaccgggcaacttgagtacaaggagcagtctctcctacagccgcccacgctacagctgttgaatggaatgggcccccttggccggagggcatcagatggaggagccaacatccaactgcatgcccagcagctgctgaagcgcccacggggaccctctccgcttgtcaccatgacaccagcagtgccagcagttacccctgtggacgaggagagctcagacggggagccagaccaggaagctgtgcagagctctacctacaaggactccaacactctgcacctccctacggagcgtttctcccctgtgcgccggttctcagatggggctgcgagcatccaggccttcaaagctcacctggaaaaaatgggcaacaacagcagcatcaaacagctgcagcaggagtgtgagcagctgcagaagatgtacggggggcagattgatgaaagaaccctggagaagacccagcagcagcatatgttataccagcaggagcagcaccatcaaattctccagcaacaaattcaagactctatctgtcctcctcagccatctccacctcttcaggctgcatgtgaaaatcagccagccctccttacccatcagctccagaggggctgcatcttcttcccagtttcaaggcttaccttcccgcagtgcaatctttcagcagcaacctgagaactgttcctctcctcccaacgtggcactaacctgcttgggtatgcagcagcctgctcagtcacagcaggtcaccatccaagtccaagagcctgttgacatgctcagcaacatgccaggcacagctgcaggctccagtgggcgcggcatctccatcagccccagtgctggtcagatgcagatgcagcaccgtaccaacctgatggccaccctcagctatgggcaccgtcccttgtccaagcagctgagtgctgacagtgcagaggctcacagtgcacatcagcagccgccacactataccacgtcggcactacagcaggccctgctgtctcccacgccgccagactatacaagacaccagcaggtaccccacatccttcaaggactgctttctccccggcattcgctcaccggccactcggacatccggctgcccccaacagagtttgcacagctcattaaaaggcagcagcaacaacggcagcagcagcagcaacagcagcaacagcaagaataccaggaactgttcaggcacatgaaccaaggggatgcggggagtctggctcccagccttgggggacagagcatgacagagcgccaggctttatcttatcaaaatgctgactcttatcaccatcacaccagcccccagcatctgctacaaatcagggcacaagaatgtgtctcacaggcttcctcacccaccccgccccacgggtatgctcaccagccggcactgatgcattcagagagcatggaggaggactgctcgtgtgagggggccaaggatggcttccaagacagtaagagttcaagtacattgaccaaaggttgccatgacagccctctgctcttgagtaccggtggacctggggaccctgaatctttgctaggaactgtgagtcatgcccaagaattggggatacatccctatggtcatcagccaactgctgcattcagtaaaaataaggtgcccagcagagagcctgtcatagggaactgcatggatagaagttctccaggacaagcagtggagctgccggatcacaatgggctcgggtacccagcacgcccctccgtccatgagcaccacaggccccgggccctccagagacaccacacgatccagaacagcgacgatgcttatgtacagctggataacttgccaggaatgagtctcgtggctgggaaagcacttagctctgcccggatgtcggatgcagttctcagtcagtcttcgctcatgggcagccagcagtttcaggatggggaaaatgaggaatgtggggcaagcctgggaggtcatgagcacccagacctgagtgatggcagccagcatttaaactcctcttgctatccatctacgtgtattacagacattctgctcagctacaagcaccccgaagtctccttcagcatggagcaggcaggcgtgtaacaagaaacagagagttttgtgtacagcttgggaatgaaaaggttgattgtaaacccacagtatctagcagcgttgtgccaaattgcccttgtgtttctctccacccaaaatatcacagctgctttcctcacatttggttcatccgtgtgctgttcttttgggttctgagagggttttgccatgtttgcttgtatgaccaagtcaccaaggaaataaacaggaaggaaatccatgttctccatcttttgtgaaagtatatttgagttggtggttttttgttttgtttgggggtttgtgttttgttttgtttttggtatgttttcttccagaggtgatatactttcttttttttcttcctttcttttttttctttcgttccttttttgaaacaggagagcaaagcagttagagttcagaggccagcggcctcagggccactccctccctagccttcatcagcagagcaccctccatccccctgcattgctcttctgtgaaagcaaatactaaaggatgccatcctctggaatcctaatggcaggcaaagggagagaggaagggtgacggcttctggcacttagaaaacaaaaagaacaaaaaaagagaaacccccaagcctggaacgcagagaggtctttactgctgggatccacggaaaacatgtctgtcctagccaagatcatatgaagagtttggcacggaggctgagaatgacctggcatagatggtttgccagttaggatgtctcaatttgagcctttgcttttggtggataactcagctcccctcttgtaacctggaaagttggttgcctttatcatcctgctggttttatccatggactgaacacccaacagcagtgcactatgctttctatggcatctttcattctcattttatattgtgctataaaaaggattgtttctccatatatatattatatatgtgtgtatatatataatataatatatgtgtatatatatattatatatataatatataatataatatattatatatatattatatatataatatatatataaaatatatatatatatgctctcctctttcagcctctttgtcacagggaagaagtgtaggaggttgccttgggccctgcctctctcctaacctcctcttccccactgggtaccctcagcccctatattttaattcttgatcatgtagaaattgtttttggtaaatgttgatattattgttattatcattattaataaataaagagaaaaggaatttttgtttaaatgagaaatgtttaaccagattctgttctatttgaattgtgacttgcaccttttgttcaaagtatttcctttaggcattgtaattgtgaacagctcttacttgtgccagtgacagatgcagtggtctcctttccccagttgaagcagtgcatacgcagtagctattatttgtgttatctttatttctcttcattgttagaaaccaaagtcttctctgctggctggggctgagagagggtctgggttatctccttctgatcttcaaaacaagagagagaccttgaatacactgactcttccaccctttttttttctgggaaaggagagcaagaggtcccgagtcccctcctagtctttcatcctgaatttgcacagaggaaagcgggtgcccggcatggccatcctgatgttgctggcgggatccccatgcaccttgtccttctccactgatactggcagctcggctcctggacccaagatcccttgagtggaattctgcagtgcaagagcccttcgtgggagctgtcccatgtttccatggtccccagtctcccctccacttggtggggtcaccaactactcaccagaagggggcttaccaagaaagccctaaaaagctgttgacttatctgcgcttgttccaactcttatgcccccaacctgccctaccaccaccacgcgctcagcctgatgtgtttacatggtactgtatgtatgggagagcagactgcaccctccagcaacaacagatgaaagccagtgagcctactaaccgtgccatcttgcaaactacactttaaaaaaaactcattgctttgtattgtagtaaccaatatgtgcagtatacgttgaatgtatatgaacatactttcctatttctgttctttgaaaatgtcagaaatatttttttctttctcattttatgttgaactaaaaaggattaaaaaaaaaatctccagactcaagttgct

SEQ ID NO: 1957 - DNA, 6213 bp, Homo sapiens
aacaagatggcggcggcggcggcgagcggagctggcggggctgccggggccgggactgggggagccgggcccgcgggccgcctgctgcctccgcccgcgccggggtccccagccgcccccgctgccgtgtcccctgcggccggccagccgcgtcccccagccccggcctcccgcggacccatgcccgcccgtatcggctactacgagatcgaccgcaccatcggcaagggcaacttcgcggtggtcaagcgggccacgcacctcgtcaccaaggccaaggttgctatcaagatcatagataagacccagctggatgaagaaaacttgaagaagattttccgggaagttcaaattatgaagatgctttgccacccccatatcatcaggctctaccaggttatggagacagaacggatgatttatctggtgacagaatatgctagtggaggggaaatatttgaccacctggtggcccatggtagaatggcagaaaaggaggcacgtcggaagttcaaacagatcgtcacagctgtctatttttgtcactgtcggaacattgttcatcgtgatttaaaagctgaaaatttacttctggatgccaatctgaatatcaaaatagcagattttggtttcagtaacctcttcactcctgggcagctgctgaagacctggtgtggcagccctccctatgctgcacctgaactctttgaaggaaaagaatatgatgggcccaaagtggacatctggagccttggagttgtcctctacgtgcttgtgtgcggtgccctgccatttgatggaagcacactgcagaatctgcgggcccgcgtgctgagtggaaagttccgcatcccattttttatgtccacagaatgtgagcatttgatccgccatatgttggtgttagatcccaataagcgcctctccatggagcagatctgcaagcacaagtggatgaagctaggggacgccgatcccaactttgacaggttaatagctgaatgccaacaactaaaggaagaaagacaggtggaccccctgaatgaggatgtcctcttggccatggaggacatgggactggacaaagaacagacactgcagtcattaagatcagatgcctatgatcactatagtgcaatctacagcctgctgtgtgatcgacataagagacataaaaccctgcgtctcggagcacttcctagcatgccccgagccctggcctttcaagcaccagtcaatatccaggcggagcaggcaggtactgctatgaacatcagcgttccccaggtgcagctgatcaacccagagaaccaaattgtggagccggatgggacactgaatttggacagtgatgagggtgaagagccttcccctgaagcattggtgcgctatttgtcaatgaggaggcacacagtgggtgtggctgacccacgcacggaagttatggaagatctgcagaagctcctacctggctttcctggagtcaacccccaggctccattcctgcaggtggcccctaatgtgaacttcatgcacaacctgttgcctatgcaaaacttgcaaccaaccgggcaacttgagtacaaggagcagtctctcctacagccgcccacgctacagctgttgaatggaatgggcccccttggccggagggcatcagatggaggagccaacatccaactgcatgcccagcagctgctgaagcgcccacggggaccctctccgcttgtcaccatgacaccagcagtgccagcagttacccctgtggacgaggagagctcagacggggagccagaccaggaagctgtgcagagctctacctacaaggactccaacactctgcacctccctacggagcgtttctcccctgtgcgccggttctcagatggggctgcgagcatccaggccttcaaagctcacctggaaaaaatgggcaacaacagcagcatcaaacagctgcagcaggagtgtgagcagctgcagaagatgtacggggggcagattgatgaaagaaccctggagaagacccagcagcagcatatgttataccagcaggagcagcaccatcaaattctccagcaacaaattcaagactctatctgtcctcctcagccatctccacctcttcaggctgcatgtgaaaatcagccagccctccttacccatcagctccagaggttaaggattcagccttcaagcccaccccccaaccaccccaacaaccatctcttcaggcagcccagtaatagtcctccccccatgagcagtgccatgatccagcctcacggggctgcatcttcttcccagtttcaaggcttaccttcccgcagtgcaatctttcagcagcaacctgagaactgttcctctcctcccaacgtggcactaacctgcttgggtatgcagcagcctgctcagtcacagcaggtcaccatccaagtccaagagcctgttgacatgctcagcaacatgccaggcacagctgcaggctccagtgggcgcggcatctccatcagccccagtgctggtcagatgcagatgcagcaccgtaccaacctgatggccaccctcagctatgggcaccgtcccttgtccaagcagctgagtgctgacagtgcagaggctcacagcttgaacgtgaatcggttctcccctgctaactacgaccaggcgcatttacacccccatctgttttcggaccagtcccggggttcccccagcagctacagcccttcaacaggagtggggttctctccaacccaagccctgaaagtccctccacttgaccaattccccaccttccctcccagtgcacatcagcagccgccacactataccacgtcggcactacagcaggccctgctgtctcccacgccgccagactatacaagacaccagcaggtaccccacatccttcaaggactgctttctccccggcattcgctcaccggccactcggacatccggctgcccccaacagagtttgcacagctcattaaaaggcagcagcaacaacggcagcagcagcagcaacagcagcaacagcaagaataccaggaactgttcaggcacatgaaccaaggggatgcggggagtctggctcccagccttgggggacagagcatgacagagcgccaggctttatcttatcaaaatgctgactcttatcaccatcacaccagcccccagcatctgctacaaatcagggcacaagaatgtgtctcacaggcttcctcacccaccccgccccacgggtatgctcaccagccggcactgatgcattcagagagcatggaggaggactgctcgtgtgagggggccaaggatggcttccaagacagtaagagttcaagtacattgaccaaaggttgccatgacagccctctgctcttgagtaccggtggacctggggaccctgaatctttgctaggaactgtgagtcatgcccaagaattggggatacatccctatggtcatcagccaactgctgcattcagtaaaaataaggtgcccagcagagagcctgtcatagggaactgcatggatagaagttctccaggacaagcagtggagctgccggatcacaatgggctcgggtacccagcacgcccctccgtccatgagcaccacaggccccgggccctccagagacaccacacgatccagaacagcgacgatgcttatgtacagctggataacttgccaggaatgagtctcgtggctgggaaagcacttagctctgcccggatgtcggatgcagttctcagtcagtcttcgctcatgggcagccagcagtttcaggatggggaaaatgaggaatgtggggcaagcctgggaggtcatgagcacccagacctgagtgatggcagccagcatttaaactcctcttgctatccatctacgtgtattacagacattctgctcagctacaagcaccccgaagtctccttcagcatggagcaggcaggcgtgtaacaagaaacagagagttttgtgtacagcttgggaatgaaaaggttgattgtaaacccacagtatctagcagcgttgtgccaaattgcccttgtgtttctctccacccaaaatatcacagctgctttcctcacatttggttcatccgtgtgctgttcttttgggttctgagagggttttgccatgtttgcttgtatgaccaagtcaccaaggaaataaacaggaaggaaatccatgttctccatcttttgtgaaagtatatttgagttggtggttttttgttttgtttgggggtttgtgttttgttttgtttttggtatgttttcttccagaggtgatatactttcttttttttcttcctttcttttttttctttcgttccttttttgaaacaggagagcaaagcagttagagttcagaggccagcggcctcagggccactccctccctagccttcatcagcagagcaccctccatccccctgcattgctcttctgtgaaagcaaatactaaaggatgccatcctctggaatcctaatggcaggcaaagggagagaggaagggtgacggcttctggcacttagaaaacaaaaagaacaaaaaaagagaaacccccaagcctggaacgcagagaggtctttactgctgggatccacggaaaacatgtctgtcctagccaagatcatatgaagagtttggcacggaggctgagaatgacctggcatagatggtttgccagttaggatgtctcaatttgagcctttgcttttggtggataactcagctcccctcttgtaacctggaaagttggttgcctttatcatcctgctggttttatccatggactgaacacccaacagcagtgcactatgctttctatggcatctttcattctcattttatattgtgctataaaaaggattgtttctccatatatatattatatatgtgtgtatatatataatataatatatgtgtatatatatattatatatataatatataatataatatattatatatatattatatatataatatatatataaaatatatatatatatgctctcctctttcagcctctttgtcacagggaagaagtgtaggaggttgccttgggccctgcctctctcctaacctcctcttccccactgggtaccctcagcccctatattttaattcttgatcatgtagaaattgtttttggtaaatgttgatattattgttattatcattattaataaataaagagaaaaggaatttttgtttaaatgagaaatgtttaaccagattctgttctatttgaattgtgacttgcaccttttgttcaaagtatttcctttaggcattgtaattgtgaacagctcttacttgtgccagtgacagatgcagtggtctcctttccccagttgaagcagtgcatacgcagtagctattatttgtgttatctttatttctcttcattgttagaaaccaaagtcttctctgctggctggggctgagagagggtctgggttatctccttctgatcttcaaaacaagagagagaccttgaatacactgactcttccaccctttttttttctgggaaaggagagcaagaggtcccgagtcccctcctagtctttcatcctgaatttgcacagaggaaagcgggtgcccggcatggccatcctgatgttgctggcgggatccccatgcaccttgtccttctccactgatactggcagctcggctcctggacccaagatcccttgagtggaattctgcagtgcaagagcccttcgtgggagctgtcccatgtttccatggtccccagtctcccctccacttggtggggtcaccaactactcaccagaagggggcttaccaagaaagccctaaaaagctgttgacttatctgcgcttgttccaactcttatgcccccaacctgccctaccaccaccacgcgctcagcctgatgtgtttacatggtactgtatgtatgggagagcagactgcaccctccagcaacaacagatgaaagccagtgagcctactaaccgtgccatcttgcaaactacactttaaaaaaaactcattgctttgtattgtagtaaccaatatgtgcagtatacgttgaatgtatatgaacatactttcctatttctgttctttgaaaatgtcagaaatatttttttctttctcattttatgttgaactaaaaaggattaaaaaaaaaatctccagactcaagttgctaa

SEQ ID NO: 1958 - DNA, 2030 bp, Homo sapiens
cccgtccattgtgcgccgctgccccgtgtctccctccagccgcgaccatgcccaggaagaaggcggcggcggcggcctgggaggagccgagctcgggcaacggcactgcccgcgccgggcccaggaaacgcggcggcccggcgggcaggaagcgcgagcggcccgagcgctgcagtagcagcagcggcggcggcagcagcggcgacgaggacggcctggagctcgacggggcccccggcgggggcaagcgcgcggcgcggccggcgacagcaggcaaggcgggcggcgcggccgtggtcatcaccgaacccgagcacaccaaggagcgcgtcaaacttgaagggtcaaagtgcaaagggcagcttttgatttttggggcaaccaactgggacttgattggtcgaaaagaagtgcctaaacagcaagctgcttaccgcaatctcggtcagaatttgtgggggccccacagatatgggtgcctggcgggggtccgggtgcggacagtggtctcgggctcgtgtgctgcacacagcctcctcatcaccacggaagggaagctgtggagctggggtcgaaatgagaaggggcagctgggacatggtgacaccaagagagtagaagcccctagactcatcgagggtcttagccacgaagtgattgtgtctgcagcatgtgggcggaaccacaccttggccttgacggaaacgggctccgtgtttgcgtttggggaaaacaagatggggcagctgggccttggcaaccagacagacgctgttcccagccccgcgcagataatgtacaacggccagccaattaccaaaatggcctgtggggctgaattcagtatgataatggactgcaaaggaaacctctattcctttgggtgccctgaatatggtcagctgggacacaactcagatgggaagttcatcgcccgggcacagcggatagagtacgactgtgaactagttccccggcgagtggccatcttcattgagaagacgaaagatggacagattctgcctgtaccaaacgtggttgtacgagacgtggcctgtggcgctaaccacacgctggtcctggactcccagaagcgagtcttctcctggggctttggtggctatggccggctgggccacgcagagcagaaggatgagatggtcccccgcctggtgaagctgtttgacttccctgggcgtggggcttcccagatctatgctggttacacctgctcctttgctgtcagtgaagtgggtggtctgtttttctggggggccaccaacacctcccgtgaatctaccatgtacccaaaagcagtgcaggacctctgcggctggagaatccggagcctggcttgtgggaagagcagcatcattgtggccgccgatgagagcaccatcagctggggtccgtcaccgacctttggggaactgggctacggggaccacaagcccaagtcttccactgcagcccaggaggtaaagactctggatggcattttctcagagcaggtcgccatgggctactcacactccttggtgatagcaagagatgaaagtgagactgagaaagagaagatcaagaaactgccagaatacaacccccgaaccctctgatgctcccggagactcctccgactccacacctctcgcggcagctgtcatttccatgtgcactgggacgggaagtcaaacgaggaatttaaaaaagcaaaagttgaccgaaggtgcatttttgtttagactccctgaggttccgttttacacatgatccaacgttaactacctttttttctgtatgctttccaaagtccttttttttcccttaatgttgaattaaaatacttgctcatagttgatttaccattcctacaaaagaggcagaaactttgagcaatctaggttttttttttttttaagttttttctttcttcctctcctgaatacactccccaaaacacccctttccagttacaattagcatcgtgatccaagcagatgccacatggaagaggaatcgccatttactca

SEQ ID NO: 1959 - DNA, 4087 bp, Homo sapiens
cgcacatgtgtttctgttttgtgttgtagcatttgttctggaagctcgtatttacattttaagtgtatctggtgagtgggctggagccctcgtctgggccggaaaaaaaaaagccctccgatccgtcttttagttgcttctcttccttttttctctccggtttctcatcactccaaccagccgcgaccatgcccaggaagaaggcggcggcggcggcctgggaggagccgagctcgggcaacggcactgcccgcgccgggcccaggaaacgcggcggcccggcgggcaggaagcgcgagcggcccgagcgctgcagtagcagcagcggcggcggcagcagcggcgacgaggacggcctggagctcgacggggcccccggcgggggcaagcgcgcggcgcggccggcgacagcaggcaaggcgggcggcgcggccgtggtcatcaccgaacccgagcacaccaaggagcgcgtcaaacttgaagggtcaaagtgcaaagggcagcttttgatttttggggcaaccaactgggacttgattggtcgaaaagaagtgcctaaacagcaagctgcttaccgcaatctcggtcagaatttgtgggggccccacagatatgggtgcctggcgggggtccgggtgcggacagtggtctcgggctcgtgtgctgcacacagcctcctcatcaccacggaagggaagctgtggagctggggtcgaaatgagaaggggcagctgggacatggtgacaccaagagagtagaagcccctagactcatcgagggtcttagccacgaagtgattgtgtctgcagcatgtgggcggaaccacaccttggccttgacggaaacgggctccgtgtttgcgtttggggaaaacaagatggggcagctgggccttggcaaccagacagacgctgttcccagccccgcgcagataatgtacaacggccagccaattaccaaaatggcctgtggggctgaattcagtatgataatggactgcaaaggaaacctctattcctttgggtgccctgaatatggtcagctgggacacaactcagatgggaagttcatcgcccgggcacagcggatagagtacgactgtgaactagttccccggcgagtggccatcttcattgagaagacgaaagatggacagattctgcctgtaccaaacgtggttgtacgagacgtggcctgtggcgctaaccacacgctggtcctggactcccagaagcgagtcttctcctggggctttggtggctatggccggctgggccacgcagagcagaaggatgagatggtcccccgcctggtgaagctgtttgacttccctgggcgtggggcttcccagatctatgctggttacacctgctcctttgctgtcagtgaagtgggtggtctgtttttctggggggccaccaacacctcccgtgaatctaccatgtacccaaaagcagtgcaggacctctgcggctggagaatccggagcctggcttgtgggaagagcagcatcattgtggccgccgatgagagcaccatcagctggggtccgtcaccgacctttggggaactgggctacggggaccacaagcccaagtcttccactgcagcccaggaggtaaagactctggatggcattttctcagagcaggtcgccatgggctactcacactccttggtgatagcaagagatgaaagtgagactgagaaagagaagatcaagaaactgccagaatacaacccccgaaccctctgatgctcccggagactcctccgactccacacctctcgcggcagctgtcatttccatgtgcactgggacgggaagtcaaacgaggaatttaaaaaagcaaaagttgaccgaaggtgcatttttgtttagactccctgaggttccgttttacacatgatccaacgttaactacctttttttctgtatgctttccaaagtccttttttttcccttaatgttgaattaaaatacttgctcatagttgatttaccattcctacaaaagaggcagaaactttgagcaatctaggttttttttttttttaagttttttctttcttcctctcctgaatacactccccaaaacacccctttccagttacaattagcatcgtgatccaagcagatgccacatggaagaggaatcgccatttactcagaaaaaatgtcccttacaggaaccggcagcagctaggcagtcaccggcccgcctccatccaaaatcacgctcgcgtgcttcggaagcatccgggtcactccttctccgctttttcttgcagatgggcctaggccggtgtcggttctgtttctccccttggctgcctgtacgcccacagccttctggctgcgacattatagaatcggccgtgtcccccctggtgggggattggggatctgtgtttagccatttatatctactttagctgttaaagaggtccaaatgaaaatcaggtgattgtggaaccatggggacttgggggtggggcagaggtgggaacatttgtatcagttgagtcagcttggtggctccctgtggagccagggctgagccttgtcacgcgcactcgccaattaagagatggaccagccagcagtcaagtgcattctccagtccttgcaagaaggatcagccctttctgtgccagcctcgatcgccttgtgctttggtctctttttctcccccccgcctggatcctgcctcgcgcgggccgtcctgttgctgagactcggggtaccgttctgctgacccagctccctttagtcacgtttgcttggctctggtaccaaatagttgggattaccgaagagtccccttccttgcgtgtcagcacggatgctgtgactgccacctgcgtcctcgtcaagtgcccgagctcgccgccgtgtgtgctgcgctgagtgagttatgaggtgcctttcccggaaccctcctctcgcctggacccaagagaggcgacagctgtggctggggctcttggtttccagagggtctggactggtttgggtgctttaaaatagatatttagttcagtggtgcttatgggggagatgggactagaacttaagtgtgagacttgggtggatgggaaagttaaatattggtctcttcaagttttttttttcttttgctttgttaccacttgtcactgtctccatgttaaaatgccaaaaatgatgtagttgttgttgcttttttccctattttccaccccagtcgctccttaccgtgactcctgcccttggagggcatgtagcagtgtctgtcctgccagtcccaaggccctgtgggaggagactggcctgcatctctctaagacttagtctgacgccacgcgcatctcttgttctgtgttcaatcagtagtccaggggagaagcttctgctacttcagagctttgctaaactaacctaatttgtccaaatcaccccaaaaccaccatctctgacgtaagcttccatgcgacagcctgatccgtttccctggacaggtctctttcctggaatgcagcccaggcacctgtgctcctggcacccttgaggtctctcctttgagccgtggtcaccgagagggttgaggacgcagcacccgaggtcccagcctttgcaggagcctccctgggcttagctggacttagatcttcggtggcctcatgtaaacgtggcagccagcctcttctagaaccctagcccagggactggagcaggaaagggaccttcaaagtgaagactgccttgtcccgcagctccttctggcttagattgaaaaatgggcttcctaatgggttaaatcctttaaaacaaggagttgtgggggaagggtgtcgtgcactcctagagaaaggtacacagttgcccggttgggaatgtgcttggcgctgaccctgcgggcatctgactggtcttccagctcaggaaaaagaatttgaaagaggcttagcgtgaaggggaatcaaagaggaggttgtgatttggtcgaaggtgcctggtttagtgctgtaattgtcttattattttttttatatatatatttcttggagtaaacattttaaataaacaacaacattgtctactgtc

SEQ ID NO: 1960 - DNA, 855 bp, Homo sapiens
aaaaggggcgggcgagcacggcccgcgggcggcgttcgctggagctggtggaccgggcggctgaccgaggggcggacgcgcggcggggcagaccgctggggactgcgggcggcgctgtgtccgtcgccatgacagatcagacctattgtgaccgcctggtgcaggacacgcctttcctgacaggccatgggcgcttgagtgagcagcaggtggacaggatcatcctccagctgaaccgttactacccacagatccttaccaacaaggaggcggaaaagttccggaaccccaaggcatccttgcgtgtgcggctctgtgacctcctgagccacctgcagcggagcggtgagcgggactgccaggagttctaccgagccctgtatatccatgcccagcccctgcacagccgcctgcccagccgccacgctctgcagaactcagattgcacagagctagactcgggcagccagagcggcgagctgagtaacaggggacccatgagcttcctggctggcctgggccttgctgtgggactggccctgctcctgtactgctatccgccagaccccaagggcctgccagggacccggcgcgtcctcggtttctcgcctgtcatcatcgacagacatgtcagccgctacctgctggccttcctggcagatgacctaggggggctctgacagaccctggacccagggcctcacctgccactcaaccaaagagtcctcgagccggcccgccaaggggactgctgcttctttttctaaatgcatatttttcattatttataatttgtgtaaaaaacacaccttcaccttacaaggtgctgaccatattaaatgttcaggttctctc

SEQ ID NO: 1961 - DNA, 882 bp, Homo sapiens
accctgagtccggggctcgggcctcagggcccgcgagtctgcgaagccagccctttcagtaggagccttcgctgccaaggtgcagatgttggacctgctggacatcgaaggcctctaccctctgtacaaccgggttgagcgatacctggaagagtttcccgaggagagaaaaaccttacaaatagatgggccttatgatgaagcattttaccagaagctgcttgacctttccactgaggatgacgggacagtggccttcgcgctaacgaaggtgcagcagtaccgcgtcgccatgactgccaaggactgctccatcatgattgcactgtctccctgtctgcaggatgccagctctgatcaaaggcctgtcgtcccttcatcgaggtccaggtttgccttttccgtgtctgtgctggaccttgacctcaagccctacgagagcattccccatcagtataaactggacggcaagatcgtcaactattattcaaagactgtacgtgccaaagacaacgccgtgatgtcgactcggttcaaggaaagcgaagattgcacattagttctccacaaggtctaactctttccctgcagtgtctttgaaacttgaacataatgtgaaggctgaatgatagagatattttctgttgtgttgggtgacctttggttgtgaatgtttttgcttttaaccccttttgaggtgggattgcctcttggagacatggaattgaagagcactagaaacaacttcctggacaaggaatgtaggaagtgagtgctgtgtcccaggaagctgctcacactcttaaaatggaagtgtccgttaagccctgggaagacgttctggatagttcttctttcccaaccagggctcatgtctgattc

SEQ ID NO: 1962 - DNA, 1334 bp, Homo sapiens
ataccctccatgggcagtaatgggatgactatccccagggagcattgcgaaggagagaggcggctgagggactgcactttctggggccccccgggagagtcagagggcagttaagagggatcacaggcccggcttggtactgtcactccccttcccactccctgctctcagcattctgtcacctccctaccccgtcgcggtgcccagccatggccagacctcccgtgcccggttcggtggttgtcccaaactggcacgagagtgccgagggcaaggagtacctggcttgcattctgcgcaagaaccgccggcgggtgtttgggctgcttgagcggccagtgctgctgccgcctgtgtccattgacactgccagctacaagatctttgtgtccgggaagagtggtgtgggcaagacggcgctggtggccaagctggctggcctggaggtgcctgtggtgcaccacgagaccaccggcatccagaccaccgtggtattttggccagccaagctgcaggccagcagccgtgtcgtcatgtttcgttttgagttctgggactgtggagagtctgcactcaaaaagttcgatcatatgctgctggcttgcatggagaacacagatgccttcctcttcctcttctccttcactgaccgtgcctcctttgaagacctccctggacagctggcccgcatagcaggtgaggcccctggtgtcgtcaggatggtcatcggctccaaatttgaccagtacatgcacacggacgtgcccgagcgggacctcacagccttccggcaggcctgggagctgcccctgctacgggtgaagagtgtgccggggcggcggctggctgatgggcgcacactggacgggcgggctgggctggccgacgttgcccacatactcaatggccttgctgagcagctgtggcaccaggaccaggtggcggctggcctgcttcccaaccccccagagagtgctcctgaatgagtcacgagtggttgcctgtgatcccacccccaaccctcaggtctcgacatagggctggaggctggggcaggaacatggatcctatctggaggactggccagcatggcctgatcagggaggatgtggccagagaaggcccacccgcgagcagcgctttccttgcagaattcatggcagggaggtggggaccaaggccctgagctcgaacatctcccgtggcctttccccctttggcagcaccgatggaggatgactgggagagggggtgcctctcaagttacttcaatcaagaacctgtattggttgaggtgacaccatctgttgtaacagataaaccccgaaatccca

SEQ ID NO: 1963 - DNA, 466 bp, Homo sapiens
gggaggagagaaaagccatggccgacaaggtcctgaaggagaagagaaagcagtttatccgttcagtgggcgaaggtacaataaatggcttactgggtgaattattggagacaagggtgctgagccaggaagagatagagatagtaaaatgtgaaaatgctacagttatggataaggcccgagctttgcttgactctgttattcggaaaggggctccagcatgccaaatttgcatcacatacatttgtgaagaagacagtcacctggcagggacgctgggactctcagcaggtccaacatctggaaatcaccttactacacaagattctcaaatagtacttccttcctaggttcaactttcatttgagcagccagatgataaagcacagatgcccagcactgaaagagttacttcgacaagacgtttctatctcttcccagtacattaaaataaggaagctgtatg

SEQ ID NO: 1964 - DNA, 1257 bp, Homo sapiens
ggcctgtacattttcaaggaattcttgagaggttcttggagagattctgggagccaaacactccattgggatcctagctgttttagagaacaacttgtaatggagccttcatctcttgagctgccggctgacacagtgcagcgcattgcggctgaactcaaatgccacccaacggatgagagggtggctctccacctagatgaggaagataagctgaggcacttcagggagtgcttttatattcccaaaatacaggatctgcctccagttgatttatcattagtgaataaagatgaaaatgccatctatttcttgggaaattctcttggccttcaaccaaaaatggttaaaacatatcttgaagaagaactagataagtgggccaaaatagcagcctatggtcatgaagtggggaagcgtccttggattacaggagatgagagtattgtaggccttatgaaggacattgtaggagccaatgagaaagaaatagccctaatgaatgctttgactgtaaatttacatcttctaatgttatcattttttaagcctacgccaaaacgatataaaattcttctagaagccaaagccttcccttctgatcattatgctattgagtcacaactacaacttcacggacttaacattgaagaaagtatgcggatgataaagccaagagagggggaagaaaccttaagaatagaggatatccttgaagtaattgagaaggaaggagactcaattgcagtgatcctgttcagtggggtgcatttttacactggacagcactttaatattcctgccatcacaaaagctggacaagcgaagggttgttatgttggctttgatctagcacatgcagttggaaatgttgaactctacttacatgactggggagttgattttgcctgctggtgttcctacaagtatttaaatgcaggagcaggaggaattgctggtgccttcattcatgaaaagcatgcccatacgattaaacctgcgagatcggagttctttaattaggaatggaatgcaacagatttggacaagtcaaggacaagagctttagagagaccaaagagtttttcactgttaaagtgtccagtatgtagccgagaaccatatggagaacatcaaatacagtggaacaaatgtaactgctattgatgtcacactttgtgaagtagtctttgttgcttaaaaagggtgacatctagtggctaaacatgttatttcaaataaataatatcgaaataa

SEQ ID NO: 1965 - DNA, 4122 bp, Homo sapiens
gcctccttccccgccggccgcgctccggagcctccgggccgcggtggagcgagggcccaggcgaggcgagggccgggcggcgggcgccgggccccgcggccggcacgacggagcccccgtacggccggcggcagcggttggcggcggcccccggcccccggcgcgggaagcggcggcggggcggcggcggcggtggcggtggcggtggcggcgacggtggcagcgccatggagccgggggaggtgaaggaccggatcctggagaacatctcgctgtcggtgaagaagttgcagagctattttgctgcatgtgaggatgagatccctgccatccggaaccatgacaaggtcctacagcgtctgtgtgagcacctggaccacgccctgctgtacggactgcaagacctctcctctggctactgggtgctcgtggtgcattttactcggagagaggccatcaagcagatcgaggtgctgcagcacgtggccaccaacctggggcgcagccgtgcctggctgtacctggccctcaacgagaactccttggagagctacctgcggttgttccaggagaacctgggcctgctgcataagtactacgtcaagaatgccctggtctgcagccacgatcacctgacgctcttcctgaccttggtgtccgggctagagttcattcgtttcgagctggatctggatgccccttacctagacctggccccctacatgcccgactactacaaacctcagtacctgctggactttgaagaccgccttcccagctcggtccacggctcagacagtctgtccctcaactctttcaactccgtcacctccaccaacctggagtgggatgacagtgcgattgccccatctagtgaggattatgattttggagatgtgtttccagcagtgccgtctgtacccagcacagactgggaagatggagacctcacagacacggtcagtggtccccgctccacagcctccgacctgaccagcagcaaggcctccaccaggagccccacccagcgccagaaccccttcaacgaggagccggcagagactgtgtcctcctctgacaccacccccgtgcacaccacctctcaggagaaggaggaggcccaggccctggacccgccggatgcctgcacggagctcgaggtcatcagggtcaccaagaagaagaaaattggcaagaagaaaaagagcagatcagatgaggaggcaagtccactccaccccgcctgcagccagaagaaatgtgccaagcagggggacggtgacagccgcaacggcagcccaagccttgggcgggactcgccagacactatgcttgcctccccccaggaggagggagaggggccgagcagcaccacggagagcagcgagcgctccgagccgggcctgctgatccctgagatgaaggacacctccatggagcgcttggggcagcccctgagcaaggttatcgaccagctcaacgggcagctggaccccagcacctggtgctcccgtgctgagcccccagaccagtcctttcggaccggctctcccggggatgccccggagaggccgccgctttgcgactttagtgaggggctttcagccccaatggacttctaccgctttaccgtcgagagtccaagcactgttacatcaggtggcggccaccatgaccctgcagggcttggccaaccgctgcatgttcctagtagccctgaggctgctggccaagaagaagagggaggaggaggagagggacagacgcctcggcccctagaggataccacgagggaggctcaggagctggaggcccagctgtccctggtcagggaggggcctgtgtctgagccagagcctgggacccaggaggttctctgccagctcaagcgagaccagcccagcccgtgtctgagtagcgctgaggattctggggtggatgagggacaggggagcccttcggagatggtccattcctcggagttcagagtagacaacaatcacctgctcctgctcatgatccacgtgttccgagaaaacgaagagcagctgttcaaaatgatccggatgagcaccgggcacatggagggcaacctgcagctgctgtacgtgctgctcacagactgctatgtctacctgctccggaaaggggccacagagaagccatacctggtggaagaggccgtttcttacaatgaacttgactatgtgtcggttggccttgaccagcagacggtgaagctggtgtgcaccaaccgcaggaagcagtttctgctggacacggctgatgtggcgctggctgagttctttttggcttctttgaagtcagccatgatcaaaggctgtcgagaacctccctaccccagcatcctgacggatgccaccatggagaagctggcactggccaaatttgtggcccaagaatcgaagtgtgaggcatctgctgtcaccgtgcgcttctacggccttgtgcactgggaggaccccacagacgagtccctgggccccacgccctgccactgctcaccccccgagggcaccatcaccaaagaaggcatgctgcactacaaggcgggcacctcctacctgggcaaggaacactggaagacgtgcttcgtggtgctcagcaacgggatcctctaccagtacccggaccgcaccgacgtcatccctctgctctcggtgaacatggggggggagcagtgcggtggctgccggagagccaacaccacggatcggccccacgccttccaggtcattctctccgaccggccctgcctggagctaagtgccgagagcgaggccgagatggccgagtggatgcagcatctctgccaggctgtgtccaaaggggtcatcccccagggcgtagctcccagcccctgcataccctgctgcctggtcctcacggatgaccgcctctttacgtgccatgaggattgccagaccagcttcttccgctctttgggcacagccaagctgggcgacatcagcgccgtctccaccgagccgggcaaggagtactgcgtcttggagttctcccaggacagccagcagctcctcccgccctgggtcatctacctgagctgcacttctgaactggaccgattgctgtctgcactgaactctgggtggaaaaccatctatcaggtggacctcccccacacggcgatccaggaagcctccaacaagaagaaattcgaggatgccttgagcctcatccacagcgcctggcagcggagcgacagtctctgccgcggccgagcctcccgagacccctggtgctgaggcagagctggttggcgtccctggtgggcaggaaaggaaggcacgccagccggcaggcacactgtcacggctgttgtcatgctgtcgggagcctacagtccacccctgccctgggcggcagaaccaccgagtgtggcttaagacagggtccctccactccagggatccagatcaggtgcccggcacccctgggcatcctgcccgacaggtagcgaatggaggtcgctgggggcagagggtccgagccctgtgggctctgcggatgcacgccctcctcccgggcctccgcctcagtctgcagaatttctgccgagtggcaccgagaacaccatccatctaaggacgaacaaaagaaccaggagggcgggacccccctcttcctctcctgggttgggggctggggccctgagtgcccagccatccttgttcgtgtttgaacactctcctggccacgtggggaagcgggaacacggggtgtctgcgcatgtttcctcctcctagctccatcactgcgcacacagctgcctgcctcgccagatgcaggggggcgggcagccctccctggctgccaggaggctctgcatgcccacagtcctgccctgcctgtcccctcaacccggcagtgcctgtagcaccgaggagcaaagggggtggatggggggcttggagaagggcggagcccaccagcctggcatccatgttgacatcttctgactgtcccctgcttggctggagccaggcccttccctagagtttcgtcaagagcctcctggggaaggggtcaggtggtttgggttttgttttttaaaataaaatagacatgttatattgccaa

SEQ ID NO: 1966 - DNA, 1981 bp, Homo sapiens
tgcttttgctgtgagcagccccaagcagctgggcgctccatcagaggcaactatgacttttgcaaagcaaacgtgcaaccccaagcagcggtctcccgggccggggctgcgcggccgccgctgtgctggcttttaacggtgggagggcaccatcctcttgctctgctctcgttctccagaaggctgtcccggggcccccactctccgtcccgctccggggacagtggctcgcctgctatgcgcggcagcccgcgccggggccggcaccagcagcgcccgggcggatgcagcgagcccacggaggggcatgcttccacgcaccaagtataaccgcttcaggaatgactcggtgacatcggtcgatgaccttctccacagcctgtcggtgagcggcggcggaggcaaggtttcggcggcgcgcgcgaccccggcggcggctccctacttggtgtccggcgaggcgctgcgcaaggcgcccgacgatgggcccggcagcctgggccacctgctccacaaggtgtcccacctgaaactctccagctcgggcctccgcggcctgtcgtcggccgcccgggagcgggcgggcgcgcggctctcgggcagctgcagcgcgcccagcctggccgccccggacggcagtgcgccctcggcgccccgcgccccggccatgagcgccgccaggaagggccggcccggcgacgagccgctgcccaggccccctcggggggcgccgcacgccagcgaccaggtgctggggcccggagtcacctacgtggtcaagtacttggggtgcattgaagttctgcgctcaatgaggtctcttgacttcagtacaagaacacaaattaccagggaagccatcagccgcgtctgtgaagctgtgcctggtgcgaagggagccttcaagaagagaaagcctccaagcaaaatgctgtccagcatcttgggaaagagcaacctccagtttgcgggaatgagcatctctctgaccatctccacggccagtctgaacctgcgaactccggactccaaacagatcatagcgaatcaccacatgcggtccatctccttcgcctctgggggagacccggacacaactgactatgttgcatatgtggctaaggaccctgttaatcgcagagcttgtcacattttggaatgctgtgatgggctggcccaggatgtcatcggctccatcggacaagcctttgagctccggtttaagcaatatttacagtgtcctaccaagattcccgctctccatgatcgaatgcagagtctggatgagccatggacggaagaggagggagatggctcagaccacccatactacaacagcatcccaagcaagatgcctcctccagggggctttcttgatactagactgaaacccagaccccatgctcctgacacagcccagtttgcaggaaaagagcagacttattaccagggaagacacttaggagacacttttggcgaagactggcagcaaacacctttaaggcaagggtcctcggacatctacagcacgccagaagggaaactgcacgtggcccccacgggagaagcacccacctacgtcaacactcagcagatcccaccacaggcctggccggctgcggtcagcagtgctgagagcagcccaaggaaagacctctttgacatgaaaccttttgaagatgctctcaagaaccagcccttggggcccgtgttaagcaaggcagcctccgtggagtgcatcagccctgtgtcacctagagccccagatgccaagatgctggaggaactgcaagccgagacttggtaccaaggagagatgagcaggaaggaggcagaggggctgctggagaaagacggagacttcctggtcaggaagagcaccaccaacccgggctcctttgtcctcacgggcatgcacaatggccaggccaagcacctgctgctcgtggacccagaaggcacgagaagtaactcctactga

SEQ ID NO: 1967 - DNA, 569 bp, Homo sapiens
cccacgggagaagcacccacctacgtcaacactcagcagatcccaccacaggcctggccggctgcggtcagcagtgctgagagcagcccaaggaaagacctctttgacatgaaaccttttgaagatgctctcaagaaccagcccttggggcccgtgttaagcaaggcagcctccgtggagtgcatcagccctgtgtcacctagagccccagatgccaagatgctggaggaactgcaagccgagacttggtaccaaggagagatgagcaggaaggaggcagaggggctgctggagaaagacggagacttcctggtcaggaagagcaccaccaacccgggctcctttgtcctcacgggcatgcacaatggccaggccaagcacctgctgctcgtggacccagaaggcacgagaagtaactcctactgatgttggccatccctggcactacagctgtatctgaataatcccgtaggtttggctgaatttttcatcttcccgtcaagaaagacattcatctttacctggggcatagtccaagaattgctaagtttaataaatgcagttaaatc

SEQ ID NO: 1968 - DNA, 2394 bp, Homo sapiens
tgcttttgctgtgagcagccccaagcagctgggcgctccatcagaggcaactatgacttttgcaaagcaaacgtgcaaccccaagcagcggtctcccgggccggggctgcgcggccgccgctgtgctggcttttaacggtgggagggcaccatcctcttgctctgctctcgttctccagaaggctgtcccggggcccccactctccgtcccgctccggggacagtggctcgcctgctatgcgcggcagcccgcgccggggccggcaccagcagcgcccgggcggatgcagcgagcccacggaggggcatgcttccacgcaccaagtataaccgcttcaggaatgactcggtgacatcggtcgatgaccttctccacagcctgtcggtgagcggcggcggaggcaaggtttcggcggcgcgcgcgaccccggcggcggctccctacttggtgtccggcgaggcgctgcgcaaggcgcccgacgatgggcccggcagcctgggccacctgctccacaaggtgtcccacctgaaactctccagctcgggcctccgcggcctgtcgtcggccgcccgggagcgggcgggcgcgcggctctcgggcagctgcagcgcgcccagcctggccgccccggacggcagtgcgccctcggcgccccgcgccccggccatgagcgccgccaggaagggccggcccggcgacgagccgctgcccaggccccctcggggggcgccgcacgccagcgaccaggtgctggggcccggagtcacctacgtggtcaagtacttggggtgcattgaagttctgcgctcaatgaggtctcttgacttcagtacaagaacacaaattaccagggaagccatcagccgcgtctgtgaagctgtgcctggtgcgaagggagccttcaagaagagaaagcctccaagcaaaatgctgtccagcatcttgggaaagagcaacctccagtttgcgggaatgagcatctctctgaccatctccacggccagtctgaacctgcgaactccggactccaaacagatcatagcgaatcaccacatgcggtccatctccttcgcctctgggggagacccggacacaactgactatgttgcatatgtggctaaggaccctgttaatcgcagagcttgtcacattttggaatgctgtgatgggctggcccaggatgtcatcggctccatcggacaagcctttgagctccggtttaagcaatatttacagtgtcctaccaagattcccgctctccatgatcgaatgcagagtctggatgagccatggacggaagaggagggagatggctcagaccacccatactacaacagcatcccaagcaagatgcctcctccagggggctttcttgatactagactgaaacccagaccccatgctcctgacacagcccagtttgcaggaaaagagcagacttattaccagggaagacacttaggagacacttttggcgaagactggcagcaaacacctttaaggcaagggtcctcggacatctacagcacgccagaagggaaactgcacgtggcccccacgggagaagcacccacctacgtcaacactcagcagatcccaccacaggcctggccggctgcggtcagcagtgctgagagcagcccaaggaaagacctctttgacatgaaaccttttgaagatgctctcaagaaccagcccttggggcccgtgttaagcaaggcagcctccgtggagtgcatcagccctgtgtcacctagagccccagatgccaagatgctggaggaactgcaagccgagacttggtaccaaggagagatgagcaggaaggaggcagaggggctgctggagaaagacggagacttcctggtcaggaagagcaccaccaacccgggctcctttgtcctcacgggcatgcacaatggccaggccaagcacctgctgctcgtggacccagaaggcacgatccggacaaaggacagagtctttgacagtatcagccacctcatcaaccaccacctagaaagcagcctgcccattgtctctgcagggagtgagctgtgtctccagcagccagtggagaggaagcagtgacctggccagcactgctcccagcactgcgcaccaggtcaggaggacctggagtggactagaatcggggctgctggaactgggacagctgcctgtggctcagagccttcttcaaaagcttcaaaaggaaggcttcctttaaggtcaagtttcataaacttggttctgaatttctcatatgcatattaaaggtgtacatacctatacatcctgtacaaattatccctctatatttatattttttaagactaagaaagatgtaagactaatgttctgtgctgtatgtttttaatgaaaaaaaaaaa

SEQ ID NO: 1969 - DNA, 2402 bp, Homo sapiens
gaggtgggggcgggggccttaccccaccctggcaccggcaggcgcgggcggatggggggatgtcgcctagagccccccggccggcccacaaactcccgtcccccttccggctctgcctggacgtccctgcgggccccgggggaaagcacccaacttctcccgcctcggcttctagcagaaacgtgacggggctggactttgatcgccgagggctctctgctcttcagagtctgcttggaacgggataagagggatggtgccatccagggaagctctgctgggaccaggcacaactgccattaggtgccccaagaaattacagaaccaaaattacaagggccatggattgtcaaagggaaaagagcgagagcagagagcatcgatccggttcaagaccaccctcatgaacacactcatggacgtccttcgccacaggccaggatgggtggaagtgaaggacgaaggggagtgggatttctactggtgtgacgtcagctggctccgggagaacttcgaccacacctacatggatgaacatgtgcggatcagtcacttccggaaccactatgagctgacccggaagaactacatggtgaagaacctgaagcggttccggaagcagctggagcgtgaggcaggaaagctggaggcagccaagtgtgacttcttccccaaaacctttgagatgccttgcgagtaccacctgtttgtagaggagtttcgcaaaaacccaggaatcacctggatcatgaagcctgacacaagaagctctgacgaccagaaagatgatattcccgtggagaactatgtggctcagcgttacattgaaaatccttacctgataggaggccgcaagtttgacctgcgtgtctatgtgctggtgatgtcgtacatcccgctgcgggcctggctctaccgggatggctttgcccgattctccaacacccgcttcacactgaacagcattgatgaccagtatgttcacctcaccaacgtggctgtgcaaaaaacatctcccgactaccacccaaagaaggtggctcctggaggtcaatgcgtccccatcactgacagccagcagccaggaagactatgagctcaagacctgcctcctggaagacaccctgcatgttgtggacatggaagcgaggctcacgggaagggagaagcgagtcgggggctttgacctcatgtggaatgatggccctgttagcagagaggagggggctcctgacctgtcgggaatgggaaactttgtgaccaacacacatctcggctgcgtcaacgatcggaagaaacaactgaggcagctcttctgctcccttcaagttcagaagaaagcttccagttgatccccagctgccaggaggaaatcagccttagcaggccttgtgtttgagattgggagctgagccagaaaccggaaaaccctgggctcatgggcaggacagcttcgggagttgagtgtcaagcccgaagggaagacttttggaaggaaaatactggcaaatccaagaagtgaaccagccgactttaggaaagccagaagccaggctactctagaccttctgccttcagagcatgaggacttctcccactcatccctgtacctgaggcacaccaacccagacaggtccaggcatggactccaggttccctatttccagaaggaatgcgattagctttttttggcccagcacccaccctgccagggaggaaggggcaattttccagtgatgaaattgtgaatcaggcagtcacactggacaacatctagcaaggtgaattctgcaactccctactttatttacattttaaaataagcaatatattcatacggtttaaaatccaaagtttacaaaagggtatagggtgacatctccttccctcccacctgtgcgccccaaccctgcaggtgctgttctgagggaatcacactgtgcttgcacaaaaattattagcttataagacaccagccttccccttgctttcctcacttgatgtatcttggagcttgttccttattcttgattatagttgtatggtattgcactatctggagctaacacctgtgacccacactcatgttttaaaagtttctgcattagtcaaaaatatttaaaaggagattcaacttcacaacccatatgtctagcttctcttgaaaacacgtaagaactggccatgacagcctgtgtttctatgtaactatgagccagagccaaggagcggggggaccaggagaggtgtgcccctgccatgctgccatttgttatcacccgcctgtcaaatcacaggtttatttcaaggcaagaaccatgttcataggttgtattctaaatggagtggcgtgcccttactgaaggactagatgaggcaaataaagactagttgctgctatt

SEQ ID NO: 1970 - DNA, 1514 bp, Homo sapiens
aagcacgcgaggcgcgcggtggcggtttggatctggcccctggggaatcgcgttatgtcgcgaccgaagagagcagagagcatcgatccggttcaagaccaccctcatgaacacactcatggacgtccttcgccacaggccaggatgggtggaagtgaaggacgaaggggagtgggatttctactggtgtgacgtcagctggctccgggagaacttcgaccacacctacatggatgaacatgtgcggatcagtcacttccggaaccactatgagctgacccggaagaactacatggtgaagaacctgaagcggttccggaagcagctggagcgtgaggcaggaaagctggaggcagccaagtgtgacttcttccccaaaacctttgagatgccttgcgagtaccacctgtttgtagaggagtttcgcaaaaacccaggaatcacctggatcatgaagcctgacacaagaagctctgacgaccagaaagatgatattcccgtggagaactatgtggctcagcgttacattgaaaatccttacctgataggaggccgcaagtttgacctgcgtgtctatgtgctggtgatgtcgtacatcccgctgcgggcctggctctaccgggatggctttgcccgattctccaacacccgcttcacactgaacagcattgatgaccagtatgttcacctcaccaacgtggctgtgcaaaaaacatctcccgactaccacccaaagaagggctgcaagtggacgctgcagcgcttccggcagtacctggcgtccaaacacgggcccgaggcagtggagacactcttcagggacatcgacaacatctttgtcaaaagcctgcagagtgtgcagaaggtgatcatcagtgacaagcactgcttcgagctgtacggctatgacatcctcatcgaccaggacctcaagccgtggctcctggaggtcaatgcgtccccatcactgacagccagcagccaggaagactatgagctcaagacctgcctcctggaagacaccctgcatgttgtggacatggaagcgaggctgcgtcaacgatcggaagaaacaactgaggcagctcttctgctcccttcaagttcagaagaaagcttccagttgatccccagctgccaggaggaaatcagccttagcaggccttgtgtttgagattgggagctgagccagaaaccggaaaaccctgggctcatgggcaggacagcttcgggagttgagtgtcaagcccgaagggaagacttttggaaggaaaatactggcaaatccaagaagtgaaccagccgactttaggaaagccagaagccaggctactctagaccttctgccttcagagcatgaggacttctcccactcatccctgtacctgaggcacaccaacccagacaggtccaggcatggactccaggttccctatttccagaaggaatgcgattagctttttttggcccagcacccaccctgccagggaggaaggggcaattttccagtgatg

SEQ ID NO: 1971 - DNA, 1263 bp, Homo sapiens
aagcacgcgaggcgcgcggtggcggtttggatctggcccctggggaatcgcgttatgtcgcgaccgaagaaccaaaattacaagggccatggattgtcaaagggaaaagagcgagagcagagagcatcgatccggttcaagaccaccctcatgaacacactcatggacgtccttcgccacaggccaggatgggtggaagtgaaggacgaaggggagtgggatttctactggtgtgacgtcagctggctccgggagaacttcgaccacacctacatggatgaacatgtgcggatcagtcacttccggaaccactatgagctgacccggaagaactacatggtgaagaacctgaagcggttccggaagcagctggagcgtgaggcaggaaagctggaggcagccaagtgtgacttcttccccaaaacctttgagatgccttgcgagtaccacctgtttgtagaggagtttcgcaaaaacccaggaatcacctggatcatgaagcctgtagcccggtctcaagggaaaggcatcttcctcttccgtaggctgaaggacatcgtggactggaggaaggacacaagaagctctgacgaccagaaagatgatattcccgtggagaactatgtggctcagcgttacattgaaaatccttacctgataggaggccgcaagtttgacctgcgtgtctatgtgctggtgatgtcgatgttcacctcaccaacgtggctgtgcaaaaaacatctcccgactaccacccaaagaagggctgcaagtggacgctgcagcgcttccggcagtacctggcgtccaaacacgggcccgaggcagtggagacactcttcagggacatcgacaacatctttgtcaaaagcctgcagagtgtgcagaaggtgatcatcagtgacaagcactgcttcgagctgtacggctatgacatcctcatcgaccaggacctcaagccgtggctcctggaggtcaatgcgtccccatcactgacagccagcagccaggaagactatgagctcaagacctgcctcctggaagacaccctgcatgttgtggacatggaagcgaggctcacgggaagggagaagcgagtcgggggctttgacctcatgtggaatgatggccctgttagcagagaggagggggctcctgacctgtcgggaatgggaaactttgtgaccaacacacatctcggctgcgtcaacgatcggaagaaacaactgaggcagctcttctgctcccttcaagttcagaaga

SEQ ID NO: 1972 - DNA, 1290 bp, Homo sapiens
ataagcacgcgaggcgcgcggtggcggtttggatctggcccctggggaatcgcgttatgtcgcgaccgaagaaccaaaattacaagggccatggattgtcaaagggaaaagagcgagagcagagagcatcgatccggttcaagaccaccctcatgaacacactcatggacgtccttcgccacaggccaggatgggtggaagtgaaggacgaaggggagtgggatttctactggtgtgacgtcagctggctccgggagaacctggagcgtgaggcaggaaagctggaggcagccaagtgtgacttcttccccaaaacctttgagatgccttgcgagtaccacctgtttgtagaggagtttcgcaaaaacccaggaatcacctggatcatgaagcctgtagcccggtctcaagggaaaggcatcttcctcttccgtaggctgaaggacatcgtggactggaggaaggacacaagaagctctgacgaccagaaagatgatattcccgtggagaactatgtggctcagcgttacattgaaaatccttacctgataggaggccgcaagtttgacctgcgtgtctatgtgctggtgatgtcgtacatcccgctgcgggcctggctctaccgggatggctttgcccgattctccaacacccgcttcacactgaacagcattgatgaccagtatgttcacctcaccaacgtggctgtgcaaaaaacatctcccgactaccacccaaagaagctccatcccacagtggggcccttgtgcatacacagccctgaaaatggcagcctgtcggtcactccttggccttgggatgcacacatgggctgcaagtggacgctgcagcgcttccggcagtacctggcgtccaaacacgggcccgaggcagtggagacactcttcagggacatcgacaacatctttgtcaaaagcctgcagagtgtgcagaaggtgatcatcagtgacaagcactgcttcgagctgtacggctatgacatcctcatcgaccaggacctcaagccgtggctcctggaggtcaatgcgtccccatcactgacagccagcagccaggaagactatgagctcaagacctgcctcctggaagacaccctgcatgttgtggacatggaagcgagcttttccccgattattccagcagaagtttgagggctgattctccttgctggtaactgggacacattcccattcctaaaccactcactgtgactctgcttgaccaggctcacgggaagggagaagcgagtcgggggctttgacctcatgt

SEQ ID NO: 1973 - DNA, 2623 bp, Homo sapiens
gaggtgggggcgggggccttaccccaccctggcaccggcaggcgcgggcggatggggggatgtcgcctagagccccccggccggcccacaaactcccgtcccccttccggctctgcctggacgtccctgcgggccccgggggaaagcacccaacttctcccgcctcggcttctagcagaaacgtgacggggctggactttgatcgccgagggctctctgctcttcagagtctgcttggaacgggataagagggatggtgccatccagggaagctctgctgggaccaggcacaactgccattaggtgccccaagaaattacagaaccaaaattacaagggccatggattgtcaaagggaaaagagcgagagcagagagcatcgatccggttcaagaccaccctcatgaacacactcatggacgtccttcgccacaggccaggatgggtggaagtgaaggacgaaggggagtgggatttctactggtgtgacgtcagctggctccgggagaacttcgaccacacctacatggatgaacatgtgcggatcagtcacttccggaaccactatgagctgacccggaagaactacatggtgaagaacctgaagcggttccggaagcagctggagcgtgaggcaggaaagctggaggcagccaagtgtgacttcttccccaaaacctttgagatgccttgcgagtaccacctgtttgtagaggagtttcgcaaaaacccaggaatcacctggatcatgaagcctgtagcccggtctcaagggaaaggcatcttcctcttccgtaggctgaaggacatcgtggactggaggaaggacacaagaagctctgacgaccagaaagatgatattcccgtggagaactatgtggctcagcgttacattgaaaatccttacctgataggaggccgcaagtttgacctgcgtgtctatgtgctggtgatgtcggtgtttgctgaatgcctgctgtggtctgggcacaggagacaggatgttcacctcaccaacgtggctgtgcaaaaaacatctcccgactaccacccaaagaagggctgcaagtggacgctgcagcgcttccggcagtacctggcgtccaaacacgggcccgaggcagtggagacactcttcagggacatcgacaacatctttgtcaaaagcctgcagagtgtgcagaaggtgatcatcagtgacaagcactgcttcgagctgtacggctatgacatcctcatcgaccaggacctcaagccgtggctcctggaggtcaatgcgtccccatcactgacagccagcagccaggaagactatgagctcaagacctgcctcctggaagacaccctgcatgttgtggacatggaagcgaggctcacgggaagggagaagcgagtcgggggctttgacctcatgtggaatgatggccctgttagcagagaggagggggctcctgacctgtcgggaatgggaaactttgtgaccaacacacatctcggctgcgtcaacgatcggaagaaacaactgaggcagctcttctgctcccttcaagttcagaagaaagcttccagttgatccccagctgccaggaggaaatcagccttagcaggccttgtgtttgagattgggagctgagccagaaaccggaaaaccctgggctcatgggcaggacagcttcgggagttgagtgtcaagcccgaagggaagacttttggaaggaaaatactggcaaatccaagaagtgaaccagccgactttaggaaagccagaagccaggctactctagaccttctgccttcagagcatgaggacttctcccactcatccctgtacctgaggcacaccaacccagacaggtccaggcatggactccaggttccctatttccagaaggaatgcgattagctttttttggcccagcacccaccctgccagggaggaaggggcaattttccagtgatgaaattgtgaatcaggcagtcacactggacaacatctagcaaggtgaattctgcaactccctactttatttacattttaaaataagcaatatattcatacggtttaaaatccaaagtttacaaaagggtatagggtgacatctccttccctcccacctgtgcgccccaaccctgcaggtgctgttctgagggaatcacactgtgcttgcacaaaaattattagcttataagacaccagccttccccttgctttcctcacttgatgtatcttggagcttgttccttattcttgattatagttgtatggtattgcactatctggagctaacacctgtgacccacactcatgttttaaaagtttctgcattagtcaaaaatatttaaaaggagattcaacttcacaacccatatgtctagcttctcttgaaaacacgtaagaactggccatgacagcctgtgtttctatgtaactatgagccagagccaaggagcggggggaccaggagaggtgtgcccctgccatgctgccatttgttatcacccgcctgtcaaatcacaggtttatttcaaggcaagaaccatgttcataggttgtattctaaatggagtggcgtgcccttactgaaggactagatgaggcaaataaagactagttgctgctatt

SEQ ID NO: 1974 - DNA, 800 bp, Homo sapiens
gggagagggaaggtcaggcttgcctcctgttcacaaggacaacctctgtctcccttgtggcggcttctatgaaggtggggactccaggctttctctcgtctgctttttggatgccttcaagagaggccagttagaggatatcaattgtggcaattccccagagccctcatcagatggcattagcccgtcatgtgctgcagtggcacccagtttggaggaaattcggaaccagaagagtgtgacagtgctcctgcgggaagaagtgtcgcggctccaggaggaagttcaccttctccggcagatgaaggagatgttggcgaaggacctggaggagtcgcagggcggcaagtcctctgaggtcctctcggccaccgagctcagggtccagctggcccagaaggagcaggagctagccagagccaaagaagccttgcaggccatgaaagctgatcggaagcgcttaaagggcgagaagacagacctggtgagccagatgcagcagctgtatgccacactggagagccgcgaggagcagctccgagacttcatccgcaactatgagcagcaccgcaaggagagcgaggatgcggtcaaagcgctggccaaggagaaggacctgctggagcgtgagaagtgggagctgcggcgccaagccaaggaggccacagaccacgccacggcactgcgctcccagctggacctcaaggacaaccggatgaaggagctggaggccgagctggccatggccaaacagtccttagctacgctgaccaaggacgtccccaagcggcattccctcg

SEQ ID NO: 1975 - DNA, 6030 bp, Homo sapiens
gcgcccgcccgccggggtctcggcgatcgctgctcctcctcctccttctcctcctcttttttctcctccgcctcctccccccgccgcctcgccaccgccgcggctagggctggaggcgccgctgtcattcctgtgccggaggaaccggcgctgccggtgcctgggggtcggggcgcgggcgaagccgggccgcggaggacacaacaggtagagccgggggtgcccggccgcgcgccccccgcgcatcatgcagctctttgtcacctctctcgcccccaggccaaaatcctgagcatgatggaagacaataagcagctcgcgctccgcatcgatggggcggtccagtcggccagccaggaggtgaccaacctgcgagccgaactcacggccaccaaccggagactggcggaactgagcggcggcggcggccccggcccgggcccgggagccgcggccagcgcctcggcggcgggggactcggcggcgacgaacatggagaacccccagcttggagcgcaagtgctcctgcgggaagaagtgtcgcggctccaggaggaagttcaccttctccggcagatgaaggagatgttggcgaaggacctggaggagtcgcagggcggcaagtcctctgaggtcctctcggccaccgagctcagggtccagctggcccagaaggagcaggagctagccagagccaaagaagccttgcaggccatgaaagctgatcggaagcgcttaaagggcgagaagacagacctggtgagccagatgcagcagctgtatgccacactggagagccgcgaggagcagctccgagacttcatccgcaactatgagcagcaccgcaaggagagcgaggatgcggtcaaagcgctggccaaggagaaggacctgctggagcgtgagaagtgggagctgcggcgccaagccaaggaggccacagaccacgccacggcactgcgctcccagctggacctcaaggacaaccggatgaaggagctggaggccgagctggccatggccaaacagtccttagctacgctgaccaaggacgtccccaagcggcattccctcgccatgccgggcgagacggtgctcaatggcaaccaggagtgggtggtgcaggcggacctcccgctgaccgcagccatccggcagagtcaacagactctctaccactcacacccccctcaccctgcggaccggcaagcggtcagggtgagcccctgccactcccggcagccctctgtcatctccgacgcatctgccgccgaaggcgaccggtcgtccacaccgagcgacatcaactcccctcgacaccggacacactccctctgcaacggcgacagtcccggcccagttcagaagaacctgcacaaccctattgtacagtcactagaggatcttgaagaccaaaaacggaaaaagaagaaagagaagatgggattcggctccatctcccgcgtcttcgccagagggaagcagcggaagtccctcgaccccggcctctttgatgactcggacagccagtgcagccccacgcggcagagcctcagcctgtcggaaggcgaggagcagatggaccggctgcagcaggtggagctggtgaggaccacccctatgtcccactggaaggcgggcaccgtccaggcctggctggaggtggtgatggccatgcctatgtacgtcaaggcctgcacggagaacgtgaagagcgggaaggtgctgctgagcctgagtgacgaggacctgcagctgggccttggggtgtgcagctccctgcaccggcgcaagctgcgcctggccatcgaggactaccgtgatgccgaggcaggccgcagcctgtccaaagctgccgagctggaccatcactgggtggccaaggcctggctgaatgacattggcctgtcccagtactcccaggcctttcagaaccacctggttgatgggcggatgctgaattccctgatgaagcgagacctggagaagcacctgaacgtgtccaagaagttccaccaggtcagcatcctgctggggatcgagctgctgtaccaagtgaacttcagcagggaggccctccaggagcgccgggcccgctgcgagacgcagaacattgaccccgtggtgtggaccaaccagcgggtgctcaagtgggttcgagacatcgacctgaaggagtacgcagacaacctgaccaacagcggcgtccatggtgctgtgctggtgctggagcccacattcaatgccgaggccatggccactgccctgggcatccccagtgggaagcacatcctccggagacacctggcagaggagatgagcgccgtcttccacccagccaactccacaggcatccgggaggctgagcgttttggaacgccccctggcagggcctccagcgtcacgcgggcaggaaaggaggagaacagcagcggtctcaagtacaaggctggccggctgcccctggggaagataggaaggggcttcagcagcaaagatcccgatttccatgatgactatggctctcttcaaaacgaagattgcggagacgatgacccccagagcaggctggaacagtgccgtctggaaggctacaacagcctggaggtcaccaacgtgtaaggaactggtggctccaccagacccaacgtgagagacccaggaaggaagagaagccagatggccccaggtgtcgttctcactgtacatagcggccgcaggctgaggatgtcccttgctcctgggcaaaatcccgatggactctgcggtttcagctccacagcgcccaggagagagaagacaccagcccacctgtcttgggtgggccatggactttcctgttcagctggagatgggcccagaggacctgtcacagtgtccggccctgcctccatccaggatacacaggctccacctcagagtgaccgtcactgtggagcagccaagcagtccctggagccttaaacggagctgccaaggtgggaggaggcccacagttccctaaaacacccttccggcgggagcaggggggaccccaaccccacaccccagcgcccagtgcattggcagagccgggtgcaggaagtgctgcctcttgccgagacgtcggacagggcgggggttggggaactctcggctacagcatcttacccttgactgagaacttgggtcctgacttggctcactgaatctctcttgggagaatgcaaaatccttccacctgaaaagctctgtgacacatgggggtggacgtattgaagagctgtttgccgatccacccaggagtggctacgctgagtggggagccggtgaatgatccgtgcaggagtggggcttagcagccacatttctaggagatgcagatatcctatcaccagaatgaaagctattgggacaacaggatcggggatgaccgacggccccatatggtgaatctctggcctgtggtttggctttactgagattccaaaccccactatctgcactccgtgacagtggtatggagtgtggcaatgagtttggggtctggggcagggaaatgcttgacattgttaacccaacaaacctttgttgtgatgtccctgtcacctgaaacataggtgacatagctcaccaatgtcctaaccgagacacaaactccacagagcaaaatcatttggtattggtggggagaaccccagcccttttcttgacctgccactgttatgctgtgtggcttcttcccagtggcctcacctctctgtgcctcgatgtcttcatctacgatacttctggttccctcccagggacatcgtgaggattaacacttgctaatatctgtaacacaatttgtaacctctcaggagacaatgggaagttatggggtagctaatttcccatttacaacacagaaatgatatagagctagttcgctccaactctttaggttgaagcagtgtgcaaaaggaagaaaagaaatgtttaatgttcagacctgccaagagcctccaacagggctcaagaaacatataaatcccatgagcacagccttgaaaaccagtttgactcaagccttcgggcctcagttcattgaccagatgacagccacgtgatgattagggaaggacggatgcattgcgattctgcttacacatcgggttatcaaagcgagtcacttgttggaaccatgatgctcgacctccttcaaggccgtttgcactggggcttgagtttccaagattcacaacaggtgtcagcctctgagaaccctcaaagcgtgtgttcttcaacctggcaaattgtttcctctcatgggggaagccgagctctgatgaacttgagaattacacctctctcatgccgaagaccgtggtgttccccctaatgacataaacgcagcctttcttgctgtctgagaccaaatgtctagttggtagacaggtggatgtttggcctcctaagggcacacttctgatcctgggccccaggtggtgaatctctggcatgtggcttggctttgttgagactccaaattccattatcttcatgacattcggcctcatccatagggtcctgaagctgcagtccacagctcagaaaggagaggtgagacctccctccaacctggtgccacaggtctctcccaagccacatccagcctggatgacctgggaccccagaaactgccgtttgggaggcagcaacagcaacgtgcccaggcaggcagttattcccacagagtgagccagaattgtagcagggcacttgaatgcagagctgatgatttgaaaccaacgttcacccaacttgtcagaaatggcacttacatggttcgatcttgctggagacaagtggacaattgggggtcactggcagagacagtattgcccaaaatgttcacagcaggaggccagcaggcctgaggcaacacgggcaaccgcgaatgcctcttttggtttaaattatgccatcacaaccctctttcacccatgaggctccccatccctgacagccaggtgagcatttggagctggtttctcaacatgaggatgggttggttgttaaattaacaacctccacagtatcagattgagtgagctttgtctgctggaaaaacctgaaacgtcaactctgcttcaaggtcggcaagaagaacagaaggcggagacttggcagagagactcaagctgattgtcacaggctacagaggggccagctccagaacagtgaccagctacatcctgtccaagcagcccgagtgtggtcttggtccctgcagggcaatgtgggcatctggacctggggacgatgtggatgcacttcttggaaagctgttgtagcttgtgcctgtgggtggagaaggcacctgcctggtagactctcagctttctgacccccaggagcctctgcgaggcccctttgtccttggctgagccggacctttcttttggaaatctgtctgtctgttggcatcgctgttttcagaccccaggctgcagaggaggggagaagccacacaacaatctggacccaataaagtggagagaagggcgtctctacacagcccggccagcgtggagggccccaggacagggacccaaaagcttgacgtcactgaacagggctgggtactggcagaacaggaagatttggccagaggtgacctcagtgttccctccaggggcatccaggcccctctgacctggggagaagaaggcccatgctcaggcccacctccctcttcccatcagagcccatgcgtcctgggcaccaccacttccactctgcttttcgaggctccggagggctcttcctgctgtgaaaggaaaggagaagaaagcctgtgggcaatggcaacctctgagtctggcattcttgccaatggctggccagcgaggagaatctcccgagccctgacacacaaaggcattttgtggctgcagaggaaatgggttggctctgaacaaagatgcagtttctagggccgtggccccaaatcgcttccccgagagtgaattttaacactgtaacaataaatactactgcacagca

SEQ ID NO: 1976 - DNA, 1030 bp, Homo sapiens
ggggaatcacttgcaaggtccacacaagtccgcctatgtactctctggatcgaatatttgctggatttcgaacacgaagtcagatgctgttgggtcacatagaagaacaagataaggtcctccactgccaattttctgataacagtgatgatgaagaatcagaaggccaagagaaatctggaactagatgtagaagtcgttcatggattcagaagccagactctgtttgttcccttgttgaattgagtgatactcaggatgaaacacaaaagtcagatttggagaatgaagatttaaagattgattgtctccaggagagtcaagaattgaatttgcaaaaattaaagaattcagaacgcatacttactgaagctaaacaaaaaatgagagaacttacaattaacatcaagatgaaggaagatctgattaaagaattaataaaaacaggtaatgatgccaagtctgtaagcaagcagtattctttgaaagtaacaaagctagagcatgatgcagaacaggcaaaagtcgaactgattgaaacacaaaagcagctacaggagctggaaaacaaagatctttctgatgttgcaatgaaggtaaaattacagaaagagtttcgtaaaaagatggatgctgcaaagctgagagttcaggtcttgcagaagaagcaacaagatagtaagaaactggcatcactgtcaatccaaaatgagaaacgtgctaatgagctagagcagagtgtagatcacatgaaatatcaaaagatacagctacaaagaaaactacgagaagaaaatgaaaaaaggaagcaactggatgcagtaattaagcgggaccagcaaaaaatcaaagtaatattgtcatacattcctgctaagtataatatgaaatgttaaacggctcagagctaacgaatccatggtcttcattcagttggcttgtgaagtatctatccttgacctgcccttcactgctgtccttattcactttaaagctttgttcatctacgtagtaaaacctacttattgaa

SEQ ID NO: 1977 - DNA, 6243 bp, Homo sapiens
aggtggcagcgcttgcagtcgggctacggaggccgggttgccagattacgggaaagccatttaagaagttcctggaataatattagtcagagtaatataggatctgcaggaagtgtctcaagatagttggaaaagaagaatttctagactcttcatcaagatcttcatttatacagctgttaaatccaaggctactttggtgaaagcatgaataaaaatacatctactgtagtatcacccagtctacttgaaaaggatcctgcctttcagatgattacaattgccaaggaaacaggccttggcctgaaggtactaggaggaattaaccggaatgaaggcccattggtatatattcaggaaattattcctggaggagactgttataaggatggtcgtttgaagccaggagatcaacttgtctcagtcaacaaggaatctatgattggtgtatcatttgaagaagcaaaaagcataattaccggagccaagttgaggttagaatctgcttgggagatagcattcataagacaaaaatccgacaacattcagccagaaaatctgtcatgtacatcacttatagaagcttcaggagaatatggacctcaagcctcaacattaagtcttttttcttctcctcctgaaatactaatcccaaagacctcatccactcccaaaacaaataatgacattttatcttcttgtgagataaaaactggatacaacaaaacagtacagattccaattacttcagaaaacagtactgtgggtttgtctaatacagatgttgcttctgcctggactgaaaattatgggctacaagaaaagatctccctaaatccctctgttcgctttaaggcagagaaactggaaatggctctaaattatcttggtattcagcccacaaaggaacaacaccaagccctgagacagcaagtacaagcagactcaaaagggacagtgtcttttggagattttgtccaggttgccagaaacttgttttgcttgcagttggatgaagtaaatgttggtgcacatgaaatttccaatatattagattcacagcttcttccttgtgattcttcagaagcagatgaaatggaaaggctcaagtgtgaaagagatgatgccttgaaagaagtaaatacacttaaggaaaaattattggaatcagataagcaaaggaaacaattgacagaagagctccagaatgtgaaacaagaagccaaagctgtagttgaagaaacaagagccctgcgtagtcggattcatcttgctgaagctgctcagagacaggcacatggaatggaaatggactatgaagaagtgatccgtctgttagaggccaagattacagagctaaaggctcagcttgctgattattctgaccaaaataaagaaagtgttcaggatttaaaaaagagaatcatggtactcgactgccaattacgaaaatcagaaatggctcgaaaaacttttgaggcatccactgaaaagcttcttcattttgtagaggctattcaagaagtattttctgataattctactcctttatcaaatttaagtgaaagaagagctgtgttagcttctcagacttccctcacaccactgggaaggaatggacgtagcatcccagcaacgctggcgcttgaatctaaggaacttgttaaatctgttcgtgccttacttgatatggattgtttaccttatgggtgggaggaagcttacacagcagatggaatcaagtacttcatcaatcatgtaacacagactacatcctggatccatcccgtgatgagtgtcctgaatctatctcgctcagaggagaatgaagaggattgctctagagaactccccaaccagaaaagttgatggttttccttaggaagtggagctacatggatgatgtgagcagagacgcataacatccaattctgagatgaaacagtctaaaataggagtaaagcatgcactacttgttgaagtgtgaaatggagactctggactttgggtatttttgtaaaacttttgatatttctgtatacatttaaaaaatcaattgccactacagtagttccttaagaataatctagttatattttttgaaatcacatataattagactttataatatatatactttttcatatataattagatctttctttgtaatttcatatgtagttcttcatagggtctcagatacaatggtttttataattgacatattgaaaaagtatatgaacataatgaaacacctcatttatttgataattcactaatgttttatattcatatattaggaaagtgaacttagcaagctttttggaatttaaggatcacatttagacatctcatgggctgatgaatacagctggtatctttgtggagctttctaatttacaaaatgctttgtagaccccattgtctttaaaccatacaacatgcccgtgaagctgatctggtgggtatgtttattcttggttttcagtagggaaatagcagttcagagagaggaagctctctgtcccagcaccgagactcactcctaagtcttctgattccatgagcagtcccccttcccccataccctgctgtctccacggagggaggtcacagcccatcacgcaggacactgtgattgtgttgatgcagctggctccacagctgtgcattccacagagattcagaaggcacctcttcggtcaaacatggcccctctataaccccactattcttctcctataaacccttcccccttctctgcacccaagccttcgccaagtaggcgcactctttgtgatattgtttcagcagacttctttcagcagctcgtgtttttctaaagtgaaaggcatggtttgtcctgcttaggttgcccttcccagagggatggtttgaggggagctgatgagaagagaggtatctgttaaaacattactgctctactcgaaacaagatggaagcctaaagcccaagtcgagcagctcccagcactgctgtgcagacctagaggtccttagaacatagtctaagaaccattcattgtagccattttatagttgagtaaactgagatcttaagtctcctagtctactgaatttcatatggtgtataatacagatttatatggtaaagatatacatatacattgtgctcaactatacattcctgaatccatttaggatttgtgatttatgtcttgagtaataatataaagtcaactccagactgataggtagtcattagccatgagaaatgtttcaggatggctagggaagacttgtgttttgcctgacagccatttgaatgttaggaagcttcggggagacaagttttgagagaagccccagagggagctatttccttgcaccccccagaggtgaatgaggtattctataagttagtgtctataattgtgaaagtacaaacttcttgtttttgtcaaattaatggtatgaaatttctctccccctgcttgaagagttttctaattcgtttctagtgagcaaaacaaagaaggtgcttgagtcactgaaatcaaagtactcaggcacacagcccactgacaagagacacctcatccattaactgctgttttgtaccacttgccgccctgtttctgtcaaatacctagtgaaaaaggcctaaacaattgtaatgatattatttattgggcattttgtgccatacatggtgatgagcagtttgcatatatttatttatgatcttcttaaaaccattccatgaaataggaactgtaattatccccaattctaaaagaaaaaacttagttttagagagttagtaatctttgcctaagggtcacaaagcacctatgtgtagaagctagggttcaaggcagatctgtgattccagaagctgttctctaaaccactatggagaactgcttagattcattgtctatgggtacattttataaaaaggcagattctagttcagtgtcataaggaactttctagtaattagagctgataagaaaagaattccccaggagaaaatggaaacactatcccagcaatctgaattccttacttggggaatgttgctgaggaggttcagtgtgtgaatggactgaaccagttggccactctctcagattccctcttcataaagcttccgtgacttctaaaccatcaggtcggtgccataagagatgctcaaaaaagcatggtcagggcttagcaagaatccttttccagtgcaaatacgaccctcatattatgttttggcgagtagccagtctttctttaacatcaatcaaccgtagcaatgtggtcatcacgaagtcttcattgactcactggcttggattttagggttagaaaatctgaatgttcttatgtccttccgtctcactttactagagtgcccaagttgactcatccttactcactcattccctcaaaatatttattgagcaccaacaatgtcacaagcactgtgctaaacactgtggtgaagtagaacaattgctaatcatttcctgggttccacttactcttgatttaaaaaaaaaaaaacaacaaaagagtttgtgtgtggccaggactaaacagctgcttcttaatttttgaattttaaaactaatctattttatttaaaaaaaatcaagtactttggaagtgaataaagtaagagatagcctgtctcactttccagaggtagcagtcactaatactgtggtgagtgattttactcaaaggaaatcacactattaagcagcttggttttgacatgttatgttgtggtcatcttttcatgtcaatacatagattaatcttttatttcaaatgtctacataaaatatcactacccacataacctataatttgtgtggccagcaatttattgaacactaaaatgttttaagttttcttattgctaacaatgtcacagtgaacatttatatattcattaaatccttttcctcatgtatctttgcactcttgtgctagtatgtctatagtgtgaatacattcataaatttcttgatcaaagctaggtcaaagttacattcattttaattttggtacatatccataaattctccataaaagtaggaccaacttacattaccaccaatagtgtatgtgagccttatttttatgtatgataggactttttttagtccaaatgttcctatagattttctgggttttttttttttttttgtccttggaagaataaccttccttccaccaagtccaagaacctgagatttttaatcattaggttttagatttcctttagcagcagagactgacttgctgtatagagggaagtcaagtagtgactaactcactatatgtcaaacacatcattactcttctcttttcctactttacatgtaatggttgcgaggaccaactttcaaatgagctaacttgggtgagacgttcactaaagtaccaagcacaatacaaatgcatcttcgagttctttgggcctcactttccctatctgaataataaggatagtaatcccttgccttttctcaaaccagttcaactcagcaaacacttcctgagcacctgctacatgccaggcaaaatgtgaaatttgcatgctatgaggctaaatggtactgattctcaaaacaaggagctcatagtctaaaaccatttttctttcttttttttccccctaaacaacctcttaaaggggtaagaagttagggggttgtttattaagaacccctgaagagcaaccctttaccactctcttaaatttgaaaaattccaaaataatattaacacctcttgactagaaaaggaaaaaaaaggaacatgccgtatgaagagcctctccaataataaatgcaaagcagctgtcaaaatatagagtcaagtgatactttcataaagtgtttgcacaattagaaaatgttatcctttttctcgggagaaatgggacatttttattttctctgctaagtgaaatgcaactttttgaagaatcaacacgcttgacatttttacaatgtacataaagaactgaactattattaaaacaacttacacactccattgcttataacttttgagagaatgaaaagaaccttaaacagaatgtgcctgtggagcttcgctttagaaatgaaatacccaaggtgttttaactacaactgtctacatgtaatagtgtgtctgcataatgactttgtaaatattaactgcaattctgtatttgctttcttgatatgacttttaacatttaaactta

SEQ ID NO: 1978 - DNA, 692 bp, Homo sapiens
ggttatggcggcgccgggcgcgctgctggtgatgggcgtgagcggctcggggaaatccaccgtgggcgccctgctggcatctgagctgggatggaaattctatgatgctgatgattatcacccggaggaaaatcgaaggaagatgggaaaaggcataccgctcaatgaccaggaccggattccatggctctgtaacttgcatgacattttactaagagatgtagcctcgggacagcgtgtggttctagcctgttcagccctgaagaaaacgtacagagacatattaacacaaggaaaagatggtgtagctctgaagtgtgaggagtcgggaaaggaagcaaagcaggctgagatgcagctcctggtggtccatctgagcgggtcgtttgaggtcatctctggacgcttactcaaaagagagggacattttatgccccctgaattattgcagtcccagtttgagactctggagcccccagcagctccagaaaactttatccaaataagtgtggacaaaaatgtttcagagataattgctacaattatggaaaccctaaaaatgaaatgacaatgattttgtatcagtggtccaaacagaactaagcataaatcattgtgccatcccaaacctcgttccagccgccttgcccatactagattctaaatgtttctaaaggcaaaccccaatgtgt

SEQ ID NO: 1979 - DNA, 1134 bp, Homo sapiens
atggccaccatcccagactggaagctacagctgctagcccggcgccggcaggaggaggcgtccgttcgaggccgagagaaagcagaacgggagcgcctgtcccagatgccagcctggaaacgagggctcctggagcgccgccgggccaagcttgggctgtcccctggggagcctagccctgtgctagggactgtagaggctggacctccagacccggatgagtctgcggtccttctggaggccatcgggccagtgcaccagaaccgattcatccggcaggagcggcagcagcagcagcagcaacaacaacggagtgaagagctgctagcagagagaaagcctgggcctctggaggcccgggagcggagacccagccctggggagatgcgggatcagagccccaagggaagagagtcaagagaagagagactaagtccgagggagaccagagagaggaggctggggatagggggagcccaagagttgagcctgaggcctctggaggctcgggactggaggcaaagcccaggagaggtgggagacaggagctcccgactgtcagaggcatggaaatggaggctgagtcctggagaaactccagagcggagtctgagactagcagagtctcgagagcaaagccccaggagaaaagaggtggaaagtagactgagcccaggggaatctgcctaccagaagttgggcctgacagaggcccataaatggagacctgactccagagagtctcaggaacagagtttggtacaactggaggcaacagagtggaggctgaggtcaggagaagaaagacaagactactcggaagaatgtgggagaaaagaagagtggccagttccaggggtagctccaaaagagactgcagagctgtccgagaccctgacaagggaggcccaaggcaacagttccgcaggagtggaggcagcagagcagaggcctgtggaagatggcgagaggggcatgaagccaacagaagggtggaaatggaccctgataatgagcctggcagggaagggcaaccaacatcttgtaacttgctttccccaccctgtttctgggggcagagccaattgcccaatttctaccctaatccaaagtccctggtgtgggtggggttaa

SEQ ID NO: 1980 - DNA, 5576 bp, Homo sapiens
ctccttggcggtgcctggagcccgggcgcaccccaccgctcccgggacctgttgggggctggcccgaaccgtcgtcgaagggagccgctcggccacccccgacgttcctcgccccgcccgacgttccctcaagtggccgaaccagccggacgagccaaactcgccgggcctcccggcggcagcaggtggccccgtccttccagggagggccctgcgccccgcggcgctccggagccctctcggccgcccccgccaggcgggatggaggcggatggggacggagaggagctggcccggctgcgctcagtcttcgccgcctgcgacgcgaaccgctcggggcgcctggagcgcgaggagttccgggcactgtgcacggagctgcgggtgcggccggccgacgccgaggcagtattccagcggctggacgccgaccgtgacggcgccatcaccttccaggagttcgcgcgtggcttcctcgggtccctccgcggggggcggcgccgggactggggtcctctggatcccgcgcccgccgtgtctgaggcggggccggagacacacgacagcgaggaggacgaaggcgacgaggacgcggcggcggcgctggccacctcgtgcggcccggcgagtcccggccgggcttggcaggatttccaggcgcgacttggggacgaagccaagttcattcccagagaagagcaagttagtaccttgtaccaaaacatcaaccttgtggagccaagattaattcagccatatgaacatgttataaagaacttcatccgtgagatcagacttcaaagcacagaaatggaaaatttggccattgcggtgaagagagcccaggacaaggcagctatgcagttgagtgagttggaagaggaaatggatcagaggattcaggctgcagaacataagacacggaaagacgaaaaacgcaaagctgaggaagccctcagtgacctcagacgtcagtatgaaactgaagtaggagatctgcaggtgaccattaaaaagctaagaaagctcgaagaacaatcaaaacgcgtaagtcaaaaggaagatgtggctgcattgaaaaaacaaatttatgatttatcaatggaaaaccagaaagttaagaaagaccttttagaagcacagacaaacatagcctttcttcagagtgagttagatgctttgaaaagtgattatgctgatcagagtctgaatactgaaagggatctggaaataatccgagcatacacagaagatcgaaatagtcttgagaggcaaattgaaatactccaaacagctaaccggaagctacatgacagtaatgatggccttagaagtgcccttgaaaacagttatagcaagttcaacagatctttgcatataaataatatctcaccagggaatacaatttctagaagcagtcccaaattcattggtcattcccctcaacctctaggctatgacaggtcatcccgctcttcctatgtggatgaggactgtgactccctggccctctgtgatcctctgcagaggacaaattgtgaagttgacagcctgcctgaaagctgcttcgacagcggcttgtctaccttgagagatcccaatgagtatgactcagaagtggaatacaagcaccagaggggatttcagaggtcacacggggtgcaggagagctttggaggtgatgcttcagacacagatgttcctgacataagggatgaagagacatttggtttagaagatgtggcttccgtcttagactggaagccccaagggtctgttagtgaaggcagcattgttagttcatcaagaaagcccatctcagcactctcgccccagacagacctggtagatgacaacgctaaatcttttagctcacagaaggcttacaagattgtacttgctggggacgctgcagtggggaagtctagtttcctcatgagactttgcaagaatgaatttcgagaaaatataagcgccaccctgggagttgatttccaaatgaaaaccctcattgtggatggagaacgaacagttctgcagctctgggatacagctggtcaggagagattcagaagtattgccaagtcttacttcagaaaggcagatggtgttttgctgctgtatgatgttacatgtgagaaaagctttcttaacatacgagaatgggtagatatgattgaggatgcagcccatgagactgttcccattatgctggtaggaaacaaggctgacattcgtgacactgctgctacagagggacaaaaatgtgtcccagggcactttggagagaaactggccatgacgtatggggcattattctgtgaaacaagtgccaaagatggttctaacatagtggaggctgttctgcaccttgctcgagaagtgaaaaagagaactgacaaggatgacagcagatccattaccaatctaaccgggaccaattccaaaaagtcaccacagatgaagaattgttgcaatggctaaatcccaaacatccttggcctgtgaagtcttcatttccagaatactgaatttgtgtgacttatttggctcttaacagagtggcacatcctactgacactgtcctatggagagttacagtgcaggaaacctgaacccagctctcaggtccctctggaactttggctcttctttgttttgtctcagtgagtgatttgggccctctggctaaatagactagtcatgtccttacaggtcttaaaagataacatgtaaatgtttttaaaatggtaaaaaaaaagaaaagaaaagaaatcacatgctcagatcaaagctgtagaggaaactgacataattagattcatgtggtagctgaattaggttacccacaaagtcagcatttaaatatttgatactaaagttctagtaagaagggattctcatcctagctttgctgttaactggccttgtgaccttggacatgtcacaagcccatgtcggatctgtttcttcatctgtaaaatgtgcagcttgccctcaaaggccttgcagcccttggcacctcagattctgtgggaagcagtaggacagagagtgtggtggcccacagttaataatagaactatggttattcctgctttttaatattggagtattgatttttctcacttctgaaataaggacagaatttgattaaaaaatggaaacagaaatatctattttttatgtataaagaaacatgtttgagacaaaaatagttgtatataaaaggatatttcataatctcagaatagttacaaagctcactgcttgaatttggtgttaaaaattctaatggaaacatgtaaagccacatactactgaaagcacaatgcccaggaaagttgtcactcttcacttaagggagtggttgccaggggctgagaaagggaggatggggagtgactgctaataggtatgtggtttctttgggcgatgatgagaatgttctggaattggaatagtggtgatagttgtataactgtttgaatgtactaggaaccactgaattgtatactttgaaagggtgaattttatggttgtgaattatctcactaaaaaaaatgctagtacttagagtgatgtaacattttgcaaaattttcattttcgtatccctgctgatttcaaaccttcccatggtttagaagcataacctgtaatgtaatgcaagtcccctaactccctggttgctaacattaacttccttaagtaataatcaatgaaagaaattctatgcatggttttgaaataatatccttgaaagaggaatcaccattaggaaaggtgagtcagggtcctttgtttaatgtgactagtggctcatcatcaccagtgacctggttgggcctactctccttccagaacctgcattgcttcccagacctccccactgagatgcctctaagagccaaaggagtcaacacttgagcctagggtgggctacaacaaaagattctaatttaccttgcttcatctaggtccaggccccaagtagcttgctgaaggaacttaaaaagtagctgttatttattgtattgtataagctaaaaacatttatttttgttgaatcgaaacaattccatgtagcaatcttttttctgttcacggtgtttgtgatagaaccttaaattccgcaagcatcagttttttgaaaaaatgggaattgaccggatagttacaggcaaagattataaatagctacaacatcatttaacttttataaacatgccttctctctattgaagacatctgatatttttgctggaaagttggatctatcctcagtaactctgccatgaattcctgtttcctggttccagaaaaagaaaagattacatttctgatcataaagaatgtcttgcatatgggaaatttttcaaaataaggggggtattatttatgtggcatgggaaaacttttgccatggctgtttgtcttagtggcatcttttgatgacattggatcagatatatgtagatgctgatatatgggacacatgtttaggttttggtgcagttgcacaaaactgtgttagtttatatgttactgtgttgcctttatttattctctccaaagtgtctctttatatttgttttacaatctgtgaaagagtataccataatacagaagtattttcatagtctttacctctggattgtcctgtcagtatagccacgttgatgagattacaccagtgcctttgatggtcaaccaatcatctttaagtatttgagccctgataaatattttggtaacataatccaaattagagacttagagctctggttagcaatcatgtttaaagagaagcttcttaaagctctgtatgctgggagattcatgattattaccaacgttttgatttcatgaaggtgttctcaaatttaaagcacattttcagtaagaacaaaaatatttaatgtttttatcttagacttgatacatttgcatattactatggaagttattcaccttgtccctgtttttctttaagatattttaaaatcatagttatactacagtccttttttaaatgtatcctgatacattgtaaaatattttaatttcattgtggaaaataatgttggataaggagatatttttcactgttaacttttagcccatgcattttcataatttatttttttcacttgctgctttatatgacatatgtgacatttgattatttaacacttgatgtgatctgcataaacccaagttgcacaaccctcctgctgaagataaaattgaggttaaagataaagatttattttcatatttgtacagtgatcggcttcagtgatggtttttgtgggcatttattgtgtgtgtgtaagaaatttcatatgtatatattaagtaggcctctgagtattgaataattgttttatgattttgatttatatggtttacattttcattgtgtgggccatatttcgtttatactgtttatttctcttcaaaccttaataattataccataaagtgtaatttttatagcaatgcaaatgtctaaggaactacaaatattttctacgttgtaaattcaataaagcttgcttcctttggcctttt

SEQ ID NO: 1981 - DNA, 5520 bp, Homo sapiens
cttttgcggcaggcagagacaatggaagaaaatgaaagccagaaatgtgagccgtgccttccttactcagcagacagaagacagatgcaggaacaaggcaaaggcaatctgcatgtaacatcaccagaagatgcagaatgccgcagaaccaaggaacgcctttctaatggaaacagtcgtggttcagtttccaagtcttcccgcaatatcccaaggagacacaccctaggggggccccgaagttccaaggaaatactgggaatgcaaacatctgagatggatcggaagagagaagcgttcctagaacatctgaagcagaagtacccccaccacgcctctgcaatcatgggtcaccaagagaggctgagagaccagacaaggagccccaaactgtctcacagtcctcaaccacccagtctgggtgacccggtcgagcatttatcagagacgtccgctgattctttggaagccatgtctgagggggatgctccaacccctttttccagaggcagccggactcgtgcgagccttcctgtggtgaggtcaaccaaccagacgaaagaaagatctctgggggttctctatctccagtatggagatgaaaccaagcagctcaggatgccgaatgaaatcacaagtgcagacacaatccgtgctctcttcgtaagtgcctttccacagcagctcaccatgaaaatgctggaatcgcccagtgtcgccatttacatcaaagatgaaagcagaaatgtctattatgaattaaatgatgtaaggaacattcaagacagatcactcctcaaagtgtacaacaaggatcctgcacatgcgtttaatcacacaccaaaaactatgaatggagacatgaggatgcagagagaacttgtttatgcaagaggagatggccctggggcccctcgccccggatctactgctcatccaccccatgcgattccaaattccccaccgtctactccagtgccccattccatgcccccctccccgtccagaattccttatgggggcacccgctccatggttgttcctggcaatgccaccatccccagggacagaatctccagcctgccagtctccagacccatctctccaagcccaagcgccattttagaaagaagagatgtcaagcctgatgaagacatgagtggcaaaaacattgcaatgtacagaaatgagggtttctatgctgatccttacctttatcacgagggacggatgagcatagcctcatcccatggtggacacccactggatgtccccgaccacatcattgcatatcaccgcaccgccatccggtcagcgagtgcttattgtaacccctcaatgcaagcggaaatgcatatggaacaatcactgtacagacagaaatcaaggaaatatccggatagccatttgcctacactgggctccaaaacaccccctgcctctcctcacagagtcagtgacctgaggatgatagacatgcacgctcactataatgcccacggcccccctcacaccatgcagccagaccgggcctctccgagccgccaggcctttaaaaaggagccaggcaccttggtgtatatagaaaagccacggagcgctgcaggattatccagccttgtagacctcggccctcctctaatggagaagcaagtttttgcctacagcacggcgacaatacccaaagacagagagaccagcgagaaaatgatgaaaaccacagccaacaggaaccacacagatagtgcaggaacgccccatgtgtctggtgggaagatgctcagtgctctggagtccacggtgcctcccagccagcctccacctgtgggcacctcagccatccacatgagcctgcttgagatgaggcggagcgtggcggaactcaggctccagctccagcagatgcggcagctccagctgcagaaccaggagttgctgagggcaatgatgaagaaggccgagctggaaatcagtggcaaagtgatggaaacaatgaagagactggaggatcccgtgcagcgacagcgcgtcctagtggagcaagagagacaaaaatatcttcatgaggaagagaagatcgtcaagaagttgtgcgagttggaagactttgttgaagacttgaagaaggactccacggcagccagccgattggttactctgaaagacgtggaagacggggctttcctcctgcgtcaagtgggagaggctgtagctaccctgaaaggagaatttccaaccttacaaaacaagatgcgagccatcctgcgcatagaagtggaggccgtgcggtttctgaaggaggagccacacaagctggacagtctcctgaagcgtgtgcgcagcatgacagacgtcctgaccatgctgcggagacatgtcactgatgggctcctgaaaggcacggacgcagcccaagccgcacagtacatggctatggaaaaggccacagccgcagaagtcctgaagagtcaggaggaggcagcccacacctccggccagcccttccacagcacaggtgcccctggcgatgcgaagtcggaagtggtgcctttgtccggcatgatggttcgccacgcgcagagctcccctgtggtcatccagccctcccagcactccgtggccctgctgaaccctgctcagaacttgcctcacgtggccagctccccagccgtcccccaggaagcaacctccactctgcagatgtcgcaggctccgcagtccccacagatacccatgaatgggtctgccatgcagagcttgttcattgaagaaatccacagtgtgagtgccaagaacagggcagtgtctatcgagaaagcagaaaagaaatgggaggaaaaaaggcaaaatctggatcactataatgggaaagagtttgagaagctcctagaagaagctcaggccaatatcatgaagtcaataccaaatctggagatgccgccagccacaggcccactgccaaggggagatgccccagtggacaaggtggaactttcagattctccaaattcggaacaggacttggaaaagctggggggaaagtcgccccctcctcctccgccacctcctcgtcgaagctacctgccaggatcgggactcaccaccacgaggtcaggcgatgtggtctacaccggcagaaaggagaacatcaccgctaaggcaagcagtgaagatgctggaccaagcccacagaccagagctacaaaatatccagcagaggagcctgcttcagcctggaccccatccccaccgcctgtcaccacctcctcctcaaaggatgaggaggaagaagaagaagaaggagacaaaataatggcagaactccaggcattccagaagtgttcctttatggatgtaaattcaaacagtcatgctgagccatcccgggctgacagtcacgttaaagacactaggtcgggcgccacagtgccacccaaggagaagaagaatttggaatttttccatgaagatgtacggaaatctgatgttgaatatgaaaatggcccccaaatggaattccaaaagggctccagcggggccccacagacgagcaggatgcctgtccccatgagtgccaagaacagacccggaaccctggacaaacccggcaagcagtccaaactgcaggatccccgccaatatcgtcaggctaatggaagtgctaagaaatctggtggggactttaagcctacttccccctccttacctgcttctaagattccagccctttctcccagctctgggaaaagcagttctctgccctcttctagtggtgacagctctaacctccctaatccacctgctactaaaccatcgattgcttctaaccctctcagcccccaaacaggaccacctgctcactctgcctccctcatcccttctgtctctaatggctctttgaagtttcagagcctcactcatacaggtaaaggtcaccatctttcattctcaccgcagagtcaaaatggccgagcaccccctcctttgtcattttcctcctcccctccttctcctgcctcctccgtctcactgaatcaaggtgccaagggcaccaggaccatccatactcccagcctcaccagctacaaggcacagaatggaagttcaagcaaagccaccccatccacagcaaaagaaacctcttaaaggtcaaatcctattaggcacaagtcggagttacatttaaaaaaaattaacagtctacaacaactgttttcacaagagaatgtaacatattgctgtatcgtttgaggcttaatgctaaatatgtgctaaatactggattaatagatttcagtaaagctcgttcgttttgtttggttttctttttacctagttgctatagtgtctacagtctatactcaatacctataaaatgcagtaagcatgtgttacagaaagaggttctggtgggagagaaaggtgcgtgtgagacaggagaattgtcttaagcatataaaacatgtatgattccagaattttagtatgttttgtataaaactatttttcattacggagactagaagtgaacagagaattacacaagtgtgactatacaaattgtaaaacagatactataatatttccttttattttagtgttatttagctttattacagatttctatttttgtcaaaacttcatggttcctttcaagatcttttttgccaaaacattttgatactatagcattgtacatttgaaagtagtgttctagactataaaaccaatgaacttctacatgagccctacagacaggcatgtgtagaaggcaatttatcaaacctattgcactgccatgaaaagtgtgtataataatttgctagcccaagcaagctagttttctttgcttgcttcttttctttcttttttccttccttttttttttttttttcttttttaacatgttgagattctctagttgttttctttggcgtatctaaccccttcttttgttttctgagacctggtaacccacgctcttgcattgtggattttaaaatgtatactctgtacggttctgtaaaccgaaaaacttttgtaaatatataaatatacatagacataaaaatactgtatgtgacagcacatagagtagttttcccacaccaaagttaatttttatgcatgctttaaaagtatatatcgggaccggcagaaatggaagtatccatacatttttaaaaagcaacaagtttgcacagctagagtgtttttgtaaataaatgtatttgtataacacagtcatgtaatatacagaactataagcagagactttgcaaaactaaataaagggctgcatgcttattattttttgtaccttgtcactataactacttcctagtcaaagaacgaaatgtaactgttaccgagttaaatgtttttccgctttgagggatgtaaccacatccactcagaggacactacttttctgaaagctctggggtgactaatgatgagttcctaataaattaattgcaagtgtggtgccttggatgtggcctgttggctcgctttctt

SEQ ID NO: 1982 - DNA, 7381 bp, Homo sapiens
agcgaggagcttttgcggcaggcagagacaatggaagaaaatgaaagccagaaatgtgagccgtgccttccttactcagcagacagaagacagatgcaggaacaaggcaaaggcaatctgcatgtaacatcaccagaagatgcagaatgccgcagaaccaaggaacgcctttctaatggaaacagtcgtggttcagtttccaagtcttcccgcaatatcccaaggagacacaccctaggggggccccgaagttccaaggaaatactgggaatgcaaacatctgagatggatcggaagagagaagcgttcctagaacatctgaagcagaagtacccccaccacgcctctgcaatcatgggtcaccaagagaggctgagagaccagacaaggagccccaaactgtctcacagtcctcaaccacccagtctgggtgacccggtcgagcatttatcagagacgtccgctgattctttggaagccatgtctgagggggatgctccaacccctttttccagaggcagccggactcgtgcgagccttcctgtggtgaggtcaaccaaccagacgaaagaaagatctctgggggttctctatctccagtatggagatgaaaccaagcagctcaggatgccgaatgaaatcacaagtgcagacacaatccgtgctctcttcgtaagtgcctttccacagcagctcaccatgaaaatgctggaatcgcccagtgtcgccatttacatcaaagatgaaagcagaaatgtctattatgaattaaatgatgtaaggaacattcaagacagatcactcctcaaagtgtacaacaaggatcctgcacatgcgtttaatcacacaccaaaaactatgaatggagacatgaggatgcagagagaacttgtttatgcaagaggagatggccctggggcccctcgccccggatctactgctcatccaccccatgcgattccaaattccccaccgtctactccagtgccccattccatgcccccctccccgtccagaattccttatgggggcacccgctccatggttgttcctggcaatgccaccatccccagggacagaatctccagcctgccagtctccagacccatctctccaagcccaagcgccattttagaaagaagagatgtcaagcctgatgaagacatgagtggcaaaaacattgcaatgtacagaaatgagggtttctatgctgatccttacctttatcacgagggacggatgagcatagcctcatcccatggtggacacccactggatgtccccgaccacatcattgcatatcaccgcaccgccatccggtcagcgagtgcttattgtaacccctcaatgcaagcggaaatgcatatggaacaatcactgtacagacagaaatcaaggaaatatccggatagccatttgcctacactgggctccaaaacaccccctgcctctcctcacagagtcagtgacctgaggatgatagacatgcacgctcactataatgcccacggcccccctcacaccatgcagccagaccgggcctctccgagccgccaggcctttaaaaaggagccaggcaccttggtgtatatagaaaagccacggagcgctgcaggattatccagccttgtagacctcggccctcctctaatggagaagcaagtttttgcctacagcacggcgacaatacccaaagacagagagaccagagagaggatgcaagccatggagaaacagattgccagtttaactggccttgttcagtctgcgctttttaaagggcccattacaagttatagcaaagatgcgtctagcgagaaaatgatgaaaaccacagccaacaggaaccacacagatagtgcaggaacgccccatgtgtctggtgggaagatgctcagtgctctggagtccacggtgcctcccagccagcctccacctgtgggcacctcagccatccacatgagcctgcttgagatgaggcggagcgtggcggaactcaggctccagctccagcagatgcggcagctccagctgcagaaccaggagttgctgagggcaatgatgaagaaggccgagctggaaatcagtggcaaagtgatggaaacaatgaagagactggaggatcccgtgcagcgacagcgcgtcctagtggagcaagagagacaaaaatatcttcatgaggaagagaagatcgtcaagaagttgtgcgagttggaagactttgttgaagacttgaagaaggactccacggcagccagccgattggttactctgaaagacgtggaagacggggctttcctcctgcgtcaagtgggagaggctgtagctaccctgaaaggagaatttccaaccttacaaaacaagatgcgagccatcctgcgcatagaagtggaggccgtgcggtttctgaaggaggagccacacaagctggacagtctcctgaagcgtgtgcgcagcatgacagacgtcctgaccatgctgcggagacatgtcactgatgggctcctgaaaggcacggacgcagcccaagccgcacagtacatggctatggaaaaggccacagccgcagaagtcctgaagagtcaggaggaggcagcccacacctccggccagcccttccacagcacaggtgcccctggcgatgcgaagtcggaagtggtgcctttgtccggcatgatggttcgccacgcgcagagctcccctgtggtcatccagccctcccagcactccgtggccctgctgaaccctgctcagaacttgcctcacgtggccagctccccagccgtcccccaggaagcaacctccactctgcagatgtcgcaggctccgcagtccccacagatacccatgaatgggtctgccatgcagagcttgttcattgaagaaatccacagtgtgagtgccaagaacagggcagtgtctatcgagaaagcagaaaagaaatgggaggaaaaaaggcaaaatctggatcactataatgggaaagagtttgagaagctcctagaagaagctcaggccaatatcatgaagtcaataccaaatctggagatgccgccagccacaggcccactgccaaggggagatgccccagtggacaaggtggaactttcagaagattctccaaattcggaacaggacttggaaaagctggggggaaagtcgccccctcctcctccgccacctcctcgtcgaagctacctgccaggatcgggactcaccaccacgaggtcaggcgatgtggtctacaccggcagaaaggagaacatcaccgctaaggcaagcagtgaagatgctggaccaagcccacagaccagagctacaaaatatccagcagaggagcctgcttcagcctggaccccatccccaccgcctgtcaccacctcctcctcaaaggatgaggaggaagaagaagaagaaggagacaaaataatggcagaactccaggcattccagaagtgttcctttatggatgtaaattcaaacagtcatgctgagccatcccgggctgacagtcacgttaaagacactaggtcgggcgccacagtgccacccaaggagaagaagaatttggaatttttccatgaagatgtacggaaatctgatgttgaatatgaaaatggcccccaaatggaattccaaaaggttaccacaggggctgtaagacctagtgaccctcctaagtgggaaagaggaatggagaatagtatttctgatgcatcaagaacatcagaatataaaactgagatcataatgaaggaaaattccatatccaatatgagtttactcagagacagtagaaactattcccaggaaactgtgcctaaggccagtttcggtttctctggcattagtccattagaagatgaaataaacaaagggtctaaaatctcaggcctgcaatactctatacctgacaccgagaaccagacgctgaattacggaaagacaaaggagatggaaaagcaaaatacggataagtgtcacgtttcctctcacactagactaacagaatcaagcgtgcatgattttaaaacagaagatcaagaggttatcacgacagattttggccaagttgttctaagacccaaggaggcaaggcatgctaacgtgaaccctaatgaggatggagaatcaagttcaagttctcccactgaagaaaatgcagccactgacaatattgccttcatgattaccgaaaccactgtccaggttctttccagtggggaggtgcatgatattgttagccaaaagggagaagacatacagacggttaatatcgatgccagaaaagagatgaccccccgacaagaagggactgacaatgaggatccagtcgtgtgcctggacaagaaaccagtgatcatcattttcgatgagcccatggacatccggtctgcctataagagactttcaactatctttgaggaatgtgatgaggaattagagagaatgatgatggaggaaaagatagaggaggaggaagaggaggaaaatggggattctgtagtccagaataataacacttcccagatgtctcataagaaggtggccccaggcaatcttagaaccggacaacaggtggaaacaaagtcacagccacactccctggccacagagaccagaaacccaggaggacaggaaatgaacagaacggagctgaacaagttcagccacgtggattctccaaattcggaatgcaagggtgaggacgcgaccgatgaccagtttgaaagccccaagaaaaagtttaaattcaaattccctaagaagcaactcgccgctctcactcaagccattcgcaccggaactaaaacagggaagaagactttgcaagtggtagtctatgaagaagaggaagaggatggcaccctgaaacagcacaaagaagccaagcgcttcgaaatcgctaggtctcaacctgaagacacccctgaaaacacagtgaggaggcaagagcagcccagcatcgagagtacatctccgatttcaagaactgatgaaattagaaaaaacacctacagaacattggatagcctggagcagaccattaaacagctcgaaaatacaatcagtgaaatgagtcccaaagccctagttgatacctcatgttcttccaacagagattctgttgcaagttcatcccacatagcccaagaggcctctccccgacccttgctagttccggatgaaggtcccactgccctagagccccctacgtcgataccttcagcttcacgtaagggctccagcggggccccacagacgagcaggatgcctgtccccatgagtgccaagaacagacccggaaccctggacaaacccggcaagcagtccaaactgcaggatccccgccaatatcgtcaggctaatggaagtgctaagaaatctggtggggactttaagcctacttccccctccttacctgcttctaagattccagccctttctcccagctctgggaaaagcagttctctgccctcttctagtggtgacagctctaacctccctaatccacctgctactaaaccatcgattgcttctaaccctctcagcccccaaacaggaccacctgctcactctgcctccctcatcccttctgtctctaatggctctttgaagtttcagagcctcactcatacaggtaaaggtcaccatctttcattctcaccgcagagtcaaaatggccgagcaccccctcctttgtcattttcctcctcccctccttctcctgcctcctccgtctcactgaatcaaggtgccaagggcaccaggaccatccatactcccagcctcaccagctacaaggcacagaatggaagttcaagcaaagccaccccatccacagcaaaagaaacctcttaaaggtcaaatcctattaggcacaagtcggagttacatttaaaaaaaattaacagtctacaacaactgttttcacaagagaatgtaacatattgctgtatcgtttgaggcttaatgctaaatatgtgctaaatactggattaatagatttcagtaaagctcgttcgttttgtttggttttctttttacctagttgctatagtgtctacagtctatactcaatacctataaaatgcagtaagcatgtgttacagaaagaggttctggtgggagagaaaggtgcgtgtgagacaggagaattgtcttaagcatataaaacatgtatgattccagaattttagtatgttttgtataaaactatttttcattacggagactagaagtgaacagagaattacacaagtgtgactatacaaattgtaaaacagatactataatatttccttttattttagtgttatttagctttattacagatttctatttttgtcaaaacttcatggttcctttcaagatcttttttgccaaaacattttgatactatagcattgtacatttgaaagtagtgttctagactataaaaccaatgaacttctacatgagccctacagacaggcatgtgtagaaggcaatttatcaaacctattgcactgccatgaaaagtgtgtataataatttgctagcccaagcaagctagttttctttgcttgcttcttttctttcttttttccttccttttttttttttttttcttttttaacatgttgagattctctagttgttttctttggcgtatctaaccccttcttttgttttctgagacctggtaacccacgctcttgcattgtggattttaaaatgtatactctgtacggttctgtaaaccgaaaaacttttgtaaatatataaatatacatagacataaaaatactgtatgtgacagcacatagagtagttttcccacaccaaagttaatttttatgcatgctttaaaagtatatatcgggaccggcagaaatggaagtatccatacatttttaaaaagcaacaagtttgcacagctagagtgtttttgtaaataaatgtatttgtataacacagtcatgtaatatacagaactataagcagagactttgcaaaactaaataaagggctgcatgcttattattttttgtaccttgtcactataactacttcctagtcaaagaacgaaatgtaactgttaccgagttaaatgtttttccgctttgagggatgtaaccacatccactcagaggacactacttttctgaaagctctggggtgactaatgatgagttcctaataaattaattgcaagtgtggtgccttggatgtggcctgttggctcgctttcttctctgtggcttatcaaggtgtagatgacagaaagcaaacctggatacagagtttccaccctcagttcctggaggggctcttattattttctctctttttaaaaaacttccagtagaagtaaagtggaaataaaatgtctttatca

SEQ ID NO: 1983 - DNA, 6123 bp, Homo sapiens
ggagagggctgcgcgcttctcgccaagcaagcgggaggcgcactggggccgccgccgttcccgcgctcctccctctcctctgcacccactgtcacgctacccgcccgcgggggagcctcgagagcctccaggtgaattgaaagtcgtttccgggggaggacggagagggtgctgcagtcctggcatgccctgaaactgcaagtcgggcagaaacgacccggcggaggagcagggcgcgcagcgccctgcgcagcatccccgggctgccagaagaggccaccactcggctggcagccgcgagcggcggccgaacctcggccccagactcgggcccccggcacgctcgcccgggagataccccttccccctcttgcgcatttcgcagctgcgctggtgtggggcatgagagcgaggtggctccaggtctccgcggagcagctgccagtgggagagcgaggagaggcgagggggcggcagcctcggcccgaaacggagatcctggggtcctaaatttgtggccgattgcactgtgtcctggagacggagtggaaccacagcccagagcccctgggaatcatccctgaaagactgcattacttctccatggagtcttcctcctcctgcttattttctttttggaacaaggcaaaggcaatctgcatgtaacatcaccagaagatgcagaatgccgcagaaccaaggaacgcctttctaatggaaacagtcgtggttcagtttccaagtcttcccgcaatatcccaaggagacacaccctaggggggccccgaagttccaaggaaatactgggaatgcaaacatctgagatggatcggaagagagaagcgttcctagaacatctgaagcagaagtacccccaccacgcctctgcaatcatgggtcaccaagagaggctgagagaccagacaaggagccccaaactgtctcacagtcctcaaccacccagtctgggtgacccggtcgagcatttatcagagacgtccgctgattctttggaagccatgtctgagggggatgctccaacccctttttccagaggcagccggactcgtgcgagccttcctgtggtgaggtcaaccaaccagacgaaagaaagatctctgggggttctctatctccagtatggagatgaaaccaagcagctcaggatgccgaatgaaatcacaagtgcagacacaatccgtgctctcttcgtaagtgcctttccacagcagctcaccatgaaaatgctggaatcgcccagtgtcgccatttacatcaaagatgaaagcagaaatgtctattatgaattaaatgatgtaaggaacattcaagacagatcactcctcaaagtgtacaacaaggatcctgcacatgcgtttaatcacacaccaaaaactatgaatggagacatgaggatgcagagagaacttgtttatgcaagaggagatggccctggggcccctcgccccggatctactgctcatccaccccatgcgattccaaattccccaccgtctactccagtgccccattccatgcccccctccccgtccagaattccttatgggggcacccgctccatggttgttcctggcaatgccaccatccccagggacagaatctccagcctgccagtctccagacccatctctccaagcccaagcgccattttagaaagaagagatgtcaagcctgatgaagacatgagtggcaaaaacattgcaatgtacagaaatgagggtttctatgctgatccttacctttatcacgagggacggatgagcatagcctcatcccatggtggacacccactggatgtccccgaccacatcattgcatatcaccgcaccgccatccggtcagcgagtgcttattgtaacccctcaatgcaagcggaaatgcatatggaacaatcactgtacagacagaaatcaaggaaatatccggatagccatttgcctacactgggctccaaaacaccccctgcctctcctcacagagtcagtgacctgaggatgatagacatgcacgctcactataatgcccacggcccccctcacaccatgcagccagaccgggcctctccgagccgccaggcctttaaaaaggagccaggcaccttggtgtatatagaaaagccacggagcgctgcaggattatccagccttgtagacctcggccctcctctaatggagaagcaagtttttgcctacagcacggcgacaatacccaaagacagagagaccagagagaggatgcaagccatggagaaacagattgccagtttaactggccttgttcagtctgcgctttttaaagggcccattacaagttatagcaaagatgcgtctagcgagaaaatgatgaaaaccacagccaacaggaaccacacagatagtgcaggaacgccccatgtgtctggtgggaagatgctcagtgctctggagtccacggtgcctcccagccagcctccacctgtgggcacctcagccatccacatgagcctgcttgagatgaggcggagcgtggcggaactcaggctccagctccagcagatgcggcagctccagctgcagaaccaggagttgctgagggcaatgatgaagaaggccgagctggaaatcagtggcaaagtgatggaaacaatgaagagactggaggatcccgtgcagcgacagcgcgtcctagtggagcaagagagacaaaaatatcttcatgaggaagagaagatcgtcaagaagttgtgcgagttggaagactttgttgaagacttgaagaaggactccacggcagccagccgattggttactctgaaagacgtggaagacggggctttcctcctgcgtcaagtgggagaggctgtagctaccctgaaaggagaatttccaaccttacaaaacaagatgcgagccatcctgcgcatagaagtggaggccgtgcggtttctgaaggaggagccacacaagctggacagtctcctgaagcgtgtgcgcagcatgacagacgtcctgaccatgctgcggagacatgtcactgatgggctcctgaaaggcacggacgcagcccaagccgcacagtacatggctatggaaaaggccacagccgcagaagtcctgaagagtcaggaggaggcagcccacacctccggccagcccttccacagcacaggtgcccctggcgatgcgaagtcggaagtggtgcctttgtccggcatgatggttcgccacgcgcagagctcccctgtggtcatccagccctcccagcactccgtggccctgctgaaccctgctcagaacttgcctcacgtggccagctccccagccgtcccccaggaagcaacctccactctgcagatgtcgcaggctccgcagtccccacagatacccatgaatgggtctgccatgcagagcttgttcattgaagaaatccacagtgtgagtgccaagaacagggcagtgtctatcgagaaagcagaaaagaaatgggaggaaaaaaggcaaaatctggatcactataatgggaaagagtttgagaagctcctagaagaagctcaggccaatatcatgaagtcaataccaaatctggagatgccgccagccacaggcccactgccaaggggagatgccccagtggacaaggtggaactttcagaagattctccaaattcggaacaggacttggaaaagctggggggaaagtcgccccctcctcctccgccacctcctcgtcgaagctacctgccaggatcgggactcaccaccacgaggtcaggcgatgtggtctacaccggcagaaaggagaacatcaccgctaaggcaagcagtgaagatgctggaccaagcccacagaccagagctacaaaatatccagcagaggagcctgcttcagcctggaccccatccccaccgcctgtcaccacctcctcctcaaaggatgaggaggaagaagaagaagaaggagacaaaataatggcagaactccagggctccagcggggccccacagacgagcaggatgcctgtccccatgagtgccaagaacagacccggaaccctggacaaacccggcaagcagtccaaactgcaggatccccgccaatatcgtcaggctaatggaagtgctaagaaatctggtggggactttaagcctacttccccctccttacctgcttctaagattccagccctttctcccagctctgggaaaagcagttctctgccctcttctagtggtgacagctctaacctccctaatccacctgctactaaaccatcgattgcttctaaccctctcagcccccaaacaggaccacctgctcactctgcctccctcatcccttctgtctctaatggctctttgaagtttcagagcctcactcatacaggtaaaggtcaccatctttcattctcaccgcagagtcaaaatggccgagcaccccctcctttgtcattttcctcctcccctccttctcctgcctcctccgtctcactgaatcaaggtgccaagggcaccaggaccatccatactcccagcctcaccagctacaaggcacagaatggaagttcaagcaaagccaccccatccacagcaaaagaaacctcttaaaggtcaaatcctattaggcacaagtcggagttacatttaaaaaaaattaacagtctacaacaactgttttcacaagagaatgtaacatattgctgtatcgtttgaggcttaatgctaaatatgtgctaaatactggattaatagatttcagtaaagctcgttcgttttgtttggttttctttttacctagttgctatagtgtctacagtctatactcaatacctataaaatgcagtaagcatgtgttacagaaagaggttctggtgggagagaaaggtgcgtgtgagacaggagaattgtcttaagcatataaaacatgtatgattccagaattttagtatgttttgtataaaactatttttcattacggagactagaagtgaacagagaattacacaagtgtgactatacaaattgtaaaacagatactataatatttccttttattttagtgttatttagctttattacagatttctatttttgtcaaaacttcatggttcctttcaagatcttttttgccaaaacattttgatactatagcattgtacatttgaaagtagtgttctagactataaaaccaatgaacttctacatgagccctacagacaggcatgtgtagaaggcaatttatcaaacctattgcactgccatgaaaagtgtgtataataatttgctagcccaagcaagctagttttctttgcttgcttcttttctttcttttttccttccttttttttttttttttcttttttaacatgttgagattctctagttgttttctttggcgtatctaaccccttcttttgttttctgagacctggtaacccacgctcttgcattgtggattttaaaatgtatactctgtacggttctgtaaaccgaaaaacttttgtaaatatataaatatacatagacataaaaatactgtatgtgacagcacatagagtagttttcccacaccaaagttaatttttatgcatgctttaaaagtatatatcgggaccggcagaaatggaagtatccatacatttttaaaaagcaacaagtttgcacagctagagtgtttttgtaaataaatgtatttgtataacacagtcatgtaatatacagaactataagcagagactttgcaaaactaaataaagggctgcatgcttattattttttgtaccttgtcactataactacttcctagtcaaagaacgaaatgtaactgttaccgagttaaatgtttttccgctttgagggatgtaaccacatccactcagaggacactacttttctgaaagctctggggtgactaatgatgagttcctaataaattaattgcaagtgtggtgccttggatgtggcctgttggctcgctttcttctctgtggcttatcaaggtgtagatgacagaaagcaaacctggatacagagtttccaccctcagttcctggaggggctcttattattttctctctttttaaaaaacttccagtagaagtaaagtggaaataaaatgtctttatca

SEQ ID NO: 1984 - DNA, 531 bp, Homo sapiens
atgggctgctgtggctgttctggaggctgtggctctggctgtgggggctgtggctccggcagtgggggctgtggctctggctgtgggggctgtggctccagctgctgtgtgcccatttgctgctgcaagcctgtgtgctgctgtgtgccagcctgttcctgctccagctgtggctcctgtgggggctccaaagggggctgtggctcttgtgggagctccaagggtgggtgtggttcttgtggctgctcccagtccaactgctgtaagccctgctgctcctcctcaggctgtgggtcattctgctgccagtccagctgctccaaaccctgctgctgccaatccagctgctgccagtccagctgctgcaagccctgctgctgccaatccagctgctgccagtctagctgcttcaagccctgctgctgccagtccagctgctgtgtccccgtgtgctgccagtccagctgctgcaagccctgctgctcccagtccagctgctgtgtccctatttgctgtcagtacaagatctga

SEQ ID NO: 1985 - DNA, 513 bp, Homo sapiens
atgggctgctgtggctgctccggaggctgtggctccggctgtgggggttgtggctccggctgtgggggctgtggctccggctgtgggggctatggctctggctgtgggggctgtggctccagctgctgtgtgcccgtctgctgctgcaagcccgtgtgctgctgtgtgccagcctgttcctgctccagctgtggctcctgtgggggctccaagggggactgtggctgtggttcctgtgggggctccaaggggggctgtggttcttgtggctgctcccagtgcaattgctgtaagccctgctgctgctcctcaggctgtggatcctgctgccagtccagctgctgcaatccctgctgctgccagtccagctgctgtgtccccgtgtgctgccagtctagctgctgcaagccctgctgctgtcagtccagctgctgtgtcccctccagctgctgcaggtcctgctgctccaagtccagctgctgtgtccctatttgctgtcagtacaagatctga

SEQ ID NO: 1986 - DNA, 2618 bp, Homo sapiens
cgaatcaccgctcctgagcccggtgcggggctgccgctatcgcctggccgtgggtgccggagcggccgggttgcgactcagcgttcttgggtgggcgcgggcggcgtctccgcggcgggcatcccccgaggccgccctcgggccatgatcgactccgtgaagctgcgccgcgacagcgcggcggacttcttctcccactacgagtacctgtgcgcgctgcagaactcggtgccgctgcccgccgtgcgcgcctgtctccgggagggcgtgctggatttcaacgccgaccgcctccgcggggtggactgggcgcctctgctgagcaccctcaagatcaataaagacctgcccttggtctccatcaagagcttcttccagccctggctgggggacacaggttctgacatgaataaattttgcagaagtcgtgttcctgcgataagatacaaagatgtgaccttccagttgtgtaaagctcttaaaggctgtttaagtatatcaagtgtgctaaagaacctggagctaaatggactaattctgagagagagggatttaactattctagcaaagggattgaataaatcggcttctttggtgcacctgtctcttgcaaattgtccaattggagatggaggtttagaaattatttgtcaaggtataaagagctctatcactcttaagacagtcaacttcacaggatgtaatctgacatggcagggagcagatcacatggccaagatcttaaagtatcagaccatgagaaggcatgaagaaacctgggctgagagtcttcgctataggagacctgatcttgactgtatggctggcttaagacgtatcacactgaattgcaacacacttattggtgacctaggtgcatgtgcttttgcagactctctcagtgaggatttatggctgagagctcttgacctgcaacagtgcggcctcaccaatgaaggagcaaaggctttgctagaggcccttgaaaccaatacaactctggtcgttctggatataagaaaaaatccactcattgatcattctatgatgaaagcagttatcaaaaaagtcctccagaatggaaggagtgccaaatcagagtaccagtggataacttctccatcagtgaaggaaccatccaaaactgctaaacagaaaaggagaactataattctaggaagtggtcacaaaggaaaagctactattagaattgtaggattggctacaaagaaacctgtaagtagtggcagaaaacactcccttggtaaagaatattatgcgcccgcacctcttccacctggtgtgtctggtttcttgccgtggcgtactgcagaacgtgcaaaaagacacaggggtttcccattaatcaaaacacgtgatatatgtaatcagttgcagcaaccaggttttcctgtgactgtgacagtagagagtccttcatcctctgaagttgaagaggttgatgattcttcagagagtgttcatgaagtgcctgagaaaactagtatagaacaagaagcattacaggaaaaactggaggagtgcctaaagcagttaaaggaagaaagagtgataaggcttaaggttgataaacgagtcagtgagctggaacatgaaaatgcccagttaagaaatataaatttctctttgtctgaagcccttcatgcacagtcattgacaaatatgatcctggatgatgaaggtgttttgggcagcattgagaattcttttcagaagtttcatgctttcttggatctccttaaagatgctgggcttgggcagcttgccacaatggctgggatagatcagtcagattttcaattactaggtcatccccagatgacttctactgttagtaatccacctaaagaagaaaagaaggcgcttgaagatgaaaaaccagaaccgaagcagaatgccctagggcaaatgcaaaatatccaggtttctatttgtatgcagtcagcttacaatgaaggaacactaatgaagtttcagaaaattacaggtgatgctagaattcctttgcctctcgactcctttcctgtcccagtttctactccagagggcttaggaacttccagcaacaacctaggagtcccagctactgagcagcggcaggagtcttttgaaggattcattgctagaatgtgttctccttcaccagatgcgacttctggaactggaagtcaaagaaaagaagaggagttgtccagaaatagcagatcttcttcagagaaaaagaccaaaacaggtgaatataccaaaaaacactctgataagcaacaccctggaaaggacctgcattcctgatctgactgtcctgaaaaccagaaaagcaaagaaactagggaaactagttctttggttaatgaaccaattaaaagtaggtctttgaaaaaatacgtttctgtcaagaaagaaaatagaatagtgactgtttcatccaagacaaataaaagtaaatccagtccactagaacattctgaaagtgatactcttggatgtgattttgaatttcaagaaagcatccattctctatcacacctttcatatgactaaatcttttgaaactatgtttttacctttaaattttaataaattttcttatgttttta

SEQ ID NO: 1987 - DNA, 4574 bp, Homo sapiens
tgaaggtaaaattttccagatacggcagacggctttcagagtacaataaacagggaatgagaactatttacatggaagtttctttctcatgatgcggtggagaagcctcggccacttggttctgccagatgttcctggggttactgtaaatgggaaggacaggcagagctaaacaaggtttatcatttaaaagtgcctgtgtgaagtcacttttgctggaaaactgcagcttgggagctttctttgtattcacatcccactcttctgtcaagtacactttaccctgaccttatgagtggatgaagatacctcagttgtctgactttgccaattgcttaatttcagaatttaaaaaggggaaagaaaaacatcctgctaaaatatgaacatctgagtgtcttattttccaacatcgtcaatagctgtgagcgtcagcattaaatattctcccaaggagtgccatgatattgaagtcactttattaataacagctgtatctgcaaaacagtcaagagactcggacgttgaaagccagagatgacactgagcatgcttttattgcggcctaccatctttaagtgggacatattgattgatgagtgattgcctgtccatacactctctcatcatcctgttccttggattggacttcactaagcaatttatcactcaccttcagacttacatgtgggagttttcacaacagtagttttggaatcattagaacttggattgatttcatcatttaacagaaacaaacagcccaaattactttatcaccatggctttgaacgttgccccagtcagagatacaaaatggctgacattagaagtctgcagacagtttcaaagaggaacatgctcacgctctgatgaagaatgcaaatttgctcatccccccaaaagttgtcaggttgaaaatggaagagtaattgcctgctttgattccctaaagggccgttgttcgagagagaactgcaagtatcttcaccctccgacacacttaaaaactcaactagaaattaatggaaggaacaatttgattcagcaaaaaactgcagcagcaatgcttgcccagcagatgcaatttatgtttccaggaacaccacttcatccagtgcccactttccctgtaggtcccgcgatagggacaaatacggctattagctttgctccttacctagcacctgtaacccctggagttgggttggtcccaacggaaattctgcccaccacgcctgttattgttcccggaagtccaccggtcactgtcccgggctcaactgcaactcagaaacttctcaggactgacaaactggaggtatgcagggagttccagcgaggaaactgtgcccggggagagaccgactgccgctttgcacaccccgcagacagcaccatgatcgacacaagtgacaacaccgtaaccgtttgtatggattacataaaggggcgttgcatgagggagaaatgcaaatattttcaccctcctgcacacttgcaggccaaaatcaaagctgcgcagcaccaagccaaccaagctgcggtggccgcccaggcagccgcggccgcggccacagtcatggcctttccccctggtgctcttcatcctttaccaaagagacaagcacttgaaaaaagcaatggtaccagcgcggtctttaaccccagcgtcttgcactaccagcaggctctcaccagcgcacagttgcagcaacacgccgcgttcattccaacagggtcagttttgtgcatgacacccgctaccagtattgataattctgaaataatcagcagaaacggaatggaatgccaagaatctgcattgagaataactaaacattgttactgtacatactatcctgtttcctcctcaatagaattgccacaaactgcatgctaaataaagatgtagttcttctggacagaccacaactctaagaagctagtgctgctatctcatatatgagtattaaatatggtatgcttagtatattccaacctaagatagttaactacctgagaccagctgtgatgtttaaagacataaaggataaagtttacttttaaagggtttctaaacatagtttctgtcctaggaatattgtcttatctccataactatagctgatgcagaaagtccagccagtttactcatttcgattcagaatatttcaaatttagcaataaacaattagcattagttaaaaaagaaacatattccaagggcaggttcgattctagctctaattactgtcatgtcatttacccactggatcaaagggtatgtttcacttcttgacaatataaatgctgcagcaaagatgagaggtgaagtaaaaccgatacctgtcctgcaggtctaaaatttgaatggaaattcaagcacaagtactggggacacatcaaagtgtggtgtttggtttgcctggagatgccacgttgaatcatgtgattctagattaacattaaatagattgaaaaagaaactttgcacggtatgagcttcataccccaccaaacaaagtcttgaaggtattattttacaagtatatttttaaagttgttttataagagagactttgtagaagtgcctagattttgccagacttcatccagcttgacaagattgagaggcccatgccaacagtctaatctaagagattagtctttcaaactcaccatccagttgcctgttacagaataactcttcttaactaaaaacctagtcaaacaaggaagctgtaggtgaggagatctgtataatattctaatttaagtaagtttgagtttagtcactgcaaatttgactgtgactttaatctaaattactatgtaaacaaaaagtagatagtttcactttttaaaaaatccattactgttttgcatttcaaaagttggattaaagggttgtaactgactacagcatggaaaaaaatagttcttttaattctttcaccttaaagcatattttatgtctcaaaagtataaaaaactttaatacaagtacatacatattatatatacacatacatatatatactatatatggatgaaacatattttaatgttgtttacttttttaaatacttggttgatcttcaaggtaatagcgatacaattaaattttgttcagaaagtttgttttaaagtttattttaagcactatcgtaccaaatatttcatatttcacattttatatgttgcacatagcctatacagtacctacatagtttttaaattattgtttaaaaaacaaaacagctgttataaatgaatattatgtgtaattgtttcaaacatccattttctttgtgaacatattagtgattgaagtattttgacttttgagattgaatgtaaaatattttaaatttgggatcatcgcctgttctgaaaactagatgcaccaaccgtatcattatttgtttgaggaaaaaaagaaatctgcattttaattcatgttggtcaaagtcgaattactatctatttatcttatatcgtagatctgataaccctatctaaaagaaagtcacacgctaaatgtattcttacatagtgcttgtatcgttgcatttgttttaatttgtggaaaagtattgtatctaacttgtattactttggtagtttcatctttatgtattattgatatttgtaattttctcaactataacaatgtagttacgctacaacttgcctaaaacattcaaacttgttttcttttttctgtttttttctttgttaattcatttaaactcattgaaaacatagtatacattactaaaaggtaaattatgggaatcactgaaatatttttgtagattaattgttgtaacattgtctttcttttttttcttttgtttcatgattttgatttttaaaattattagcacacaactattttcagccctttaataatggagcatcaaaaacatcacctgtaaccccaagcaaatatagaagactgtattttttactatgatatccattttccagaattgtgattacaatatgcaaagagtcataaatatgccatttacaataaggaggaggcaaggcaaatgcatagatgtacaaatatatgtacaacagattttgctttttatttatttataatgtaattttatagaataattctgggatttgagaggatctaaaactatttttctgtataaatattatttgccaaaagtttgtttatattcagaagtctgactatgatgaataaatcttaaatgctttgtttaattaaaaaacaaaaatcaccaatatccaagacatgaagatatcagttcaacaaatactgtagttaagagactaactctccacttgtatgggaactacatttcactcttggttttcaggatataacagcacttcaccgaaatattctttcagccataccactggtaacatttctactaaatctttctgtaacacttaaagaattccctcattcattaccttacagtgtaaacaggagtctaatttgtatcaatactatgttttggttgtaatattcagttcactcacccaatgtacaaccaatgaaataaaagaagcatttaaaagga

SEQ ID NO: 1988 - DNA, 1864 bp, Homo sapiens
ctgaaggtaaaattttccagatacggcagacggctttcagagtacaataaacagggaatgagaactatttacatggaagtttctttctcatgatgcggtggagaagcctcggccacttggttctgccagatgttcctggggttactgtaaatgggaaggacaggcagagctaaacaaggtttatcatttaaaagtgcctgtgtgaagtcacttttgctggaaaactgcagcttgggagctttctttgtattcacatcccactcttctgtcaagtacactttaccctgaccttatgagtggatgaagatacctcagttgtctgactttgccaattgcttaatttcagaatttaaaaaggggaaagaaaaacatcctgctaaaatatgaacatctgagtgtcttattttccaacatcgtcaatagctgtgagcgtcagcattaaatattctcccaaggagtgccatgatattgaagtcactttattaataacagctgtatctgcaaaacagtcaagagactcggacgttgaaagccagagatgacactgagcatgcttttattgcggcctaccatctttaagtgggacatattgattgatgagtgattgcctgtccatacactctctcatcatcctgttccttggattggacttcactaagcaatttatcactcaccttcagacttacatgtgggagttttcacaacagtagttttggaatcattagaacttggattgatttcatcatttaacagaaacaaacagcccaaattactttatcaccatggctttgaacgttgccccagtcagagatacaaaatggctgacattagaagtctgcagacagtttcaaagaggaacatgctcacgctctgatgaagaatgcaaatttgctcatccccccaaaagttgtcaggttgaaaatggaagagtaattgcctgctttgattccctaaagggccgttgttcgagagagaactgcaagtatcttcaccctccgacacacttaaaaactcaactagaaattaatggaaggaacaatttgattcagcaaaaaactgcagcagcaatgcttgcccagcagatgcaatttatgtttccaggaacaccacttcatccagtgcccactttccctgtaggtcccgcgatagggacaaatacggctattagctttgctccttacctagcacctgtaacccctggagttgggttggtcccaacggaaattctgcccaccacgcctgttattgttcccggaagtccaccggtcactgtcccgggctcaactgcaactcagaaacttctcaggactgacaaactggaggtatgcagggagttccagcgaggaaactgtgcccggggagagaccgactgccgctttgcacaccccgcagacagcaccatgatcgacacaagtgacaacaccgtaaccgtttgtatggattacataaaggggcgttgcatgagggagaaatgcaaatattttcaccctcctgcacacttgcaggccaaaatcaaagctgcgcagccgcggccgcggccacagtcatgactcagtcgactgccaaagcaatgaagcgacctctcgaagcaactgtagacctggcctttccccctggtgctcttcatcctttaccaaagagacaagcacttgaaaaaagcaatggtaccagcgcggtctttaaccccagcgtcttgcactaccagcaggctctcaccagcgcacagttgcagcaacacgccgcgttcattccaacagtacccatgatgcacagcgctacgtccgccactgtctctgcagcaacaactcctgcaacaagtgtccccttcgcagcaacagccacagccaatcagttagtttatagc

SEQ ID NO: 1989 - DNA, 915 bp, Homo sapiens
atggcgaagattgagaaaaacgctcccacgatggaaaaaaagccagaactgtttaacatcatggaagtagatggagtccctacgttgatattatcaaaagaatggtgggaaaaagtatgtaatttccaagccaagcctgatgatcttattctggcaacttacccaaagtcaggtacaacatggatgcatgaaattttagacatgattctaaatgatggtgatgtggagaaatgcaaaagagcccagactctagatagacacgctttccttgaactgaaatttccccataaagaaaaaccagatttggagttcgttcttgaaatgtcctcaccacaactgataaaaacacatctcccttcacatctgattccaccatctatctggaaagaaaactgcaagattgtctatgtggccagaaatcccaaggattgcctggtgtcctactaccactttcacaggatggcttcctttatgcctgatcctcagaacttagaggaattttatgagaaattcatgtccggaaaagttgttggcgggtcctggtttgaccatgtgaaaggatggtgggctgcaaaagacatgcaccggatcctctacctcttctacgaggatattaaaaaaaatccaaaacatgagatccacaaggtgttggaattcttggagaaaacttggtcaggtgatgttataaacaagattgtccaccatacctcatttgatgtaatgaaggataatcccatggccaaccatactgcggtacctgctcacatattcaatcactccatctcaaaatttatgaggaaagggatgcctggagactggaagaaccactttactgtggctttgaatgagaactttgataagcattatgaaaagaagatggcagggtccacactgaacttctgcctggagatctga

SEQ ID NO: 1990 - DNA, 3007 bp, Homo sapiens
gagtgtgtgacccagcccttcccccgtggccaagcagagagagtggccttgaggaagccatagcagcaggaccagcatggcctctgctgcctctgtgaccagcctggcagatgaagtcaactgccccatctgtcagggtaccctgagggagccggtcactatcgactgcggccacaacttctgccgggcctgccttacccgctactgtgagataccaggcccagacctggaggagtcccctacttgcccactctgcaaagaacccttccgtcctgggagcttccggcccaactggcagctggctaacgtggtggagaacattgagcgcctccagctggtgtccacactgggtttgggagaggaggatgtctgccaagagcacggagagaagatctacttcttctgtgaggatgatgagatgcagttgtgcgtggtgtgccgggaggctggggagcacgctacccacaccatgcgcttcctggaggatgcagcggctccctatagggaacaaatccataagtgtcttaaatgtctaagaaaagagagagaggagattcaagaaatccagtcaagagaaaataaaaggatgcaagtcctcctgactcaggtgtccaccaagagacaacaggtgatttctgagttcgcacacctgaggaagtttctagaggaacagcagagcatcctcttagcacaattggagagccaggatggggacatcttgaggcaacgggatgaatttgatttgctggttgctggggagatctgccggtttagtgctcttattgaagaactggaggagaagaatgagaggccagcaagggagctcctgacggacatcagaagcactctaataagatgtgaaaccagaaagtgccggaaaccggtggctgtgtcgccagagctgggccagaggattcgggactttccccagcaggccctcccgctgcagagggagatgaagatgtttctggaaaaactatgctttgagttggactatgagccagctcacatttctctagaccctcagacttcccaccccaagctcctcttgtccgaggaccaccagcgagctcagttctcctacaaatggcagaactcaccagacaacccccaacgttttgaccgggccacctgtgttctggcccacactggcatcacaggggggagacacacgtgggtgtggatggccagggtacctggggactcaggctgctgccagttctgctcaccaccatccgtgcttggcacagaagtagctgcatagaaagggcactggatttgaagtcagaagacctgggttcttgaaccagcctgtcaaccagttgtatgactttaaacaaggcatctcacctcttttcatcttgttttcttccaataatgttagagttcatgtaatcacattctctagaaccatttagtttgtgttaactatgaaccaagcagtgtggtggccactggtgacttgaaaatatagagaaaaaaaaaacctgctctatatctgaaagagctcttgggaagacagagaaacataaagaggaaattacagcacagtgtggtgggtgttacgggaagtccaaccccagcattatgggagttcaggggaaggggcatagcccagcctggaaggagagggtgagtgggggatggctttctgaaaagggtggtctaaaggatgcctatggtcaatagggaaaagaggggaagaagcatcttaagaagaggaaacagcagagaactggctggatgacctgtgactctggagcactgggttgtctccattgtcattatgggcagatgtgtgccatccccagccgacgccactcactgcctccttcctcctggtgttgccacttctgggtgagattaaggtgcagggcctgggggcaggaggacataaggtatagccataaatcataacccagggaccacactcaaccctagggaaattgtcttcctgatcagttgattaccatctgaggtcaagaaatgagatagtgggagcaaatgggtcacaaatagctcagctgtgggctcagaaactgctaggtaaaagaattccagaaggaggccagggcataagttggatgacctatgaactttagtctaaagaattgagactaccgtaattgagactactgtagtgacatctgagaaatgggatggaagagtgaccatgttttattttcttgttcttgtcactattgtattttattttgcataatcatgcccttcactgacagtctccttaacatcatctgtttactctgctcagtgtaaactacaatgctctgtcatctccctactgggtctcctgggaggaggggagccatccagggtgcaaactcaaaggcagagggcacagcgtgcttaggcccaagcttagaattcaattgagaagttctgttgttcatccttacctcagcaggtagaaaagaggtggagatcagaagccagggattagagattgaattgctttccctgggagtgtgcagtatctcattaaaatgttgtatattcaaaaaaatacagacacacacaagtgcctatataatgataaaacatatccaaagcacccaaacctgtgattccagaaaagtagatcctatttttgtttatttttattggctttagctgtgtcttttgaaaggactattatcctctaaaatgtatgtgtatgaagatcctggcttgcagctcgggagctttacacaccttgtgtcactttatcttggtaacgagccaagatcatgcaaccagttcatccatgtctgacccaagagctcttaactgctatgctgcactgcctcattcagagatagatgcctgcatgggtcctggcgattattttaatgctggctacacccccacaggtgacttggattcagaaatacaatttatatttcttctttttaaattgttttattttatttttcttttaatagttatatgtcagtgagaacaatttatatgtcttacactgagaaataaaactgctcataagtgaaaa

SEQ ID NO: 1991 - DNA, 1522 bp, Homo sapiens
gagtgtgtgacccagcccttcccccgtggccaagcagagagagtggccttgaggaagccatagcagcaggaccagcatggcctctgctgcctctgtgaccagcctggcagatgaagtcaactgccccatctgtcagggtaccctgagggagccggtcactatcgactgcggccacaacttctgccgggcctgccttacccgctactgtgagataccaggcccagacctggaggagtcccctacttgcccactctgcaaagaacccttccgtcctgggagcttccggcccaactggcagctggctaacgtggtggagaacattgagcgcctccagctggtgtccacactgggtttgggagaggaggatgtctgccaagagcacggagagaagatctacttcttctgtgaggatgatgagatgcagttgtgcgtggtgtgccgggaggctggggagcacgctacccacaccatgcgcttcctggaggatgcagcggctccctatagggaacaaatccataagtgtcttaaatgtctaagaaaagagagagaggagattcaagaaatccagtcaagagaaaataaaaggatgcaagtcctcctgactcaggtgtccaccaagagacaacaggtgatttctgagttcgcacacctgaggaagtttctagaggaacagcagagcatcctcttagcacaattggagagccaggatggggacatcttgaggcaacgggatgaatttgatttgctggttgctggggagatctgccggtttagtgctcttattgaagaactggaggagaagaatgagaggccagcaagggagctcctgacggacatcagaagcactctaataagatgtgaaaccagaaagtgccggaaaccggtggctgtgtcgccagagctgggccagaggattcgggactttccccagcaggccctcccgctgcagagggagatgaagatgtttctggaaaatctgcctaatcacctggttatccccacagctcacatttctctagaccctcagacttcccaccccaagctcctcttgtccgaggaccaccagcgagctcagttctcctacaaatggcagaactcaccagacaacccccaacgttttgaccgggccacctgtgttctggcccacactggcatcacaggggggagacacacgtgggtggtgagtatagacctggcccatgggggcagctgcaccgtgggcgtggtgagcgaggatgtgcagcggaagggggagcttcggctgcggccagaggagggggtgtgggctgtgaggctggcttggggcttcgtctcggctctgggctccttccccacacggctgaccctgaaggagcagccccggcaggtgagggtgtctcttgactatgaggtgggctgggtgaccttcaccaacgctgtcacccgagagcccatctacaccttcactgcctccttcactaggaaggtcattcccttctttgggctctggggccgagggtccagtttctccctgagctcctga

SEQ ID NO: 1992 - DNA, 3738 bp, Homo sapiens
ggagccgggacaccgagggaagaggccggagggagatcgcggaggggagggggcgggaggggggtggggtatcctgagtcgtccgtggtccggagtctggaaggccctagagcggcgccagtcgacccgcctcgccacaacttgcccagaccagacacgtttcatcctgcgccctgcaagaaggagccggcctgcctctctccgctttgctgctcctcggcctccgcgggcccggcccgcgtcagcagcgaccctggggtctgggtcccctgtgtcgcccccgcccgcctgcagcgcccggcacccgcccaggagcgcgcagctggggttctagggacgtatacttgagcaagagagaccacagctcttgttcccgctgatcctgcagcccagtggatggagtccagaatctacagacctgccaggaaagaaaaaaaaattcctgatgtctggtccaagcaggaattccccggtggattggggaatgtctggcttttcctcagcttattgatctctgtggtaaccactggaggcccccagaagacccatagaaatgagaggcctgaggtctacaagtcgctgctagaaatattttagcctctccaaagcccagaatgcagccccgacccaagtttgtaagggttctgggtgcacgctgaccctgcgcgggcagacgcgccctttgctccaggtccggacctgggcgctgctatagcaacgtcctggacgcccagaccttaggccgccgccgccgcggaagcgaggaacccggccttctcccgctcctgagggctgtggcggcggcggcccgggaggcggcccaggctgggtaaagaccgcccggctcctcctatgcaagctgaggcagcggattggttttcaagcatgcccttccagaagcatgtctactacccgctcgccagcggcccagaggggcccgacgtcgctgtggccgccgccgccgcgggtgcggcctccatggcctgtgcgccccccagcgcggcttcggggcccctgcccttcttccagttcaggccgcggctggagagtgtggactggcggcggctgagcgccatcgacgtggacaaggtggcgggggctgtggacgtgctgacgctgcaggagaacatcatgaacatcaccttctgcaagctggaagacgagaagtgcccacactgccagtcgggggtggacccggtgctgctgaagctcatccgtctggcgcagttcaccatcgagtacttgctgcactcacaagagttcctcacctcgcagctgcacaccctggaggagcggctgcgcctgagccactgcgacggcgagcagagcaagaagctgctcaccaagcaggcgggggagatcaagacgctcaaggaagagtgcaaacgccggaagaagatgatctccacccagcagctgatgatcgaggccaaagccaactattaccagtgccatttttgtgacaaggcctttatgaaccaagcttttctacaaagtcacattcaacgccgccacactgaagaaaattctcattttgagtatcagaaaaatgcacagattgagaagctccggagtgagatcgtcgtattgaaggaagagctgcagctcaccaggtctgagctagaggctgcacaccatgccagtgcagtcagattctccaaggaatatgaaatgcagaaaacaaaagaggaagactttttgaagttatttgacaggtggaaagaagaagaaaaggagaaactagttgatgaaatggaaaaagtcaaggagatgtttatgaaggaatttaaagaattaacttcgaagaattcagcattagaatatcaactgtcagaaatccagaagtccaatatgcagatcaagtccaacataggcacattaaaagatgcacacgagtttaaagaagaccgttctccatatccccaggatttccataatgtcatgcagcttcttgatagtcaggaaagcaaatggacagctcgagttcaagctattcatcaagaacacaagaaagagaagggtcggctcctgtcacatatagagaaacttcgaacctcaatgatagatgatctaaatgcaagcaatgttttctataagaaaaggatagaagagctagggcagagactccaggagcagaatgagctgattataactcagagacagcagattaaagactttacctgtaatccattaaacagtatcagtgaacccaaaggaaatcctttagcctggcaggcttttgaatctcagccagctgctccagctgtgcctatgaatgccccagccctgcacactttggaaactaaatcaagtctgccaatggtgcatgaacaggcattctcgtcgcacatactggaaccaatagaagaactttcagaggaagaaaaaggaagggaaaatgaacagaaattaaataacaacaaaatgcatttaaggaaagctttgaagagtaactcctccctcactaagggactaagaacaatggtggagcagaacttgatggagaaactggaaaccttggggattaatgcagatatacgtggcatttcaagtgatcagttgcatagagtactaaaaagtgtggaatcagaaagacataagcaagaaagagaaatacctaactttcatcaaattcgagaattccttgaacatcaagtcagctgtaaaattgaggagaaagcactactctcttcagatcagtgcagtgtttctcaaatggataccctttcaactggagaagtacccaaaatgatacaacttccttccaaaaacagacaactgattagacaaaaagctgtttctactgataggacatctgttccaaaaattaagaaaaatgtcatggaagatccttttcccagaaagtcttcaactattacgacccctccttttagttcagaggaggagcaggaggacgacgacctcatccgggcatacgcatccccaggcccacttcctgtgccgccaccacaaaacaagggcagcttcgggaagaacacagtgaaaagtgacgcggacgggaccgagggaagcgaaatcgaggacactgatgattctcccaagcccgcaggagtcgccgttaaaacacctactgaaaaagttgaaaagatgtttccacatcgcaaaaatgtgaacaaaccagtcggtggaactaatgtccctgagatgtttatcaaaaaagaagaattacaagaactaaagtgtgcggatgtggaggatgaagactgggacatatcatccctagaggaagagatatctttgggaaaaaaatctgggaaagaacagaaggaacctccacctgcgaaaaatgaaccacattttgctcatgtgctaaatgcctggggcgcatttaatcctaaggggccaaagggagaaggacttcaagaaaatgaatcaagcacattaaaaagcagcttagtaactgtgactgattggagcgacacttcagatgtctaattccacatgtcagaagattattccagaagccagcagtatttcagtatcacagtgtttcagtaatttgcctccatgattctagtgcttctgccttaccgtgtttcccacagcaacacagagactgattcaaagaacaatggtctctttaatggcacccaatacagtattgaaaatcagatcatcaacagtatttcgaagcatgtaaaggtgtttaagacttccgctgctgcttaaaaataacatgtcattgaagtcataaaaagttttttcttcagaaaggta

SEQ ID NO: 1993 - DNA, 894 bp, Homo sapiens
cggttcctaccaaccgttcttattgctggcggcctgaggagcccatcatggcgacgccccctaagcggcgggcggtggaggccacgggggagaaagtgctgcgctacgagaccttcatcagtgacgtgctgcagcgggacttgcgaaaggtgctggaccatcgagacaaggtatatgagcagctggccaaataccttcaactgagaaatgtcattgagcgactccaggtaaagactatgggattgggtaccatttttttggtatgtgtgggcaagggagggaaatgggaagagagactccagacccaaccctgtcacctgacctaagagttcaccactgacccctacctctttttccctggccccacaggaagctaagcactcggagttatatatgcaggtggatttgggctgtaacttcttcgttgacacagtggtgtgagtgtctacccgcccctctgagcccacagggttcagcttaccccttccctcatgcaacttatatttttttgagtatcttctatgtaccaggcactatgcgaggttttatatcccagtaggatataagctaggtgctggggatgtgacagtgaataaaataggacaaaatccctgccttcccagagcctcaatttggggaagggtggggagcaaaacataaactatgctaaacagtgataaggacttctccccacttcctctaacctctctttcctcagcccagatacttcacgcatctatgtggccctgggatatggttttttcctggagttgacactggcagaagctctcaagttcattgatcgtaagagctctctcctcacagagtaagtccattccatgaggatagtgtgtaaaaacaccaccatttccaacactcttctccctttaccca

SEQ ID NO: 1994 - DNA, 2548 bp, Homo sapiens
aggtgtcaccacagtgatggcagtggaggacagcacgctgcaagtagtggtacgggtgcggccccccacccctcgggagctggacagtcagcggcggccagtggttcaggtggtggacgagcgggtgctggtgtttaaccctgaggagcccgatggagggttccctggcctgaaatggggtggcacccatgatggccccaagaagaagggcaaagacctgacgtttgtctttgaccgggtctttggcgaggcggccacccaacaggacgtgttccagcacaccacgcacagcgtcctggacagcttcctccagggctacaactgctcagtgtttgcctacggggccaccggggctgggaagacacacaccatgctgggaagggagggggaccccggcatcatgtacctgaccaccgtggaactgtacaggcgcctggaggcccgccagcaggagaagcacttcgaggtgctcatcagctaccaggaggtgtataatgaacagatccatgacctcctggagcccaaggggccccttgccatccgcgaggaccccgacaagggggtggtggtgcaaggactttctttccaccagccagcctcagccgagcagctgctggagatactgaccagggggaaccgtaaccgcacgcagcaccccactgatgccaacgcgacttcctcccgctcccatgccatcttccagatctttgtgaagcagcaggaccgggttccaggactgacccaggctgtccaggtggccaagatgagcctgattgacctggctggctcagagcgggcatccagcacccatgcgaagggggagcggctgcgggagggggccaacatcaaccgctctctgctggcgctcatcaacgtcctcaatgccttggccgatgcaaagggccgcaagacccatgtgccctaccgggacagcaaactgacccgcctgctcaaagactccctcgggggcaactgccgcacagtgatgatcgctgccatcagcccctccagcctgacctacgaggacacgtacaacaccctcaaatatgccgaccgggccaaggagatcaggctctcgctgaagagcaatgtgaccagcctggactgtcacatcagccagtatgctaccatctgccaacagctccaggctgaggtagccgctctgaggaagaagctccaagtgtatgaggggggaggccagcccccaccacaggacctcccaggatctcccaagtcgggaccaccaccagaacaccttcccagctcccccttgccaccccaccctcccagccagccctgcaccccagagctccctgcagggcctagagcccttcaagaggagagtctggggatggaggcccaggtggagagggccatggaagggaactcttcagaccaggagcagtccccagaggatgaggatgaaggcccagctgaggaggttccaacccagatgccagagcagaaccccacacatgcactgccagagtcccctcgcctgaccctgcagcccaagccagtcgtgggccacttctcagcacgggaactggatggggaccgttctaagcagttggccctaaaggtgctgtgcgttgcccagcggcagtactccctgctccaagcagccaacctcctgacgcccgacatgatcacagagtttgagaccctacagcagctggtgcaagaggaaaaaattgagcctggggcagaggccttgaggacttcaggcctggccaggggggcacctctggctcaggagctgtgttcagagtcaatccctgtgccgtctcctctctgcccagagcctccaggatacactggccctgtgacccggactatggcgaggcgactgagtggccccctgcacaccctgggaatcccgcctggacccaactgcaccccagcccaggggtcccgatggcccatggagaagaagaggaggagaccaagcgccttggaggcagacagtcccatggccccaaagcggggcaccaagcgccagcgccagtccttcctgccctgcctaaggagagggtctctgcctgacacccaaccttcacaggggcccagcacccccaaaggagaaagggcctcctccccctgccattcccctcgcgtttgcccagccacagtcatcaaaagccgggtgcccctgggcccttccgccatgcagaactgctccaccccgctggctctgcccactcgagacctcaatgccacctttgatctctctgaggagcctccctcaaagcccagtttccatgaatgcattggctgggacaaaataccccaggagctgagcaggctggaccagcccttcatccccagggcacctgtgcccctgttcaccatgaagggccccaagccaacatcttccctccctgggacctctgcctgcaagaagaagcgcgttgcgagttcctcagtctcccatggccgcagccgcatcgcccgcctccccagcagcactttgaagaggccaggccccttgtactcccaggtgactggcactagggacagggatagcctgggccatggaggccgatga

SEQ ID NO: 1995 - DNA, 978 bp, Homo sapiens
gagacggcggcggctgtagcggcgtgacaggagccccatggcacctgcccagccccacctcagcccatcttgacaaaatctaaggctccatggagccaccacggggcccccctgccaatggggccgagccatcccgggcagtgggcaccgtcaaagtatacctgcccaacaagcaacgcacggtggtgactgtccgggatggcatgagtgtctacgactctctagacaaggccctgaaggtgcggggtctaaatcaggactgctgtgtggtctaccgactcatcaagggacgaaagacggtcactgcctgggacacagccattgctcccctggatggcgaggagctcattgtcgaggtccttgaagatgtcccgctgaccatgcacaattttgtacggaagaccttcttcagcctggcgttctgtgacttctgccttaagtttctgttccatggcttccgttgccaaacctgtggctacaagttccaccagcattgttcctccaaggtccccacagtctgtgttgacatgagtaccaaccgccaacagttctaccacagtgtccaggatttgtccggaggctccagacagcatgaggctccctcgaaccgccccctgaatgagttgctaaccccccagggtcccaggtagggatgccttagctgaagagctgctgggggagaaaaagatcttggggctcttgtagaccacgagccatactttattcatttgtttacttgacaaacatttattgagcacctacaagtgtgagtaagggcatgaaactgggaccttgggcaagtcacctcatttctctgggcctcagttttctcatctgtaaagaggggatgatgatactttctaccatataaaggttctggtgaggcttaaatgagttaagacatgttcagtgcctagaacaggatctggtacagtgtaaataatcaatttttttgttattaattataaatatatttat

SEQ ID NO: 1996 - DNA, 2458 bp, Homo sapiens
tgacccaataagggtggaaggctgagtcccgcagagccaataacgagagtccgagaggcgacggaggcggactctgtgaggaaacaagaagagaggcccaagatggagacggcggcggctgtagcggcgtgacaggagccccatggcacctgcccagccccacctcagcccatcttgacaaaatctaaggctccatggagccaccacggggcccccctgccaatggggccgagccatcccgggcagtgggcaccgtcaaagtatacctgcccaacaagcaacgcacggtggtgactgtccgggatggcatgagtgtctacgactctctagacaaggccctgaaggtgcggggtctaaatcaggactgctgtgtggtctaccgactcatcaagggacgaaagacggtcactgcctgggacacagccattgctcccctggatggcgaggagctcattgtcgaggtccttgaagatgtcccgctgaccatgcacaattttgtacggaagaccttcttcagcctggcgttctgtgacttctgccttaagtttctgttccatggcttccgttgccaaacctgtggctacaagttccaccagcattgttcctccaaggtccccacagtctgtgttgacatgagtaccaaccgccaacagttctaccacagtgtccaggatttgtccggaggctccagacagcatgaggctccctcgaaccgccccctgaatgagttgctaaccccccagggtcccagcccccgcacccagcactgtgacccggagcacttccccttccctgccccagccaatgcccccctacagcgcatccgctccacgtccactcccaacgtccatatggtcagcaccacggcccccatggactccaacctcatccagctcactggccagagtttcagcactgatgctgccggtagtagaggaggtagtgatggaaccccccgggggagccccagcccagccagcgtgtcctcggggaggaagtccccacattccaagtcaccagcagagcagcgcgagcggaagtccttggccgatgacaagaagaaagtgaagaacctggggtaccgggactcaggctattactgggaggtaccacccagtgaggtgcagctgctgaagaggatcgggacgggctcgtttggcaccgtgtttcgagggcggtggcatggcgatgtggccgtgaaggtgctcaaggtgtcccagcccacagctgagcaggcccaggctttcaagaatgagatgcaggtgctcaggaagacgcgacatgtcaacatcttgctgtttatgggcttcatgacccggccgggatttgccatcatcacacagtggtgtgagggctccagcctctaccatcacctgcatgtggccgacacacgcttcgacatggtccagctcatcgacgtggcccggcagactgcccagggcatggactacctccatgccaagaacatcatccaccgagatctcaagtctaacaacatcttcctacatgaggggctcacggtgaagatcggtgactttggcttggccacagtgaagactcgatggagcggggcccagcccttggagcagccctcaggatctgtgctgtggatggcagctgaggtgatccgtatgcaggacccgaacccctacagcttccagtcagacgtctatgcctacggggttgtgctctacgagcttatgactggctcactgccttacagccacattggctgccgtgaccagattatctttatggtgggccgtggctatctgtccccggacctcagcaaaatctccagcaactgccccaaggccatgcggcgcctgctgtctgactgcctcaagttccagcgggaggagcggcccctcttcccccagatcctggccacaattgagctgctgcaacggtcactccccaagattgagcggagtgcctcggaaccctccttgcaccgcacccaggccgatgagttgcctgcctgcctactcagcgcagcccgccttgtgccttaggccccgcccaagccaccagggagccaatctcagccctccacgccaaggagccttgcccaccagccaatcaatgttcgtctctgccctgatgctgcctcaggatcccccattccccaccctgggagatgagggggtccccatgtgcttttccagttcttctggaattgggggacccccgccaaagactgagccccctgtctcctccatcatttggtttcctcttggctttggggatacttctaaattttgggagctcctccatctccaatggctgggatttgtggcagggattccactcagaacctctctggaatttgtgcctgatgtgccttccactggattttggggttcccagcaccccatgtggattttggggggtcccttttgtgtctcccccgccattcaaggactcctctctttcttcaccaagaagcacagaattc

SEQ ID NO: 1997 - DNA, 4725 bp, Homo sapiens
atggtctctagcgaccggcccgtgtcactggaggacgaggtctcccatagtatgaaggagatgattggaggctgttgcgtttgctcagacgagagaggctgggccgagaacccgctggtttattgcgacgggcacggctgcagcgtcgcggtgcatcaagcttgctatggcattgttcaagtacccactggaccgtggttttgcaggaaatgtgaatctcaggagagagcagccagagtgagatgtgaactttgtccccataaggatggagctttaaaaagaacagataatgggggttgggcccatgtggtttgtgccctgtatattccagaggtacaatttgccaatgtttccacaatggaaccaattgttttacagtctgttccgcatgatcgttataataagacttgctacatttgtgatgaacaaggaagagaaagcaaagcagccactggtgcttgcatgacatgtaataaacatggatgtcgacaggctttccatgtaacatgcgctcagtttgccggactgctttgtgaagaagaaggtaatggtgccgataatgtccaatactgtggctactgtaaataccattttagtaagctgaaaaagagcaaacggggatctaataggtcatatgatcaaagtttaagtgattcttcctctcactctcaggataaacatcatgagaaagagaaaaaaaaatataaagagaaggacaaacacaaacagaaacacaagaagcagccagaaccatcacctgcattggttccatccttgactgttactacagaaaaaacttatacaagcactagcaacaactctatatctggatcattgaagcgcttggaagatactactgcacgatttacaaatgcaaatttccaggaagtctctgcacacacctctagtggaaaagatgtttcagagactagagggtcagagggcaaagggaagaaatcttcagctcacagctcaggtcaaaggggaagaaagcctggtggtggaagaaatccaggaacaactgtgtcagcagctagcccttttcctcaaggcagtttttcaggaactccaggcagtgtaaagtcatcttctggaagttcagtgcagtctccccaggatttcctgagctttacagactcagatctgcgtaatgacagttactctcactcccaacagtcatcagcaaccaaagatgtacataaaggagagtctggaagccaggaagggggggtaaatagttttagtaccttaattggcctcccttcaacctcagctgttacttcacagcctaaaagctttgaaaattcacctggagatttgggtaattccagccttcctacagcaggatataagcgggctcaaacttctggcatagaagaagaaactgtaaaggaaaagaaaaggaaaggaaataaacaaagtaagcatgggcctggcagacccaaaggaaacaaaaatcaagagaatgtttctcatctctcagtttcttctgcttcaccaacatcatctgtagcatcagctgcaggaagcataacaagctctagtctgcagaaatctcctacattgctcaggaatggaagtttacagagcctcagtgttggctcatctccagttggttcagaaatttccatgcagtatcggcatgatggagcttgcccaacaactacgttctcagagttgctgaatgcaatacacaacggtatttataacagcaatgatgtagcagtatcgtttccaaatgtagtatctggctcgggatctagtactcctgtctccagctctcacttacctcagcagtcttctgggcatttgcaacaagtaggagcgctctctccctcagctgtgtcatctgcagcccctgctgttgctacaactcaggcaaatactctatctggatcttctctcagtcaggcaccatctcatatgtatggcaatagatcaaattcatcaatggcagctcttatagctcagtctgaaaacaatcaaacagatcaagatcttggagacaatagccgcaacctagttggcagaggaagctcaccccgaggaagtctctcgccacgatcccctgtaagcagcttacagattcgctatgatcaaccaggcaacagcagtttggaaaatctgcctccagtagcagccagcatagaacagcttttggagaggcagtggagtgaaggacagcaatttttactagaacagggtactcctagtgacattttaggaatgctgaagtcattacaccaacttcaagttgaaaaccgaagattagaggaacaaattaaaaacttgactgccaaaaaggaacggcttcagttattgaatgcacagctttcagtgccttttccaacaataacagcaaatcctagtccgtctcatcaaatacacacattttcagcacagactgctcctactactgattccttgaacagcagtaagagccctcatataggaaacagctttttacctgataattctcttcctgtattaaatcaggacttaacctccagtggacaaagtaccagcagctcatcagctctttctaccccacctcctgctgggcagagtccggctcaacaaggctcaggagtgagtggagttcagcaggtcaatggcgtgacagtgggggcactagctagtggaatgcagcctgtaacttccaccattcctgccgtgtctgcagtgggtggaataattggagctttgccaggtaaccaactggcaattaatggcattgtaggagctttaaatggggttatgcagactcctgtcacaatgtcccagaaccctacccctctcacccacacaaccgtaccacctaatgcaacacatccaatgccagctacactgactaacagtgcctcaggactaggattactttctgaccagcaacgacaaatacttattcatcaacagcagtttcagcagttgttaaattctcaacagctcacaccagtacacaggcacccccacttcacacagctaccaccaacccatttctcaccatccatggagataatgcaagtcagaaagtagcaagacttagtgataaaactgggcctgtagctcaagagaaaagttgacacctgagaaacatctagaaattgcctatcctgctgttctagcacttcatctggctgcctttgcagtccttttactacagctatgaagaaacgcaacaagaaactcaatgcacaacaaaggattaattgctgcaaggacattcttgtaaggctttgattagttttcttgttgctttgttgcactgaaatggaattcccatgcccctaccccttaccccagttttttgaacatggaaagaaaatttaataactttttaaagtgacataatttacatgcaatatgtttatcaactcaagaatttaatatagttggtacacaactagttttgtttataaattggagatgcaaatagcaaaactaaatacttgctccatttacaaactacttgattttattgtacaagttgaaatatgctcttttgtttgggttacagtatgcttgctctaagtcaaattccaaggaactaatttcttctcctggagttgcattgattcagtattacaaatatatagcacatcacctgggacttggcaatctttgttaaaaaaaaatttcctttctaatgggatttggccaattttggtaatgaagttaggatggtaatgtctgcatctgctaaaggtaattttcttttgagaattgctttctttagtgttaagacctactcatattttgaagaaatcttgagttaagtgagttctgaggctgctgggggaaccagatcaattcaaagctaaatacttctttcagaaaggggccactgtggaaagtgctggtggggtttgcccttgatcaagtgcctccattgtgctgcaagggctgtagacagcagggtgggacagtcagtcctccgagcagcaggaatcatcccgtcacctgcagccttcccatgcttccgcctttattcagaactttctgtgccactgtagatagctcaggcaaaactattacctgggtatttatccactaatgagtcacaagaaaaggagtggatttggtaagaatagagatttgttttatttaaaccacttcccattactgaccattaaaagctcaccactagagttcctgaaacaggtgaaacctgtatgacagcccttccactttggggagccacgcttttgatgtgacagtaccgcagagtgattcccccactgaggatgtcatcatcaaactcttctttggtgtgtgaattattagtggaaaagacccagctgtaattagacctccactgtgtacttagctggaagaacatgttaattctgcaatatgtttcttggttaaacattgcacagttcttacctcatttctgtaaataaagttttgtgaatctgttttgtattgtgacaaattcataagataacattgatattttgatttgtaatatttctaattggtagatttaattgaaaagtaaaattaatttatttttatatgttcaggggaattttaaagtcaaatcttttgtagataatttaaaaaatcagtgtggtttattttacttatttaacccactggttgttattctgtaacagtttgtataaatggtaaattttgaatgtgttgttattttacctagatgtaaaattccacatgtattaaaatgtacaaaatgttttgttaataaaatttaataatgtt

SEQ ID NO: 1998 - DNA, 5126 bp, Homo sapiens
cgcgcacgcagggctagcctcgcccaggcctcctccctcacgccggccgcaggacgggcgcgcacgccaagtgacgctccgaggaggaagcgcagcccccttcccctccctcgctgcccctggcccagcgggagccccccctccccccagtgcgcctgtgcggaggccctcttgattatgtgtgccctctccgggcgcccgcgttagcggccgggtggaggtggggagggaagacgctgaggaggaggaggaggcggaggaggcggtggaggggaggtggggggaatcagcaaggacatggctcctgactcctgtgcggaacgtgagtgactgagcggcaaagcccgaatggtctctagcgaccggcccgtgtcactggaggacgaggtctcccatagtatgaaggagatgattggaggctgttgcgtttgctcagacgagagaggctgggccgagaacccgctggtttattgcgacgggcacggctgcagcgtcgcggtgcatcaagcttgctatggcattgttcaagtacccactggaccgtggttttgcaggaaatgtgaatctcaggagagagcagccagagtgagatgtgaactttgtccccataaggatggagctttaaaaagaacagataatgggggttgggcccatgtggtttgtgccctgtatattccagaggtacaatttgccaatgtttccacaatggaaccaattgttttacagtctgttccgcatgatcgttataataagacttgctacatttgtgatgaacaaggaagagaaagcaaagcagccactggtgcttgcatgacatgtaataaacatggatgtcgacaggctttccatgtaacatgcgctcagtttgccggactgctttgtgaagaagaaggtaatggtgccgataatgtccaatactgtggctactgtaaataccattttagtaagctgaaaaagagcaaacggggatctaataggtcatatgatcaaagtttaagtgattcttcctctcactctcaggataaacatcatgagaaagagaaaaaaaaatataaagagaaggacaaacacaaacagaaacacaagaagcagccagaaccatcacctgcattggttccatccttgactgttactacagaaaaaacttatacaagcactagcaacaactctatatctggatcattgaagcgcttggaagatactactgcacgatttacaaatgcaaatttccaggaagtctctgcacacacctctagtggaaaagatgtttcagagactagagggtcagagggcaaagggaagaaatcttcagctcacagctcaggtcaaaggggaagaaagcctggtggtggaagaaatccaggaacaactgtgtcagcagctagcccttttcctcaaggcagtttttcaggaactccaggcagtgtaaagtcatcttctggaagttcagtgcagtctccccaggatttcctgagctttacagactcagatctgcgtaatgacagttactctcactcccaacagtcatcagcaaccaaagatgtacataaaggagagtctggaagccaggaagggggggtaaatagttttagtaccttaattggcctcccttcaacctcagctgttacttcacagcctaaaagctttgaaaattcacctggagatttgggtaattccagccttcctacagcaggatataagcgggctcaaacttctggcatagaagaagaaactgtaaaggaaaagaaaaggaaaggaaataaacaaagtaagcatgggcctggcagacccaaaggaaacaaaaatcaagagaatgtttctcatctctcagtttcttctgcttcaccaacatcatctgtagcatcagctgcaggaagcataacaagctctagtctgcagaaatctcctacattgctcaggaatggaagtttacagagcctcagtgttggctcatctccagttggttcagaaatttccatgcagtatcggcatgatggagcttgcccaacaactacgttctcagagttgctgaatgcaatacacaacgacagaggtgacagttctacactaacaaagcaagaacttaaattcataggtatttataacagcaatgatgtagcagtatcgtttccaaatgtagtatctggctcgggatctagtactcctgtctccagctctcacttacctcagcagtcttctgggcatttgcaacaagtaggagcgctctctccctcagctgtgtcatctgcagcccctgctgttgctacaactcaggcaaatactctatctggatcttctctcagtcaggcaccatctcatatgtatggcaatagatcaaattcatcaatggcagctcttatagctcagtctgaaaacaatcaaacagatcaagatcttggagacaatagccgcaacctagttggcagaggaagctcaccccgaggaagtctctcgccacgatcccctgtaagcagcttacagattcgctatgatcaaccaggcaacagcagtttggaaaatctgcctccagtagcagccagcatagaacagcttttggagaggcagtggagtgaaggacagcaatttttactagaacagggtactcctagtgacattttaggaatgctgaagtcattacaccaacttcaagttgaaaaccgaagattagaggaacaaattaaaaacttgactgccaaaaaggaacggcttcagttattgaatgcacagctttcagtgccttttccaacaataacagcaaatcctagtccgtctcatcaaatacacacattttcagcacagactgctcctactactgattccttgaacagcagtaagagccctcatataggaaacagctttttacctgataattctcttcctgtattaaatcaggacttaacctccagtggacaaagtaccagcagctcatcagctctttctaccccacctcctgctgggcagagtccggctcaacaaggctcaggagtgagtggagttcagcaggtcaatggcgtgacagtgggggcactagctagtggaatgcagcctgtaacttccaccattcctgccgtgtctgcagtgggtggaataattggagctttgccaggtaaccaactggcaattaatggcattgtaggagctttaaatggggttatgcagactcctgtcacaatgtcccagaaccctacccctctcacccacacaaccgtaccacctaatgcaacacatccaatgccagctacactgactaacagtgcctcaggactaggattactttctgaccagcaacgacaaatacttattcatcaacagcagtttcagcagttgttaaattctcaacagctcacaccagtacacaggcacccccacttcacacagctaccaccaacccatttctcaccatccatggagataatgcaagtcagaaagtagcaagacttagtgataaaactgggcctgtagctcaagagaaaagttgacacctgagaaacatctagaaattgcctatcctgctgttctagcacttcatctggctgcctttgcagtccttttactacagctatgaagaaacgcaacaagaaactcaatgcacaacaaaggattaattgctgcaaggacattcttgtaaggctttgattagttttcttgttgctttgttgcactgaaatggaattcccatgcccctaccccttaccccagttttttgaacatggaaagaaaatttaataactttttaaagtgacataatttacatgcaatatgtttatcaactcaagaatttaatatagttggtacacaactagttttgtttataaattggagatgcaaatagcaaaactaaatacttgctccatttacaaactacttgattttattgtacaagttgaaatatgctcttttgtttgggttacagtatgcttgctctaagtcaaattccaaggaactaatttcttctcctggagttgcattgattcagtattacaaatatatagcacatcacctgggacttggcaatctttgttaaaaaaaaatttcctttctaatgggatttggccaattttggtaatgaagttaggatggtaatgtctgcatctgctaaaggtaattttcttttgagaattgctttctttagtgttaagacctactcatattttgaagaaatcttgagttaagtgagttctgaggctgctgggggaaccagatcaattcaaagctaaatacttctttcagaaaggggccactgtggaaagtgctggtggggtttgcccttgatcaagtgcctccattgtgctgcaagggctgtagacagcagggtgggacagtcagtcctccgagcagcaggaatcatcccgtcacctgcagccttcccatgcttccgcctttattcagaactttctgtgccactgtagatagctcaggcaaaactattacctgggtatttatccactaatgagtcacaagaaaaggagtggatttggtaagaatagagatttgttttatttaaaccacttcccattactgaccattaaaagctcaccactagagttcctgaaacaggtgaaacctgtatgacagcccttccactttggggagccacgcttttgatgtgacagtaccgcagagtgattcccccactgaggatgtcatcatcaaactcttctttggtgtgtgaattattagtggaaaagacccagctgtaattagacctccactgtgtacttagctggaagaacatgttaattctgcaatatgtttcttggttaaacattgcacagttcttacctcatttctgtaaataaagttttgtgaatctgttttgtattgtgacaaattcataagataacattgatattttgatttgtaatatttctaattggtagatttaattgaaaagtaaaattaatttatttttatatgttcaggggaattttaaagtcaaatcttttgtagataatttaaaaaatcagtgtggtttattttacttatttaacccactggttgttattctgtaacagtttgtataaatggtaaattttgaatgtgttgttattttacctagatgtaaaattccacatgtattaaaatgtacaaaatgttttgttaataaaatttaataatgtttataa

SEQ ID NO: 1999 - DNA, 1732 bp, Homo sapiens
gttgccgtagagatgggcagggctggatggagtggggtgcggtgagctgagctgaccctgcttcgccacggggactgcagtgaccccggcttgccggcagggcgggtaacaggttgagccagggtggggctgctcaggggcgtggagccgaggccaggatttctctgaagacccggcacaggctattcctttctgcgacgagcccattgctatggaaaccaaagcgttaggccagcggggattgaggctgcgggatcatgacgggtctctctcccgaagaaccttgcctaaggcttccccaagcggctacttcctgagcgaacccgcccacccgcctgaaggagagagttttccatggacacagcctagcagaaagacgcagccttcgtgcttcgctgactgctgaccactgacccaccgccttgatgacagcaccctcgtgtgccttcccagttcagttccggcagccctcagtcagcggcctctcgcagataaccaaaagcctgtatatcagcaatggtgtggccgccaacaacaagctcatgctgtctagcaaccagatcaccatggtcatcaatgtctcagtggaggtagtgaacaccttgtatgaggatatccagtacatgcaggtacctgtggctgactcccctaactcacgtctctgtgacttctttgaccctattgctgaccatatccacagcgtggagatgaagcagggccgtactttgctgcactgtgctgctggtgtgagccgctcagctgccctgtgcctcgcctacctcatgaagtaccacgccatgtccctgctggacgcccacacgtggaccaagtcatgccggcccatcatccgacccaacagcggcttttgggagcagctcatccactatgagttccaattgtttggcaagaacactgtgcacatggtcagttccccagtgggaatgatccctgacatctatgagaaggaagtccgtttgatgattccactgtgagccatcccacgagcccctgcattggagtcagaggtacagatctattgttgatcttacaccaagatccaaacttgaacattctacttttgttgatacagaaaaaaacagatgatgccttttatgagcacaaaaaagagttgctgtagcttttaactttataatccattttttttaagattaaactaattgtgagatggtgaagataaattttctgccctgtgagtgacactggccaggggataggttgaggcagatggtgcccagaagaaagagggcagcacccattgcacatggcaggcctggaatcctgcagccctccccaaaaacagattgacccaggaatgaatctgctacaattccacctcattctttcacacccagagccagagccttaagcatcatggtacctcttgcgcttcttacagtggtggttcctgctgccctccaggttgtgcatctgaagcctacaagaaagtttgcctacctggggcagctggatcacaaagttggctggaagtaccagacagtgacagccaccctggaggagaagaggaaggagaaggccaagatccactaccagaataagaaacagctcatgggatggccgggcgcggtggctcacgcctgtaatcctagcactttgggaggcggaggcgggcagatcaggaggtcaggagattgagaccatcctggctaacatggtgaaacccagtctctactaaaaaaataaaaaataaaaa

SEQ ID NO: 2000 - DNA, 905 bp, Homo sapiens
tgattatgtgtgccctctccgggcgcccgcgttagcggccgggtggaggtggggagggaagacgctgaggaggaggaggaggcggaggaggcggtggaggggaggtggggggaatcagcaaggacatggctcctgactcctgtgcggaacgtgagtgactgagcggcaaagcccgaatggtctctagcgaccggcccgtgtcactggaggacgaggtctcccatagtatgaaggagatgattggaggctgttgcgtttgctcagacgagagaggctgggccgagaacccgctggtttattgcgacgggcacggctgcagcgtcgcggtgcatcaagcttgctatggcattgttcaagtacccactggaccgtggttttgcaggaaatgtgaatctcaggagagagcagccagagtggcagagtctcgctctgttgcccaggctaaagtgcagtggtgtgatctcagcccactgcaacctctgctccccgggttcaagcgattctcctgcctcagcctcccaaatggtatgcaattcctgttggttagcctcatctgaaaacgtcactcctggatacatagaacatcactgcgcatgtgcatctccccacccccgatgcctggtgtctaacgttcctccagtttctggtgctctgatgcattgcttttgggcttgtcttactacagcagctttcttcggtcctcagtcatttaccacttgtcatatgtcctttctagtttccagggatattcttttttatatttatggctttatgccatttatctcagttgtcatttggcgtttcaagaaggagaggtggtagtgtttaagtggaattaactacttgtgtttctgatgtggtcttttatatttcttacagggttttgttttaccaagtactagtct

SEQ ID NO: 2001 - DNA, 1136 bp, Homo sapiens
cgcggcagcgcgcacgcagggctagcctcgcccaggcctcctccctcacgccggccgcaggacgggcgcgcacgccaagtgacgctccgaggaggaagcgcagcccccttcccctccctcgctgcccctggcccagcgggagccccccctccccccagtgcgcctgtgcggaggccctcttgattatgtgtgccctctccgggcgcccgcgttagcggccgggtggaggtggggagggaagacgctgaggaggaggaggaggcggaggaggcggtggaggggaggtggggggaatcagcaaggacatggctcctgactcctgtgcggaacgtgagtgactgagcggcaaagcccgaatggtctctagcgaccggcccgtgtcactggaggacgaggtctcccatagtatgaaggagatgattggaggctgttgcgtttgctcagacgagagaggctgggccgagaacccgctggtttattgcgacgggcacggctgcagcgtcgcggtgcatcaagcttgctatggcattgttcaagtacccactggaccgtggttttgcaggaaatgtgaatctcaggagagagcagccagagtgatggtatgcaattcctgttggttagcctcatctgaaaacgtcactcctggatacatagaacatcactgcgcatgtgcatctccccacccccgatgcctggtgtctaacgttcctccagtttctggtgctctgatgcattgcttttgggcttgtcttactacagcagctttcttcggtcctcagtcatttaccacttgtcatatgtcctttctagtttccagggatattcttttttatatttatggctttatgccatttatctcagttgtcatttggcgtttcaagaaggagaggtggtagtgtttaagtggaattaactacttgtgtttctgatgtggtcttttatatttcttacagggttttgttttaccaagtactagtcttcagtctatcctgtttacttgattttttcccactcaactcacaaacatttttgaatcatctcatgaattctgctttccatttacatttttgcccttttgtcttttcctcttcgctgttaaacttcctgaaaaaataaaactagttgattcacttctt

SEQ ID NO: 2002 - DNA, 7196 bp, Homo sapiens
ggggactacgggtcggcgttgggctcagtgggctcgaaacaaagggctgtccggtggggattcgtcgcggcgccttctgagtggtcgggtcgaggcttctcggcctagcagtgccctcgctgcgcgatctcaggcgggttctcctcggctccgcgcagcccgcgccgcggtgggggacccggcgcagcggcacctgctgccgagggaccccgcggcccgccccggtgctcgtgatggggctgatcttcgccaaactgtggagcctcttctgtaaccaagaacacaaagtaattatagtgggactggataatgcagggaaaaccaccattctttaccaattcttaatgaatgaagtggttcatacttctccaaccataggaagcaatgttgaagaaatagttgtgaagaacactcattttcttatgtgggatattggtggtcaggagtctctgcgatcatcctggaacacatattactcaaatacagagttcatcattcttgttgttgatagcattgacagggaacgactagctattacaaaagaagaattatacagaatgttggctcatgaggatttacggaaggctgcagtccttatctttgcaaataaacaggatatgaaagggtgtatgacagcagctgaaatctcgaaatacctcacccttagttcaattaaggatcatccatggcacattcaatcctgctgtgctctcacaggagaagggttatgccaaggtctagagtggatgacctcccggattggtgtgagataacttttttgcttgaaagagactgctctatttattctgtgacatgaacattttttcctagtacctttggctgctaaggcagcagcatgtttaatttataacaacacaaacctctgagagcaacacttgaatcaagtgcagctgaactggaacataaaagattttttcttaactttttttttttaacacactaatcttcagttggatgaatgtaatgtataactatgttttcagcaacaattcttctgtttattctaattaatcagtgactgccttgtaagaaatgtttgtcatatgcgtgatgtcttctgaaatattcttataaccttaatgaccaattgctttcaattcttgaccagcactccctcccaaccagagaattactggtttgatagagtagtcttggaaaccatcaggtactgcctgcagacttctccagcactaaatatatttgttccctctataaaccattcatctttcggacagaacttactgtaaagaaagaaatctgcctagaggatatatgtaaggaagattccacatcatgagtacttgccttttaactttcccccacattactgttgagtcatggaataatgtttaagttgttatttgcatggaaattaagtaggctgtttatttatctaaaggaatcaagtccactcttctgcctgcaacatttgttcaaaaactaaccaaggtaaaatatttatttgaaagcccaactttgatgttaaatattcttgaataaatctgttattttaagaatatcacattattcaatgcatataaaactatcagaagttagtaaatcataccagcactaaaaataagacaattggaatatattttagcatcagtttacaaacaactttattatcaacagaaattttagctcttttctttgcaagatatatcacagctgctttgggcagtagctgaagccgaagtatgaacagtccattttgtttcttaaaatttgaagtcgtgtctgtcatagcatttttactaccagcagtatgttacttaaaaaactacatggctttccttgaatttatttgacggtattatgtaatagacttgaaacaattgccatctttgtagttatgccttgggttctaaaatgttataggaaactgctgaattgaatcctagcttttagaatattaataggagactcaaagttaatattcttaacaacttaaaattaaaaaaagtcataatctatcaaaagtttatttattggatggcattaaaacatttttgaggcagttgtctaatatgaacaataatctaaacaatatattccttaaattaagaggaaagacaagtgtcgtatttcgatcctgtttattcaaatgtgtgattttgctgaaatgaaagggataaaatgaatacttagagaataatacttcatttttgcagtactttttaattttgataaaaaagatacaaagttcataatatcaaaatatgtgttcaaaattggtattttaattttaatatttttgtaagttgatttaaattttgctcttttttcaggtgtgcttggtttattatatttagtcaagttaatttagtcgaatgtggtaacatttttctgatttatctttagttggagcacacccttgaactgaacagtggccaaaggaaagctttctgggctttggaaagtagttgtttaactttgttttaagccgttttcttagtgattctgtatcaagtagaggataagtgtagtttaacttagtttttaatataacccataatcaagaacatgagcgaaaagcagacataaatcgatatggatggtttgtggtgtgtgtgggatgtgggggaattaagaaaatgccatttacctaagcacagtttgcctgaatttctgcttggttgtgttgtttaccgtaagtactgagggtagtttccctaagtctgtcctgagaaaaagcatacttagtactcctgtatttgttcttatgaaatgactatctgccttcttgtatctagtaagattggctggctcaattttcttctgtcaaattatatggttattttttatattaccacatcagcattatattaaaagtgtttttaatagttgattgtattttgccaactactagtatagactcaaatttgctatttaatttttaaaatacaatttattttgtaaatcctttaaaaaatatttggttagttttggattagaaatgatttatgttagccatgtgttgaagatgaaattggcatcagtgtagacggtgctgattgggaaaagttcatgattaggaaattcatgtaagactttttaagagtattttttaggttttcactcaatctttcctgtcacagtaacgtgaaaactgattattctttactccaagagaatgttttaacccaagcaagtatctaatactagagcattggttctgacattcattgtaaatcagtgaactgtaagatactgtctaaaaaatgtacatttgtaattagtgcctttattcatattttgaaataagttcttagttttatattatacctgttctttagaagtcatgttagcagctaattatttcagtgatgaaataatttgtgttttatatcccccttcacctccatgtattggttagcacagtttatagtaagtgaaaagcaagggacccacctacattaccttcaggagactgttctaccttttaatttgaaaacaaggaaattaaattttaacagaaatcttttaagtatgttataaccaaagtgttcaattatccttgcaagttcaaatacagcatttttcttaattttgagcgtgtcatgtccttcatctttaaacccatcattcttattgaagcccatttgagaactcttagaattaatagaaccttttataagggaatatatggaatattttttattgttaatgtaacttaattccttaaaacctggaatattaatatatataatctattaaaagctgaagattaaatatgtaatttttgcttttagtttcttgtgttagtatgcttaaaggtatcaatacttttattctatattcattagaagaaaggtaataaatttaagtttcattgctgaaaaattttaaatgagtgccaccccatagccatagtcattttgattaagcataatttaactttcattatagcataaagagaaaataattattttagtatggaaacagtgataggcagtgctgtaaacaatattctctgaaaagttgtgggggtcacaaagaaaattttaaagaatatagaagcttttttaaaaaatctttttagtgtagtttcttagaacaaattataaacataatcattctgaataatcaatttttatttagtccttaactatgtaaaaccgtatcagtagaaaaatgtgctggtgtcgtgtctaaagatggataaatttctttggaatttatctttggagaccaactttatgaggcagactttttgtctacagctttggaaccaaaaaaacttcactctaattcagtcctaaaggctattttacattttgccggggtaaagtgacttcaagatacagcatggtgtcttgtatctagtagaatattgtgctagccatctaaaaaagtggatttgagccttaatttggccgtttctcaattgtctagttgaccttagacaattagtgtccatggctttccttttgtttttcccatactgaggaacttaaactacagctctaaaatgtcttttggttttaaaattctgaatgcttatatactactattaaaaattaaaaatccctcaaatagtagggcaatacaggtaatatgaaattaaatgtatttttatccattatttgattcccacctgttattttatttagaatacgaatacaaccaagtagggaaaaacgtatcagtaactgctattcaacttaaattcagcgaattaatagctgaatagaaatagctaatgacaatgcaaaagagaaaacaagccatattgctaagaaaaggatagtaagctgcttagaaagaaccagcctgtgttggaaataattctcttctagataatttaccttattttcttggcttgtactaattgaatggaagtggttaatttgttcagagtttattgccgtttgatgccaccccagtctatagttctgtgtgactttccatattgaaagagtagggttagtagccaggttgtcagtcttttacaaatgtctacataaatgtctacataaatctgaaagtggtttatattcaaggttagtttttcagtagcgtctcctccttattcattcacttttactgtgaagactgaaatccaaaagccaggttccccaaaaaagtatttttaaaaaattttaggggaccaaaataaatagaggaagaccaatataaaaaaatatgttcaactattccattttaaatttaaagcagaaaaaaaaattgtgcccctcagacctaaaggcagctttaaatgtatatagtttggtgaaacatttgggaaatattaatttggaggtttagaagcatacgaaaaacaaattcaaagcacttgaaagtaaagacaatatcatgaggtcgaaaaaacttcaaaaggatattaggtaagagaaaatgtgaatgaaagcagtgaatttctgcctctcctcgtatttagggtacttaaaattactaaaaaatactgtctttttaccatacagctagatggcctgtattattcttaatgtggccaaaggagtgaagactgattagggttttagaatttggaactgtagtcacataaaggcatcttttgcatttcttaaaccagtaatctacattttctcctggaaatggagaaatatgaaatgtgctgtgcatagcttttggaatagaaaacaaagttttaaaagaatggatatgttttcttgcacaacttgtaaaattttaattaaaaaattacctcatttttcaatccataaggtgctttgctcaagtttgtgggatgtttgtaccatcccataaaaacccccttcacccaaactgtatttgaaatatgcaaaattcataactaagggatagcattccttggagactttgttttgttttactcttgtttaccagctgggccaacatggtagatatatgagattcacatatggtttcattaaagcacataggaaagtgctcagtcaatatttaattagtttaattagataagggaaaggagaaatcctaaatttgatggattcttttatactgtgaatatatttccatcagtgttggtaagatatcaaatgactatcagttgatcccagtcatcagtgacttatttgcatatttaagccctattcacaagagaccataatcattttaatcttatattttccctcaggaaatttagggactctgaagcccctattttattctcttggagtaaactgttgagtgtagttacaaaaacttttatttatgacttaaaaaaagtttagctgctatttcagtgaaagtgtaaaataaaacggtcatgatttttttcaattacagaatagttacaaattttaccatgttcatctattccacagagcatgttaaaaacaacaacaacaaaaacctaacagcaattacaaccttggtgttgcgtttattctaatcagagtgaatgattataatcacactttgctattttaacataaattggtgctttagagcattaaagaggaagcagcaggccctgtactcagtatttattatttcttgcctcagaatgcaaaacaactttaaagtgtctatattcatatatatgtgcatttcttaagatttaaatacaaactgttgttactccttaagcttcaggctttctgcgaaagctctaagaatatcttcattactatgcttggtcaactggaagatggtattaataaggtcagaattaggaattggattgctctgtgggtcctccggtattgtgcagaggaaagaaaaatgtctttcacaccacaaactgtgtgtctgaaccccagccaaacaaatgtgttccattggtccaatatataagcattaacaacaacaacaaaaaatttaaaacaagtaaattaatgcattcacatgatcacttcttgaaaatggttcaaagcatgttttcctgatggtgggattgtttaaatgacatgttttaaagtttttaatactttattagttatgaagtgcttcttttatatgttaagtttaggttgccagtactcataatttttatttctgcaattatgttataatgagttgtttgcatgcctacttaacccaagtaaaacgatgctgtttgctctggaatgttcatcttttagacaggttttggctcatttccaatcatggtgcaatatagtgtaacattcatttgttttcattcaacagttttatttttgtcataataaataattacttttccaata

SEQ ID NO: 2003 - DNA, 4673 bp, Homo sapiens
gcagtgcggcaccttcccgtctgatgctggcgttgtgcgtatggtgccctgacgtctgtccacgtgggcgcggaagcaaacagcgatgtcccagacgcaggactacgagtgcaggagccataatgtcgacctgccggagtcgaggattccagggtcgaacactcggttggagtgggtggagatcatcgaaccgcgcacccgcgagcgcatgtacgccaacctggtcaccggtgagtgcgtgtgggacccgccggccggcgtccgcatcaagcgcaccagcgagaaccagtggtgggagctgttcgaccccaacacgtcccgcttctactactacaatgccagcacgcagcgcacggtgtggcaccggccgcagggctgcgacatcatcccgctggccaagctgcagacgctgaagcagaacacggagtccccgcgcgcctcggcggagagcagccccgggcgcggcagcagcgtcagccgtgagggcagcaccagctcctccctggagcccgagcccgacactgagaaagcgcaggagttgccagcgagggccgggcggcccgcggcgtttgggacagtgaaggaggacagcggcagctcttcaccaccaggagtgttccttgagaaggactatgagatttaccgggattacagtgcggacggccagcttcttcactacaggacctcctcgctgcggtggaactcgggcgccaaagagcgcatgctcatcaaggtcgctgatcgggagcccagcttcctcgccgcccagggcaatggctacgccccagacggcccacctggggtccgctcccgcagaccctccggcagccagcactcacccagcctgcagaccttcgccccggaggctgacggcaccatcttcttcccagagaggaggccgtcacccttcctgaagagggccgagctcccagggagcagctccccgctgctggcccagccccgaaagccctccggggactcgcagccctcctccccgcgctatggctatgaacccccgctctacgaggagcccccagtggagtaccaggcccccatctacgatgagccccccatggacgtgcaattcgaggctggcgggggctaccaggccggctctccccagcggtcgccgggccgtaagccccggccgttcctccagcccaacaagcagggccccccctcgccctgccagcagctggtgctcaccaagcagaagtgtcccgagcgcttcctgagcctggagtacagtcccgccggcaaggagtacgtgcggcagctggtctacgtggagcaggcgggctccagccccaagctgcgcgccggcccgcggcacaagtacgcgcccaaccccggcggtggttcgtactccttgcagcccagcccctgcctgctgagggaccagcgcctgggcgtcaagtccggagactacagcaccatggagggacctgagctgcggcacagccagccgcccacgccgctgccacaggcccaggaggatgccatgtcctggtccagccagcaggacaccctgtcctccacaggctactccccgggcacgcgcaagcggaagagcagaaagccctctttgtgccaagccaccagcgccacccccactgagggccccggggacctgcttgtggagcagcccctggccgaggaacagcccccgtgcgggaccagcctcgcccccgtgaagcgagcggaaggtgaggccgaaggggcgcggggcgcggccgagcccttcctggcgcaggctcggctggcctgggaggcgcagcaggcccacttccacatgaagcagaggagcagctgggactcccagcaggacggctctggctacgagagcgacggcgccctgccactgcccatgcccgggccggtggtgcgggccttcagcgaggacgaggcgctggcccagcaggagaacaggcactggaggaggggcaccttcgagaagctaggcttcccccagatcctgctggagaagagcgtctccgtgcagaccaacctggcctcaccagagccctacctccacccctcacagtctgaggacctcgctgcctgtgcccagttcgagagcagccggcagagccgcagcggcgttcccagctccagctgcgtcttccccactttcacgctgcgcaagccctcctcggagacggacatcgagaactgggcctccaagcacttcaacaagcacacgcagggcctcttccggcggaaggtgtccatcgccaacatgctggcctggagcagcgagtccatcaagaagcccatgatcgtgacaagcgaccggcacgtgaagaaggaggcctgcgagctcttcaagctgatccagatgtacatgggtgaccggcgggccaaggccgacccactgcacgtggccctggaggtggccaccaagggctggagcgtgcagggcctgcgggacgagctctacatccagctgtgccggcagaccaccgagaacttccgcctggagagcctggcccgcggctgggagctcatggccatctgcctggcctttttcccgcccacccccaagttccactcctacctggaaggctacatctaccggcacatggaccccgtcaatgacactaaagtgacacagcacataaaagagctcctggaaagaaacactaagaagaagtccaaattgagaaagaaacccaagccttatgttgaagagccggatggggtggcgataagcacgtatgccaagtactgttaccacaagctacagaaggcagccctgaccggggccaagaaggggctgaagaagcccaacgtggaggagatccggcatgccaagaacgccgtgttcagcccgtccatgttcggcagcgcactgcaggaggtcatgggcatgcagagagagcgctaccccgagcgccagctgccctgggtgcagacacggctctctgaggaggtgctggcgctcaacggtgaccagacagagggcatcttcagggtccctggggacattgacgaggtgaatgccctgaagctgcaggtggaccagtggaaggtgcccacaggcctggaagacccccacgtccctgcgtccctgctgaagctgtggtaccgggagctggaggagcccctgatcccgcacgagttctacgagcagtgcatcgcgcactacgacagccccgaggcggcggtggccgtggtgcacgcgctgccccgcatcaaccgcatggtgctgtgctacctcatccgcttcctgcaggtcttcgtgcagccggccaacgtcgcggtcaccaagatggatgtcagcaacctggccatggtgatggcgcccaactgcttgcgctgccagtccgacgacccgcgcgtcatcttcgagaacacccgcaaggagatgtccttcctgcgggtgctcatccagcacctggacaccagcttcatggagggtgtgctgtagcgggggcgcccggggacaggagggatgtcctgccgcccccagccaggccgaactccgcactcgctctcccggcagaggggccagaatcgcccggcccagccctggagccccctccactcccccaggcccctggccccggcgctccccacgtcttctgcctggtctgagggtgcagccagggcacagcagcggcggggagggcgcctctggccccccacctcacggccagttcccgcgggcaccgcctcgccctccgctggccgcgggtcagctccgagaaagtgccttctgtgtcctggagccgagcgacgctgcctccttggggccgggctgcctccctgtggctcctgcgcgccctggcctgggccttgcccagccgccccggtctctccttccctttctcctgtcctcgtcctggcctgcagctcttcccagccccgagagagcttcccgacctgtccccgcctcctctccctccctcggcccgtggtccccagctggtgactgctcaggagtttgggggctccaggacagtgggcccggggcctggcaggctctcggtgggtggggtgggggcccccaaaccaaagtcctctggggtagggagcagggctgggcaggcattctgggggcagggtgggggaggggcgagagtatttttttcttcgtgtaactgtaaatccagaatctatcctgcatcgcagcccaccgtgtatagagatataaatagagggaaagatataagaactaaatttgctaatgacatagttttaacctaaatgctatttatctctgagccgtccccgtcctccgtgcagagcaagttgaggtcattccttcttttcttctccgatcttttttcttggcttctgaccaaaaaccaagctctaccccatccccatcccagacctgcaggagacgagcgagcgggaaggcgccgggcccgggactgtccgttctcggggccagagctgctgggggaccgagtttgtacattttccattttggaattttgagttccaattgttgtaaaacttaatttctccccagtttttatatatatattttttagagttccgtttttatttattaaaaacaaaagccccagccctgccgaggcctgggcggcgtcctcagtcgggtggtcccggggcctttgcggtcccgcccggctgagacgctcgccccgacgcatggacccgagaggcgacgacacgagtgaataaagtgcacatggaccctg

SEQ ID NO: 2004 - DNA, 1007 bp, Homo sapiens
tcctgctcaccggttgtttgtctttccgtccattaggcaatactgaacactgcgcagcttgcagaggtctcctggcagccctcattaggaattctgtctggccccgatcagaatactggagacgagaccacgagattgatgagtttgccttgggagtcggtaagaaggtgaagccaggggcgaacatgggtcagaaggtcactggagggatcaagactgtggacatgagggaccccacgtacaggcccctgaagcaggagctccagggtctggattactgcaagcccacccggctggatctgctactggacatgccccctgtgtcctatgatgtccagctgctgcattcatggaacaacaacgaccgatcgctcaatgtctttgtgaaggaggacgacaagctcatctttcaccggcatccggtggcccagagcacggacgctatcaggggcaaagtcgggtatacccgtgggctgcacgtgtggcagatcacgtgggccatgagacagcggggcacacacgccgtggtgggggtggcgacggcagacgcccccctgcactctgtcgggtacacaaccctcgtggggaataaccacgagtcctggggctgggacttggggcgcaaccggctctaccacgatggcaagaaccagccaagcaaaacatacccagcctttctggaaccagatgagacattcattgtccctgactccttcctggtagccctggacatggacgacgggactctgagcttcattgtggatggacagtacatgggagtggcttttcggggactcaagggcaaaaaactgtatcctgtagtgagtgccgtctggggccactgtgagatccgaatgcgctacttgaacggactcgatcccgagccgctgccgctcatggatttgtgccgtcgctcggtgcgcctggccctggggagggagcgcctgggggagatccacacgctgccgctgccggcttccctcaaggcctacctcctctaccagtga

SEQ ID NO: 2005 - DNA, 6279 bp, Homo sapiens
gccggagtcctgaaagtcgagcgagctccgggttttgaaaatgttggagggaaaagctcctcggagatgagcgtgaccccctggctcgtggtggccgcctgttctcactaacgccatggcggggaccggagtgagaaaccggtgtctgtcactgactgcaaagtgagcgagaagcaggctgcgggccgtcccagcacgacgtggagccccgcggagacctcgagatgccccgcggggaagctcctggccccgggagacggggggctaaggacgaggccctgggcgaagaatcgggggagcggtggagccccgagttccatctgcagaggaaattggcggacagcagccacagtgaacagcaagatcgaaacagagtttctgaagaacttatcatggttgtccaagaaatgaaaaaatacttcccctcggagagacgcaataaaccaagcactctagatgccctcaactatgctctccgctgtgtccacagcgttcaagcaaacagtgagtttttccagattctcagtcagaatggagcacctcaggcagatgtgagcatgtacagtcttgaggagctggccactatcgcttcagaacacacttccaaaaacacagatacctttgtggcagtattttcatttctgtctggaaggttagtgcacatttctgaacaggctgctttgatcctgaatcgtaagaaagatgtcctggcgtcttctcactttgttgacctgcttgcacctcaagacatgagggtattctacgcgcacactgccagagctcagcttcctttctggaacaactggacccaaagagcagctgcacggtatgaatgtgctccggtgaaaccttttttctgcaggatccgtggaggtgaagacagaaagcaagagaagtgtcactccccattccggatcatcccctatctgattcatgtacatcaccctgcccagccagaattggaatcggaaccttgctgtctcactgtggttgaaaagattcactctggttatgaagctcctcggatcccagtgaataaaagaatcttcaccaccacacacaccccagggtgtgtttttcttgaagtagatgaaaaagcagtgcctttgctgggttacctacctcaggacctgattggaacatcgatcctaagctacctgcaccctgaagatcgttctctgatggttgccatacaccaaaaagttttgaagtatgcagggcatcctccctttgaacattctcccattcgattttgtactcaaaacggagactacatcatactggattccagttggtccagctttgtgaatccctggagccggaagatttctttcatcattggtcggcataaagttcgaacgagcccactaaatgaggatgtttttgctaccaaaattaaaaagatgaacgataatgacaaagacataacagaattacaagaacaaatttacaaacttctcttacagccagttcacgtgagcgtgtccagcggctacgggagcctggggagcagcgggtcgcaggagcagcttgtcagcatcgcctcctccagtgaggccagtgggcaccgtgtggaggagacgaaggcggagcagatgaccttgcagcaggtctatgccagtgtgaacaaaattaaaaatctgggtcagcagctctacattgagtcaatgaccaaatcatcattcaagccagtgacggggacacgcacagaaccgaatggtggtggtgagtcagcgaatggtggtggtgaatgtaagacctttacttccttccaccaaacactgaaaaacaatagtgtgtacactgagccctgtgaggatttgaggaacgatgagcacagcccatcctatcaacagatcaactgtatcgacagtgtcatcagatacctgaagagctacaacattccagctttgaaaagaaagtgtatctcctgtacaaatacaacttcttcctcctcagaagaagacaaacagaaccacaaggcagatgatgtccaagccttacaagctggtttgcaaatcccagccatacctaaatcagaaatgccaacaaatggacggtccatagacacaggaggaggagctccacagatcctgtccacggcgatgctgagcttggggtcgggcataagccaatgcggttacagcagcaccattgtccatgtcccacccccagagacagccagggatgctaccctcttctgtgagccctggaccctgaacatgcagccagcccctttgacctcggaagaatttaaacacgtggggctcacagcggctgttctgtcagcgcacacccagaaggaagagcagaattatgttgataaattccgagaaaagatcctgtcatcaccctacagctcctatcttcagcaagaaagcaggagcaaagctaaatattcatattttcaaggagattctacttccaagcagacgcggtcggccggctgcaggaaagggaagcacaagcggaagaagctgccggagccgccagacagcagcagctcgaacaccggctctggtccccgcaggggagcgcatcagaacgcacagccctgctgcccctccgcggcctcctctccgcacacctcgagcccgaccttcccacctgccgccatggtgcccagccaggccccttacctcgtcccagcttttcccctcccagccgcgacctcacccggaagagaatacgcagcccccggaactgcaccggaaggcctgcatgggctgcccttgtccgagggcttgcagccttacccagctttcccttttccttacttggatacttttatgaccgttttcctgcctgacccccctgtctgtcctctgttgtcgccatcgtttttgccatgtccattcctgggggcgacagcctcttctgcgatatcaccctcaatgtcgtcagcaatgagtccaactctggacccacccccttcagtcaccagccaaaggagagaggaggaaaagtgggaggcacaaagcgaggggcacccgttcattacttcgagaagcagctcacccttgcagttaaacttacttcaggaagagatgcccagaccctctgaatctccagatcagatgagaaggaacacgtgcccacaaactgagtatcagtgtgttacaggcaacaatggcagtgagagcagtcctgctactaccggtgcactgtccacggggtcacctcccagggagaatccatcccatcctactgccagcgctctgtccacaggatcgcctcccatgaagaatccatcccatcctactgccagcgctctgtccacaggatcgcctcccatgaagaatccatcccatcctactgccagcacactgtccatgggattgcctcccagcaggactccatcccatcctactgccactgttctgtccacggggtcacctcccagcgaatccccatccagaactggttcagcagcatcaggaagcagcgacagcagtatataccttactagtagtgtttattcttctaaaatctcccaaaatgggcagcaatctcaggacgtacagaaaaaagaaacatttcctaatgtcgccgaagagcccatctggagaatgatacggcagacacctgagcgcattctcatgacataccaggtacctgagagggttaaagaagttgtactaaaagaagacctggaaaagctagaaagtatgaggcagcagcagccccagttttctcatgggcaaaaggaggagctggctaaggtgtataattggattcaaagccagactgtcactcaagaaatcgacattcaagcctgtgtcacttgtgaaaatgaagattcagctgatggtgcggccacatcctgtggtcaggttctggtagaagacagctgttgagtgactgtgaggatgaaccttcataccctttccaagacgtgttacacagacagacctttttaagtcctggacttttaaatgaccatgaagttatcattgaatgttaagattttttcttcttgattttttaatacacgtaatctttttgaagcagacattgtatacagaatcttacttctctttgttcctgatatattaaaatggccagttaggctctttttgtagttgaattgtcttctaaagagattggatggcctctaaagaggtatgtgtatctttatttcagatgtcacccagagtaaattataattagaagtatagctagaatgagccccaaaccttagcctcatttattttgttctgttacataagtcattttccccttagagtgcttgaagaaatgccacctacaggttgtgtacttttcataatggtttccatgaatgtagtacgttcatacaggcttcattcaacctggcgttcccctccataattaagatgaaacattccggttttctcacaacacattagcacatactgtccattagcatatctgggataaccaggttttgggggttgagttttggccttcatccttgtagatccctttcctattgatttcccaccttccagtgaaattctgaaagtcttatcttaaaaatcgatccgcttaccatgggcctattcttgtaagtttcagttagcatttgcatgtgtaatattaaaatgaaagagcttcttacccagtgctgttgcccttttgagtatttttgtttttaaaataatgattgtaaaatgttttacaagtaatgtaaaagctagtatcattcttacatacttctgtgtttaaattttcattcttaccaaaacagttaactctttctttccaatcaatttatacaaaagaggtcgctccagccctaccacaggtctgactggcactgccttttgtttgcccttgaacagggcagtgttgtggggactgcaaaagagaaaacgtccaggcgagcccagttgtcctcgcccacagggtcctgcaggctccatcagtcaccgctttctatggcgtttgtagttgtgtcttttaagaagtgagtgtgattgtttacttgataaatcagctcactctctggtgctttttagagaagtccctgattccttcttaaacttggaatgatagatgaaattcacacccctgcagatcagaaaaaacaaatagaagaaaatgagggttacagtaacctgttgtctttatataacttgcaacaaactaatttatttttttttcctttttttgtttttggttttttatggttttttaaggaaaatacttttctcctttgaagttttacagctttttgtaaatgcgtcctgataatgattaggaaaatcgaccttttcatccatgatgaccatcctcatagctcagatctcctttcaaagtagtggctttctggatggtaattccatcttaaggtgtcagaactattttcaaatgctgcctttgacagttcttggaattttctgatattaagcagttccatgcaaatattcgtgttttataaatagctctcatagtctgctccatcttgatagttaagtgatttctgaagcgtttgtgtgtgtgttgatcaggttgtgtgatatttttgcttgatagagaatcaaatttgaaacaattaaccagccagtagattgtctgtcagtgaccttctgtagtaataaagtttttgccactgtaaataaaaacagtatccgtagctatcaggatcattgcgcactcatatatgctaagccttctgttctctaatagaagcctttcttttccattgtttctggatatttgtattatccaaatgtgcttatttctttgccttagcacacgttttatggagtacttgttatactaggtttgatttgaaactggtgcttgtcgcagaactgtcagagcatgaggagcgctcctcctgtgggtggacgcattcacgcactcccaggttgcacctgctgctggcggtgagcagggggttcagcagcttgaccgatgccccccgagggggctctccccagcttaaactttgttgtttaaatttgttaactttttatattaatgactattgaaagtggtaataaaaatttatattataggcttcaatgttttcatgaatgttacccaaaaagctgtgttttctttggtcagaggtcaaaatttatgaaaaacaaaatgctgtatgaatggaaatcattttgcaattgagtgacacttcattgtaattcacagtgtaaatttaatccaaactgaaattttgtttcaactgaatttgtaattaactctgaatttgtttttaatcattagtaatatttcagttgggtatctttttaagtaaaaacaacaaataaactctgtacatgtaaaacgtga

SEQ ID NO: 2006 - DNA, 1524 bp, Homo sapiens
gcgagggcggccccgggggcgagcggctgtgcgcggggccaagggcgggggcagcaggccggagtcctgaaagtcgagcgagctccgggttttgaaaatgttggagggaaaagctcctcggagatgagcgtgaccccctggctcgtggtggccgcctgttctcactaacgccatggcggggaccggagtgagaaaccggtgtctgtcactgactgcaaagtgagcgagaagcaggctgcgggccgtcccagcacgacgtggagccccgcggagacctcgagatgccccgcggggaagctcctggccccgggagacggggggctaaggacgaggccctgggcgaagaatcgggggagcggtggagccccgagttccatctgcagaggaaattggcggacagcagccacagtgaacagcaagatcgaaacagagtttctgaagaacttatcatggttgtccaagaaatgaaaaaatacttcccctcggagagacgcaataaaccaagcactctagatgccctcaactatgctctccgctgtgtccacagcgttcaagcaaacagtgagtttttccagattctcagtcagaatggagcacctcaggcagatgtgagcatgtacagtcttgaggagctggccactatcgcttcagaacacacttccaaaaacacagatacctttgtggcagtattttcatttctgtctggaaggttagtgcacatttctgaacaggctgctttgatcctgaatcgtaagaaagatgtcctggcgtcttctcactttgttgacctgcttgcacctcaagacatgagggtattctacgcgcacactgccagagctcagcttcctttctggaacaactggacccaaagagctgcacggtatgaatgtgctccggtgaaaccttttttctgcaggatccgtggaggtgaagacagaaagcaagagaagtgtcactccccattccggatcatcccctatctgattcatgtacatcaccctgcccagccagaattggaatcggaaccttgctgtctcactgtggttgaaaagattcactctggttatgaagctcctcggatcccagtgaataaaagaatcttcaccaccacacacaccccagggtgtgtttttcttgaagtagatgaaaaagcagtgcctttgctgggttacctacctcaggacctgattggaacatcgatcctaagctacctgcaccctgaagatcgttctctgatggttgccatacaccaaaaagttttgaagtatgcagggcatcctccctttgaacattctcccattcgattttgtactcaaaacggagactacatcatactggattccagttggtccagctttgtgaatccctggagccggaagatttctttcatcattggtcggcataaagttcgaacgtaagccagtcagttttcatattttctaaaacatctcttgtatcaaataatattccttagcttattgactgccctctgactcaattgacacataaactaaataaagcaca

SEQ ID NO: 2007 - DNA, 4487 bp, Homo sapiens
gtctctccgcaggccccggccgcggcgtcctcgacaacctatcgaaggcgccatggagcgaccggcgcccctggccgtgcttcccttctcggaccccgcgcacgccctgagcctgctgcgcggcctgagccagctgcgcgccgagcgcaagttcctggacgtgaccctggaggcggcgggcgggcgcgacttcccggcgcaccgtgcggtgctggccgccgccagcccctacttccgcgccatgttcgcggggcagctgcgcgagagccgcgccgagcgggtgcgcctgcacggagtgcctcccgacatgctgcagctgctgctggacttcagctacacgggccgcgtggcggtaagcggcgacaacgctgagccgctgctgcgcgccgccgacctgctgcagttcccggccgtgaaggaggcgtgcggggccttcctgcagcagcagctcgacctggccaactgcctggacatgcaggacttcgctgaggccttcagctgctcgggactggcgagcgcggcgcagcggttcattctgcgccacgtgggcgagctgggcgccgagcagctggagcggctgccactggcgcgcctgctgcgctacctgcgggacgacgggctgtgtgtgcccaaggaggaggccgcctaccagctggcgctgcgctgggtccgcgctgacccgccgcgccgcgccgcgcactggccgcagctgctggaggccgtgcgcctgcccttcgtgcgccgcttctacctgttggcgcacgtcgaggccgagccgctggtggcgcgctgcccaccctgcctgcgcctgctgcgcgaggcgcgcgacttccaggcggcgcgctacgaccgccacgaccgcgggccctgtccccgaatgcgtcctcgcccgtccaccggtctcgccgagatcctcgtgctcgtgggcggctgcgaccaggactgtgacgagctggtcactgtcgactgctacaacccgcagacgggtcagtggcgctacctggccgagttcccagaccacctgggcggaggctacagcatcgtggcgctgggcaatgacatctacgtgacgggtgggtccgatggctcccggctctatgactgcgtgtggaggtacaactcaagcgtgaatgagtgggcggaggtggcgcccatgctgaaggcccgcgagtaccacagctcctctgtgctggacggactgctgtacgtggtggccgccgacagcaccgagcgctatgaccacaccactgactcctgggaggccctgcagcccatgacctaccccatggacaactgctccaccactgcgtgccgtggccggctctatgccatcggctccctggctggcaaggagaccatggtgatgcagtgctacgacccggacaccgacctgtggtcgctggtggactgcggccagctcccgccctggtccttcgcccccaagactgcgactctaaacggactcatgtactttgtcagggatgactccgctgaggtggacgtgtacaacccgacgaggaacgaatgggacaagatcccgtccatgaatcaggtacatgtggggggcagcctggccgtccttggggggaagctgtacgtctctgggggatacgacaatacatttgaactctcggacgtggtagaggcctatgacccagagactcgcgcgtggagcgtggtggggcggctcccagaacccaccttctggcatggcagtgtcagcatcttccgccagttcatgccccagaccttctcgggtgggcgtggcttcgagttggacagtggcagcgatgacatggacccaggccgaccccggccgccgcgggaccccgatgagctgcactagccccagtctggcccggcacgggcctcggtgcaggtaactggcacctctgcggggcagtgccccactcctttgtgcacaaggacacgttgggctcacaggaggagcacaggctcttgggtggcgaagccagcccaggatccattacctggaaggtttctgtaccttgagagcctgaatcagaggccgtcgggaacgccctccctgcagttgaggaagagccactttcctgccagcacatgtttctgggtcttggaggtcacccccaccccgcggatcacagctcacccacgcggcgcacacccctcctgccgttgtcatctgcacctacttgttcccaccttgggagaggacgatgacttgggagggacgcgtgaagggagaaggggtcctcccatgaggctgaggatggcctgaacctggagcagcggaccaggcagacgggctgaagtggggtcccaaattccatgtccagaggtgtggggagcctgcctccctagctcctggcccctgccaggggcttacatcaaaacacctcagagggctgccctccagaggctgcacccagaacagtgggacatgagcaggggtgtgggcttggagggtgaagaggatgtggtcctatcagatgctgggcctcctcagccatagccccctgctcctaccccctgactggctcttgcgtcctcacctctcaccctctccttcccgggaggccctgggaggtgatcattgacacccagccaagcagacagctgcgggtgcccaagcccttgctgggcctgcgcgtgaggagtcccactgcttctaaaggaagtcctgggcaggaggtggctttggtggttggttccaaagttgaaaatgcttgcagtttgaccttagaagaagtgggaagaagaaggagctctacagggtcagctttgtttgatttgtccagtctaagaagtcccattgccaaagctttctgcaggagggtgaatgccgcagcttggcagcccctgggtttctcttggaaatggtcagtttcccctcaaagtacccaaagtagccttggcttgagtttttgtccttgcctcctttttagagaagagggcatttagactgcattttcctggttaaagaaggttaaagcaaatgtttattgccttttctagtgaactaactcgtagagatgttctcagcaggaagacagtcttagcactgtcacttagcagattgcacttaagtcccttgtgctggccagatggcgtggctggttgccttaatatgtcccaggacccctgacagggctgcctggcctctccctcgtgctcctcaagagcccagtccatacactgtggatgtcattgctgtcgggttaggaagtcttgtcctagaacgccctggctggtatgaccacagttcatggcggctcttctcgcttgggtcatggtcatcttccagcacctgctgtgctgggaaggccgaggatgggggcccagcactgtccaggcctgctggggcctggctgggagtcctgtgggcagcatggaacatgcagctgggcttcctgtgaccaggcaccctctggcactgttgcttgccctgtgccctggaccttttcctgcccttctccttcctctgctcccttggggctaccccttggcccctcctggtctgtgcaaactccctcagggagcccccctgccctgtagctctcgcttaacttcctaggggctgctgagcccacccagaggttgttggagttcagcggggcagcttgtctcccttgtcagcaggggcgtaagggctgggtttggccatacaaggttggctacgccctcaatccctgaccgttccaggcactgagctgggcacccacggaaggacatgctgtccagactgtgatgactgccagcacagggcatctcgggcttggctggtctgcgaggccttgcccctgtggaactctgggttcctgttttctcagtcttttttgcggctttgctgtggttggcagctgccgtactccaggcttgtgtcggccactcagatgagggctgtggtgcgagccagtgcaggagagctgcgcttgggattgtgccctctcctgtgtctgtcctccggacctacccaggtctccaccatcaggaccctgtctttgggtttagaagaccaagtatggggaaaaccaggcaccagcctctgcagcaatgggtccctctagcctgtggacaccagctgggggatccagggtcaggccccctcctctccccagtttccctctgctgtgggttctgggctgtcatgtctccaccacttaaggatgtctttacactgacttcaggatagatgctgggatgcctgggcatggccacatgttacatgtacagaactttgtctacagcacaaattaagttatataaacacagtgactggtatttaatgctgatctactataaggtattctatatttatatgacttcagagacgcgtatgtaataaaggacgccctccctccagtgtccacatccagttcaccccagagggtcgggcaggttgacatatttatttttgtctattctgtaggcttccatgtccagaatcctgcttaaggttttagggtaccttcagtactttttgcaataaaagtatttcctatcca

SEQ ID NO: 2008 - DNA, 6445 bp, Homo sapiens
cgcgctcgcggggggcggtggcgcccggcacagaggggttaagggggcggtgcagacgtctccccgcccatcccgcccctcgagagccgcggcgccccgccctatttatagcagcggtgcctagcgcgccgcgtctctccgcaggccccggccgcggcgtcctcgacaacctatcgaaggcgccatggagcgaccggcgcccctggccgtgcttcccttctcggaccccgcgcacgccctgagcctgctgcgcggcctgagccagctgcgcgccgagcgcaagttcctggacgtgaccctggaggcggcgggcgggcgcgacttcccggcgcaccgtgcggtgctggccgccgccagcccctacttccgcgccatgttcgcggggcagctgcgcgagagccgcgccgagcgggtgcgcctgcacggagtgcctcccgacatgctgcagctgctgctggacttcagctacacgggccgcgtggcggtaagcggcgacaacgctgagccgctgctgcgcgccgccgacctgctgcagttcccggccgtgaaggaggcgtgcggggccttcctgcagcagcagctcgacctggccaactgcctggacatgcaggacttcgctgaggccttcagctgctcgggactggcgagcgcggcgcagcggttcattctgcgccacgtgggcgagctgggcgccgagcagctggagcggctgccactggcgcgcctgctgcgctacctgcgggacgacgggctgtgtgtgcccaaggaggaggccgcctaccagctggcgctgcgctgggtccgcgctgacccgccgcgccgcgccgcgcactggccgcagctgctggaggccgtgcgcctgcccttcgtgcgccgcttctacctgttggcgcacgtcgaggccgagccgctggtggcgcgctgcccaccctgcctgcgcctgctgcgcgaggcgcgcgacttccaggcggcgcgctacgaccgccacgaccgcgggccctgtccccgaatgcgtcctcgcccgtccaccggtctcgccgagatcctcgtgctcgtgggcggctgcgaccaggactgtgacgagctggtcactgtcgactgctacaacccgcagacgggtcagtggcgctacctggccgagttcccagaccacctgggcggaggctacagcatcgtggcgctgggcaatgacatctacgtgacgggtgggtccgatggctcccggctctatgactgcgtgtggaggtacaactcaagcgtgaatgagtgggcggaggtggcgcccatgctgaaggcccgcgagtaccacagctcctctgtgctggacggactgctgtacgtggtggccgccgacagcaccgagcgctatgaccacaccactgactcctgggaggccctgcagcccatgacctaccccatggacaactgctccaccactgcgtgccgtggccggctctatgccatcggctccctggctggcaaggagaccatggtgatgcagtgctacgacccggacaccgacctgtggtcgctggtggactgcggccagctcccgccctggtccttcgcccccaagactgcgactctaaacggactcatgtactttgtcagggatgactccgctgaggtggacgtgtacaacccgacgaggaacgaatgggacaagatcccgtccatgaatcaggtaaattttcaggcgggccagcattggaagcacaggctggtcctgattttgcaacccaagtgtcatcgtgatgagtgtttgggatccacagccatgatgggtgggtctcatctcaattaatagaaggctgctcttacccttattttgcacttaaggctcactgagacacagatgttaagtaataccctatgattacacagcttagtacacatttgagcagtgtttattgagtatctgctgtgagccagagagcagaaggaagtgagggagcaaggcatacagtcatctggggacacctgttccagagagggacagcaggtacagaggccctgcagcagggcaccctggcgtgttcttagatacaccagcagcccatgtggccggagcagagtcagcatgaggtctgtgacctaccttttttatttttgagacagggtcttgctctgtcacccaggctggagtgcagtggtacaatcatggctcactgcagcctccacctccttgactcgcagtcctcccaccgcaccttcctgaatagctgagactacaggcgtgtgccaccacacccagtaattttttttctcatatgtagatacaaaaggatattcttaaaatttttatagagacagggtcttgctgtgttacccaggctggtctcacactcctggcctcaagtgaccctcctgtctcagcctcccaaagtgctaggattataggcgtgaaccaccacgcccagctggttcctgaggaagtcagtgtgggaatactttttttttttttatacggagtctcgctctgtcacccaggctggagtgcagtggcacgatctcggctcactgcaagctccatctcccaggttcacgccattctcccgcctcaacctcccgagtagctgggactacaggtacccaccaccacgcccagctaattttgtttgtgtatttttagtagagacgggatttcactgtgttagccaggatggtctggatctcctgaccttgtgatctgcctggctcagcctcccaaagtgctgggattacaggcatgagccaccatgcccagcccactgtgggaatacttgtgttgagcacttgctgtgtgttctgaataggacaaccagggtccaccccttctctctgggcttgttgagaagaggggtgcccagcctgacagtgatgggacagggaggcttcagtgccatttggccatgtgagcagtgttagtctgaggtacacatcatattgcctacagccttctttcctgtgtgtctgttaacatttccaaacctacactccgtgacatccagcctcacagcttacatcacagcttaatgtcctggcatttaagagacccagcgttctgttttccccgcagtaagctgcacatagtcatagcgaatttgggaaagatggaaggaatcatccagcctcgcggttcagagcccagctctgccactgtcagccatgcaagcctcagttttcccatctgtaacatggggagaacagcactgctcagcccagagggccactgcagagattctgagagagaacgtaggaagcgctgctcggcacgacctgcacacggggaggcctggcgctgcagcgggcaccctcatcaccatagggaaggcccagctgcctccggggaggcccgttctcctaggcagggtgttggaaaggggttggcctctctgctgctttctgggagagccaaggccacccctctggggtactgacagggcatgccttgtctccagtggttccccaggtggggccctgccctaccctctcctctgacctccactcactcatccctttggcccacaggtacatgtggggggcagcctggccgtccttggggggaagctgtacgtctctgggggatacgacaatacatttgaactctcggacgtggtagaggcctatgacccagagactcgcgcgtggagcgtggtggggcggctcccagaacccaccttctggcatggcagtgtcagcatcttccgccagttcatgccccagaccttctcgggtgggcgtggcttcgagttggacagtggcagcgatgacatggacccaggccgaccccggccgccgcgggaccccgatgagctgcactagccccagtctggcccggcacgggcctcggtgcaggtaactggcacctctgcggggcagtgccccactcctttgtgcacaaggacacgttgggctcacaggaggagcacaggctcttgggtggcgaagccagcccaggatccattacctggaaggtttctgtaccttgagagcctgaatcagaggccgtcgggaacgccctccctgcagttgaggaagagccactttcctgccagcacatgtttctgggtcttggaggtcacccccaccccgcggatcacagctcacccacgcggcgcacacccctcctgccgttgtcatctgcacctacttgttcccaccttgggagaggacgatgacttgggagggacgcgtgaagggagaaggggtcctcccatgaggctgaggatggcctgaacctggagcagcggaccaggcagacgggctgaagtggggtcccaaattccatgtccagaggtgtggggagcctgcctccctagctcctggcccctgccaggggcttacatcaaaacacctcagagggctgccctccagaggctgcacccagaacagtgggacatgagcaggggtgtgggcttggagggtgaagaggatgtggtcctatcagatgctgggcctcctcagccatagccccctgctcctaccccctgactggctcttgcgtcctcacctctcaccctctccttcccgggaggccctgggaggtgatcattgacacccagccaagcagacagctgcgggtgcccaagcccttgctgggcctgcgcgtgaggagtcccactgcttctaaaggaagtcctgggcaggaggtggctttggtggttggttccaaagttgaaaatgcttgcagtttgaccttagaagaagtgggaagaagaaggagctctacagggtcagctttgtttgatttgtccagtctaagaagtcccattgccaaagctttctgcaggagggtgaatgccgcagcttggcagcccctgggtttctcttggaaatggtcagtttcccctcaaagtacccaaagtagccttggcttgagtttttgtccttgcctcctttttagagaagagggcatttagactgcattttcctggttaaagaaggttaaagcaaatgtttattgccttttctagtgaactaactcgtagagatgttctcagcaggaagacagtcttagcactgtcacttagcagattgcacttaagtcccttgtgctggccagatggcgtggctggttgccttaatatgtcccaggacccctgacagggctgcctggcctctccctcgtgctcctcaagagcccagtccatacactgtggatgtcattgctgtcgggttaggaagtcttgtcctagaacgccctggctggtatgaccacagttcatggcggctcttctcgcttgggtcatggtcatcttccagcacctgctgtgctgggaaggccgaggatgggggcccagcactgtccaggcctgctggggcctggctgggagtcctgtgggcagcatggaacatgcagctgggcttcctgtgaccaggcaccctctggcactgttgcttgccctgtgccctggaccttttcctgcccttctccttcctctgctcccttggggctaccccttggcccctcctggtctgtgcaaactccctcagggagcccccctgccctgtagctctcgcttaacttcctaggggctgctgagcccacccagaggttgttggagttcagcggggcagcttgtctcccttgtcagcaggggcgtaagggctgggtttggccatacaaggttggctacgccctcaatccctgaccgttccaggcactgagctgggcacccacggaaggacatgctgtccagactgtgatgactgccagcacagggcatctcgggcttggctggtctgcgaggccttgcccctgtggaactctgggttcctgttttctcagtcttttttgcggctttgctgtggttggcagctgccgtactccaggcttgtgtcggccactcagatgagggctgtggtgcgagccagtgcaggagagctgcgcttgggattgtgccctctcctgtgtctgtcctccggacctacccaggtctccaccatcaggaccctgtctttgggtttagaagaccaagtatggggaaaaccaggcaccagcctctgcagcaatgggtccctctagcctgtggacaccagctgggggatccagggtcaggccccctcctctccccagtttccctctgctgtgggttctgggctgtcatgtctccaccacttaaggatgtctttacactgacttcaggatagatgctgggatgcctgggcatggccacatgttacatgtacagaactttgtctacagcacaaattaagttatataaacacagtgactggtatttaatgctgatctactataaggtattctatatttatatgacttcagagacgcgtatgtaataaaggacgccctccctccagtgtccacatccagttcaccccagagggtcgggcaggttgacatatttatttttgtctattctgtaggcttccatgtccagaatcctgcttaaggttttagggtaccttcagtactttttgcaataaaagtatttcctatcca

SEQ ID NO: 2009 - DNA, 2293 bp, Homo sapiens
gggtacgcatagccgggcactaggttcgtgggctgtggaggcgacggagcagggggccagtggggccagctcagggaggacctgcctgggagctttctcttgcataccctcgcttaggctggccggggtgtcacttctgcctccctgccctccagaccatggacggctccttcgtccagcacagtgtgagggttctgcaggagctcaacaagcagcgggagaagggccagtactgcgacgccactctggacgtggggggcctggtgtttaaggcacactggagtgtccttgcctgctgcagtcactttttccagagcctctacggggatggctcagggggcagtgtcgtcctccctgctggcttcgctgagatctttggcctcttgttggactttttctacactggtcacctcgctctcacctcagggaaccgggatcaggtgctcctggcagccagggagttgcgagtgccagaggccgtagagctgtgccagagcttcaagcccaaaacttcagtgggacaggcagcaggtggccagagtgggctggggccccctgcctcccagaatgtgaacagccacgtcaaggagccggcaggcttggaagaagaggaagtttcgaggactctgggtctagtccccagggatcaggagcccagaggcagtcatagtcctcagaggccccagctccattccccagctcagagtgagggcccctcctccctctgtgggaaactgaagcaggccttgaagccttgtccccttgaggacaagaaacccgaggactgcaaagtgcccccaaggcccttagaggctgaaggtgcccagctgcagggcggcagtaatgagtgggaagtggtggttcaagtggaggatgatggggatggcgattacatgtctgagcctgaggctgtgctgaccaggaggaagtcaaatgtaatccgaaagccctgtgcagctgagccagccctgagcgcgggctccctagcagctgagcctgctgagaacagaaaaggtacagcggtgccggtcgaatgccccacatgtcataaaaagttcctcagcaaatattatctaaaagtccacaacaggaaacatactggggagaaaccctttgagtgtcccaaatgtgggaagtgttactttcggaaggagaacctcctggagcatgaagcccggaattgcatgaaccgctcggaacaggtcttcacgtgctctgtgtgccaggagacattccgccgaaggatggagctgcgggtgcacatggtgtctcacacaggggagatgccctacaagtgttcctcctgctcccagcagttcatgcagaagaaggacttgcagagccacatgatcaaacttcatggagcccccaagccccatgcatgccccacctgtgccaagtgcttcctgtctcggacagagctgcagctgcatgaagctttcaagcaccgtggtgagaagctgtttgtgtgtgaggagtgtgggcaccgggcctcgagccggaatggcctgcagatgcacatcaaggccaagcacaggaatgagaggccacacgtatgtgagttctgcagccacgccttcacccaaaaggccaatctcaacatgcacctgcgcacacacacgggtgagaagcccttccagtgccacctctgtggcaagaccttccgaacccaagccagcctggacaagcacaaccgcacccacaccggggaaaggcccttcagttgcgagttctgtgaacagcgcttcactgagaaggggcccctcctgaggcacgtggccagccgccatcaggagggccggccccacttctgccagatatgcggcaagaccttcaaagccgtggagcaactgcgtgtgcacgtcagacggcacaagggggtgaggaagtttgagtgcaccgagtgtggctacaagtttacccgacaggcccacctgcggaggcacatggagatccacgaccgggtagagaactacaacccgcggcagcgcaagctccgcaacctgatcatcgaggacgagaagatggtggtggtggcgctgcagccgcctgcagagctggaggtgggctcggcggaggtcattgtggagtccctggcccagggcggcctggcctcccagctccccggccagagactgtgtgcagaggagagcttcaccggcccaggtgtcctggagccctccctcatcatcacagctgctgtccccgaggactgtgacacatagcccattctggccaccagagcccacttggccccacccctcaataaaccgtgtggctttggactctcgta

SEQ ID NO: 2010 - DNA, 1005 bp, Homo sapiens
tgacaccatgacccactgttgctccccttgctgtcagcctacctgctgcaggaccacctgctgcaggaccacctgctggaagcccaccactgtgaccacctgcagcagcacaccctgctgccagcccgcctgctgtgtgtccagctgctgccagccttgctgccgcccaacttgctgtcaaaacacctgctgtaggaccacctgctgccagcccacctgtgtgaccagctgctgccagccttcctgctgcagcacaccctgctgccagcccacctgctgtgggtccagctgctgtggccaaaccagctgtgggtccagctgtggccagagcagctcctgtgcacctgtgtactgcagaagaacctgctactaccccacgactgtctgcctgcctggttgcctaaaccagagctgtggctccaactgctgccagccctgctgccgcccagcctgctgtgagaccacctgctgcaggaccacttgcttccagcccacctgtgtgtccagctgctgccagccttcttgctgctgatcacgttccaagagaaccaccatcctcacacaacaaatttctgctcaactgactcatcttttgggggactaatttaatttgctgctgacagccaccatgctctcacccaaatttttatgaattctctacatgtttaaaatcttggaaatctgcttgagggagggcagaatacttcatcctgattctctttttccttacaccttgtggatcatgtgccagcttcatctgttctcaagtttgagtcatggtctcagctttgactctaaagtcaagagcttcattccctgcttctaaggaatttaggtttctgcaactgatcgatgatctttgcaatcttttttttgttttcaatatcctcctcatcgttcttgtatccttctttcttcttttcatgataaatttgtgttgtgtccctggtagcagaaatccttacctatatgtttctgaataaattctgaaccatcctcatctca

SEQ ID NO: 2011 - DNA, 597 bp, Homo sapiens
atggtcagctcctgttgtggctccgtgtgctctgaccagggctgcagccaagacctctgtcaggagacctgctgccgccccagctgctgtcagaccacctgttgcaggaccacctgctaccgccccagctgttgtgtgtccagctgctgcaggccccagtgctgccagtctgtgtgctgccaacccacctgctgtcgcccccctaggtgctgcatctccagctgctgccgccccagctgctgtatgtccagctgctgcaagccccagtgctgccagtctgtgtgctgccagcccaccacgacctgctgccaccctaggtgctgcatctccagctgctgtcgccccagctgctgtgtgtccagctgctgcaagccccagtgctgccagtctgtgtgctgccagcccaactgctgccgccccagctgcagcatctccagctgctgccgcccctcttgctgtgaatccagctgctgccgcccctgctgctgcgtgcgtccagtctgtggccgagtctcctgccacaccacttgctatcgcccaacctgtgtcatctccagctgcccccgccccttgtgctgtgcctcctcttgctgctga

SEQ ID NO: 2012 - DNA, 1812 bp, Homo sapiens
ttttgcagccagtctctgtctttgcttctggaaggatgacttctgactgctcctccacacactgctctcctgagtcctgtggcacggcttccggttgtgcacctgcctcaagctgctccgtggaaacagcttgtctccccggtacctgtgctacatcccgatgtcagactccaagcttcctatccaggtctcgcgggctgactggttgcctcctgccatgctactttactgggagttgtaatagtccctgcttggtggggaactgtgcctggtgtgaggatggggtgttcactagcaatgagaaggagacgatgcagttcctgaatgacagactcgccagctatctggagaaggtgcgcagcctggaggagaccaacgcagagctggaatccaggatccaagaacaatgtgaacaggatatcccaatggtgtgcccggattatcagcgttacttcaacaccattgaagatctccaacaaaagatcttatgcacgaaagcagagaattctagacttgctgtacagcttgacaactgcaaactggccactgatgactttaagtcaaagtacgagagtgaactgtcccttcgccagctgttagaggctgacatcagcagcctgcatgggatcctggaggaactgaccctgtgcaaatctgatctggaggcccatgtggagtctctgaaggaagatctcctttgccttaagaaaaaccatgaagaggaagtcaacttgcttcgtgaacagcttggcgaccgcctcagtgtggagctggacactgcccccacccttgacctcaacagggtcctggatgagatgcgctgtcagtgtgaaacggtgcttgccaacaatcgcagagaagctgaagaatggttggctgttcagacagaagagctgaatcagcagcaactgtccagcgcggagcagctgcagggctgccagatggagatcttggaactgaaacgcacagccagtgctctggaaattgagctccaagcacagcaaagcctgacagaatctctggaatgcaccgtggcagaaaccgaggcccagtacagctcccagctggcccaaattcagtgtctgatcgataacctggagaaccagctggccgagatccgctgcgacctggagcgacagaaccaggagtaccaggtgctcctggacgtgaaggcccggctggagggtgagatcaacacgtactggggcctgctggacagcgaggacagcaggctttcctgtagcccatgttcgaccacatgcacctcgagcaacacttgtgagccatgctcagcctatgtcatctgcactgttgaaaactgctgcttgtgaatgttaaggacagcaggtagaggaatcaaagccagcagcatcctagaaaggagatggggcttcaaccagggacatccaaaccggaagcacaaatccaggaggctctcatatcctggaattgccctccaggtatcctcagtctttctgctttactatttcctctccttccggcttatttgtggtatactggaagcccataaagcattcttgctcatctccaaataaaacgtgttttattcctttagcgtggtaaatatagctctatggctgattactgttgatagaatattcattttatggcaaggaaatcatctaaacccataaccatagtttcaatgtacataaacccaggctgaaaatattttttaactcctcaaatacaaataaattaatgaacccatgagaaatgtcatatatcttagaaaatagttgtgtgtatctttctgaggaaaaatattaggaataaaatatgataaaatgt

SEQ ID NO: 2013 - DNA, 1566 bp, Homo sapiens
agcatccgggctcccggcagcggcgctgcggcggctcgcgggagacgctgcgcgcggggctagcgggcggcggagcggacggcgacggggcgctctcgggctgccggcggggccgagcgccgcgcgtcccgagcatggcaggctccctgcctccctgcgtggtggactgtggcaccgggtataccaagcttggctacgcaggcaacactgagccccagttcattattccttcatgtattgccatcagagagtcagcaaaggtagttgaccaagctcaaaggagagtgttgaggggagttgatgaccttgactttttcataggagatgaagccatcgataaacctacatatgctacaaagtggccgatacgacatggaatcattgaagactgggatcttatggaaaggttcatggagcaagtggtttttaaatatcttcgagctgaacctgaggaccattattttttaatgacagaacctccactcaatacaccagaaaacagagagtatcttgcagaaattatgtttgaatcatttaacgtaccaggactctacattgcagttcaggcagtgctggccttggcggcatcttggacatctcgacaagtgggtgaacgtacgttaacggggatagtcattgacagcggagatggagtcacccatgttatcccagtggcagaaggttatgtaattggaagctgcatcaaacacatcccgattgcaggtagagatattacgtatttcattcaacagctgctaagggagagggaggtgggaatccctcctgagcagtcactggagaccgcaaaagccattaaggagaaatactgttacatttgccccgatatagtcaaggaatttgccaagtatgatgtggatccccggaagtggatcaaacagtacacgggtatcaatgcgatcaaccagaagaagtttgttatagacgttggttacgaaagattcctgggacctgaaatattctttcacccggagtttgccaacccagactttatggagtccatctcagatgttgttgatgaagtaatacagaactgccccatcgatgtgcggcgcccgctgtataagcccgagttctttcaggtctgccacaccaagaaggactatgaagagtacgggcccagcatctgccgccacaaccccgtctttggagtcatgtcctagtgtctgcctgaacgcgtcgttcgatggtgtcacgttggggaacaagtgtccttcagaacccagagaaggccgccgttctgtaaatagcgacgtcggtgttgctgcccagcagcgtgcttgcattgccggtgcatgaggcgcggcgcgggcccttcagtaaaagccatttatccgtgtgccgaccgctgtctgccagcctcctccttctcccgccctcctcaccctcgctctccctcctcctcctcctccgagctgctagctgacaaatacaattctgaaggaatccaaatgtgactttgaaaattgttagagaaaacaacattagaaaatggcgcaaaatcgttaggtcccaggagagaatgtgggggcgcaaacccttttcctc

SEQ ID NO: 2014 - DNA, 444 bp, Homo sapiens
gatttgccccatgggcctaagacataagctgaacctctggcctgcagttccagatccaaggtgactgagacaaactgccagctgccactggcttatcaggagcacctggagatggacaacatgtctcccaggctgagagccttcctctccgaacccattggagaaaaggatgtctgctgggtggatggcatcagccatgagctcgcgatcaatttggtcaccaaaggtatcaataaggcctacatcctgctgggacaattccttctgatgcacaagaatgaagccgagtttcagaggtggctcatttgctgttttggtgccactgagtgtgaggcccagcagacttctcactgcctcaaggagtggtgtgcctgcttcctgtagacacaaacctcattgctgccccccaccaccctctggggaaaatgacgccttctccaccta

SEQ ID NO: 2015 - DNA, 2299 bp, Homo sapiens
gagacgcgctgtgtgattgcctcggagagaggaaggcgctccagttccgggtcaggcccttctcccgcctccctcggccttagccatggcgagtagcagcggtgctggggcggcggcggcggccgcggcggcgaatctgaatgcggtgcgggagaccatggacgttctgcttgagatttcaagaattttgaatactggcttagatatggaaactctgtctatttgtgtacggctttgtgaacaaggaattaacccagaagctttatcatcggttattaaggagcttcgcaaggctactgaagcactgaaggctgctgaaaatatgacaagctgactttctggagaaattctgatgagatatgtcaagctctgcaagagggtttgaagattgcattgtagttgagaatgtacaatgaaattactgcatgcagcagtgtagaaaaattttactttttaaaagaattataaaaccatagctttataaatcagtggaaagtggcttacagagagaactatcagatgtgtttacatcacatcttattcactttttttaacagctctaatgctttggcattgctatgttcatatttatgtattccttatttatagctctgatagctttaattttctaagcagtctgtctatcagatgtgcacatctgctgtgccaggttgaagtatagtggaacccatcagtagtaatgtgtagtagttatgacttgttgacatttccattataaactttaattttgaattgtttatgcattataactgtggatttatattgtattgggctgaaagttgacaggatttcagccaccacttgtgaatttttatttagattcattatgtatatcagaatcttgttttttgaaataagagcatggaaaacatttcttgtaatctactcttgaacaaagaatatttagtttttcaaacagtttgttgggcagctaatagtgtgaaccaggtcatttttgtattgagtaaaaaaatcaaactttgagaaacttggattttaaaagtaatgacaatgcttaggttagtattatttgtaatttgaatcatttacatctaatgagaatgttagttgagaatgttttcttaaagttttatatcctataaataacggaataaaaaaatttgtaaaatgaaacaacaaacatgcaaaattcctatttacttttattacataaaagtaattttagtgcttacctaataaatcttgaatggttatttaataaattattagatgggtgatgtgtttcaaaagatacttgctattttttgaagaaataaggatttccagtcattaaacaaaactaaacaatcttattagatgggtgatgtgtttcaaaggatacttgctattttttgaagaaataaggatttccagtcattaaacaaaactaaacaatcaaatgttctatattaggaatctcaagtatggctttttttaaaaaacctttttaacatcttgatgtcaaggattataagtatggcttttcagaattgttttgtttgtcattattcttgcctttaaaattttaactcatcaaagtgaagattagaaataaattttagaaaatgtagaatagtattgattctgttcctgtaatagaatctcagtggagtttttttgcaaaactaatatggatttcatctgattttattatttcttaaattttagattttattgagtaccatttatatgattgtacaagcattcactctttactagcattttttgtttttcagacaagctgaagtggttttattaagatttggtaatatttaaatagcaaccttctctgcctttttttttttttaatatagaattttgaccattttgactttttaaatgcctggcatctttaccaaccaagtaaactggaagatctgttactggtagaacaggttgaggagacagtaggaatttgtaaaaagtcatttgatttataatcaacactacaaatactatgtgttatttataaaatcataaagaacacttttgtcagactccaaaatttgtatatacttccaggccataagagttgatagtattatttatgactttgtagattaagttatttatgtatgaaacaaagcaggaaaatatattgagaagggatcgtgtttacagaggacttctttaaagtgtcacatttttaaaatgtaaacatatttttaatgcatacttaagtaatatttaagaaactaaacaaaataatgatacaattgcagtgttgtgcttgttgtcaatgacaaaaataaaaccattttggtggtattggcctgta

SEQ ID NO: 2016 - DNA, 4597 bp, Homo sapiens
agactccatccgccatgttggatgccgcagattcgccataacctcgccggctcttttcttaaaaaaataaaaataaaaagcgaagcgtcagcagggcgccccgccccctcggtcggcacgggagggggcccggaagagcccgaggcttttttttcctccgcggtggggcgttgccatggagacgcgggcggcagaaaacacggccatctttatgtgtaaatgttgtaacctcttctcaccaaatcagtcggaactcctctcccacgtttcagagaagcacatggaagaaggggttaatgttgatgagattattattccccttaggcctctgagtacacctgaaccccccaactcaagcaaaaccggagatgagtttttggtcatgaagaggaagagaggcaggcctaaggggtccacgaagaagtccagcacagaagaggagctggcagaaaacatcgtgagtccgactgaggacagcccgctggctccggaggaagggaacagcctgcctccaagcagcttggagtgtagcaagtgctgtcggaagttctccaacacgcgccagctgcggaagcacatctgcattatcgtgctgaatttgggtgaggaggaaggagaagcaggtaacgagtctgaccttgaactagaaaagaagtgtaaggaagatgatcgggaaaaagcctcgaaaagaccacggtcacagaaaacagagaaagtccagaagatctcaggaaaggaggccagacagctttctggggcgaagaaacccatcataagtgtggttttaactgcacacgaagcaattccaggtgctaccaagattgtgccagtggaggctgggccccctgaaacaggagctacaaattctgagaccacttcagcagacctggtgcctcggagaggctaccaggaatacgccattcagcagacaccttatgagcaaccaatgaagtcaagcaggctaggtcccactcagctcaaaatcttcacttgtgaatactgcaacaaggtcttcaagttcaagcactcgctgcaggcccacctgaggatccacaccaatgaaaagccatacaagtgcccccagtgcagctatgccagtgccatcaaggccaacctcaatgtgcacctgcgcaagcacactggagagaagttcgcctgcgactattgctcgttcacctgcctgagcaagggccacctcaaggtgcacatcgagcgagtgcacaagaagatcaagcagcactgccgcttctgcaagaagaagtactctgacgtcaagaacctcatcaagcacatccgagacgcgcatgacccacaggacaagaaggtcaaagaggccttggacgagctctgcctgatgacgagggagggcaagcggcagctgctctatgactgccacatctgtgagcgcaagttcaagaacgagctggaccgtgaccgccatatgctggtccacggagacaagtggccttttgcctgtgagctctgtggccatggggccaccaagtaccaggcgctggaactgcatgtcaggaagcaccccttcgtgtacgtctgtgccgtctgccgcaagaagttcgtcagctccatcaggctgcgcacccacatcaaagaggtgcacggggctgcccaggaggccttggtcttcaccagttccatcaaccagagcttctgcctcctggaacctggtggggacatccagcaagaagctctgggggaccagctacagctggtggaagaggagtttgccctccagggcgtgaatgcactcaaggaagaggcctgtcctggggacactcagctggaggagggccggaaggagccggaggcccctggggaaatgcctgccccagctgtgcacctggcctccccgcaggccgaaagcacagccctgccaccctgtgagctggaaaccaccgtggtctcctcctcagacctgcattctcaagaggtggtttcagatgattttttgttgaaaaatgatacctcctccgcagaggctcatgctgctcctgagaagcccccagacatgcagcacagaagctcagtccagacgcaaggtgaagtgatcacactactgctgtccaaggcccagagtgctgggtcagatcaggaaagccatggcgcccagagccccctaggggaagggcagaacatggctgtgctttcagctggtgacccagatcccagcaggtgtctcaggtcaaacccagctgaggcctcagacctcctccctccagtagctggtggtggggacaccatcacacatcagcctgactcttgcaaagctgcccctgagcaccggtcaggcatcaccgctttcatgaaggtcctgaacagtttacagaagaagcaaatgaacaccagcttgtgtgagcggatccggaaggtttatggagacctggagtgtgaatactgtggcaaacttttttggtaccaagtgcattttgatatgcatgtccgcacccacacccgggaacatctgtattattgctctcagtgtcattattcttccatcaccaaaaactgccttaaacgccacgtaattcagaaacacagtaacatcttgctgaagtgtcccaccgatggctgtgactactcaactccagataaatataagctacaggcacatcttaaagttcacacagcactggacaaaaggagttattcttgtcctgtttgtgaaaagtctttttcagaggatcgattgataaagtcacatatcaagaccaaccatcctgaggtctccatgagcaccatttctgaggttctcgggaggagggttcagctgaaagggctaattggaaagagagccatgaaatgcccatattgtgacttttatttcatgaagaatggctcagaccttcagcgtcatatttgggctcatgaaggtgtgaagcccttcaagtgttctttgtgtgagtatgcaactcgtagcaagagtaacctcaaggctcatatgaatcgtcacagcactgagaaaacccacctatgtgacatgtgtggcaagaaattcaaatcaaaagggacactgaaaagtcacaaactccttcacactgcagatgggaagcagtttaagtgcacggtgtgtgactacacagcggcccagaagccacagctgctgcggcacatggaacagcatgtctccttcaagcctttccgctgtgcccattgccattactcctgcaacatatctggctctctgaagcggcactacaacaggaagcaccctaatgaggagtatgccaacgtgggcaccggggagctggcagcggaggtgctcatccagcaaggtggtttgaagtgtcctgtttgcagctttgtatatggcaccaaatgggagttcaataggcacttgaagaacaaacatggcttgaaggtggtggaaattgatggagaccccaagtgggagacagcaacagaagctcctgaggagccctccacccagtatctccacatcacagaggccgaagaagacgttcaagggacacaggcagcggtggccgcgctccaggacctgagatacacctctgagagtggcgaccgactggaccccacggccgtgaacatcctgcagcagatcattgagctgggcgccgagacccatgacgccactgcccttgcctcggtggttgccatggcaccagggacggtgactgtggttaagcaggtcaccgaggaggagcccagctccaaccacacggtcatgatccaggagacggtccagcaagcgtccgtggagcttgccgagcagcaccacctggtggtgtcctccgacgacgtggagggcattgagacggtgactgtctacacgcagggcggggaggcctcggagttcatcgtctacgtgcaggaggccatgcagcctgtggaggagcaggctgtggagcagccggcccaggaactctagaggacatgtggcatcggatggccacagggcggggctgccaggctctgcaggcacccagggtggggaggccacccttcctgccctacccgcagaatggtgctctcctttgccctccctgcccagcagcctgataggactctcctagtccaacttggggtgggcaaggcagtcagcatcaccagcaataccacaggaccctcaccccagcatagacacacaccccctgacccttaccatctgcttcctgaaagacttcagtgtcagctcccctacacacaccccacaccttcaccccttgcttcaagattcaaacagagactcccagtccccctcagcatcttccctgaatcacagccccagctccttgacccccatctaggtgccaaatgttcatctgcaaccgctatgcagtctggtgagagggagacagccatcacatagaaagtgaccgtacgggtttttaatcactgctgggtggggtgggggtagggggattgtcctggctttgtcgacaaagtcccacttccccgagtattaagggcccttggtatcaagtgaggtaaattcacccatcacagggtctcgccctaccatcctggaattatttcacttttaagataaatgcactatttcactgttcgcctcccattctaaggaggtgaggtggttggaataaaaacagttcctgtc

SEQ ID NO: 2017 - DNA, 5847 bp, Homo sapiens
agcgcggccgaagggcgtggttggcgctcggtcctgccctgcgcgttttgggctgcggttggagggccgcagttgcagtcagggtccgccagctcggggccagcgcatggggctgctgagaccgctccggacgtgcgaagcgttcgcggtgcggtaggaagctgaagtcttcagcagaaccctgacctaggtagggagtctcaatggccctgggtgaagaaaaggcagaagcggaagcatctgaagacacaaaggcccagtcctatgggagagggagctgcagggagcgggagctggacatcccagggcccatgagtggggagcagcccccacgcctggaagctgagggagggctcatctcccctgtatggggggcagaagggatacctgcccctacttgctggattgggactgaccctggcggcccctctagagcccaccagccacaggccagtgatgccaacagagagcccgtagctgagaggtctgagcctgcactcagtggcctgcctcctgccaccatggggtctggagaccttctgctctccggggaaagccaggtggagaagaccaagctttcttcctccgaggagttccctcagactctgagccttcccagaacaacaactatttgctcaggacatgatgctgataccgaagatgatccatccctagcagatttgccccaggcactggacctcagccagcagcctcacagctcaggtctctcttgcctgtcacagtggaagtccgtgctgagcccaggttccgcagctcagccttccagctgcagcatctctgcttcctccacaggcagcagtctccagggtcaccaggagagggcggagcctcgtggtggttctctggccaaggtctcctcctccctggagccggtcgtcccccaggaaccttcctctgtggtggggctaggacctcggccccagtggtcaccacagcctgtgttctctgggggtgatgcttctgggctaggcaggagacgcctctccttccaggctgagtactgggcctgtgtgctgccagattccctgcctccatcacccgaccgccactcccctctctggaacccaaataaagagtatgaagatctgcttgactatacttacccactgaggcccgggcctcagctcccaaagcaccttgatagccgtgtgccagctgaccctgtcctgcaggactccggggtagacctggatagcttctctgtctctccagcaagcaccctcaaatcacctactaatgtctcccccaactgcccaccagcagaggccactgccctgccattttctgggcccagagagccaagccttaagcagtggccctccagagtaccccagaaacagggtggcatgggcttggcatcttggagccaacttgcatctacccccagagccccaggcagtagggatgctcgttgggagcgcagagagccagccctgaggggtgcgaaggaccggctgactataggcaagcaccttgatatgggctctccccagctaaggacacgggacagagggtggccctcgcccaggccagagagggagaagaggaccagccagagtgcccggcgccctacctgcacagagtctaggtggaaatcagaagaggaagtggaaagtgatgacgagtatcttgccctccccgctcggctgacacaggtttctagcctggtttcgtatctaggatccatttctaccttggttaccctgcccactggggatatcaaagggcagagccccttggaagtgtcagacagtgatgggccagcttccttcccttcaagctccagccaaagccagcttccccctggagctgccctccaaggatctggggatcctgagggccagaatccctgtttcctgcgctccttcgtccgtgcccacgactccgcaggggaaggcagtctggggagcagccaggccctcggggtctcctctggactgctgaaaacacgcccctccttgccagctaggttggaccggtggccattctcagacccagatgttgaagggcagcttcccaggaaaggaggagaacagggaaaagaatcactggtgcaatgtgtgaagacattttgctgtcagctggaagagctgatctgctggctgtataatgttgcagatgttactgaccacgggactgcagccaggtccaatcttacaagtctcaagtcttctctgcagctttaccggcaatttaagaaagatatagatgaacatcagtctctgacggagagtgtcttacagaagggggagattcttcttcagtgcctgttggagaacaccccagttttagaggatgtccttgggaggatcgcaaagcagtctggtgagctggagagccacgcagatcgcctgtatgactctatcttggcctctctggacatgctggctggctgcacccttatccctgacaaaaagcccatggcggcaatggagcacccatgtgaaggggtttaacctggcatcttctcaggcagaggtgcaacctgtcggccaaacactggctagtgagaaaaaaaaccttcaagaagtccttgcaagagccattcaacactgaagtcaagggggaaaccttcaatatactagctttaaaatgcctttctcctccctgaatggagggctgagttactatttttatttacaatgaatccttccaaactaaggttttccttttggtgcttctccacaaagagcgtgtagctttgcaatttttgataaaataagacgtgttgccttcccctctatcccattaaaaaagagcagataaagctcaaactattccacctggtagggtcatttaccaagggctggtaggagattccgaatactcaatattctcaggcatgcaagaggacctaagagactgaaaaaagtgaattgttggccagaaaccttgggtcttttcataaaaggaaatttgggcttgtcaatccctctttaaagatataggtagaaagaagagatttttaaccctttgtctgcaaaagaaaaagggttaaatgaagcatctatacagatgactttgggagattatgacaccttttgccatcttcagggcttacgtctttactttcttggctaaccagtttcttagaagaaaatgtgtcagggacttggggatctacagtcatgctttagcatggctatggagctaattatcaagcttaaagggtaactttgggaggactcctcccttcactcctagtctcccttggaagagcagtccaggctcagggaagggaacggataggatgacacagtaagtacagaaactgaagctgtcaatagtgaaggaaaaaggggaattcttcgttgctttggcattgacacataagtactttgattaaaaaaaaaaaaaactatggatcaaccattcaaagcatcaattctatagctttttgcagcaagatgatcagttattgctggtaactgcagattctacagaaaagcacttttaaagttctgttgggccatgaatgaacctggaaggaggaaagcacagtaacaatggaaactaaagtcctattattaatgtgacttttctgcttcagaatttctgagactttatagtcactggaaaatagccattaaattctttaaagattagctcttcaacagtagctacacataaaatgcagtatttcaagtgcctgatgctgctgtggtatgctttatcataatgcttaagggcatgatcaaaattaaaatggcttatgagtttgccatattaatcatcttagttccatacacactgagactttaaaagggaaaaaccactctagcaaataattgtcaattataaacctgtatgtaaaacattcttgaaaacctagagttggttaaaaaggtagagatgtctgacggcctcttcttaaattgatatattttaccttctcttagatgtacatttataagtaggaacatgtccttccactgagtatgttactgaatagcccttaggaaattaaacccatttatttactaatatttgacaggcatagaagtgtattaattagcataaaagttggagatgaaaaccctatagaaacaaattggccaatattatactaattgaatgcagaatgtggcattctattcccattcaactaataatcagcttcaactgacaggaatttgcacagaatgttacacaataccctgtttcccaagaaagtactaccttacctagagatgatctaagatatttttgttcatcctctgaataaggtgagactaaagggtgctaactccctggacctggctgtgaatgctactgaagagtatcaacacaactgttaattataccgccgtgctttaagtttaagacttaccttaaaactcaagctgaaggctgggcacggtggctcatgcctgtaatcccagcactttgggaggccgaggcgggtggatcacaaggtcaggagatcgagaccatcctggctaacacggtgaaaccccatctctactaaaaatacaaaaagaaattagccaggcgtggtgatgggcgcctgtagtcccagctacttgggaggctgaggcatgagaatggcatgaacccgggaggcggagcttgcagtgagctgagatggcaccactgcactccagcctgggcaacagagtgagactcttgtctcaaaaaaaaaaaatcaagctgaaattgtttcagcctagtaagatgctgccagcagcatttctatgagcaaacatggccaaattagagtcaagtagctgagcttgctaactgcactgtgatgccacactggaataacttagtagtcccttaaaattaatggaagttaaatccacagggaagtgatgatactcaaagctggatcagcagtttcaagatctgggttcttggagatccataggtaagctcagcaaatggaagacgacgtcaacacggctattttgaagcttaggtgggaatggaacacaaagaaggtttgaggtaagatatgctggaaaggcaagatgtaggctaagggaaattcaatccaaggtcgaagaataggaaattactgctcagaccacaatgactatcattctgaaaggatttcacagagtgtgcagctgcttagatttaagaacactcttcttcactatgtaaactaatttatggcagcaccttatatttagaacaagtggtaattccctttactaagtgaacagattattaaaacctgtagtagctttgaaccgtttgtacttgaaaatgggggtataaaggggtatatattttttccagaaccacatttattggcgtatacatagaagcaaatcttaaggcatgctgaaatttgttgtaaatcccaatctttactgccatggggaaaagaacgctggaattttccaaacttaagtctgtaaatatgctcatcttaagttcatgtaatgtttccgctaactcaccaagaataagctgacaatttaaacaacttttactgtgtaaaaatgaagtgcacggcatggcatcacagtatcttgacatttgttttgtgtcatttagctactttagaaaatagtttctgaactctttccccctttatactgtattaaggcaaaaacaaaacttctgaagcattaaagatcttcaccaaaataactattggtaacttcaggaatttgtcagttgccttatgtgaggatgaatagatccaccaagcacgcctataatacaaagtaaactatgatttttattgtgaaattttcatagatggaaaattgaatattctgtccatttcattttacaattatcttaccacttatttttgtaccatgtatttcaattgcctgtttagtgaaaaataaaaattaaaaaaaccta

SEQ ID NO: 2018 - DNA, 653 bp, Homo sapiens
gacgcgcggggccacactgcccgccccctagcctggcgctgggcctccgggacaagttggctgggtccgggcttggggactgcaacgcggtcttctgtgcttcaccatctacataatgaatcccagtatgaagcagaaacaagaagaaatcaaagagaatataaagaatagttctgtcccaagaagaactctgaagatgattcagccttctgcatctggatctcttgttggaagagaaaatgagctgtccgcaggcttgtccaaaaggaaacatcggaatgaccacttaacatctacaacttccagccctggggttattgtcccagaatctagtgaaaataaaaatcttggaggagtcacccaggagtcatttgatcttatgattaaagaaaatccatcctctcagtattggaaggaagtggcagaaaaacggagaaaggcgctgtatgaagcacttaaggaaaatgagaaacttcataaagaaattgaacaaaaggacaatgaaattgcccgcctgaaaaaggagaataaagaactggcagaagtagcagaacatgtacagtatatggcagagctaatagagagactgaatggtgaacctctggataattttgaatcactggataatcaggaatttgattctgaagaagaaa

SEQ ID NO: 2019 - DNA, 688 bp, Homo sapiens
gatgctgctctttaggatggacctgggcataccctagtatctgtttattttgctttttctggtgactatttaatccaggacaatatgtttagaaattttaaaccagttttagaaattggtttaaaatacattaatttcattttttcagctataattattatgtgtgtatatatgtaaaatatagatatcaagagtcattaactttagtcaccttagtcattgacagggctgagtttggattaagagagaaaaaataatagttctactgtacaatagtataatttttatgattgtaagtattttaaacctagactccaccttcgggggtgcaaaccatattgttttttaattactagtcttctgtgcttcaccatctacataatgaatcccagtatgaagcagaaacaagaagaaatcaaagagaatataaagaatagttctgtcccaagaagaactctgaagatgattcagccttctgcatctggatctcttgttggaagagaaaatgagctgtccgcaggcttgtccaaaaggaaacatcggaatgaccacttaacatctacaacttccagccctggggttattgtcccagaatctagtgaaaataaaaatcttggaggagtcacccaggagtcatttgatcttatgattaaagaaaatccatcctctcagtattggaaggaagtgg

SEQ ID NO: 2020 - DNA, 3220 bp, Homo sapiens
gcgccgagtcccagcatgcaccgcgcccggccggctctgcctttgggggccagcagggctgtacctgggagttgggttggggcggagcggaggggaggccgtgccaggcagggccggttcgtgcggaaccgccatggccgagccggcttcggtaactgtgacatttgatgatgtggccttatatttttcggaacaagagtgggagatcctggagaagtggcagaagcaaatgtataagcaagagatgaagaccaattacgagacccttgattccctggggtatgctttttccaagccagatttgatcacatggatggaacaagggagaatgctattaatcagcgaacagggatgcttagataaaacaagaaggacaactagccctcctactgatgaacagttgaacatgaagaatactggaaagttgctatgttttgatgacgaaggaactcccaggacaaaagaagaggattgccgtttaaatggtcctcaaaaacaggacttgtgtgctgccttacgagggaaagagagaaagattttattagctcaaacagccaccttccagtctccaagtctccgagaaacagagattctaaataaaaaagtcagcatcacagcatatgatccagacaagaaagacctgcggcataagcctcgggagaccccagggcgcttagaaattcccacagggccaagatgctattcctgctatgtctgtaggaaagtcttccaagtaaggagggatttgctaaagcacaaacggagccactccaagagccagctctgcagatacccaaagtacaaaaactcgtccagagggaagtccgaactcaggcggacgcagaggctcctgtgtcagaagaagcggttccagtgcagtgagtgtgagaagagctacttcctgaagggcagcctcgtcactcatcaggttgtccacaccggccagcggccctacccatgccctgagtgcgacaagaccttccggtacagggccaacctgaagaagcacctgtgtctacaccgcggggagcggccgttctgctgcggggagtgcggccgggccttcgtgcagcagtgcgagctcacggagcacttgcggctgcacagcggagagaagcccttccagtgtccgcagtgtgaccggtgcttccgcctgaagaggggcatgaaggtccatctgacccagcacagcgggaagaggcccttccactgtcccgagtgtggccggagcttctcccggaaggctgccctgaagacccaccagaggacgcacagcgaggaaaagccgttttcttgtggtgaatgtggcaggaaattcatctacaagattaagctggacgagcacatcagagttcacacgggagagaagcccttttcgtgtcccgagtgtaacaaaagtttccgcctcaagagaagcctgaaagcccacgggctgcagcacattgggaagcggcccttccagtgcccggagtgcagcaggggcttcttctggaggaacgccatgcgcgcccaccagcgcctgcacagcgagcaaaagcccttcccctgcgccgagtgcggcaagcgcttcacgcggccttccaagctcgcctgccacaccagagtccacgacaggcagaaggagtttccctgcggcgagtgcaaaaagaccttttctcagcagtcgcggctcacgcagcacctgaaggtccacaccacggaaaagccgttctcctgcgccgagtgcggccgcagtttccgccgacgcgcgcatctcacagagcacacgaggcttcacagtggcgaggagcccttccagtgtcccgagtgcgacaagagcttctcctggaaggcctccatgaagttccaccagcggatgcacagggacgagaagcccttcgcgtgcggtgagtgtgacaagacctacacgcatcagtctcagctcaccgagcacctgaggctgcacagtggagagaagccctaccagtgtcctgaatgcgagaagactttccgcctcaagggaaacctgaaaagccacctgctgcagcacagtggccaaaagccattctcttgtgtgatgtgcggcaaaagtttcactcaacagtaccggctcacagaacacattcgagtccacagcggggagaagcccttccagtgtccggagtgtgacaagagctactgcatcaggggcagcttgaaggtccacttgtataagcacagtggagagaggcccttccagtgtcccgagtgtggcaaaggcttcctccagaagagaagcctgaaggcccatctgtgccttcacagtggggagaggcctttttcttgtgatgagtgtggaaggagcttcacgtacgtgggggcgctcaagacccacattgcagtgcatgccaaagagaagccctccagcctctaggtcaggccatgcagcagtcacgcagtcggctttcaggaggtgccagcagctctgttggctcaagttgaggcaggttgaaggattcacagggtaagatcgggcacagtggctcccgcctgtaatcccattactttgggaggcccaggtgggaggatcgcttgagcccagaagtttgagaccagcctaggcaacattgcaagactccatctctacaaaaaatataaaagtcagccaggcgttgtggtgcatgcttgtggtcccagctactttgggaggttgaggcaggaggatcgcttgagcccaggaggcagaggctgcagtgagccatgctcacaccactgcactccagcctgggtgacagagcaagatcttgtctcaaaaaagaaaaaaaatcacaaaatactggctacagacacactggacaggtgtgtggtctgcagaactctatggctccttgacaaaagttccaaataatccatagacagtcaaagagacatctccctcaataatcgtcataggaaagacgtgccagttgtggaggaaacattcacactgatctgctagtccaacgatctcttcagtgtcatccaataatcccttcattaaattcagaaactacagcctgagtgaagaaatgttacagccaggaacatattcctcagtcagcttttccattaccaggccattttacttaaatctgtattaaagtcttcagttttctctcatagtggattttcattttctctcagatggtgagagggcttctgtttcttggaatgtttccatattgctaaaaataaatgtcttccactatctcatttgttaaaa

SEQ ID NO: 2021 - DNA, 3101 bp, Homo sapiens
cgccatgcagagcactgacctaggcaacaaggagagcggcaagatatggcaccgcaagccgtccccggccacgcgggacggaattatagtgaacattattcacaacacttccgattaccatccaaaagttttgcgatttttgaatgtggcttttgatggcacaggcgactgcttaattgctggggaccaccaaggaaatatttatgtttttgacttacatggaaacagtcaccaaggagctagttagctggatgagaggacatgaatcatcagtattttcgatctctgtgcatgcatcagggaaatatgccatcacaacttcttctgatacagcacaattatgggacttggatacctttcagagaaaaagaaagctgaatattcgccagtctgtgggtatacagaaggttttctttctaccattaagtaataccatcctcagctgttttaaagataattccatttttgcctgggaatgtgacacacttttttgcaaatatcaattgccagctccacctgaaagctctagtatattatacaaagtgtttgctgtaaccagagatggccgaatcctggctgctggaggcaagtcaaatcatcttcatttgtggtgcttggaagctaggcagctctttagaattatccagatgcccactaaagttcgagccattcgccatctggaatttcttcctgatagttttgatgctggttctaatcaggttcttggagtactaagtcaagatggtattatgagatttatcaatatgcagacttgtaaacttctctttgagattgggagcctcgatgaaggaattagctcatcagcaattagcccacatggacggtacattgcatctattatggaaaatggaagtctaaacatatattcagttcaggctttaacacaagaaataaataagccacctccgcctttagtgaaagttattgaagatttgcccaagaataaactgagttccagtgatcttaagatgaaagtaacatcagggagagtacagcagccagcaaaatctagggaaagcaaaatgcaaactagaatattaaaacaagacctgactggtgattttgaaagtaaaaagaatgaattaccagatggattaaacaaaaagcgtttacaaatcttattaaaaggctatggtgaatatccaacaaaatacagaatgttcatttggcgctctctgctacaactgcctgaaaatcatactgcgtttagtaccctcatagataaggggactcatgtggcatttctcaaccttcagaagaaataccccatcaaaagtaggaagctactcagagtattacagagaaccttatctgcattagctcactggtctgtcatttttagtgacacaccatatcttccactcttggcatttccatttgtaaaattattccagaacaaccaactcatctgttttgaagttattgctactctcataatcaattggtgtcaacactggtttgaatattttcctaatcctcctatcaatattcttagcatgatagaaaatgttttggcatttcatgacaaggaactgctgcaacacttcatagatcatgatataacctcccagctatatgcatggcctcttcttgaaactgtgttctcagaagtgctgacaagagaggagtggctgaaattgttcgataatatcttttccaaccatccttccttccttctgatgactgttgtagcctacaacatatgttctagaacgcctctgctcagctgtaatcttaaagatgactttgagtttttttttcaccatcggaataacctggatataaatgttgtgattagacaagtttatcatctcatggagaccacgcctactgacattcatccagacagcatgcttaatgtttttgttgcactgacaaaagggcagtatccagtatttaatcaatatccaaagtttattgtggactatcaaacacaggaacgagaaagaataaggaatgatgaattggattacttaagagagagacagttgaagatatgcaagctaaagtcgaccagcaaagagttgaagatgaagcttggtaccagaaacaggagctgcttcgtaaagctgaagaaacaagaagagaaatgctcttacaagaggaggagaaaatgatacaacaaagacagaggctagctgctgtgaaaagagagctgaaagtaaaggaaatgcacttacaagatgctgcaagaaggcgttttctgaagcttcagcaagatcaacaggaaatggaactaagaagactggatgatgaaattgggagaaaggtatatatgagagatcgagaaattgctgccacagccagagacctagaaatgagacagctggaactcgaatcacaaaagagactttatgagaagaatcttactgaaaatcaagaagctcttgcaaaagaaatgcgagcagatgcagatgcctatagacgaaaagtggatcttgaagaacacatgtttcataagctgatagaagcaggtgaaacccagagccagaaaactcagaagtggaaggaagctgaaggaaaagagttccgtttgagatcagcaaagaaagcttctgctctttcagatgcgtctagaaagtggtttttaaagcaagagataaatgcggctgtagaacatgctgaaaatccatgtcataaagaagaacccaggttccaaaatgaacaggactcaagctgtttgcctagaacctcacaattaaatgactcttctgaaatggatccctcaacacagatttctttaaatagaagagcagtagaatgggacaccacgggacagaatcttattaagaaagtgagaaatcttcgccagagactcactgcccgggctcgtcacagatgtcaaacccctcatcttttggctgcatagaatgcatgtcaccttgagacggtcgagagagagacctattttgcaatcagtgacattgatttttagattatttatttaaaattcctataaagatcagccctttgtacagaaaaatgtgtctataaaaattatgtgttatttaattctgatactttttggcttgtaaatggcttcttgaactttttacaataaaaatgttttagaaactgtt

SEQ ID NO: 2022 - DNA, 1121 bp, Homo sapiens
cccagggctgggcttggttgtcatgagagtggaggctgcggccggggctatgggcagaggtggccgggtctgcttcttccctgtcactgccgcagcagcttggggtgcaaggcggcctggggcggcggaaggggcgccccccgagttccgtctgaggaagcggcggctgccgaggaagtccacgagagccgggtcccgcacgcccctggggtccgggtgctgaggcgccgcctggccgcctccccgggccgcggcaccgctccgacccagccgccctctccaccggggccgcggcagcgccagtcggggcccttccctctaagcagcccaaacgtgcagaatgccccacaagattggatttgtagtcgtcagctcatctggacacgaagacggcttcagtgcccgggagctcatgatccacgcgccaactgtcagtgggtggcggtcacctagattttgccagtttccacaagaaattgtccttcaaatggtggagagatgtcgaataaggaaactgcagttacttgctcaccagtatatgatttcaagtaaaattgagttctacattagtgaaagcttgcctgaatattttgcaccctatcaagcagagcggtttcgaagacttggctacgtgtctctctgtgataatgaaaagacaggttgcaaagcccgggaactaaaatcagtttatgtggatgcagtaggacaatttcttaaactgatttttcaccaaaaccatgtcaacaaatacaacatatataatcaggttgctttggttgccataaatatcattggagaccctgcagatttcagtgatgaaagcaatactgcctctcgagagaagttgattgaccactaccttgggcacaacagcgaggaccctgctctagaaggaacgtacgccagcagtgtaagaaccgggggtgaatccacttttggggagctaaagggccccgctgtgccatcctcggtcaccctctctgtcctgggcacctctttgggacagtggttcccttgccacctgcctgctgtggatgacaatgaggggactccattccagaggtgcctggtctaaaggaaagaagggaagggctgccatagttgccgcagtgagaaaaaaa

SEQ ID NO: 2023 - DNA, 6424 bp, Homo sapiens
ggttgtcatgagagtggaggctgcggccggggctatgggcagaggtggccgggtctgcttcttccctgtcactgccgcagcagcttggggtgcaaggcggcctggggcggcggaaggggcgccccccgagttccgtctgaggaagcggcggctgccgaggaagtccacgagagccgggtcccgcacgcccctggggtccgggtgctgaggcgccgcctggccgcctccccgggccgcggcaccgctccgacccagccgccctctccaccggggccgcggcagcgccagtcggggcccttccctctaagcagcccaaacgtgcagaatgccccacaagattggatttgtagtcgtcagctcatctggacacgaagacggcttcagtgcccgggagctcatgatccacgcgccaactgtcagtgggtggcggtcacctagattttgccagtttccacaagaaattgtccttcaaatggtggagagatgtcgaataaggaaactgcagttacttgctcaccagtatatgatttcaagtaaaattgagttctacattagtgaaagcttgcctgaatattttgcaccctatcaagcagagcggtttcgaagacttggctacgtgtctctctgtgataatgaaaagacaggttgcaaagcccgggaactaaaatcagtttatgtggatgcagtaggacaatttcttaaactgatttttcaccaaaaccatgtcaacaaatacaacatatataatcaggttgctttggttgccataaatatcattggagaccctgcagatttcagtgatgaaagcaatactgcctctcgagagaagttgattgaccactaccttgggcacaacagcgaggaccctgctctagaaggaacgtacgccaggaaatctgactatatctctccgctagatgacttagcttttgatatgtaccaagatccagaagttgcacagatcatacgaaaattagatgaaagaaaacgggaagctgtccaaaaggaacgctatgattatgccaagaaactaaaacaagccattgctgatttgcaaaaggttggtgaacgccttgggaggtatgaggtagagaaacgctgtgccgtggagaaggaagactacgatctcgccaaggagaagaagcagcagatggagcagtatcgtgccgaggtgtacgagcagctggagctgcacagcctcctggatgccgagctgatgcgaagaccttttgatttgcccctccagcccctcgctcgttctggcagtccttgccaccaaaagccaatgccctcactaccacaactggaagaaagaggaacagaaaaccagtttgcagaacctttccttcaggaaaagccttcatcatattctctaactatttctcctcagcattctgcagtagacccgttactccctgccacagatcctcatccaaagatcaatgcagagtccctgccctacgatgagcggcctcttccagctattcgtaagcattatggggaggcagtggtggagccggaaatgagtaatgcagacatcagcgatgctcggaggggaggcatgttaggggagccagagcccttaaccgagaaggccttgagagaagccagctctgccatcgatgtgttgggagaaaccttggttgctgaggcctattgtaagacgtggtcctaccgagaggatgcactgcttgccttgtctaagaagttaatggaaatgcctgttggaaccccaaaagaagatttaaagaacacactgagagcatccgtctttctcgttagaagagccataaaggacattgtgacctccgtttttcaggcttctttgaaattgttgaaaatgatcattacacaatatattcctaaacataaactgagtaaacttgaaacagctcactgtgtggagaggaccattcccgttttgctcaccagaactggagattcttctgcccgcctccgcgtcacagctgcaaattttattcaggaaatggccttgtttaaagaagttaagtctctccaaattattccatcctacctggtgcagccattgaaagcaaactcttcagttcacctggcaatgagtcagatgggcctcctggcccggctgctgaaagacctgggcactggcagctcgggcttcaccattgacaacgtgatgaagttttcagtgagtgccctggagcatagagtgtatgaggtccgcgagacggcggttcgaattattttggacatgtacagacagcaccaggcttccatcctggagtaccttcctccagacgacagcaacacacgcaggaacattctctacaaaacaatttttgagggatttgctaaaatagatggcagagctacagatgctgagatgagggcacggagaaaagcggctacagaagaagcagaaaaacaaaagaaagaagaaataaaagctttacaagggcagctggcagcactgaaagaaattcaggctgaagttcaggaaaaagaaagtgatgctgtgaagccaaagaatcaggacattcaaggagggaaagcagcccctgctgaagctctgggaatcccggatgagcactatctagataatttgtgtattttttgtggggaaaggagtgaatccttcacagaggaaggtctggatctccactactggaagcactgtctcatgctgacaagatgtgaccactgcaaacaggtggtcgagatatccagtctgacggagcacttgctgacggaatgtgacaaaaaagacgggtttggaaagtgttaccgttgcagtgaggctgttttcaaggaagagctgcccagacacataaaacacaaggattgcaaccctgccaaaccggagaagctggcaaaccggtgtcccctgtgtcatgagaacttcagccctggagaagaggcatggaaagctcacctgatgggcccagccggctgcacgatgaacctgcgcaagacacacattctgcagaaggccccggcactgcagccagggaaaagctcagctgtggccgcatcaggccccttggggtcaaaggccggaagcaagatccccaccccgaagggcggactgagcaagagctccagcaggacgtacgccaagcgctgacgcggcgctcgggctccttggtctctgtgagggatggagcgggtctcctgattctacaccatctctccagaactctctggccttggtggccccatgctctggctgctgtccccagctccccgccgtgcacgcctcttacgcgtctgtgccgtcagctctcgtgcaaacgatatggatgcagctaaccaaagatcctgcgtgcagtgccaggacctggccgcactgtacattaagccttcagggctgtctcaggccttccttagaatcagagaaggaagcgtcctgtttggagagagccagagagcaccgccgggaggcgctcgcgcaaggccacggtcagcacaggcacggtcccgctttccttagtgcttggagcaatttccataaaacattcaccagaaaccttttgcacatcggtctctgccacacgcagtagaatttccgcagggctgtggctcggccagcagcggttccaggagagtggcggtgcgcacgggcctccagccgtgccttccccctgcaggccccgtctgctgggcctgctgcccagtgcactcagccccaggtagcagaactcacgttcccactatagcaagaaataaaggcaaaagagaacatcttttttttaatcgtagtttttttgagaattggtcccacctcagccgcaccttgctggatgcttctccagtagtgctgcccctgtgacaggcatcagctccctgctggaactgaggtagacacaggtgtgggcccttcccgtgcctttgctcagaggcgcttcactttctccacactttcgaattcctaaagacatgtggaggaagtcactgttaaatgaatttccacctgatcaccctgtgttcacagcaggcagaagcccactggtatgggcctcccgccccttccacatccatgttgtgattggatccataagtttactttcttcaaagagttgataggatgtttaaaacatcaacacattgcttaaaatgatgaaaccaaccctcaaaaaacagtctcctaaccagccatcccctcctgtgggagtgagctgggggttttgtccatagctttggttgggcctgtgtcacatccaggcagccatgtggagggagtcagggtctgtctggaagcatccaccctctcgctgccccagcctgtgctcccaggggcctaggctaccatggactgaagggcagtcccctcccacctggtgcccagggcttctgcttgcctcgctgatgttgcatgggcagacttcaaaaaggatagttagaaaggtttgggttgatggagtttgcattaatgcaattagtgtataaatatgttttaattgccaaccgtgtgaaacaacaaaatatctaaaaactaatcccgatttgaacaatgtactccctggcctggatacattaataaccataaatttgcatgaattaatctccacgtttggtaaactaatacctctggttgactgagaatactgagtaagatataagacctaccaggaacctttaagaatatgctctgctcagtgttgtttgtctgcttgtttgcgacggagtctcactgtgtcgcccgggctgcagtgcaatggcgtgatcttggctcacagtaacctccacctcctgggttcaagcaattctcctgcctcagcctccctagtagctgggattacaggtgcacaccaccatgctcggctaattttttctatttttagtagagatggggtttcaccatgttggccaggctggtctcgaactcgtgacctcataatctgcccaccttggcctcccaaagtgctgggattacaggcgtgagccaccacgcccaggttaaatgtgtttataaggagagaggaggccaggcgcggtggctcacgctgtaatcccagcactttgggaggccgaggcgggcggaccacctgaggtcaggagttcgagaccagcctggccaacatggtgaaaccccatctctactaaaaatacaaaaatgagccaggcgtggtggcctgtagtcccagctacttgagaggctgaggcaggaaaattgcttgaacccgggaggtggaggttgcattgagcccacatcatgccattgcactccagcccaggcgacagagcgagactccgtctcgaaaaaaaaaaaaagtataaggagagaaataactttaaagtttattagacaaaacagagtatagatgccaagatgtctgtaaaatgattttttctggttttaaagagatgttggccattattttctaatccatttttaaaatacagacaaaacacttctttaaacagaacaagaatgagaaaagttaaccaaggaattattcttttctcaccaatcaacacttttaagaaatatatatatatatatacacacatatacacatgccttctatatattgtaacttaaagaaaatacttataaaaagacttcatttttagtgattgacaagcaaacgggttcatttaaaacaggttcctcttttgttagttacagggggtttttttgttgtttttttgtttttgtttttgttttgcgggggtggtggggtttgagacggagtcttgctctgttgcctaggctggagtgcagtggcgcgatcttggccccctgcaacctccgcctcccgggttcgagcaattctcctgcctcagcctcccgagtagctgggattacaggcgtgtgtcaccacgcctggctaatttttttgtatttttagtagagacggggtttcaccatattggccaggctggtctcaaactcctgaccttgtgatccacccacctcggcctcccaaagtgctggaattacaggcatgagccaccgcgcccggcccaatcatgtgtttttgttgaaatgatcctaccagtgattagtggctattgagagttttacagggttatacattgttaagggaccaagaatcaagtacaaaaaattaaaaaggaactgtaaaatcccttggtcattcataaataaatatctaaattaggaatactaattaattgaattttcactcatgagtatgttctgaatatttaatatttatttctattattttcatatgttaagatattccattaaatctaacttaaaagaattgtatgtataaattggcattaggatacaaatgtaaatgtttttaatgaaattttgcaactttttaatattttaacatagttttctatttgtctttatttcaagtaccagaattacaaaatatctaagtaatatatttttgttgtcgttttagggcttaagggttaattcacccagagtatattaatataataaaaagatcactaaatgttt

SEQ ID NO: 2024 - DNA, 3244 bp, Homo sapiens
cgcggctgcatggacgcgggtccggcgcgcgggaggcgatgacggccccgccatggcccgggcgggcagctgcggcggcgccgcggcgggcgcagggcggccggagccctgggagctgtccctggaggaggtgctgaaggcctacgagcagccgctcaacgaggagcaggcgtgggccgtgtgcttccagggctgccgcgggctgcggggctcgccgggccggcgcctgcgggataccggggacctcctgctgcgcggggacggctcggtcggggcgcgggagcccgaggccgcggaacctgcaaccatggtcgtgccactagccagctcggaagcccagaccgtgcagtccctcggcttcgccatctaccgcgcgctggactgggggctggacgagagcgaggagcgcgaactcagccctcagctggagcggctcatcgacctcatggccaacaacgacagcgaggacagcggctgcggtgccgccgatgagggctacgggggtcccgaggaggaggaggaggccgagggcgtcccccgcagcgtgcgcacctttgcccaggccatgcggctgtgcgcggcgcggctgaccgacccccggggcgcacaggcgcattaccaggccgtgtgccgcgcgctcttcgtggagacgctggagctgcgggccttcctggccagggtccgggaggccaaggagatgctgcagaagcttcgggaggacgagccgcatctggagacgcctcgggcagagctggacagcctgggtcacacagactgggcccgactgtgggttcagctcatgcgggagctccgccgcggagtgaagctgaagaaggtgcaagagcaggagttcaaccccctccccaccgagttccagctcacgcccttcgagatgctgatgcaggacatccgggcccggaactacaagctgcgcaaggtcatggtggatggggacatcccgccccgggtgaagaaggacgctcacgagctcatcctggactttatccgctcacggcctccactgaagcaggtctctgagaggcggctgcgcccgttgccaccaaagcaaaggtccctgcatgagaagatcctggaggagatcaagcaggagcggaggctgcgcccggtgcggggcgagggctgggctgcccgcgggtttggctctctgccctgcatcctcaacgcctgctccggagatgccaagtccacctcctgcatcaacctgtcagtcacagatgctgggggcagcgcccagcgcccgcggccccgcgtgctgctcaaggcgcctaccttggctgaaatggaagagatgaatacatctgaggaagaagagtctccgtgtggggaggtgacgctgaaacgggaccgctccttctcagagcatgacctggcccagctccgaagtgaggtggcctctggcctgcagtcggccacccaccccccaggagggacggagccaccacggccccgagctggcagtgcgcatgtgtggaggcccggctcccgagaccagggtacctgtcccgcgagtgtctctgaccccagccaccccctactcagcaaccggggctcctcgggggacagacccgaggcctccatgacccccgatgccaaacacctgtggctggagttcagccaccccgtggagagcctggcgctgactgtggaagaggtgatggacgtgcgccgtgtgctggtgaaggccgagatggaaaagtttttgcagaacaaggagctcttcagcagtctgaagaaggggaagatttgctgctgctgccgggccaagttcccgctgttctcgtggccgcccagctgtctcttctgcaagagagccgtctgcacttcctgtagcataaagatgaagatgccttctaagaaatttggacacatccctgtctacacactgggctttgagagtcctcagagggtatcagctgccaaaaccgcgccaatccagagaagagacatctttcagtctctgcaagggccacagtggcagagcgtggaggaggcgttcccccacatctactcccacggctgtgtcctgaaggatgtctgcagtgagtgcaccagctttgtggcagacgtggtgcgttccagccgcaagagcgtggacgtcctcaacactacgccacgacgcagtcgccagacccaatccctctacatccctaacaccaggactcttgacttcaagtgacagccccaggtggccaggcctccaggaggcaccaggcaggccctgtatcaggctaggacgctctgagctgtgcatgtacatatatacatatatagatacatttataatatatacacacagtctatatatttatatacactgtttcctggccccagagctcatttgggttcaggcgcacttcaaaaccctccctgggggaggctgtttcttctcaggattccttgccagggaggaaggggagggaacagggtgggttttctcactgaagagagaaagcagaaggttctagatcctggcacagactgcatcccatgttcccatgctcttctccgtccccaggaatgcgaacggcagtttcccttccccagtggacgtctaggtggggacagggtatcttggctcccagctggaccagagtgccctgcttgcctctgctctccctttgtggggactcaggcagcagaggcatctgggaagtctctgagtaggcagggtcctcctgggaggcacccccacctgtttgaaaggtctggccaggcgtggtggttcaggcctgtaattccagcactttgggaggccgaggagggaggatcacctgaggtcaggagtttgagaccagcctggccaacatgatgaaatgttgtctctactgaaaatgcaaaaattagccaggtatagtggcaggaacctgtaatcccagctacaggggaggctgaggcaggagaatcgcttgaacccgggaggtgtaggttgcagtgagccgagattgcaccactgcactccagcctgggcgacagagcgagactctgtctcgaaaaaaaaaaaggtccgtgccaagctgctccctgcccttgccctttccctttccctggggtccaaaccacatgtgtcctgcctctcctggccctaccacattctggtgctgtcctcactcgcccctggcccagaggctcctgaagatgctgggcggtcctggcacagggaggagcagctctgtaaatctgtgcacatggccactcttggcctaataaaggaggtctcacagtc

SEQ ID NO: 2025 - DNA, 1998 bp, Homo sapiens
gcgcccaggggtcccgcgggttttcgggcgcagggtggcgcccgcggcaggcggcggccatgaacttctccgaggtattcaagctctccagcttactctgcaagttctccccggacggcaagtacctggcttcctgtgtccagtaccggttagtggtccgggatgtgaacacccttcagatccttcagctgtacacgtgcctagaccagatccagcacatcgagtggtcggcagactcgctcttcatcctgtgcgccatgtacaagcgagggctggtgcaggtctggtctttagagcagcccgaatggcactgcaaaatagacgagggctcagccgggctggtggcctcgtgctggagcccggacgggcgccacattctcaacaccacggaattccatctgcggataaccgtctggtccttgtgcacaaaatccgtgtcttacatcaaatacccgaaagcttgtctgcagggaatcaccttcaccagggacggccgctacatggcgctggcagaacggcgcgactgcaaagattacgtgagcatcttcgtctgcagtgattggcagctcctgcggcattttgatacggacacccaggatctcacagggattgagtgggccccaaacggctgtgtgctggcagtgtgggacacctgcttggagtacaagattctgctgtactcattggatggccggttgttgtccacgtacagcgcttacgagtggtccctgggcatcaagtctgtggcctggagccccagcagtcagttcctggcagttgggagctatgatggaaaggtgcgcatccttaatcacgtgacttggaaaatgatcacggagtttgggcatcctgcagccattaatgatcccaagatagtggtgtataaggaggccgagaagagcccacagctgggactgggctgcctctccttcccgccgccccgggccggggccggccctctcccgagctcagagagtaaatatgagatcgcctctgtcccagtctccttacagacactgaaacctgttaccgacagagcaaacccgaaaatcggcataggaatgctggcatttagtcctgacagctacttcctggcgacaaggaacgacaacattcccaatgccgtctgggtctgggacattcagaagctgaggctgttcgcggtgctcgagcagctgtccccagtgcgcgcatttcagtgggacccgcagcagccgcggctggccatctgcacgggaggcagcaggctctacctgtggtccccagcgggctgcatgtcggtgcaggtgcctggggaaggtaagcacatccccgaggccacggacgtggcagccttgctgtgtgcagtctggcatcacacgggctgaactgttgaagcccagctgctgtctccggcagcactccagggaaactgccctcagagtctttgcgtaaacctcaagacggacacacaggggacccgctgccctcagctttatgggctagaagcagcctctccctgacttgaggcagctctggggctccaccctggctctgcctatgtgggtcactccaggcactgtgctggcctgcaggacaagggggtgcccatcccccagaatctgggcctcccctgctgtaatcctctggccacctgtctctctctaggcgactttgcagtgctctctctgtgctggcatttaagcggagactcgatggccctcctcagcaaggatcacttctgcctctgcttcctggagacagaggcagtggtcggcacagcctgcagacagctgggcggccacacgtagcagcggtgcactaacgtgtgcagaaacagggctactctgtgtttccagtgtgggaaaaaacacagcttcaccaggaggttctccactgtggtggtctggattcagtgattgattctatttttctatagcaaagcatttttgtaaatatgtatggtataaaactgtagttttattatttaaaataaatacttgctgatttatacaacta

SEQ ID NO: 2026 - DNA, 2414 bp, Homo sapiens
gggtggtggcggtggctgcggcgacggcggtcgcgtcggcgtcagggtcggggtcggtaaggggtgcggcaatgctgcaactgcgggactcggtggactcggccggtacgagccccacggcggtgctggcggccggcgaggaggtgggggcaggcggcggcccgggcggggggcggccgggggcggggacgccgctgcgccagacactctggcctctcagcatccacgaccccacgcgccgcgcccgcgtcaaggagtacttcgtgttccggcccggcagcatcgagcaggcagtggaggagatccgcgtggtggtgcggcccgtggaggacggcgagatccagggagtgtggctgcttaccgaggtggatcactggaacaatgagaaggagcggctggtgctggtcacggagcagtccctgcttatctgtaaatacgacttcatcagtctccagtgccagcaggtggtgcggatagcgctcaacgcagtagacaccatttcctacggagaattccagtttccccctaaatcgctcaacaagcgagaaggttttgggattcgaattcagtgggacaagcaaagtcgtccttccttcataaacagatggaatccctggtctaccaacgtgccctatgccactttcacagaacacccgatggctggcgcagatgagaagacagcatctctgtgtcagttggaaagcttcaaggctctgttaatccaagctgtcaaaaaagcccaaaaagaaagccctttgccaggacaggcgaatggcgtgctgatcctggagcgccccctgctcatcgagacctacgtgggactcatgtccttcattaacaacgaggcgaaactgggctactccatgaccaggggcaaaataggcttttagccgctgcgttctgggagctcctcccccttctgggagctcctccccctccccagaaggccaagggatgtgggggctgggggactgggaggcctggcagtcttcatgctgccctgctgctgctggaaggatggggatctttcacctttagggatctcagcacaattagaatcgtaaagtgaattctatctatttaattggatattggactctgctcatataagctacagacaaaagccaaaagactctcgctgtccctgtgctgctggtatttcattctctgtaacttcagttctggtgttttccttgagtatctacttggcttctcgtggtttttcccaccccagctgccccagcacgcgggacccatagcacaccccttagcgcttgcctaggttgctgaaaacagggaggcacctggtatctcgagtgcctgcagttgcaagtatgtttacacctggtgtccaattttgtattttaaaatgtaatccatttttacttcagctcatccaaaagcagccagcagaccggttgactgagaccggtctgtggctgtgggccccttggtgacccgctgctcttttggaaatgggtgacctgaagtgacactttttccacaattaacccaagttgtgttaatacttcaggtctgtttcccagacccagaaagctttacagaaaatcattgtaagacaatttattaatttgagaaagtcaccttgacagttctttgcacacaagttttacacctctctggattcgaagtttgtattgtattcatagttaaagggaatcgggtactttgcttgttgaataatgcactttaaaacaaggaaccgtatcaggccagcatggtggctcatgcctgtaatcccagcattttgggaggctcaggcagacaaatcgctctagctcagaagttgcagagcagcctgggcaacatggtgaaacccgtctctaccaaacagacaaaaagcagccaggcgtggtggcacatctgtggtcccagctacttgagaggctgagccaggaggatcgcttgagcccaggaggcggaggttgcagtgagctgagatggcaccacttattgcactccagcccgggcgacagagcgagactccatctaccagatccttatgacgcagctgatgcctgccttggttcctaccactctggtgtagacagaggactttgtccaagtctcacactaaacatgcccgggcttcgatgtgcctggaggatttccccacagggacccacgcacctccctgtatctgcgcagcttgctcgtgtggctggaagcgctgtcgataagcttcacgcactggcttgccagttcttcagctctaggacttgtagctttaagcaaacggtgtggcatgggttgagtgtggccacctgcaggatgtgcagggctgcctcagaagctggctggggactctagcctctgtgttcataaagacattaagaagtggatggatgttgttccttttttgaagttgtcattaaagtaggtgcaacaaccaa

SEQ ID NO: 2027 - DNA, 870 bp, Homo sapiens
atgtggcccttcccgagccgctctctcttcccacccccgactcaggcctggctccagacggtctcctcagaccctgaggcccagggctggggggcctggaacgagaccaaggagattctggggccagagggtggggaagggaaggaggagaaagaggaggaagaggatgcagaggaagaccaggatggggatgcaggctttctgctgtctctgctggagcaagagaacctggctgagtgcccattgcctgaccaggagctggaggccatcaagatgaaggtgtgtgccatggagcaggccgaggggacgccacggcctccaggagtgcagcaacaggccgaggaagaggagggcaccgcggccgggcagctgctgagccctgagaccgtgggctgccccctctctgggacccccgaggagaaggtggaggctgaccacagatccgtctacgtgggcaacgtggactacgggggctccgccgaggagctggaggcccacttcagccgctgtggggaggtccaccgagtcacgatcctgtgtgacaagttctctggacaccccaagggttatgcctacatagagtttgccaccaagggctccgtgcaggccgccgtggagctggaccagagcctcttccggggccgggtcatcaaggtgctgccgaaaagaaccaacttccctgggatcagctccacagaccgcgggggccttcgaggacacccaggctccaggggggcacccttcccccacagcggcctccagggcaggccccggctcagaccacaagggcagaaccggacgccggcggcactgacgccactatgggctcggccgctgccctgggtggtagtcagccacgtcatcaagtga

SEQ ID NO: 2028 - DNA, 2219 bp, Homo sapiens
cccatttcaggtgggacttgtggcataggagaggtcttgggactggtgcccagcctggggcagtcccctcccaaagcctccctctcccacacagccgtgagagcctgtgggcctagaggactcagctggcgggttgcagggaggcgcagccttttgcaatcccccagggccacaggttaccctccttctctctctagacccccagctctaccaggagatccaggagcggggcctgaacaccagccaggagtctgatgacgacatcctcgatgagtcctccagccccgagggaacccagaaggtggacgccaccattgtggtcaagagctaccggcccgcccaggtcacctggagccagctcccagaggtggtggaattgggcatcctggaccagctctccactgaggagcggaaaaggcaggaggccatgttcgagatcctcacgtcggagttctcctaccagcacagcctgagcatcctggtggaggagttcctgcagtccaaggagctgcgggcgaccgtgacccagatggagcaccaccacctcttctccaacatcctggatgtcctgggtgccagtcagaggttcttcgaggacctggagcagcggcacaaggcccaggtgctggtcgaggacatcagtgacatcctggaggagcacgctgagaagcacttccacccctacatcgcctactgctccaacgaggtctaccaacagcgcacgctgcagaagctgataagcagcaacgccgccttccgagaggccctgagagagattgagaggcggccggcgtgcgggggcctgcccatgctctccttcctgatcctccccatgcagcgggtgacccggctgcccctcctgatggatacgctctgcctcaagacccagggccactccgaaaggtacaaggctgccagccgtgcactgaaggccatcagcaagctggtgaggcagtgcaacgagggggcccacaggatggagcgcatggagcagatgtacacgctgcacacacagctggacttcagcaaggtcaagtccctcccactgatctctgcctcccggtggctgctgaagcgcggagagctgttcttagtggaagaaaccggactttttcgaaaaattgccagccggccaacgtgctaccttttcctgttcaacgatgtcctggttgtgaccaagaagaagagcgaggagagctacatggtccaggactacgcccagatgaaccacatccaggtggagaagatagagccgtctgagctccctctgcccgggggcggcaaccgtagctcctccgtgccccaccccttccaggtgaccctgcttcgcaacagcgagggccgccaggagcagctcctgctctcctcggactccgcgagtgaccgggcacggtggatcgtggcgctcacacacagtgagagacagtggcagggcctctccagcaaaggagacctgccccaggtggagatcaccaaggccttcttcgcgaagcaagcagacgaggtcacactgcagcaggcggacgtggtcctggttctgcagcaggaggatgggtggctctatggcgagaggctccgggacggagagacgggatggttccccgaggactttgcccgcttcatcaccagccgtgtggccgtggagggcaatgtccgcaggatggagcgtctgcgggtggagacggacgtgtagccctggcgaggccagccggcggcagcacagcctgtctccaatcagcaagtggtcgtgcctggctctagagagcgtggggagctggtctcaaggacccagcatggttccctggggcttcccaagagcctgtggctgtggtgccgggctccagacacttcacggaaggaagatcacatgtccccagagaggcacccccaggcaagctcgagggggccacaccgtgtcccagggagcccagcctattcccgttggctggctgggcccctcagctgctgggccccacctccccactgcacccagggggcaactccacctggactgatgggcacaggaggcaccaatagcgattattgggggcaatgcgaggtctcctcctatgcccttcctacccctgagtgggacaagaagggccctgagtgcccaggagtgccccacgttctgagaaggggccggccggagggaggggacccggcagggagatttcggttttgaggtttctaaatacattaaagttatttcttaagaa

SEQ ID NO: 2029 - DNA, 2211 bp, Homo sapiens
cgtgaggccctgtggagctgacatctattgggcacagcttcgcatgtggagccgagaggtctctggggtcccagggcagaatcgccgtgggcaacacctgccccggctgacagctgcggtttctgtgtctctcttttgtgcagaagacgctggggaggaaacgtgggcacaagggttccttcaaggacgacccccagctctaccaggagatccaggagcggggcctgaacaccagccaggagtctgatgacgacatcctcgatgagtcctccagccccgagggaacccagaaggtggacgccaccattgtggtcaagagctaccggcccgcccaggtcacctggagccagctcccagaggtggtggaattgggcatcctggaccagctctccactgaggagcggaaaaggcaggaggccatgttcgagatcctcacgtcggagttctcctaccagcacagcctgagcatcctggtggaggagttcctgcagtccaaggagctgcgggcgaccgtgacccagatggagcaccaccacctcttctccaacatcctggatgtcctgggtgccagtcagaggttcttcgaggacctggagcagcggcacaaggcccaggtgctggtcgaggacatcagtgacatcctggaggagcacgctgagaagcacttccacccctacatcgcctactgctccaacgaggtctaccaacagcgcacgctgcagaagctgataagcagcaacgccgccttccgagaggccctgagagagattgagaggcggccggcgtgcgggggcctgcccatgctctccttcctgatcctccccatgcagcgggtgacccggctgcccctcctgatggatacgctctgcctcaagacccagggccactccgaaaggtacaaggctgccagccgtgcactgaaggccatcagcaagctggtgaggcagtgcaacgagggggcccacaggatggagcgcatggagcagatgtacacgctgcacacacagctggacttcagcaaggtcaagtccctcccactgatctctgcctcccggtggctgctgaagcgcggagagctgttcttagtggaagaaaccggactttttcgaaaaattgccagccggccaacgtgctaccttttcctgttcaacgatgtcctggttgtgaccaagaagaagagcgaggagagctacatggtccaggactacgcccagatgaaccacatccaggtggagaagatagagccgtctgagctccctctgcccgggggcggcaaccgtagctcctccgtgccccaccccttccaggtgaccctgcttcgcaacagcgagggccgccaggagcagctcctgctctcctcggactccgcgagtgaccgggcacggtggatcgtggcgctcacacacagtgagagacagtggcagggcctctccagcaaaggagacctgccccaggtggagatcaccaaggccttcttcgcgaagcaagcagacgaggtcacactgcagcaggcggacgtggtcctggttctgcagcaggaggatgggtggctctatggcgagaggctccgggacggagagacgggatggttccccgaggactttgcccgcttcatcaccagccgtgtggccgtggagggcaatgtccgcaggatggagcgtctgcgggtggagacggacgtgtagccctggcgaggccagccggcggcagcacagcctgtctccaatcagcaagtggtcgtgcctggctctagagagcgtggggagctggtctcaaggacccagcatggttccctggggcttcccaagagcctgtggctgtggtgccgggctccagacacttcacggaaggaagatcacatgtccccagagaggcacccccaggcaagctcgagggggccacaccgtgtcccagggagcccagcctattcccgttggctggctgggcccctcagctgctgggccccacctccccactgcacccagggggcaactccacctggactgatgggcacaggaggcaccaatagcgattattgggggcaatgcgaggtctcctcctatgcccttcctacccctgagtgggacaagaagggccctgagtgcccaggagtgccccacgttctgagaaggggccggccggagggaggggacccggcagggagatttcggttttgaggtttctaaatacattaaagttatttcttaagaa

SEQ ID NO: 2030 - DNA, 3061 bp, Homo sapiens
gaaggcgcaggcaccgggcggcggcggctcggcgggaatcgagaggcgcgatccagtccgggcgatcacgtgggctccagccggcccaggtggggctgtgacctgtgacgcaggcggcgccgccacaggtgcccgggacgcgccccgccccctccccggccctccccgcccgggccctcggacccggagcagccccgcccgcccagcgcccacctgcggggccgcagccgccgccctccagccagaccgcgcaggaagcggaggaggcgccccgggccggaccgcgctgccgcaggagcgaagcggctgcaggacaggacaggacccggcgctggaagctgcaccgccagcgcgccgcccctccgtccctccgccccgcggcgcaggaccccacagccgcccagcatggcccagcggcactcagacagctccttggaggagaagctcctgggacaccgcttccactcggagctccggctcgatgccggggggaacccagcctccgggctcccaatggtccgtggctccccgcgtgttagagacgatgccgccttccagccccaggtcccggcacccccacagcctcggcccccggggcacgaggagccatggcccatcgtcctgagcacagagagcccggcggccctcaagctgggcacccaacagctgatccctaagagcctggctgtggccagcaaggcaaagaccccagcccgccaccagagcttcggggcggctgtacttagcagggaggccgcccggcgggaccctaagctcctcccagcccccagcttctccctggatgacatggacgtggacaaggaccccgggggcatgctgaggcggaacctgcggaaccaatcctaccgggcggccatgaagggcctggggaagccaggtggccagggagatgccatccagctaagccctaagctccaggctctggctgaggaacccagccagcctcatactcggagcccggccaaaaacaagaagacgctggggaggaaacgtgggcacaagggttccttcaaggacgacccccagctctaccaggagatccaggagcggggcctgaacaccagccaggagtctgatgacgacatcctcgatgagtcctccagccccgagggaacccagaaggtggacgccaccattgtggtcaagagctaccggcccgcccaggtcacctggagccagctcccagaggtggtggaattgggcatcctggaccagctctccactgaggagcggaaaaggcaggaggccatgttcgagatcctcacgtcggagttctcctaccagcacagcctgagcatcctggtggaggagttcctgcagtccaaggagctgcgggcgaccgtgacccagatggagcaccaccacctcttctccaacatcctggatgtcctgggtgccagtcagaggttcttcgaggacctggagcagcggcacaaggcccaggtgctggtcgaggacatcagtgacatcctggaggagcacgctgagaagcacttccacccctacatcgcctactgctccaacgaggtctaccaacagcgcacgctgcagaagctgataagcagcaacgccgccttccgagaggccctgagagagattgagaggcggccggcgtgcgggggcctgcccatgctctccttcctgatcctccccatgcagcgggtgacccggctgcccctcctgatggatacgctctgcctcaagacccagggccactccgaaaggtacaaggctgccagccgtgcactgaaggccatcagcaagctggtgaggcagtgcaacgagggggcccacaggatggagcgcatggagcagatgtacacgctgcacacacagctggacttcagcaaggtcaagtccctcccactgatctctgcctcccggtggctgctgaagcgcggagagctgttcttagtggaagaaaccggactttttcgaaaaattgccagccggccaacgtgctaccttttcctgttcaacgatgtcctggttgtgaccaagaagaagagcgaggagagctacatggtccaggactacgcccagatgaaccacatccaggtggagaagatagagccgtctgagctccctctgcccgggggcggcaaccgtagctcctccgtgccccaccccttccaggtgaccctgcttcgcaacagcgagggccgccaggagcagctcctgctctcctcggactccgcgagtgaccgggcacggtggatcgtggcgctcacacacagtgagagacagtggcagggcctctccagcaaaggagacctgccccaggtggagatcaccaaggccttcttcgcgaagcaagcagacgaggtcacactgcagcaggcggacgtggtcctggttctgcagcaggaggatgggtggctctatggcgagaggctccgggacggagagacgggatggttccccgaggactttgcccgcttcatcaccagccgtgtggccgtggagggcaatgtccgcaggatggagcgtctgcgggtggagacggacgtgtagccctggcgaggccagccggcggcagcacagcctgtctccaatcagcaagtggtcgtgcctggctctagagagcgtggggagctggtctcaaggacccagcatggttccctggggcttcccaagagcctgtggctgtggtgccgggctccagacacttcacggaaggaagatcacatgtccccagagaggcacccccaggcaagctcgagggggccacaccgtgtcccagggagcccagcctattcccgttggctggctgggcccctcagctgctgggccccacctccccactgcacccagggggcaactccacctggactgatgggcacaggaggcaccaatagcgattattgggggcaatgcgaggtctcctcctatgcccttcctacccctgagtgggacaagaagggccctgagtgcccaggagtgccccacgttctgagaaggggccggccggagggaggggacccggcagggagatttcggttttgaggtttctaaatacattaaagttatttcttaagaa

SEQ ID NO: 2031 - DNA, 1586 bp, Homo sapiens
gccctcgcgctgtcgccgccacagtctgcgacgggacccggcgtgcccatgtgtcaggtgggcgaggactacggggagccggcgcctgaggagccgcccccggcgccgcggcccagccgtgagcagaagtgtgtgaagtgcaaggaagcgcagcccgttgtggtgatacgagccggagatgccttctgcaggtgctcttggcgtggtctggggggccttcgtccagctccatggtctggcaggttcttgagggcctgagccaagattctgccaaaagactgcgctttgtggcaggagtcatctttgttgacgagggagcagcctgtggccagagcctagaggagagatcaaagaccctggccgaagtgaagcccattctgcaagcaactgggttcccatggcatgtggtggccttagaggaggtgttcagcctgccaccgtcggtgctttggtgctctgcccaggagctggtgggatccgagggggcctacaaggcggccgtggacagcttcctccagcagcagcatgtgctgggggccgggggtggtcctggcccgactcaaggggaggaacagccaccccagcccccgctggacccccagaacctggcaagaccgcctgcccctgcccagactgaggctctttcccaactgttctgctcagtgaggacactgactgccaaggaggagcttctgcagaccctgcggacccacctgatcctccacatggcccgagcccacggctactccaaggtcatgactggggacagctgcacacgcttggctatcaagctcatgaccaacctggcgctgggtcgaggggccttcctggcctgggatacgggcttctcggatgagcggcacggggacgtggtggtggtgcggcccatgcgggaccacaccctgaaggaggtcgctttctacaaccgcctgttctccgttccttctgtcttcacaccagccgtcgacaccaaggcccctgaaaaggccagcatccaccggctgatggaggccttcatcctcaggctgcagacccagttcccctccactgtcagcactgtgtacaggacaagtgagaagctggtgaagggcccccgggatggccctgctgctggcgactccggcccccgctgcctcctctgcatgtgtgccctggacgtcgacgccgctgacagtgccacggcttttggggctcagacctcctcgcgtctctcccagatgcagtcacccatccccctgactgagacccggacacccccggggccctgctgttctccaggggtgggctgggcccagcgctgtggccagggggcctgcaggagggaggacccccaagcctgcattgaggagcagctgtgctacagctgccgcgtgaacatgaaggacttgccctcactggaccccctgccgccgtacatcctggctgaggcccagctccgcacacagagggcctggggcttgcaggagatccgggactgtctgattgaggacagtgacgacgaggcgggccagagctgagcgtgaggacgtgcttgccgggacagcaggcagtggccacctggtacaccacactggagccggaaggca

SEQ ID NO: 2032 - DNA, 1814 bp, Homo sapiens
gtggagctggggtcactgcgcggtgggaccatggcctcggagaagccgctggcggcagtcacttgtacagcgccggtcaacatcgcggtcatcaagtactggggcaagcgcgatgaagagctggttctgcccatcaactcctccctgagcgtcactctgcaccaggaccagttaaaaaccaccacaacagccgtcatcagcaaggacttcaccgaggaccggatttggctgaatggccgggaggaggatgtggggcagccgcggctgcaggcctgcctgcgggagatccgctgcctggcccggaagcggaggaactcacgggatggggacccgctgccctccagcctcagctgcaaggtgcacgtggcatcggtgaacaacttccccacggctgcgggcctggcctcctcagcggcgggctatgcctgcctagcctacaccctggcccgtgtctacggcgtggagagtgacctctcagaagtggctcgccggggctcaggcagcgcctgccggagcctgtatgggggctttgtggagtggcagatgggagagcaggccgacgggaaggacagcatcgctcggcaagtggcccccgagtcacactggcctgaactccgcgtgctcatccttgtggtgagcgctgagaagaagctgacaggcagtaccgtgggcatgcgggccagtgtggagaccagccccctgcttcggttccgggccgagtccgtggtgcccgcgcatggcggagatggcccgctgcatccgggagcgagacttccccagcttcgcccagctgaccatgaaggacagcaaccagttccacgccacctgcctcgacaccttcccccatctcttacctcaatgccatctcctggcgcatcatccacctggtgcaccgcttcaacgcccaccacggggacaccaaggtggcgtacacctttgacgcgggccccaatgccgtgatcttcaccctggacgacactgtggctgagtttgtggctgctgtgtggcacggctttcccccaggctcgaatggagacacgtttctgaaggggctgcaggtgaggccggcccctctctcagctgagcttcaggctgcgctggccatggagccgacccccggtggggtcaaatacatcattgtcactcaggtggggccagggcctcaaatcctggatgacccctgcgcccacctcctgggtcctgacggcctgccgaagccagctgcctgactgcctcagcagggaccgcatgccgcttggagaaggggtggcctcgccggagctagggagcggatgtggtgggctggccggactcctgggacatgtgggtggtggcttgaccccgggcccatgggcagcttgctgtggggcagtgcagggagtcctgcggccgcccaggtgtcaggagaggtccccgccgagtgcttcagctgccctaagctgcaccagcgctttgccaagatgggatggggagggggtatgagaactggcagagcctcggtgcagcagggctgaagggctttctcaccccagctctggctatgcccagttctctgagaaaggagctcagtggggaggtggtccctccagcggaccagggaaggggtcaccgtgctgggagcagcctccttgggcctcaggaaaccaccaagtgcctcggatggtggctgcccacggcgcttctgctgagaccctgcccccggcccaggtgtctcggagggtggctgcccacggcctgggtgtggctggaatggtggcaggagtgggcaccagtgcggccccggtggccatggggaataaaccagcattgctgcc

SEQ ID NO: 2033 - DNA, 2709 bp, Homo sapiens
gggatccaggagcgaggagccgggagcggggaacagggagtcggggagccgggaaccagggctggcagcggccgccatgagcacggtggaccttgctcgcgtgggcgcgtgcatcctgaagcatgcggtgaccggggaggccgtggagctgcggagcctgtggcgggagcacgcgtgcgtggtggccgggctgcggcgcttcgggtgcgtggtgtgccgctggatcgcccaggacctcagcagccttgctgggctcctggaccaacacggcgtgcgcctggtgggcgtagggcccgaggccctgggtctgcaggagttcctggacggcgactacttcgcgggagagctctacctggatgagagcaagcagctttacaaggagctaggcttcaagcggtacaacagcctgagcatcctcccagcagctctggggaagcccgtgcgtgatgtggctgccaaggccaaggctgttggcatccaggggaacttgtctggggacctgctgcagagcggagggctgctggtggtcagcaaaggtggtgataaagtgctcctgcatttcgtccagaagtccccaggcgactacgtccccaaggagcacatcctgcaggtcctgggcatctctgcggaggtctgtgccagcgacccgcctcagtgtgacagagaggtgtgagggaggcgaaggccctggcctccgaggatctgggtggcgtctgctgccctaggtgtgctggaagtccacttggaagaactgttccggaggcgctgggtcgggatgccgaacctctcctgatccgccggcagcaacgagccattaaaactgcagttcctgaccacgcactgcttcgcaggctccgagccctgcatcctccacagcccccgccttgctcactgttgggccctcagggcgggcagggtggctgtgagtcccaggtgtcatcttcctgctctgcgactttctctggagaccttgggcctttggcctgtggggcactggggatggtaacctcactgccccgtcactcccttcaaaggcgacagacccaagcccacgtcaggagaggagcgtggggtcagctccagcagggtcggggtcagtgcctgtgtctggtgggggccactcaggagagttgggttttcagggcagagatgggcttgattccacctggtggggtgggtggaccctggagactctcaggtgatgggccagcctgccccaaggctctttactgatgtcagaatcattgtttgcacctgctgggtatggcctttggggcggccggcccgggagggtcttagtctaattaggtgtgtccagcttcttggccacctttccctggggaccctaacaggcccagagcagagccccttacctcccaggtcagactacctgctcaggccctcccctcccatgcaggccgatgacaactgcagccctctctgcactccctagtccagacctggggaccactgtgggttcctgtgggtctcccggctcccttcctgcccccaatgccacccttgcagtggccatttaaaaatgcatagcaggtgacccactgcgtccctttgcgttcagcccctcctctggctttcagttacaccaagctaaaatttcaggttcccagctgcagctctctgggtcccccggtgccccagtggggctccccgcatctgaatgtgtggtccctgggggtgggcacttgggggcatcctggtcactgctggccctagcattggaccctaggagacctgactggaactggctccctccccatcagctcccagctgtcactctctcccacccccgggcagctgttttgcccaagaccactgctacctgtttacccaccctggtccctcccagacaagcaaggcctctgatttctttgaagcatttacttagctcaagtctgaagctgtagatactggaagacaatgcaccttggagggtgggcaggacacagttgattgtctctacagagctgtgacgggggcactgagccccgcgggtgtctgtggagggggctccggtccaggtactgcactggacactgctcatccctgggtgtcaggcaggtggctgcaccctaggccaggcgcagaggcctggcaggcaggcttggcatggttggccggggcgggacgtacactgggtcgccgctagctgcaccttcgcacagatgcctccgagcagcgggtgggcgtgggccgcacagcgcggcagggccttggctaccacacgcggcatcgctccttggggtgcatgggggtgccccgggcacagtggaacgtgtctgcgaaggcggccaggttctgcagcgaccccagtaccctgtgggtgggtgggtgtgacagcaggagcattgccatcttggacaaacatggccattttaagttctccgtgattaaaaaccagcccaaaacatcagcctaatggctcatgtcagtatgagcagaaacatttcaaccatgagataaacccccatctgaccagaaacatgccaatcctgagaataacctcccctccagccagagatattccaactctgcaataaaactctccttcacacagaaacattcgcagcctgcggtaggctcccccttcctaaacccttaaatgcccttagtctgtaagagaatgtccctgaccgaaatcggccagaagcccctctcaggtttattcccaaaataaacctgtctctgttg

SEQ ID NO: 2034 - DNA, 2689 bp, Homo sapiens
gagccgggagcggggatccaggagcgaggagccgggagcggggaacagggagtcggggagccgggaaccagggctggcagcggccgccatgagcacggtggaccttgctcgcgtgggcgcgtgcatcctgaagcatgcggtgaccggggaggccgtggagctgcggagcctgtggcgggagcacgcgtgcgtggtggccgggctgcggcgcttcgggtgcgtggtgtgccgctggatcgcccaggacctcagcagccttgctgggctcctggaccaacacggcgtgcgcctggtgggcgtagggcccgaggccctgggtctgcaggagttcctggacggcgactacttcgcgggagagctctacctggatgagagcaagcagctttacaaggagctaggcttcaagcggtacaacagcctgagcatcctcccagcagctctggggaagcccgtgcgtgatgtggctgccaaggccaaggctgttggcatccaggggaacttgtctggggacctgctgcagagcggagggctgctggtggtcagcaaagaagtccccaggcgactacgtccccaaggagcacatcctgcaggtcctgggcatctctgcggaggtctgtgccagcgacccgcctcagtgtgacagagaggtgtgagggaggcgaaggccctggcctccgaggatctgggtggcgtctgctgccctaggtgtgctggaagtccacttggaagaactgttccggaggcgctgggtcgggatgccgaacctctcctgatccgccggcagcaacgagccattaaaactgcagttcctgaccacgcactgcttcgcaggctccgagccctgcatcctccacagcccccgccttgctcactgttgggccctcagggcgggcagggtggctgtgagtcccaggtgtcatcttcctgctctgcgactttctctggagaccttgggcctttggcctgtggggcactggggatggtaacctcactgccccgtcactcccttcaaaggcgacagacccaagcccacgtcaggagaggagcgtggggtcagctccagcagggtcggggtcagtgcctgtgtctggtgggggccactcaggagagttgggttttcagggcagagatgggcttgattccacctggtggggtgggtggaccctggagactctcaggtgatgggccagcctgccccaaggctctttactgatgtcagaatcattgtttgcacctgctgggtatggcctttggggcggccggcccgggagggtcttagtctaattaggtgtgtccagcttcttggccacctttccctggggaccctaacaggcccagagcagagccccttacctcccaggtcagactacctgctcaggccctcccctcccatgcaggccgatgacaactgcagccctctctgcactccctagtccagacctggggaccactgtgggttcctgtgggtctcccggctcccttcctgcccccaatgccacccttgcagtggccatttaaaaatgcatagcaggtgacccactgcgtccctttgcgttcagcccctcctctggctttcagttacaccaagctaaaatttcaggttcccagctgcagctctctgggtcccccggtgccccagtggggctccccgcatctgaatgtgtggtccctgggggtgggcacttgggggcatcctggtcactgctggccctagcattggaccctaggagacctgactggaactggctccctccccatcagctcccagctgtcactctctcccacccccgggcagctgttttgcccaagaccactgctacctgtttacccaccctggtccctcccagacaagcaaggcctctgatttctttgaagcatttacttagctcaagtctgaagctgtagatactggaagacaatgcaccttggagggtgggcaggacacagttgattgtctctacagagctgtgacgggggcactgagccccgcgggtgtctgtggagggggctccggtccaggtactgcactggacactgctcatccctgggtgtcaggcaggtggctgcaccctaggccaggcgcagaggcctggcaggcaggcttggcatggttggccggggcgggacgtacactgggtcgccgctagctgcaccttcgcacagatgcctccgagcagcgggtgggcgtgggccgcacagcgcggcagggccttggctaccacacgcggcatcgctccttggggtgcatgggggtgccccgggcacagtggaacgtgtctgcgaaggcggccaggttctgcagcgaccccagtaccctgtgggtgggtgggtgtgacagcaggagcattgccatcttggacaaacatggccattttaagttctccgtgattaaaaaccagcccaaaacatcagcctaatggctcatgtcagtatgagcagaaacatttcaaccatgagataaacccccatctgaccagaaacatgccaatcctgagaataacctcccctccagccagagatattccaactctgcaataaaactctccttcacacagaaacattcgcagcctgcggtaggctcccccttcctaaacccttaaatgcccttagtctgtaagagaatgtccctgaccgaaatcggccagaagcccctctcaggtttattcccaaaataaacctgtctctgttg

SEQ ID NO: 2035 - DNA, 5432 bp, Homo sapiens
agactgaggctggctggctggaggttgacacaggagtgctcaggggagcagcatcacaagagggcagatcgaaagcatcgtccttgctgaaaaacagatggcagaggtggaagcggtacagctgaaggaggaaggaaaccggcatttccagctccaggactacaaggccgccacaaatagctacagccaggccctgaagctgaccaaggacaaggccctgctggccacgctttatcggaaccgggcagcctgtggcctgaaaacggagagctacgtccaggcagcttcagatgcctccagagccatcgacatcaactcctcggacatcaaggctctgtatcggcgatgccaggcactggagcacctggggaagctggaccaggccttcaaagacgtgcagcgttgtgccaccctcgagccacggaaccagaacttccaggagatgctgaggagactcaacaccagcattcaggagaagctccgagtgcagttctccacagactcgagggtacagaagatgtttgagatcctcttggatgaaaacagtgaggctgataagcgggaaaaggctgccaacaatctcattgtcctaggccgtgaggaagcaggggctgagaagatcttccagaacaatggagtagccttgctactgcagcttctggacactaagaagcctgagctggtgctggctgcagtgcggaccctgtcgggcatgtgcagcggccaccaagccagagccacagtgattctgcatgcagtgcggatagaccgaatctgtagcctcatggccgtggagaatgaggagatgtctctggctgtctgcaacctgctccaagccatcattgactccttgtctggggaggacaagcgggagcatcgagggaaggaggaggccctggttctagacaccaagaaggacctgaagcagatcaccagccacctgctggacatgctagtcagcaagaaggtgtctggccagggcagggatcaggcgctgaacctgctcaataagaatgttcccaggaaggaccttgccattcatgacaactcacgtaccatctatgtggtggataatggtctgaggaagatcctgaaggttgtggggcaggttccagatctgccatcctgcctgcccctgactgacaacacccgcatgctggcctctatcctcatcaacaagctctatgatgacctgcgctgtgacccggagcgcgatcacttccgcaagatctgtgaggaatatatcacgggcaagtttgacccccaggacatggacaagaacttgaatgccatccagacagtgtcagggatcctgcagggcccctttgacctgggcaaccagctgctgggactgaaaggtgtgatggagatgatggtggcactatgtggctcagagcgcgagacggaccagctggtggccgtggaggccctcatccatgcctccacgaagctcagccgcgccaccttcatcatcaccaatggagtgtcactgctcaaacagatctacaagaccaccaaaaatgagaagatcaagatccgcacactggtgaccagtgacaagaccatcctgtactcggtggccaccaccctggtgaactgcaccaacagctacgatgtcaaggaggtcatcccagagcttgtccagctcgccaagttctccaagcagcatgtgcccgaggaacaccccaaggacaagaaggactttatagacatgcgggtgaagcggcttctgaaggcgggtgtcatctctgccctggcttgcatggtgaaagcagatagtgccatcctcactgaccagaccaaggagctgctggccagggtattcctggcactgtgtgacaacccaaaggaccgaggcaccattgtggctcaaggtggtggcaaggccctgattcccctggctttggagggcacagatgtgggcaaggtgaaggcagcccacgctctagcaaagatcgctgctgtctccaatccggacattgcttttcctggggagcgggtgtatgaggtggtgcggccccttgtaagactcttggacacacagagggatgggcttcagaactatgaggctctcctaggcctcaccaacctgtctgggcggagtgacaaactccggcagaagatctttaaggagagggccttgccagacatcgagaactacatgtttgagaatcatgatcagctgcggcaggcggccaccgagtgcatgtgcaacatggtgctccacaaggaggtacaggaaaggttcttggctgacgggaatgaccggctgaagctggtggtgctgctctgcggggaggatgatgataaggtgcagaatgcggctgcaggggctctggccatgctgacagcagcacacaagaaactgtgcctcaagatgactcaagtgacaacccagtggttggagatcctccagcggctttgcctgcacgaccagctgtctgtccaacaccggggcctggtcattgcctacaacctactggcagccgatgctgagctggccaagaagctggtggagagtgagctgctggagatcctgactgtggtgggcaaacaggagccagatgagaagaaggcagaagtggttcagacagcccgagaatgtctcatcaagtgcatggattatggtttcattaaaccagtgtcttagacagcgaccctcagggatgctgggagtggtcctgtactgtgcagagtcctgggttggttgggttctcctgaagagtcaggtcatctagggatcatagcagtgacaatgaagtctcaatataaaggaaagacttgattgttctctgagttgtgagtcttctcctttgtcctgacagagtttggatgtttcactctctctcttgcttcctgtctccttatatttgtcatgtttcagaaattcccagaataattttcacccatgattagaaataggttggatcattctttctgtacccattctgaaggccaggataataggttgaagttctttatattttggaaaatggattttgtggtaaggtaggaactaacgggtgtgtgcatataaaggttaatgctgttgtatttggatgctgatctgtgctgttttcatgacctctctcccacactatttgaatcagtctgttcagaactgtgtgtttcacctgcagtgctctgtcccagtcccatgcccattcccatcacttcactgtgatggaaatagagtttatgttcaacagtggggcatgacctctgcaatttgcttgggaaagtcttccaagcaagatggacatgatgaatacaaataagatctactcaaagtacttcaaacaaaaaataaataattcattggctcatgtatcttggccacccagggaaggtctgacattgttagttagatccagagtttcaaatgtcatcaccatggatgtgtctttttctctctctcatttcccctccccatatcttgtcttttatttattataggtttgtctcattccctggcaggctctctccctgtgataggaaagagagtccccagcagccccagggtgacatagttgttatagttcattatggaatagaagagagaagagcattctcaataacccggcaaagttcccagggatgactctgatatgtctatgtctcaggtcacatttccatctatgaaccaatcatattcagaggtggaatgctaattggccaggcctgggtcatatatacaagtctagggaagaaatgagcttcatccctgtccaattgacatggactgattaggggtattaatggaagaggtgtgccaccacaaaagaatgtaccctgggcagatcaaagaacatattctgtatgtcaggcttggccacaaaagaatgacacaagtaatatgctgtagatcagaacctctctgctaatattgcctttttagcatggttaagatagctaagatctagtactgtcactccagtatgtcccaattctacctacgtttattgaagggtcaacagttctgatctcagcattgggtaaagggtgggacattcagatttacggtccttgataaaaacaatttacaacgttccgttgtgtaataaatgtaagtgtacatatgcctgggacatcagctggaaaagggacagactatcagagagttgcactgttgcggtatgggccaaatccaacataatacccgctgtacctctagagaactaaaaccttaatttctcagatcttttctgcactaatggtctttacatacagcctacattttaactaactcttgcatgggcttgtttcacagcaggaaactatattcatcatatccttattatgatagagaatgacaacattcaaaagggtgtggtgcttctgaaaatatacacaataaatggcatgatttgacctctgtcaaattcttctttcctgctttcctcatatgtgggcttgagtgggtgtatttagctcctttaaaggaaactctttcacaggcagggccacactcttactcgttttgatctcatgaggttacatctgccagtggcgttcagggccagttagataaagttcatcttgtttggattggagagactttttttttttttttttttgagacagggtcttgctctgtaacctaggctcaagtgcagtgcagtggtgcagtcatggctcaccgcagccttggtctcctgggctcaagtgatctttctacttcagcctcctcaatagctgggactacaggcacacaccaccacccccaggtaattaaaaaatttttttttgtagagacagggtctcactatgttgcccagtctgggagaccacattctttaacatgaatattttgtaaatagtccaagaagatctagaggaaagctgaattccttcatctgatttttgccactgggctgcctcccattgtctggctaagtcttcatgggaggcctttaagaaaagctgtgacaaatacctttgtttcccactgcctaggttacataagtagttggcttttccagcctagactcttatattgttgcttgtaagagggcccttctttgcagatttcttttttttttcatctatgctttcaaataggcagatgctagcctgagatcatctctttattgaggtagtttgcccaaaaacagcaaggaacagccaatacctgccaactttctaggtttttccaaccaattctcttacagaaaatctataaatatcttagaggtatgtttcttagtttcccaacatataatgggaaaattcatcatttatattattacttttaactgaagtatgttgttatcagagaacttggtctgtgtcatattaatcctttgccatttgagaagcatacagttttaaagtttatatctccaaaaggatattttgtaaaaatttaacccctttgactcttagtcttctcatttgtgaaaggtaaataataaagaatttctgttcctagt

SEQ ID NO: 2036 - DNA, 1889 bp, Homo sapiens
cggaccttttccttctggagtttccccggcgggttcacagtccagccactgaccgcagcagcgcccttgcgtagcagccgcttgcagcgagaacactgaattgccaacgagcaggagagtctcaaggcgcaagaggaggccagggctcgacccacagagcaccctcagccatcgcgagtttccgggcgccaaagccaggagaagccgcccatcccgcagggccggtctgccagcgagacgagagttggcgagggcggaggagtgccgggaatcccgccacaccggctatagccaggcccccagcgcgggccttggagagcgcgtgaaggcgggcatccccttgacccggccgaccatccccgtgcccctgcgtccctgcgctccaacgtccgcgcggccaccatgatgcaaatctgcgacacctacaaccagaagcactcgctctttaacgccatgaatcgcttcattggcgccgtgaacaacatggaccagacggtgatggtgcccagcttgctgcgcgacgtgcccctggctgaccccgggttagacaacgatgttggcgtggaggtaggcggcagtggcggctgcctggaggagcgcacgcccccagtccccgactcgggaagcgccaatggcagctttttcgcgccctctcgggacatgtacagccactacgtgcttctcaagtccatccgcaacgacatcgagtggggggtcctgcaccagccgcctccaccggctgggagcgaggagggcagtgcctggaagtccaaggacatcctggtggacctgggccacttggagggtgcggacgccggcgaagaagacctggaacagcagttccactaccacctgcgcgggctgcacactgtgctctcgaaactcacgcgcaaagccaacatcctcactaacagatacaagcaggagatcggcttcggcaattggggccactgaggcgtggcgcccgtggctgcccagcaccttcttcgacccatctcaccctctctcattcctcaaagctttttttttttttcctggctggggggcgggaagggcagactgcaaactggggggctgcgtacgtgcaggaggcgcggtggggctgcgtggaggagggggccacgtgtgagagagaagaaaatggtggccggagatgggagggcccaaggaacctcctgggagggggcctgcattctatgttggtgggaatgggactgggctgacgccctgcattcagcctgtgcctttcctggggtttcttttctgttcttttcggaggagagggcccgagaaggggccataccagggcgcggcgctgggttgccacacttgggaaagcagcccggagctgggtgctggggaaggcggggcgcgtagcctcccgccgccctgcggttgggccggtggaggcccaggcgttgctaggattgcatcagttttcctgtttgcactatttctttttgtaacattggccctgtgtgaagtatttcgaatctcctccttgctctgaaacttcagcgattccattgtgataagcgcacaaacagcactgtctgtcggtaatcggtactactttattaatgattttctgttacactgtatagtagtcctatggcacccccaccccatccctttcgtgccactcccgtccccacccccaccccagtgtgtataagctggcatttcgccagcttgtacgtagcttgccactcagtgaaaataataacattattatgagaaagtggacttaaccgaaatggaaccaactgacattctatcgtgttgtacatagaatgatgaagggttccactgttgttgtatgtcttaaatttatttaaaactttttttaatccagatgtagactatattctaaaaaataaaaaagcaaa

SEQ ID NO: 2037 - DNA, 3897 bp, Homo sapiens
gaaggtaaaaaaaagagggaggtctgagaaatagaaatatcagaggaaggaaataaaggagggtgagagtaaattctcttttagcattcagattccacagattccacaaatcacatttctttttttaccaactaaggaaaaataacacttgacctaacatttcattgcagttagctaaaggatgctagaaaaactatgttgcagtggtttgctctaatttcttcaggaatagagaaaagtgacaaaaagatcagagaagagaagaaaggaaactatcagaaaaatacagaattggagtaggatataacatatttgggttgaaggtaaaattttatattgtaatcttaagtatcttgctacttcagtttggtccctggaacagcagcatcagaatctgccgagggcttgttaaaaaggcagaatctcaggtcccatcccagactcactgaatcagaatataaatactgacaagatgccccgggattcatatgcacagtagagctggcgaagttccattgtagcctgtgattgttttctgcaacttagtatttctgagttttcccaaggaagaaaacccaggccttagcttctggcagacttgtgtttctcctttacttactagctgcatgactcatgagcaaggaaatcaaactttatgtgcctgagtttcctcatctataaaatggagactataataatcatctcctaggcttgttttgaggatgttcaacaaatgctcctttcattcctctatttacagacctgccgcagacaattctgctagcagcctttgtgctattatctgttttctaaacttagtaattgagtgtgatctggagactaactctgaaataaataagctgattatttatttattttctcaaaacaacagaatacgatttagcaaattacttcttaagatattattttacatttctatattctcctaccctgagttgatgtgtgagcaatatgtcactttcataaagccaggtatacattatggacaggtaagtaaaaaacatattatttattctacgtttttgtccaaaaattttaaatttcaactgttgcgcgtgtgttggtaatgtaaaacaaactcagtacagtagtattcagtacagtatttaagcccctgtacttaaacatattcctcgtaccaatgaagttacatgaaaagcaaatttgtgtgagatatcgtagatggaagtaaattagtctttatgttccccacaaattgaaatgcatttcaaaaactctgtgtgtgtatgtgtgtgtgtgacagagtgtgtgtgagagagagacagagagatacgctttggttgcctccataagctggctgctatgattaataagaccaagttttctaaagaaaatgagatcataacaaaagccctctttatgactatcttttatcaggggcaaaaaggaaagagacaaaacagcatgaaatgatgagaccaagtgatgaaaattcattcacaatgattgctttcaagagtaatttctcttgggtaattcagcagcctgttactatggctctctggagtgatagctaatgtaaatgaagcctctaaaagtggattatcctgacaagaatatactcagccaataatgcaacagaaatccattcaaagcattcgggaaaaattcaaaagaataaatattctttttttttttttaaagttaatgacctacgatccatttcttccctgactaacaagcagcaagcacttaaaaatatccagccaggatgaaatagaaacccacctgacttgttaatatttttgtttggtcccagggactcagattctaagccaaattctttgaatgatcttggcaaatgtctcgaattatttttgccaacttttctttatcttggaaaaaaagtttcatgaatgggtgtcaaaattgattagttttaaaaacctttcttgcagatacgtatggcaccctaaaactgtattagaaaaaaatttcatatctccaggcctttcattgggtcaggttggcatttcgctgccctttatgtgtgtgacaagtgaaaataaggaaagaaaaaaactcaagtgaagaaaatcagaatctgcgcagcagttcctgggcgtttcagctgcttcccacatcacctgcctcatcaagccccagcatccatctccttgctcatcttacaccctgtgtgcatgacaggcccaccattcatttatcagagcaaaggctctcccactattctggttcacccccctacttagccagatatacaagaatatctgcacggatgacctgcctcacctgggagctcagaggagctcagattccattactatcgcaccaaggacagatctcccagcaagaatgacagaaaagactaactgcccccaaaatctcccttccaaaacacagttctcttaattctcccaagaaaccagaatgtgactgctcacctctctaaggacctgaaaacaactggccatttcagctatttaaatcaactttaaaaaatccaaccgccaaaatattaaaccattttggttggaatgataacataactaacctgctgacagctgcttctgctaggtgcaaaaatggaaaaaaaaatacttctaatcaggtcaaatcactctacctttgggattctaaatttactcatattctcaaagaaatatattcagtcatagtggggaaaataggattattcctttagctcgataagcaaccagaagttcttccttcaaatcttgacatttaatcaatcagaaattgatttttggaaaactgtttcctatgaagctatctctgcctgaaggatttttcttttacaatccagactatagaaggaaattcacaacctggactttcacctccattggtcagagttttactgaccaattcccacctctgccttacacctaacggaagtttatgcctgttttctcttcacataccccaacagttacaaatggttgttattattaagcatcttttattttgtggcctctgattacatggtcccctaaattttgacctaatcacaaaagattggtaaaatttcttaacatattaataatattttgtttatgtgtcaatatcttagcatgtatcaattaagacagaggtcttaacgttctctttttgaaagagaatattaggattcagagatattaagagattctcccaggatcacagttaggtaacagagctggattttagtccaggtctgtctacagctctaacgtatatacaccctttgtataacatgtcacgaattcagcataaagggatcttcagtgatctaagtcaggggtcagcaaccttttctaaaaaggaccaaatagtaatatttcaggctttgtggaccctatggtctctatcataactgttcaaatcaccatgtagtgtaaaaggagccataagcaaaatataaactaacgaatgtggctgttttatgggatttttttttaactctttatttacaaaagcaggtggcagatcagaactcacttatgggccatagttctctgacccctgacctgagaaaatcttatatttatggacaacatttagactgtgacttgccaagtaagaacaagaagctctgtcaactgaaggtcaaggctggagttctgaaagcaaagagctgtctggtgttaatgataagtgaaatagttaaagttagaagatcccagttataagaagcacaaagaataatgaccatagactcctgaacaagaatgtctggacttctggcttaggcactcttgttgtatggtccaggccaagttacctaatctctccaggcctccattttcttatcattaaatgaagataataaaagtattttcctcagagagctgtaagaataaactgagctaacccatgtcaagcacatagaatagg

SEQ ID NO: 2038 - DNA, 1495 bp, Homo sapiens
gagctgcggcggtggcacctccgggtgtggaaggctccagtgagatggagtcgcgagtcgcggacgctgggaccggcgagaccgcgcgagcagcgggcgggagtccggcagttggctgcaccactcgggggcccgtagtctcggcgcccctgggagccgcccggtggaagctcctgcggcaggttctgaagcaaaaacacctggatgattgcctgcgacatgtatctgtaagaagatttgaatcatttaatctgttttcagtaacagaaggcaaagaaagggaaactgaagaggaggttggtgcatgggtccaatatacaagcatcttctgtcctgaatacagtatctccttaaggcataatagtggatccttgaatgttgaagatgtccttaccagctttgacaatacaggaaatgtttgcatctggccatctgaagaggttttggcttactactgcctcaagcacaataatatattcagggcccttgctgtgtgtgagctagggggtggcatgacatgcttggctgggctcatggttgctatttctgcagatgtcaaagaagttctgttaactgatgggaatgaaaaggccatcagaaatgtgcaagacatcatcacaaggaatcagaaggctggtgtgtttaagacccagaaaatatcaagctgcgttttacgatgggataatgagacagatgtctctcaactggaaggacattttgacattgttatgtgtgctgactgcctgtttctggaccagtacagagccagccttgttgatgcaataaagagattactccagcccagggggaaagcgatggtatttgccccacgccgagggaatactttaaaccagttttgcaatctagctgaaaaagctggtttctgtatccaaagacatgaaaattatgatgaacacatttcaaacttccactccaagttgaaaaaggaaaacccggacatatatgaagaaaaccttcattacccgcttctgcttattttgaccaaacatggatagaagattaagcttctcaaagacgaagaaacgtatcaagtgcatagggaatatttttacaaaaacggaaatctgtaaggggtataatcgcctgcctgcgccctttgcagcatttcacgtgtgggctatggactccacctgtcctcacccacgttattccccagctgccctctccagctccctccccgcctctttttacactctgcttgttgctcgtcctgccctaaacctttgtttgtctttaaatgtgtataagctgcctgtctgtgacttgaatttgactggtgaacaaactaaatatttttccctgtaattgagacagaatttcttttgatgatacccatccctccttcattttttttttttttttggtctttgttctgttttggtggtggtagtttttaatcagtaaacccagcaaatatcatgattctttcctggttagaaaaataaataaagtgtatctttttatctccctccaa

SEQ ID NO: 2039 - DNA, 3120 bp, Homo sapiens
atggcagtgcagctggtgcccgactcagctctcggcctgctgatgatgacggagggccgccgatgtcaagtacatcttcttgatgacaggaagctggaactcctagtacagcccaagctgttggccaaggagcttcttgaccttgtggcttctcacttcaatctgaaggaaaaggagtactttggaatagcattcacagatgaaacgggacacttaaactggcttcagctagatcgaagagtattggaacatgacttccctaaaaagtcaggacccgtggttttatacttttgtgtcaggttctatatagaaagcatttcatacctgaaggataatgctaccattgagcttttctttctgaacgcgaagtcctgcatctacaaggagcttattgacgttgacagcgaagtggtgtttgaattagcttcctatattttacaggaggcaaagggagatttttctagcaatgaagttgtgaggagtgacttgaagaagctgccagcccttcccacccaagccctgaaggagcacccttccctggcctactgtgaagacagagtcattgagcactacaagaaactgaacggtcagacaagaggtcaagcaatcgtaaactacatgagcatcgtggagtctctcccaacctacggggttcactattatgcagtgaaggacaagcagggcataccatggtggctgggcctgagctacaaagggatcttccagtatgactaccatgataaagtgaagccaagaaagatattccaatggagacagttggaaaacctgtacttcagagaaaagaagttttccgtggaagttcatgacccacgcagggcttcagtgacaaggaggacgtttgggcacagcggcattgcagtgcacacgtggtatgcatgtccggcattgatcaagtccatctgggctatggccataagccaacaccagttctatctggacagaaagcagagtaagtccaaaatccatgcagcacgcagcctgagtgagatcgccatcgacctgaccgagacggggacgctgaagacctcgaagctggccaacatgggtagcaaggggaagatcatcagcggcagcagcggcagcctgctgtcttcaggttctcaggaatcagatagctcgcagtcggccaagaaggacatgctggctgccttgaagtccaggcaggaagctctggaggaaaccctgcgtcagaggctggaggaactgaagaagctgtgtctccgagaagctgagctcacgggcaagctgccagtagaatatcccctggatccaggggaggaaccacccattgttcggagaagaataggaacagccttcaaactggatgaacagaaaatcctgcccaaaggagaggaagctgagctggaacgcctggaacgagagtttgccattcagtcccagattacggaggccgcccgccgcctagccagtgaccccaacgtcagcaaaaaactgaagaaacaaaggaaaacctcgtatctgaatgcactgaagaaactgcaggagattgaaaatgcaatcaatgagaaccgcatcaagtctgggaagaaacccacccagagggcttcgctgatcatagacgatggaaacattgccagtgaagacagctccctctcagatgcccttgttcttgaggatgaagactctcaggttaccagcacaatatcccccctacattctcctcacaagggactccctcctcggccaccgtcgcacaacaggcctcctcctccccagtccctggagggactccgacagatgcactatcaccgcaacgactatgacaagtcacccatcaagcccaaaatgtggagtgagtcctctttagatgaaccctatgagaaggtcaagaagcgctcctctcacagccattccagcagccacaagcgcttccccagcacaggaagctgtgcggaagccggcggaggaagcaactccttgcagaacagccccatccgcggcctcccgcactggaactcccagtccagcatgccgtccacgccagacctgcgggtccggagtccccactacgtccattccacgaggtcggtggacatcagccccacccgactgcacagcctcgcactgcactttaggcaccggagctccagcctggagtcccagggcaagctcctgggctcggaaaacgacaccgggagccccgacttctacaccccgcggactcgtagcagcaacggctcagaccccatggacgactgctcgtcgtgcaccagccactcgagctcggagcactactacccggcgcagatgaacgccaactactccacgctggccgaggactcgccgtccaaggcgcgccagaggcagaggcagcggcagcgggcggcgggcgcactgggctcagccagctcgggcagcatgcccaacctggcggcgcgcgggggtgcggggggcgcggggggcgcggggggcggtgtgtacctgcacagccagagccagcccagctcgcagtaccgcatcaaggagtacccgctgtacatcgagggcggcgccacgcccgtggtggtgcgcagcctggagagcgaccaggagggccactacagcgtcaaggctcagttcaagacgtccaactcctacacggcgggcggcctgttcaaggagagctggcgcggcggcggcggcgacgagggcgacacgggccgcctgacgccgtcgcgatcgcagatcctgcggactccgtcgctgggccgcgagggcgcccacgacaagggcgcgggccgtgccgccgtctcagacgagctgcgccagtggtaccagcgttccaccgcctcgcacaaggagcacagccgcctgtcgcacaccagctccacctcctcggacagcggctcgcagtacagcacctcctcccagagcaccttcgtggcgcacagcagggtcaccaggatgccccagatgtgcaaggccacgtcagctgccttacctcaaagccagagaagctcgacaccgtcaagtgaaattggagccacccccccaagcagcccccaccacatcctaacctggcagactggagaagcaacagaaaactcacccattctggatgggtctgagtctccacctcaccaaagtactgatgaatag

SEQ ID NO: 2040 - DNA, 2432 bp, Homo sapiens
tgtaaccagcgtgcagttttctccacatggaaacttattggcgtctgcctcacgagacagaaccgtgagactctggattcctgataagagaggaaaattctcagaatttaaagctcatacagctccagttcgaagtgtagacttttcagctgatggccagtttctagctacagcttctgaagacaaatccataaaagtatggagcatgtatcgccagcgcttcctgtattccttgtatcgacatacacactgggtacgctgtgccaaattttcacccgatggaagactaattgtgtcatgtagtgaggataaaactattaaaatttgggataccacaaataagcaatgtgttaataacttctcagattccgttggggacctgtctttactgtttcattttcaaaaggtggagagctatttgcatcaggaggtgcagacacacaggtcttattatggaggactaactttgatgaattgcattgtaaaggtcttaccaaaagaaatctcaaaagattacattttgattcaccaccacatcttcttgatatctacccaagaacaccacatccccatgaggaaaaagttgagactgtagaaattaatccaaagcttgaggtaatcgatttgcagatctctactccccctgttatggatatcctttcttttgattctaccacaacaacagaaaccagtggtaggactctgccagacaagggtgaagaggcctgtggatatttcttgaacccttccttaatgtcaccagaatgtttgccaacaaccacgaaaaagaaaacagaagacatgagtgacctcccctgtgaaagtcaaaggagcatacctctcgctgtgactgatgctttagagcatattatggaacaactcaatgttttgacacagactgtttcaatcttggagcagcgactgactttgacagaggataagctgaaagactgccttgaaaatcagcaaaagcttttcagtgctgtccaacagaaaagctgaataaaaaattcattttcatttgttgggcagaggcccaataaatgaacaaatgtacatacactcaggaaggtagtacaagatactccatacaacacaaccatgtgctatttatcatggcatttcttaaaagggtgagcaacagaacaaaaggcagaaaaggcatacctaaggactaatttaaacacatatcaatgtgaaggactaatttaaattactatcatttatgattgcagtaataaagtgataagcattcaagcaactctgtattttccccatattattttaaatgtccattttcatttataggccaaatcctgccaggaaagtaaccagatctctggatttcactgttaagtcatttcagattgaccatattcagacagtcatggggtgaaataattcacttacctccaaaatagcatcctatatgccaataatgagttattgatctgactagttgtatgtctttctgttcaaaatagaaattatcctttcttactaatgccttgaaagaatgaacaaataaaaattcccagaccacagaatttccacagcaagaatacacttattttaattaacaatagcacagatatagcatagggcagtgggttttttagttaatttatggcgtactttgtttatccattggccaacctgaaggaaatgaaactcacctatctttctatcacagatgaatgtgctagatgaatgatttgggttgtatctgatcatggttcacaaaaattatgttagtgtgttttcagtatgctaaaaagtcagagtgatacaaaagtgatatttaaaaatatacacacatgtatgtacacatgcttcagaaatattgttgcttagggtgatttgggcagctaaatagtaagtactttttaaaatttttgcatcatcatcttcctatttaatgaattgtgatttaaaacaaaatgaaaataagccaggtattctaaaagatcctggatacaaattaagaattttgctttattttaaaccaaattgagattaaattgaagaaaagcaagcaaattaatttcagcttgattatcaacctgtatcaagaacaaaaatgggaggaggtgtccacatttatggtgtgtataggtaacatggggaaaatgctattctgtgttttggaaaagaagaaatagtgccgtcctatttatttctatatttagaaatttttctcaaagaaatttcaattgtatctatgagatgggtttctaagtatcttattgtgtgttataagtgccttttaatatcatactaagtgtgagcttctggacattttcaagagcttacaaaaactaagtggcattgtatttttataaccccattgagaagactaagtaagaaatgaaatgtcctatcaattttattttgtcatgcttcaaacaataaagacatttctgctttaaaag

SEQ ID NO: 2041 - DNA, 3271 bp, Homo sapiens
gcgtgcgcagcggttgcctgggcgaccggggaagcgttgggctgtaaagactagggcgccagcggctggcgaagaaggaaagagggtactctctggctgggctggggccgtagcgacgtccgccgcgaacctgggccccccaaagctgcggggcgttcggtgtcgccgaagtaaacatgcaccctgagccctcggagcctgcgacaggtggtgcagcagagctggattgcgcgcaggagcccggcgtggaggagtctgcgggtgaccacgggagcgcaggccgagggggctgcaaggaagaaattaatgatcctaaggaaatatgtgtgggttcttctgacacatcctaccacagccagcagaaacagagtggtgataatgggtcaggtggtcacttcgcacacccaagagaagacagggaagatcggggccccagaatgactaaaagttccctgcaaaaactctgcaagcagcacaagctttatattaccccagcattgaatgatacgctgtatttacactttaaaggttttgatcgcattgagaacctggaagagtacacagggctgcgctgtctctggctgcagagcaatggaatacagaaaatcgaaaacctggaggcccaaactgagttgcgttgcctcttcttgcaaatgaacttgctccgtaaaattgagaacctggaacctctgcagaaactggatgctcttaacctcagcaacaattacatcaagaccattgaaaacctctcctgcctcccagtcctgaacacattgcagatggcccacaatcacctggagaccgtggaggacattcagcatctacaagagtgtttgaggctttgtgtccttgacctttcgcacaacaagctgagtgacccggagatcctgagcattctggaaagcatgcccgatttgcgtgtactgaatttgatgggaaacccggttatcagacagattcctaattacagaaggacagtcactgtacgactaaagcacttaacatacctggatgatagaccagtgtttccaaaggacagagcttgtgcggaggcctgggctaggggagggtacgcagctgaaaaggaggagagacagcagtgggagagcagggagcggaagaagatcacagacagcattgaagccttggccatgatcaagcagcgggcagaggagaggaaaagacagagagagagtcaagagagaggggagatgacatcttcagatgatggtgagaatgtgcccgccagtgcggaaggcaaggaggagcctcccggggacagagaaacaaggcagaagatggagctatttgttaaggaaagctttgaggccaaggacgagctctgcccggaaaagccaagtggagaggagccgcctgtggaggctaaaagagaggatggaggtccagagccagaggggaccctcccagctgagaccctgctactgtcgtcacctgtggaggttaaaggagaggacggagatggagagccagaggggaccctcccagctgaggccccaccacccccgccacctgtggaggttaaaggagaggatggagatcaagagccagaggggaccctcccagctgagaccctgctactgtcaccgcctgtgaaggttaaaggagaggatggagatcgagagccagaggggaccctcccagctgaggccccaccaccaccgcccctgggagctgccagggaagaaccgactccccaggctgtggccactgagggtgtattcgttacagaacttgatggaacgagaacggaagatttagaaaccattagactggagacaaaggagacattctgcattgatgacctacctgacttggaagatgatgatgaaacaggcaaatctctggaagaccagaatatgtgctttccgaagattgaggtcatctcgagcttgagtgatgacagtgaccctgaactggactacacgtcactccctgtgctggaaaacctccccacagacactctgtcaaatatatttgcagtctctaaagacacctcaaaggcggctcgggtgcccttcacagacatctttaaaaaagaagctaagagggacttggaaatccgaaaacaagacaccaagtccccaagacccctgatccaggagctcagcgacgaggacccctctggccagctactgatgccccccacctgccaaagagatgctgcaccactcacttccagtggagacagggacagcgacttccttgcagcctcttctccggtgccgactgagagcgccgccacacccccagagacgtgtgtcggagttgcccagcccagccaagctctgcccacgtgggacctcactgcattcccagcaccgaaagcatcatagttttccccagttatatgtagcataaatggtttaatcataaatgtctcccttaggcatgataaacattttaacacccacgcgagtcagtgtatgattgggctagctcctgtttgtgtgagtcacatgcaattcctttcaccagccaacctgaaaaaagacctttctcttactatgtcatcagaaaccagacagacccgggtccctgcaaaatctcaagtgagcattttccccacaggaaaacagaatcttccactgcagctagagaaactccgaggaagagggacttgatgctttagacatcaaaatgagaaggggagggaggaaagaaaggggggagtctgtgaggcacaacagagaattcccccaaactgacatgaccgtgaccctctgctcagagggcactatcgacagcccacaggtgccagacccatgtcccaagggagaaggaacatcagccatcatctctctgcatgagctcagtgtcaggtagtagctgtggcgggacgctgtccagcctaaaaaacgtgaccattccaattcatcttcagctgccaagtgtatttagtccctgaacctggatccaaggcatctccctgtaggaaacatcagaccggggcagagattgacaaagcaacccacaacagcagctgccaacggccgctgtgcccacctcatcagcagctctgcaggggcctcactccaccctcaccaaacacgaggagccagcactcctggcccccattccactggacaggaaggcgtgagaactgagggacctgcctgaggcccccacagctgaggcgcagcggagccctgcctcccagcacagactaaaatcccagcaacacaggcccaccggcacctccagcctgccttgcgggatgatcttcaggcgaatatacaaaatacaaaagaaa

SEQ ID NO: 2042 - DNA, 1253 bp, Homo sapiens
ggggaattaatggaagtgaaggtgatggagctgaaattgcagaaaaatttgttttcttcattggcagtaaaaatgggggaaagactactattattctaaggtgtcttgacagagatgaaccaccaaaaccaaccttagctttggaatatacatatggaagaagagcaaaagggcacaacacaccaaaagatatcgctcacttttgggaactcggtggaggaacctctttattggacttaatcagcatacccatcacaggtgacaccttacggacgttttctcttgttctcgttctggatctttcaaaacctaatgatctctggcccaccatggaaaatctcttgcaagccacaaaaagccatgtagacaaagtgataatgaaactgggaaagacaaatgctaaagcagtttctgaaatgagacagaagatctggaataatatgccgaaggatcatcctgatcatgaattaattgacccatttccggtacctctggtcataattggaagtaaatatgatgtttttcaggattttgagtctgagaagagaaaggtaatatgcaagacacttcgatttgttgcacattattatggagcatcattaatgtttaccagtaaatcagaagctctattactaaaaatacgtggagttatcaaccagttggcatttggcattgacaaaagcaaatcaatatgtgtggatcagaataaaccgctgtttatcacagcaggattggattctttcggtcaaataggatctcctcctgttcctgaaaatgacattggaaagcttcatgcccactcacctatggagttgtggaaaaaagtgtatgaaaagctctttccaccaaagagtattaacacgctgaaagatatcaaggaccctgcgagagatcctcagtatgctgaaaatgaagtcgatgagatgagaattcagaaggatctggtattatcctaaacatttacttaatttcatctgaaattttaacacaaaacctggggtgccttgggaattccttacatttttctctatgtatttacttagagtatcttctttactattaaaattatttaagtagtacatctatttaaataacacactaatagtatactgtagaaaaaataaaaatttgatatgaataaagaaaaatttttaaatcacctgtcatcccaccacccagacatgacttagtgttcacataaacctttttgattttccagttttcattatattaaagatgagtggtgattctta

SEQ ID NO: 2043 - DNA, 4019 bp, Homo sapiens
cggacgcgctggaggccggtgggcggtcgccgtagtcgccctcccaccacctcgctcaggtttctccggcctggggcaagaggcctgtggcccgcgcgggaacgcactgtccaccctcagacctgggactgggccggcgcgcggacgctaccaagaggctgcggctcccgcccccgcggccggacgtggcgcctcccctgaggccgcggccggagcctggaggtggggtcggagtcagagcccggggctctgatgtcaccgcgcggctgcgacggcccaggagcgcgtctcggcgggagcctcagagcctcactttgtcgccaggctggagtgcagtggcgcgatctcggctcactacaacttccgcctcccgggttcaagcgattcttctgcctcagcctcccgagtagctgggactacaggcgtgtgccaccacgcccagctaatttttgggaaagatcacatggagaagccaacagaacggccaggaagcagcctgggtggaacagggttggggaggaaaggaacatgggtacattctcagcgttccaggaggtctcagggtaaaggctgcttgtgtgggcaaggggagcctggcagggaatgagctggtcccaattccttcccctgagctgggccctcaaccttcagaggtgctccctgggactggtcctacttcctctgccacctctgatcccaaggtgactctgccaaaatctgggggatgccagcgcttgtgacggtgtgaccagggaggggaagtgacccacgcagccacccagcctcagcactcatctgcgcagccatggaggccctgggacctgggggcgaccgcgcctccccggcctcgtccactagcagcctggacctgtggcatctgtccatgcgcgcggactcggcctacagctctttctccgcagcctccggcggccccgagccgcgcacgcagtcgccggggacagacctccttccttacctagactgggactacgtgcgtgtggtttggggcggcccgggccccgccccgcccgacgctgccctttgcacatccccgcggccccggcccgcggttgcagcccgcagtgggccgcagccaacagaggtcccggggaccccgggaccactgaacaggcaggccaccccgctgctgtacgcgctggcggccgaggcggaggccgcggcgcaggctgccgagccgcccagcccgccggcctcgagggccgcctaccgccagcggcttcagggcgcgcagcggcgagtgctccgggagacgtcgttccagcgcaaggagctccgcatgagcctgcccgcccgtctgcggcccactgtcccagcgcggcccccggcgactcacccgcgctccgcctcgctcagccacccgggcggggagggggagccggcgcgctcccgggctcccgcgccaggaactgccggccggggtcccctcgccaaccagcagcggaagtggtgcttctcagagccaggaaagctggatcgtgtgggtcggggcggtgggccggcgcgggaatgcctgggtgaggcctgctccagctctggcctccctgggcccgagcccttggagttccagcatccggcgctggctaagtttgaagatcacgaggtcggatggctgcccgagacgcaaccccaaggctccatgaacctggactccgggtccttgaagctcggtgatgccttcaggcccgccagtcggagtcggagcgcttcaggcgaagtcttgggttcctggggaggatcaggagggaccatacccattgtccaggctgttccccaaggagcagaaacccccagaccattgtttcagaccaaactttccaggttcttgcctcagaaagaggctgcggtgatgtatcctgcagagttaccccagagcagccctgctgacagtgaacagagggtctcagagacctgcattgtgcctgcctggctcccctcccttcctgatgaagtgttcctagaagaggccccactggtcagaatgagatcaccaccagacccccatgcctcccaggggcccccagccagtgtccatgcctctgaccagccgtatggaactggcttaggccaaagaactggccaggttacagtccccacagagtacccgctccatgagtgtccaggaactgcaggggcagatgactgctggcagggggtgaatggttctgtaggtatttccaggcccacaagccacacccccactgggactgcaaatgataacatcccaactattgaccccactggactgaccaccaatccccccacagctgcagagagtgacctcctcaaacctgtcccagctgatgccttgggactttcaggcaatgatactccaggtccctctcacaatactgccctagccaggggcactggccagcctggttccaggcccacatggcctagtcagtgcctcgaggagctggttcaggagctggccagattagatccctctctatgtgaccctcttgcttcccagcccagcccagagccacccctgggcctgctggatggactgattcctttagcagaggtccgggctgcaatgcggcctgcctgtggggaggctggagaggaggctgccagtacttttgagccagggtcctatcagttcagcttcacccagctcctgccggctcctcgggaggagacaaggcttgaaaaccctgccacccaccctgtgcttgaccagccatgtgggcaggggctccctgcaccaaacaacagcatccagggcaagaaagtggagctggccgcccgcctccaaaagatgcttcaggaccttcacacggagcaggagcggctgcagggggaggcacaagcgtgggccaggcgccaagcggctctggaggctgcagtgcgccaggcctgtgcccctcaggagctggagcggttcagccggttcatggccgacctagagcgcgtgcttggccttctgctgctgctgggcagtcgcctggcgcgcgtgcgccgcgccctggcccgggcggcctcagacagcgaccctgatgagcaggcctccctgctgcagcgactccggctcctgcagcggcaggaggaggacgccaaggagctgaaggagcacgtagcgcggcgcgagcgggccgtgcgggaggtgctggtgcgagcactaccggtggaggagctgcgcgtctattgcgccctgctggcgggcaaggccgccgtcctggcccagcagcgcaacctggacgagcgcatccgcctccttcaggaccaactggacgccatcagggacgaccttggccatcatgccccgtctcccagcccggcgcggcccccagggacctgtcctccagttcagccgcccttccctcttctccttacatagttataggtggagagggtggggtgcaccgcccctatctctcacccacgtaagtggggtgatgctgatttagtctctgcttttcccttgagggattggggaggacccagtccaggcctttctaagatactcctccagccgggcgcggtggctcacgcctgtaatcccagcactttgggaggccgaggcgggcggatcacaaggtcaggagatcgagaccatcctggctaacacggtgaaaccccgtctctactaaaaatataaaaaattagccgggcgtggtggcgggtgcctgtattgccagctactcggaaggctgaggcaggagaatggcgtgaacctgggaggtggagcttgcagtgagcggacatcgcgccactgcactccagcctgggcgacagagcaagactccgtctcaaaaaaaaaaaaaaaaaaaaaaaaaaaaaagatacttctccaaagtgttctcatgtggcctcacccaggtcttgtgtattatttggtaattaatttatggatcttaaaaactgcagtattcccccattttgtgatgagagtgtggggctggcaggggttggttggagggaggagagaagacagaggagcacttaaggtgcaaagcagcctattttttcttcaataaaaattgttaagagaa

SEQ ID NO: 2044 - DNA, 2134 bp, Homo sapiens
gtcccgcgggcgcggagaaggcgggtgacggtgtgacccgaactgcctcttttctaaagaggactccaaaggaaggactggtcatctctttcatatctcaaaaccatggctcagggatcagtgtctttcaatgatgtgactgtggacttcactcaggaggagtggcagcacctggatcatgctcagaagactctatatatggatgtgatgttggaaaactattgccacctcatctctgtggggtgtcacatgaccaaacctgatgtgatcctcaagttggaacgaggagaagagccatggacatcatttgcaggtcatacctgcttggaagaaaactggaaagctgaagactttttagtgaaattcaaggaacaccaagagaagtattctagatcagttgtaagcatcaaccacaaaaaactggtgaaggagaagagtaaaatatatgaaaagacatttactctaggcaaaaaccctgtgaattcaaaaaatctacctcctgaatatgatactcatggaaggattttgaaaaatgtttcagaattaatcatcagtaatctaaatcctgcaagaaagagacttagtgagtataatggatatgggaaatcactcctgagtactaaacaagagactactcatcctgaagtcaaatcccataatcaaagtgccagagctttcagtcataatgaagttcttatgcagtatcagaaaacggaaactccagcacagtcatttggatataatgactgtgagaaatcattccttcaaaggggaggcctgattacacatagtagaccttacaaaggagaaaacccatctgtatataataaaaaaagaagagcaaccaatattgaaaaaaaacatacatgcaatgaatgtgggaaatctttctgcaggaaatcagtattgattctgcatcagggaattcactcagaagaaaaaccctatcaatgtcatcaatgtggaaatgcatttagaaggaaatcatatctcattgatcatcagagaactcacacaggagagaaaccatatgagtgtaatgactgtgggaagtccttccgccagaagacaacactctctctacatcagagaatccatacaggtgagaaaccctacatttgtaaagaatgtgggaagtcctttcaccagaaggcaaatcttactgtacatcagagaactcatacaggggaaaagccctatatttgtaatgaatgtgggaaatccttctcccagaagacaacccttgctcttcatgagaaaactcataatgaggagaaaccctatatttgtagtgaatgtggaaagtccttccgccagaagacaacccttgtagcacatcagagaacacatacaggggagaaatcttatgaatgtcctcactgtgggaaggcctttagaatgaagtcatacctcattgatcatcaccgaactcacacaggagagaaaccatatgaatgtaatgaatgtggtaaatcattcagtcaaaagacaaatctcaatctacatcagagaattcatacaggggagaaaccctatgtttgtaatgaatgtgggaagtcctttcgccagaaagcaaccctcactgtacatcagaaaatacataccggccagaaatcctatgaatgtcctcagtgtgggaaagcctttagcaggaagtcatatctcattcatcatcaaagaactcatacgggagagaaaccatataaatgtagtgaatgtggaaagtgcttccgccagaagacaaatcttattgtacatcagagaactcacacaggtgagaaaccctatgtttgtaatgagtgtggtaagtctttcagttataagagaaacctcattgtccatcaaagaactcacaagggagaaaacattgaaatgcaataaatgatgtggtttcttatatgaattctttacaagctgttgtaaacatttagttttaaaaagaaaagcatgctgaaacatgttaatgtaattttaaatcacaagtctaataattattaaagtaccatacggaataactgtctactgtttactagcatataaaataagtatgatcattattattgaactctatcagctatgaagctaaattttaaagtcaactgctcttcctactgactcaaatagtttatttttt

SEQ ID NO: 2045 - DNA, 3230 bp, Homo sapiens
acttccggtgcttgccctgcccatccccgtggcgggggcgtggccatggcgggggcgctccggcgggggcgggccctgggctcccgcccttcgggtcccacagtttccagccgccgctctcctcagtgcccggtggcccaggagggcctgggagcccgaagccgtccccgagtcgctcctaggtcactggcgcgatgcgggccgtcctctcggctgatgggttggaagcccagcgaggctagaggccagtcccaaagtttccaggcatcagggctgcagcccaggagcctcaaggcggcccggcgggcgactggacggccggacaggtcccgagcagcccggcccaccatggacccctctgcccacaggtcccgagcagccccgcccaacatggacccagacccccaggcgggcgtgcaggtgggcatgcgggtggtgcgcggcgtggactggaagtggggccagcaggacggcggcgagggcggcgtgggcacggtggtggagcttggccgccacggcagcccctcgacacccgaccgcacagtggtcgtgcagtgggaccagggcacgcgcaccaactaccgcgccggctaccagggcgcgcacgacctgctgctgtacgacaacgcccagatcggcgtccggcaccccaacatcatctgtgactgctgcaagaagcacgggctgcgggggatgcgctggaagtgccgtgtgtgcctggactacgacctctgcacgcagtgctacatgcacaacaagcatgagctcgcccacgccttcgaccgctacgagaccgctcactcgcgccctgtcacactgagtccccgccagggcctcccgaggatcccactaaggggcatcttccagggagcgaaggtggtgcgaggccccgactgggagtggggctcacaggatggaggggaagggaaaccgggccgtgtggtggacatccgtggctgggatgtggagacaggccggagtgtggccagcgtgacgtgggctgatggtaccaccaatgtgtaccgtgtgggccacaagggcaaggtggacctcaagtgtgtgggcgaggcagcgggcggcttctactacaaggaccacctcccaaggctcggcaagccggcggagctgcagcgcagggtgagtgctgacagccagcccttccagcacggggacaaggtcaagtgtctgctggacactgatgtcctgcgggagatgcaggaaggccacggcggctggaaccccaggatggcggagcaccactccttctgggtgggcgacgtggtccgggtcatcggcgaccttgacacagtgaagcggctgcaggctgggcatggcgagtggacggacgacatggcccctgccctgggccgcgtcgggaaggtggtgaaagtgtttggagacgggaacctgcgtgtagcagtcgctggtcagcggtggaccttcagcccctcctgcctggtggcctaccggcccgaggaggatgccaacctggacgtggccgagcgcgcccgggagaacaaaagctcactgagcgtggccctggacaagcttcgggcccagaagagtgacccagagcacccgggaaggctggtggtggaggtggcgctgggtaacgcagcccgggctctggacctgctgcggaggcgcccagagcaggtggacaccaagaaccaaggcaggaccgctctgcaagtggctgcctacctgggccaggtggagttgatacggctgctgctacaagccagggcgggcgtggacctgccggacgacgagggcaacacggcactgcactacgcggccctggggaaccagcccgaggccaccagggtgctcctgagtgctgggtgccgggcggacgccatcaacagcacccagagcacagcactgcacgtggccgtgcagaggggcttcctggaggtggtgcgggccctgtgtgagcgcggctgtgacgtcaacctgcccgacgcccactcggacacgcccctgcactccgccatctcggcgggcactggagccagcggcattgtcgaggtcctcacggaggtgccaaacatcgatgttaccgccaccaacagccagggtttcaccctgctgcaccatgcctccctcaagggtcacgcgctagctgtgagaaagattctggctcgggcgcggcagctggtggacgccaagaaggaggacggcttcacggcgctgcatctggctgccctcaacaaccaccgcgaggtggcccagatcctcatccgggagggccgctgtgacgtgaacgtgcgcaaccggaagctgcagtccccgctgcatctcgccgtgcaacaggcccacgtggggctggtgccgctactggtggacgctgggtgcagtgtcaacgccgaggacgaggagggggacacagccctgcacgtggcgctgcagcgtcatcagctgctgcccctggtggctgatggggccgggggggacccagggcccttgcagctgctgtccaggctacaggcctcgggcctccccggcagcgcggagctgacggtgggcgcggcggtcgcctgcttcctggcgctggagggcgccgacgtgagctacaccaaccaccgcggtcggagcccgctggacctggccgccgagggtcgcgtgctcaaggcccttcagggctgcgcccagcgcttccgggagcggcaggcgggcgggggcgcggccccgggccccaggcaaacgctcgggacccccaacaccgtgacgaacctgcacgtgggcgccgcgccggggcccgaggccgctgagtgcctggtgtgctccgagctggcgctgctggtgctgttctcgccgtgccagcaccgcaccgtgtgtgaggagtgcgcgcgcaggatgaagaagtgcatcaggtgccaggtggtcgtcagcaagaaactgcgcccagacggctctgaggtggcgagcgccgcccccgcccccggcccgccgcgccagctggtggaggagctgcagagccgctaccggcagatggaggaacgcatcacctgccccatctgcatcgacagccacatccgcctcgtgttccagtgcggccacggcgcatgcgccccctgcggctccgcgctcagcgcctgccccatctgccgccagcccatccgcgaccgcatccagatcttcgtgtgagccgcgccgtccgccgcgcccgagctgccttcgcgtgcccccgccctgtgttttataaaaagaaagattctcggacgttg

SEQ ID NO: 2046 - DNA, 2890 bp, Homo sapiens
gctggggtcgtcgtccgggccgggtgggctgcggcgcgcggcaggcgctctggcctggcctggccgccgctgagcagtcggggccggtgggtggcctcgaacgccgggacagaccgacagacggactggccggcggtcccgcgcccccgagcggagcgggcgggacggaaacgtccgggcaagttggggtcggcagggttggaagcccagcgaggctagaggccagtcccaaagtttccaggcatcagggctgcagcccaggagcctcaaggcggcccggcgggcgactggacggccggacaggtcccgagcagccccgcccaacatggacccagacccccaggcgggcgtgcaggtgggcatgcgggtggtgcgcggcgtggactggaagtggggccagcaggacggcggcgagggcggcgtgggcacggtggtggagcttggccgccacggcagcccctcgacacccgaccgcacagtggtcgtgcagtgggaccagggcacgcgcaccaactaccgcgccggctaccagggcgcgcacgacctgctgctgtacgacaacgcccagatcggcgtccggcaccccaacatcatctgtgactgctgcaagaagcacgggctgcgggggatgcgctggaagtgccgtgtgtgcctggactacgacctctgcacgcagtgctacatgcacaacaagcatgagctcgcccacgccttcgaccgctacgagaccgctcactcgcgccctgtcacactgagtccccgccagggcctcccgaggatcccactaaggggcatcttccagggagcgaaggtggtgcgaggccccgactgggagtggggctcacaggatggcaagccggcggagctgcagcgcagggtgagtgctgacagccagcccttccagcacggggacaaggtcaagtgtctgctggacactgatgtcctgcgggagatgcaggaaggccacggcggctggaaccccaggatggcggagtttatcggacagacgggcaccgtgcatcgtatcacggaccgcggggacgtgcgcgtgcagttcaaccacgagacgcgctggaccttccaccccggggcgctcaccaagcaccactccttctgggtgggcgacgtggtccgggtcatcggcgaccttgacacagtgaagcggctgcaggctgggcatggcgagtggacggacgacatggcccctgccctgggccgcgtcgggaaggtggtgaaagtgtttggagacgggaacctgcgtgtagcagtcgctggtcagcggtggaccttcagcccctcctgcctggtggcctaccggcccgaggaggatgccaacctggacgtggccgagcgcgcccgggagaacaaaagctcactgagcgtggccctggacaagcttcgggcccagaagagtgacccagagcacccgggaaggctggtggtggaggtggcgctgggtaacgcagcccgggctctggacctgctgcggaggcgcccagagcaggtggacaccaagaaccaaggcaggaccgctctgcaagtggctgcctacctgggccaggtggagttgatacggctgctgctacaagccagggcgggcgtggacctgccggacgacgagggcaacacggcactgcactacgcggccctggggaaccagcccgaggccaccagggtgctcctgagtgctgggtgccgggcggacgccatcaacagcacccagagcacagcactgcacgtggccgtgcagaggggcttcctggaggtggtgcgggccctgtgtgagcgcggctgtgacgtcaacctgcccgacgcccactcggacacgcccctgcactccgccatctcggcgggcactggagccagcggcattgtcgaggtcctcacggaggtgccaaacatcgatgttaccgccaccaacagccagggtttcaccctgctgcaccatgcctccctcaagggtcacgcgctagctgtgagaaagattctggctcgggcgcggcagctggtggacgccaagaaggaggacggcttcacggcgctgcatctggctgccctcaacaaccaccgcgaggtggcccagatcctcatccgggagggccgctgtgacgtgaacgtgcgcaaccggaagctgcagtccccgctgcatctcgccgtgcaacaggcccacgtggggctggtgccgctactggtggacgctgggtgcagtgtcaacgccgaggacgaggagggggacacagccctgcacgtggcgctgcagcgtcatcagctgctgcccctggtggctgatggggccgggggggacccagggcccttgcagctgctgtccaggctacaggcctcgggcctccccggcagcgcggagctgacggtgggcgcggcggtcgcctgcttcctggcgctggagggcgccgacgtgagctacaccaaccaccgcggtcggagcccgctggacctggccgccgagggtcgcgtgctcaaggcccttcagggctgcgcccagcgcttccgagtgcgcgcgcaggatgaagaagtgcatcaggtgccaggtggtcgtcagcaagaaactgcgcccagacggctctgaggtggcgagcgccgcccccgcccccggcccgccgcgccagctggtggaggagctgcagagccgctaccggcagatggaggaacgcatcacctgccccatctgcatcgacagccacatccgcctcgtgttccagtgcggccacggcgcatgcgccccctgcggctccgcgctcagcgcctgccccatctgccgccagcccatccgcgaccgcatccagatcttcgtgtgagccgcgccgtccgccgcgcccgagctgccttcgcgtgcccccgccctgtgttttataaaaagaaagattctcgg

SEQ ID NO: 2047 - DNA, 1444 bp, Homo sapiens
gcgggcaggcgactcctgtcccgggtggaggcggcggagccggagccgggggagggggcagcggctgtctcacggaccacggcggcgcccgcagctcctcaccgcagcacccccactgcaggcccgaggagctttccggagcttcccacactcctggggagaagacttcttagccagcttgatgtttaaaattcagctggagcccttaaaacttcgagcgtggacgctgaatgggtttgtaaagtttcgaaacaaggagaccagtgctggtccagtggctgtgatgggaaaagattattacaagattcttgggatcccatcgggggccaacgaggatgagatcaagaaagcctaccggaagatggccttgaagtaccacccagacaagaataaagaacccaacgctgaggagaagtttaaggagattgcagaggcctatgatgtgctaagtgaccccaagaaacggggcctgtatgaccagtatggggaggaaggcctgaagaccggcggtggcacatcaggtggctccagtggctcctttcactacacctttcatggggacccccatgccacctttgcctccttctttggtggctccaaccccttcgatatcttctttgccagcagccgctccactcggcccttcagtggctttgacccagatgacatggatgtggatgaagatgaggacccatttggcgctttcggccgttttggcttcaatgggctgagtaggggtccaaggcgagccccagaaccactgtaccctcggcgcaaggtgcaggaccccccagtggtgcacgagctgcgggtgtccctggaggagatctaccatggctccaccaagcgcatgaagatcacaaggcgtcgcctcaaccctgatgggcgaactgtgcgcaccgaggacaagatcctgcacatagtcatcaagcgtggctggaaggaaggcaccaagatcaccttccccaaagaaggcgacgccacacctgacaacatccctgctgacatcgtctttgtgctcaaagacaagccccatgcacacttccgccgagatggcaccaacgtgctctacagtgccctgatcagcctcaaggaggcgctgtgtggctgcactgtgaacattcccactatcgacggccgagtgatccctttgccctgcaatgatgtcatcaagccaggcaccgtgaagagactccgtggggagggccttcccttccccaaagtgccaactcagcgaggagacctcattgttgagttcaaagttcgcttcccagacagattaacaccacagacaagacagatccttaagcagcaatacccccaacactcactccactcaatgtgcacccagcttgatgtccactggacactggcaactttttctaaaatgcaaaaaaaagccactggttttcaggaaaatgttcctgtccctgaccccttttag

SEQ ID NO: 2048 - DNA, 2255 bp, Homo sapiens
gtcggtgtctgctgcgttcacggcaggattcggttaggaggaacagcacagcatgctgggctctggatttaaagctgagcgcttaagagtgaatttgagattagtcataaatcgccttaaactattggagaaaaagaaaacggaactggcccagaaagcaaggaaggagattgctgactatctggctgctgggaaagatgaacgagctcggatccgtgtggagcacattatccgggaagactacctcgtggaggccatggagatcctggagctgtactgtgacctgctgctggctcggtttggccttatccagtctatgaaggaactagattctggtctggctgaatctgtgtctacattgatctgggctgctcctcgactccagtcagaagtggctgagttgaaaatagttgctgatcagctctgtgccaagtatagcaaggaatatggcaagctatgtaggaccaaccagattggaactgtgaatgacaggctaatgcacaagctgagtgtggaagccccacccaaaatcctggtggagagatacctgattgaaattgcaaagaattacaacgtaccctatgaacctgactctgtggtcatggcagaagctcctcctggggtagagacagatcttattgatgttggattcacagatgatgtgaagaaaggaggccctggaagaggagggagtggtggcttcacagcaccagttggtggacctgatggaacggtgccaatgcccatgcccatgcccatgcctatgccatctgcaaatacgcctttctcatatccactgccaaagggaccagtagatgacattaatgctgataagaatatctcttctgcacagattgttggtcctggacccaagccagaagcctctgcaaagcttccttccagacctgcagataactatgacaactttgtcctaccagagttgccatctgtgccagacacactaccaactgcatctgctggtgccagcacctcagcatctgaagacattgactttgatgatctttcccggaggtttgaagagctgaaaaagaaaacataggtctcttaaaccaggcaactttcacgttttgggagttgagactgagcaatttctccttgtaacaaagaatctccatgaaattctgtttcatctgttaaccgtcactcagcacaacactccctctgggctctcttcctgctcctccagattctgctgctttccagttctctgttgatcctgagactaacaattggagactgaggccagagcaactggctcctggcagctgtgcttgtccgtttcctgtcagagtgatcccaggtttcctcctggcccgtcccatggtccctccacaggagtgtgagaggatgggggaagcactgtgggaagaccaccaaagatggctggacagtgggagagagcacgttgtgaagcatcccagcctcgtgttgaggttccagacttagaaacagacccctctgtacagggggattgtggtgagtgagaatcaaggccaccttgtgtgttttctcactctcgaatgcaagtgggagagggaaaatgactcgggacgccattgtaacggttcctggaagctgggccctctcattggcatatacagtactcctcgctgcagggcactgtcccaccgggatccagttgcaaagtttgtcttgacagttgaaggcctcgcttagttgtactggattctcagggagccctctgtggccttttgctttgcgtgctgtttcccttgtaccagagggcggcaccgtggaaattctgttttccctgtagcatattgtgttggattgcattactggcagagaaaggacaaggtgccattcaagtcctagggtgggcttccagctgccttaatagaagtactcaagtcttttgggtagtgagctggaaagcctacaggaaaagaggggtacctgttttcatttgaaaactttgattcatggaacctttaaaactaatctcagaaaaatttttggtgcccatgcagctgtagttgttcactgctttcctggatggatgggactcttatgtcataacttctgttactcctttggcccatagctaaggtcatccttccccacaggggtggctttgggattggatgatacagcttttgcttctgtgtagtatacctgtacatacttgtttcaggcagcctttctttaatgttttcagttggtttgtattctgtagctcagtagctgctaataaagttaaagatcctgtgtcc

SEQ ID NO: 2049 - DNA, 2654 bp, Homo sapiens
ctgtggctggcctccccgcgcccagagcgaaattaagggcatgcccccagcagctgactcagtcggcgtggcgcttcccccaacgtctgccgtgcccccgccgcgggaagtagtccccggccgcgccgactccaaaggaaaccgagggagggtgccccgagtcagcgcgtgggtcccggcagcggcgatcgcgcagccaatccctggaaaggagggcgtggctatatcggccccgtggatccctccgcccgcgcttgttgtgctgaggccgagggagtcgccattttggatggtgaaccctgaagtcggtgtctgctgcgttcacggcaggattcggttaggaggaacagcacagcatgctgggctctggatttaaagctgagcgcttaagagtgaatttgagattagtcataaatcgccttaaactattggagaaaaagaaaacggaactggcccagaaagcaaggaaggagattgctgactatctggctgctgggaaagatgaacgagctcggatccgtgtggagcacattatccgggaagactacctcgtggaggccatggagatcctggagctgtactgtgacctgctgctggctcggtttggccttatccagtctatgaaggaactagattctggtctggctgaatctgtgtctacattgatctgggctgctcctcgactccagtcagaagtggctgagttgaaaatagttgctgatcagctctgtgccaagtatagcaaggaatatggcaagctatgtaggaccaaccagattggaactgtgaatgacaggctaatgcacaagctgagtgtggaagccccacccaaaatcctggtggagagatacctgattgaaattgcaaagaattacaacgtaccctatgaacctgactctgtggtcatggcagaagctcctcctggggtagagacagatcttattgatgttggattcacagatgatgtgaagaaaggaggccctggaagaggagggagtggtggcttcacagcaccagttggtggacctgatggaacggtgccaatgcccatgcccatgcccatgcctatgccatctgcaaatacgcctttctcatatccactgccaaagggaccatcagatttcaatggactgccaatggggacttatcaggcctttcccaatattcatccacctcagataccagcaactcccccatcgtatgaatctgtagatgacattaatgctgataagaatatctcttctgcacagattgttggtcctggacccaagccagaagcctctgcaaagcttccttccagacctgcagataactatgacaactttgtcctaccagagttgccatctgtgccagacacactaccaactgcatctgctggtgccagcacctcagcatctgaagacattgactttgatgatctttcccggaggtttgaagagctgaaaaagaaaacataggtctcttaaaccaggcaactttcacgttttgggagttgagactgagcaatttctccttgtaacaaagaatctccatgaaattctgtttcatctgttaaccgtcactcagcacaacactccctctgggctctcttcctgctcctccagattctgctgctttccagttctctgttgatcctgagactaacaattggagactgaggccagagcaactggctcctggcagctgtgcttgtccgtttcctgtcagagtgatcccaggtttcctcctggcccgtcccatggtccctccacaggagtgtgagaggatgggggaagcactgtgggaagaccaccaaagatggctggacagtgggagagagcacgttgtgaagcatcccagcctcgtgttgaggttccagacttagaaacagacccctctgtacagggggattgtggtgagtgagaatcaaggccaccttgtgtgttttctcactctcgaatgcaagtgggagagggaaaatgactcgggacgccattgtaacggttcctggaagctgggccctctcattggcatatacagtactcctcgctgcagggcactgtcccaccgggatccagttgcaaagtttgtcttgacagttgaaggcctcgcttagttgtactggattctcagggagccctctgtggccttttgctttgcgtgctgtttcccttgtaccagagggcggcaccgtggaaattctgttttccctgtagcatattgtgttggattgcattactggcagagaaaggacaaggtgccattcaagtcctagggtgggcttccagctgccttaatagaagtactcaagtcttttgggtagtgagctggaaagcctacaggaaaagaggggtacctgttttcatttgaaaactttgattcatggaacctttaaaactaatctcagaaaaatttttggtgcccatgcagctgtagttgttcactgctttcctggatggatgggactcttatgtcataacttctgttactcctttggcccatagctaaggtcatccttccccacaggggtggctttgggattggatgatacagcttttgcttctgtgtagtatacctgtacatacttgtttcaggcagcctttctttaatgttttcagttggtttgtattctgtagctcagtagctgctaataaagttaaagatcctgtgtcctg

SEQ ID NO: 2050 - DNA, 1567 bp, Homo sapiens
atggaaaagtatgaaaaattagctaagactggagaagggtcttatggggttgtattcaaatgcagaaacaaaacctctggacaagtagtagctgttaaaaaatttgtggaatctgaagatgatcctgttgttaagaaaatagcactaagagaaatacgtatgttgaagcaattaaaacatccaaatcttgtgaacctcatcgaggtgttcaggagaaaaaggaaaatgcatttagtttttgaatactgtgatcatacacttttaaatgagctggaaagaaacccaaatggagttgctgatggagtgatcaaaagcgtattatggcaaacacttcaagctcttaatttctgtcatatacataactgtattcacagagatataaaacctgaaaatattctaataactaagcaaggaataatcaagatttgtgacttcgggtttgcacaaattctgattccaggagatgcctacaccgattatgtagctacgagatggtaccgagctcctgaacttcttgtgggagatactcagtatggttcttcagtcgatatatgggctattggttgtgtttttgcagagctcctgacaggccagccactgtggcctggaaaatcagatgtggaccaactttatctgataatcagaacactaggaaaattaatcccaagacatcaatcaatctttaaaagtaacgggtttttccatggcatcagtatacctgagccagaagacatggaaactcttgaggaaaagttctcagatgttcatcctgtggctctgaacttcatgaaggggtgtctgaagatgaatccagatgacagattaacctgttcccaactcctggagagctcctactttgattcttttcaagaggcccaaattaaaagaaaagcacgtaatgaaggaagaaacagaagacgccaacaggtacttccgctcaaaagttaaagtgctataaaaataattccttttttgtttttgtttgtctgcctttcaaagtgagacaaggtggacaccaagacctttcatttgtactggtgtagttgtatttgtctagcttaataaatattggtaattgatgtaataaaaccatagaactatgaaaatatcaagattattgcaaaaatcttattccaaacacacctgaatcaaatcgttacgcaactctttggctgctctgattggatatcccacccacaagatcgtatacccataatataacaacttcatataataaaatgctgattccaacaggactgagttttgccagcattgcaaaggaatccaagtgcctttctgtagcctccagatgtgcaataacggtaacttgactcttccatcttttcacccacagcaggcacctaagtctgcctttcctaggctttttctcaaaaccaagatctgccaggtacaaaggaatgaaacccagacatctgggaaccaaattctacccaatgggccaatattgcagaacagtatggtgactgttatgacaaacattaattctgcagtttatcaggtgactgtccttcacttgctttcagaaaactttgaagttaaatcgtaa

SEQ ID NO: 2051 - DNA, 2386 bp, Homo sapiens
aggcgcagtcccgcgttccctcggcggctgccggcgtagtgagcccgccgccgtggagtgtagcggaaagggctcgccgtcctcctccgtttctcgctgcttcgggacgcgctctctgcggctctgtgagcgcccctgagcgccggcagcggccgcggtgggttcttcaggttatcttatgatgaggcttttgctatggctaatgatcccttggaaggcttccatgaagtaaaccttgcttcacctacttctccggaccttcttggtgtgtatgaatcaggaactcaagagcagactacctcaccaagtgtcatctaccggccacacccttcagctttatcctctgtacctatccaggcaaatgcattagatgtttctgaacttcctacacaacccgtgtattcatcccccagacgtttaaattgtgcggaaatatctagtatcagctttcatgttacagacccagccccttgctctacctctggagtcacagctggattaactaaattaactacaagaaaggacaactataatgcagagagagagtttttacagggtgctactataacagaggcttgcgatggcagtgatgatatttttgggttgagtactgatagtctgtctcgtttacgaagcccatctgttttggaagttagagaaaagggctatgaacgattaaaagaagaactcgcaaaagctcagagggaactgaagttaaaagatgaagaatgtgagaggctttcaaaagtgcgagatcaacttggacaggaattggaagaactcacagctagtctatttgaggaagctcataaaatggtgagagaagcaaatatcaagcaggcaacagcagaaaaacagctaaaagaagcacaaggaaaaattgatgtacttcaagctgaagtagctgcattgaagacacttgtattgtccagttctccaacatcacctacgcaggagcctttgccaggtggaaagacaccttttaaaaaggggcatacaagaaataaaagcacaagcagtgctatgagtggcagtcatcaggacctcagtgtgatacagccaattgtaaaagactgcaaagaggtaactcatcaaggactgtcccctctgactctgttgatacttgttagttctcatcactgaggtgtcagttatcatttttgccagcaaaatttttagtacaaaataatgcagtattaagatgggggaggctttatctagagctggctgctttcagggattcttcagttccattttctacctggctgaccttggagtacctgctggaaacttggtaagtttcttaatctcagtatttcattaagggaggaaactgtcatgtgttgtctagaggagagtgggtggctttaatgatctggctagtcaaaatttattgctagagtgcgcttacaaagtatggatataagaaatatgtgaaaataagatgattttcttaaagatcaatacattgcttttatttaaattcagagagaattttatgtcagcaagggagtcctagagttaatttagataattaagcaacaaaaaaatagaaataatggtagccttacaatgacataaggctggaagacattttgctaagtgaaatttcaagttatagtagaacaattagtgtcatttttgatcccaaattaggtttcacagttcagccagtctgttattcagacacttacaactatgtaaggccaccattatcatgtatccataacaattaaaaatttaaaaacgaaataatgggccgggcatggtggctcatgcctgtaatctcagcactttgggaggccaaggccggaggatcacctgaggttgggagttcgagaccagcctgaccaacatggagaaaccctatctgtactaaaaatataaaattagctgggcatggtatctcatgcttataatcccagctactcaggaggctgaggcaggagaatcccttgaacctgggaggcggaggttgcggtcagctgagattgcgccatcacactccagcctgggcaacaagagcgaaactctgtctcaaaatcataataataataatagtcttattttaaaagatatgttacaaagataactgaaataatatataaatattttgagctgtttagagtaaaaatttttaatcattgtatactgtgagaatgcatttctaagaggattgatcaataatttatgaagctttcccatttcttcttagaagccatcttttacattgttaaattcaagtccatcattaatcttgaagaaatgtgtgtgcttgttaaatttttgtatggaagccaggagtttattaaatggaataaccaatgttaacctgttttaattgaattgcattttgacgaattatcaataaaaatgatgctggtaa

SEQ ID NO: 2052 - DNA, 1578 bp, Homo sapiens
cccgccgcctctgcgcccgcgccgcgcccccggcgccccctccccagcgcgcccccggccgctcctccgcgccgcgctcgtcggccatggcccgggagaacggcgagagcagctcctcctggaaaaagcaagctgaagacatcaagaagatcttcgagttcaaagagaccctcggaaccggggccttttccgaagtggttttagctgaagagaaggcaactggcaagctctttgctgtgaagtgtatccctaagaaggcgctgaagggcaaggaaagcagcatagagaatgagatagccgtcctgagaaagattaagcatgaaaatattgttgccctggaagacatttatgaaagcccaaatcacctgtacttggtcatgcagctggtgtccggtggagagctgtttgaccggatagtggagaaggggttttatacagagaaggatgccagcactctgatccgccaagtcttggacgccgtgtactatctccacagaatgggcatcgtccacagagacctcaagcccgaaaatctcttgtactacagtcaagatgaggagtccaaaataatgatcagtgactttggattgtcaaaaatggagggcaaaggagatgtgatgtccactgcctgtggaactccaggctatgtcgctcctgaagtcctcgcccagaaaccttacagcaaagccgttgactgctggtccatcggagtgattgcctacatcttgctctgcggctaccctcctttttatgatgaaaatgactccaagctctttgagcagatcctcaaggcggaatatgagtttgactctccctactgggatgacatctccgactctgcaaaagacttcattcggaacctgatggagaaggacccgaataaaagatacacgtgtgagcaggcagctcggcacccatggatcgctggtgacacagccctcaacaaaaacatccacgagtccgtcagcgcccagatccggaaaaactttgccaagagcaaatggagacaagcatttaatgccacggccgtcgtcagacatatgagaaaactacacctcggcagcagcctggacagttcaaatgcaagtgtttcgagcagcctcagtttggccagccaaaaagactgtgcgtatgtagcaaaaccagaatccctcagctgacactgaagacgagcctggggtggagaggagggagccggcatctgccgagcacctcctgtttgccaggcgctttctatacttaatcccatgtcatgcgaccctaggactttttttaacatgtaatcactgggctgggtgcagtggctcacgcctgtaatcccaacactttgggaggctgaggcaggaggactgtttgagttcaggagttttaagaccagcctgaccaacatggtgaaaccccatctctactaaaatataaaaattagccgggtgtggtggcgagcacctgtaatgtcagctacttgggaggctgaggcaggagaatcacttgaacccaggaagcggaggttgcaatgagctgagatcacaccactgcactccagcctgggtgacagattgagactccctctcaaaaaaa

SEQ ID NO: 2053 - DNA, 8154 bp, Homo sapiens
ggaggaggcgcgaggtgggggggagcgcggcgggcggcagggagggagcgggagggaggcaagaaagtagcagaaagtgaggctggcaggcggcggcaaaggagccggcgcgcggcggcggcaggaagtctgtgcccgagaacagcagaaataagagccagggagggaccgcggccgcggcggcggcggcgagagcgaaagaggaaactgcagaggaggaagctgcgccgcagcccgagccgcccggcatccccgccgcctctgcgcccgcgccgcgcccccggcgccccctccccagcgcgcccccggccgctcctccgcgccgcgctcgtcggccatggcccgggagaacggcgagagcagctcctcctggaaaaagcaagctgaagacatcaagaagatcttcgagttcaaagagaccctcggaaccggggccttttccgaagtggttttagctgaagagaaggcaactggcaagctctttgctgtgaagtgtatccctaagaaggcgctgaagggcaaggaaagcagcatagagaatgagatagccgtcctgagaaagattaagcatgaaaatattgttgccctggaagacatttatgaaagcccaaatcacctgtacttggtcatgcagctggtgtccggtggagagctgtttgaccggatagtggagaaggggttttatacagagaaggatgccagcactctgatccgccaagtcttggacgccgtgtactatctccacagaatgggcatcgtccacagagacctcaagcccgaaaatctcttgtactacagtcaagatgaggagtccaaaataatgatcagtgactttggattgtcaaaaatggagggcaaaggagatgtgatgtccactgcctgtggaactccaggctatgtcgctcctgaagtcctcgcccagaaaccttacagcaaagccgttgactgctggtccatcggagtgattgcctacatcttgctctgcggctaccctcctttttatgatgaaaatgactccaagctctttgagcagatcctcaaggcggaatatgagtttgactctccctactgggatgacatctccgactctgcaaaagacttcattcggaacctgatggagaaggacccgaataaaagatacacgtgtgagcaggcagctcggcacccatggatcgctggtgacacagccctcaacaaaaacatccacgagtccgtcagcgcccagatccggaaaaactttgccaagagcaaatggagacaagcatttaatgccacggccgtcgtcagacatatgagaaaactacacctcggcagcagcctggacagttcaaatgcaagtgtttcgagcagcctcagtttggccagccaaaaagactgtctggcaccttccacgctctgtagtttcatttcttcttcgtcgggggtctcaggagttggagccgagcggagacccaggcccaccactgtgacggcagtgcactctggaagcaagtgactggccctggaggtggggcccggggtcggggctggggaaggggagccccagggtcgccagagccgcgagccactccagcgagaccccaccttgcatggtgccccttcctgcataggactggaagaccgaagtttttttatggccatattttctactgcaattctgaagtgttcatttctcacaaactgtactgactcgaggggcgctgatttcataggatctggtgctgtatatacgaatcttgcaaagctctaactgaacggaccttcttattcctctcccctaacaccatcgtttccactcttctcagtgtaggtaaccgtctatggtgtgttttttcattaatgacaaaaaaaaaaaggtttcaactggattatttaaatattggtaaatattgtgcattagggtttgtttttccttttaagaagtatgtcctttgtatctctaagttacatgacctatatcttttcctctttaatagtagttttatgttaacctttaagagatttgtttttcctcaaaggagaatttaaaggtattttttaaaattctaataagaggatcagccgggtgcaatgactcatgcctgtaatcccagcacgttgggaggccaagtcgggcggatcacaaggtcaggagatcaaggccatcctggccaacatggtgaaaccccacgtctactaaaaatacaaaaaattagccgggcgtggtggcacacacctgtagtcccggctactcgggaggctgaggcaggagaattgcttgaacccgggagacggaggttgcagtgagctgagatcgtgccactgcactccagcctgggtgacagagcaagactctgtctcaaaaaaaaaaaaaaaaattctaacaagaggatcatgaatctgtctccaaggctaagagtgcccttcacctctactccttctgtttctctccccttccccaggaggaggggcccctcagttctgcgaggctctcttctctgcgggggactttggtagagaatctgcacagagcctttgctggcaacccatccagcagaacccacacccaccagagaccctagaggcctcttgccatcagcaaccagaaataagcctgctcccccgagacgcagggctcagcttcacaggccagacttgctgtgagtgagatgcccacactgcagagatgcaggaccctcccttgcaaaaggaaccagctgccatgttgctgaaagtgggcccacacacaaccctcatttctcacgagagctaacagatgaaagctcagctatgcagtgttaaaattcatctctttctctgtggtttttaaaaaaatgcatttctaatcttacacttcacgtggcctccaacacaaagttctttctccacatttttaccctcttctcacatgaatgttttccaagggaaggaagggagggaagcagccttgggaaaggatccatttctggtggtaaggagagggggccctgccaggctaatgggacttcagccaccacagagatgaccaaagaccacctccgccaggcccagccagtgcttgcagccctcccattggtcaggggagtctaaaatcaaagatacatggtggtagggtcaccaaacgtcccatttgcccgagactgaaggatttctcaggctgtggacatttaatgccaaaaccaggaatatccggggcaaagcaggctgtgttgttcgcctttgtggagccaggcagtgtgtggcccagggaaagctgcgtttcatggaggcttccaggaggctgccctgtaaagccaggcaggtggcttcaagtgccattcctgcaagtgcccctgcttcagctctcaggcccatccaatgcctcgagcccacgggggtgtcccggcaggtctgcgtcatcacgacccagtaacgctgctggctgtgtcctcatgccctcttcctctggctggccagtcatgggaagtcctgttggttgagtcatctttgtcacttctacacctttgagtatgtacaggctgaatgttgagtgatgcccccccaccctctcaataaacacacacacacacacacacacacacacacacacacacaatgttattaggcacagcagctccatcctgctccctgagaatggcagtgcaggcacagagaagagcagttgggaagacaggcagctggtctaccctgtccccgcacacttcacaggcactccactgcttggcaggaattctgcatggcatctgccacgcatgctcacagggtgaaaaatcaagctgtcactctgcaaaatctaaaaaccctggaaaggtctataagatgacattagacccagttaagaagcaagtgtcacctgagttggccatgcaatgaatgaatattataagcagtattggagaactaggcggttgcttactaagaagtgtcttggaaacattcgagttcatacagtgcatgacaaagtaatagaaggctgcaagcgctgaaaatgcacccgaatctggtacctaggatgagtacatgaatagtgatgaatagccctttgtgctgtgtgctatatacaaccatttgcattcagaaagcagcatttgaagctgagttccattactggtgattgaagtattttcaggagcagatacatgtggtgcatgttatatgcacttagtttgaaagtatccctcacccaaaaagtgcagaacctctgaaaggtgagccgtggtgcaggtgcccccctcgctgttcgggtcagttcttggccatgcttggcctgtcacacgccgggtctcaacaacatcgtgcgaggagacagtgactggtttcagcccaagagtcaactgttgagcatgacatcaggaagcctgtactgtcctgatcccaccaggcttgggttaatttcctattgcttcagagaaagagaggcgctcttgtgcttttgagagagctctcatgttaaaaagaggttgtctttgcactgcgcttggtatgatttgttttcttataaaacaggaagagaacctagaatgtgcctttcgtgaaggtctgacaaatggggtctcagagtcctaggacccgcaccaaggtcagagtccacctgtagaggctgagcatttctacatgcacccagggtgctgggctgaggctaagggtggacgcgtagaccccatcacaggcttccttcctgagcccaagtcccccatttggtcactatcccttctcagagcaagtggattctcttttcctcacttggagtattcaatgttgaagtagtggcctggagtggcctttccctcagctgcctgtctgggcctccctggcttcccggatcttcatctcatacgtgaggcaataggaggagtttctattcattgagacaaacagtgagcgggcaccaacaggccagcagcttggcccttttcacagaggtggccttggagtctggagtctgggcagctgtctgcctctctacggctctgcttcccagcgggcacacgggtccggagcctcagaatgaagtggtgcagaggcgcagggcacacctaggagaagctcaatgaccaccaaagcccttgaggagagacggggtttgctgtgttagagaaatggcaacccccaggaccatgcacggctctggcagtgcacagtggctgattttcaccagttcctcctacccctgcctctgtcggagactagaaaacattctaccccttcaggtcttcttttaaaagaaaagagctatggcaaagcgtgccatacaaagttaaaaaaaggaagagtggctttgcgttcttgaccatggccacaattctggtcacttctagcatctgaccttgagaacggtgtagagtctctgagccaccgctggcctttgagagagtctcactctccagctagctctttgtgtagtgtccagggccccggcagtcaggatagagcgagcaaaagaagatggacagtggacagggcgcagtggctcacgcctgtaatcccagcgctttgggagagcgaggcgggcagatcacaaggtcaagagatcaagaccattctggccaacatggtgaaaccctgtttctactaaaaatacaaaaattagctgggcatggtggtgcgtgcctgtaatcccagctactcgggaggctgaggcaggagaatcgcttgaacccgggaggcagaggttgcagtgagccgagatcgtgccactgcactccagcctgggtgacagagcaagactccgtctcaaaaaagatggccatgctggccaaggctgggctcataggaaatatctgtagtaggatgaaaggaatctggcctagggagccccggactcggtttacctaccccgtactcatcccactcatctgtctaccctagtgtccatcatgccctggatgaatcgtaggtgggagggacagaagccgagaacaccaggcacacggggtggggggaatggggggagcccaggtgatcccctttggaaagtggattgatcctctcccctgtggaatgacagcttaacctgattaacccactggggcttgctattttatgagcatttttaaacagaaaggaaagatgatatcccagtgcaggtagactttatttttgaaagcatcgtggcccctcacctctccctctcccccagaaccttggccagaattgagtcttcgcgttggggaggccacgctggaaccattgctctagggctgaaggtggaagtagggccactgccgcagcttcagccagagccctcgctgcttcgcagaatttaacaagcacacgactgggattcctttggatatgagaaaggaaggcaagtgcgggcaaagggaagctcctcccgtttttcataaacagaagtaagatgtcctctttcccaggtttgcacaatcacttctggcaaattaattgaaggtccttgaattcagccagtgcacgaaacctttgcatgttcttctgaaactgtacttcttccctattctgtctacccacactctgcgaactttgccttttccttaaacacattccagaccaaacactgttcagtttgttaaaaaaaaaaaaaaaaaaaaaagatgtatatacctgtatgtgatccaccacccttttgaggggcacctggtcctcggttggggctgcaggtgtgcctgacatttgcaaaagatattccagtctttcgatgttcagaattgaaaatgtggagatagaaaagctcaaacagactcctaaaaggagggtttctttcctgaagactccaagaaaatgagtgtgcagatgagttagcttgacaacctcaactctggggagcaggcaggcggtctgaggaagataagggcccacgccccactcacctggcacctgttcggtggtcccggggcatcatggtctgcagctctgggcccccagccccactgtgaagtcagtcctgcatgctggccgaggcccggccacctcccgatgcctccagagtcagtgggaaggagtcagcccttcccagacttccccgccacctccagcaggagcagctcagtttgtggctctgggagctccgcttttgcaaacccaaaaaggctgtgcatttggaagccaaacgctcagcatgcggctgccgagtctggttttgtggacaaagcaaactgtggaatggcttctcggtgtctgtataaagggacaaacggttgcattcaccctttgtactataacaccgcttctgcattcgccatatccgttttttaacctttttgtctccggggaacttctcattcgattattatgtcttctgatgatttgccatgttattttaaaggtgattttattttcttatggacaggaaaaaagaaaatgaggaggagttggttttactcttagagataagacttcagcaggggctcagaaaccccaaactctagttaaattgcttctcggaggaaaatcttaatctagacagattcagattcccaggctctcctggaagccctgcacttcagggcacaggggccctgggacgtggttggcagccaggctgcgagagagctaaaaaggaacaagaacatcagctcggatgtttgtctctcagccctgacacctgccactctccttcccggggcacttggccctatcagagggacatgaaatgctgtccgaatggtggcagaaatgcagcgacattgcatgcagcagagtctttgcttcgaaagatggggcgccatgtttcagagaacatttatcttagtcccacgttcaggtgagaagacctcaaaggtaccctctgtccagaataaacattggaacaatctctcaattggcttttgtcactacacataatgtaatctcccttctttcagctcccccaacagtgagcatgcttcccaaaaaattacaacatcaaaaccaggaatgtccccgcatctactattaccaggcttgcaattggttcaattttcccataaaaacatgtttgtccaaaagaagggaaactgtgaatttattccatgcatgtaataaactctgcaagaagtttaacccacataggtttgcggcactgcaaaattgttcatgggtctatgtagcaaatgattctctgccttgacaatcatgtatacatatcaagatttctatcataatgataatgagattgatgacttcctgttttcctccaataaagacaattaatcaccttca

SEQ ID NO: 2054 - DNA, 933 bp, Homo sapiens
gcagcagcggcggcagctggaggatgaagaaggagcatgtgcttcactgccagttctccgcgtggtacccgttcttccgaggcgttaccatcaagagtgtcattcttccacttcctcagaatgtgaaggattatttactcgatgatggaactctggtggtttcaggaagggatgatccaccaacacattctcagccagacagtgatgatgaagcagaagaaatacagtggtctgatgatgagaacacagccacgcttacggcaccagaatttcctgagtttgccactaaagtccaggaagctatcaattccctcgggggcagtgtctttcctaagcttaattggagtgccccaagggatgcgtattggatagcaatgaatagttctctgaaatgtaaaaccctcagcgacatctttctgcttttcaagagttccgatttcatcactcgtgacttcactcagccgtttattcattgtactgatgattctccagatccatgtatagaatatgagctcgttctccgaaaatggtgtgaattgattcctggggctgagtttcgatgttttgtcaaggaaaacaagcttattgttgtgttcgatatatacagagacagtagggggaaggtgtggctcattgactttaatccatttggtgaagtcacagattcactgctgttcacctgggaagaactgatatctgagaacaacttaaacggcgattttagtgaagttgacgctcaagagcaggattccccagctttccgttgcacaaacagtgaagtgacagtccagcccagcccctatttgagttaccggctacccaaggactttgtagacctctctactggggaggacgctcacaagctaatagacttccttaagctgaagagaaatcagcaggaggacgactgatgagcgtactggaactggagaa

SEQ ID NO: 2055 - DNA, 3925 bp, Homo sapiens
aaagagcccgctccgccgagcgccgggcgacggcaggaagcccctccgcttggccagaatggagcagccgaagggagttgattggacagtcatcatcctgacctgccagtacaaggacagtgtccaggtctttcagagagaactggaagtgcggcagaagcgggagcagatccctgctgggacgctgttactggccgtggaggacccagagaagcgtgtgggcagcggaggagccaccctcaacgccctgctggtggctgctgaacacctgagtgcccgggcaggcttcacttggatttgtgttggagtctctctctggattcgagggtgccatcctccagggcgtctgcctgaggcctctgttcacagggctttcccactcctgcaggtggtcacatccgatgtcctgcactcggcctggatcctcattctgcacatgggtcgagacttcccctttgatgactgtggcagggctttcacctgcctccccgtggagaaccccgaggcccccgtggaagccttggtctgcaacctggactgcctgctggacatcatgacctatcggctgggcccgggctccccgccaggcgtgtgggtctgcagcaccgacatgctgctgtctgttcctgcaaatcctggtatcagctgggacagcttccggggagccagagtgatcgccctcccagggagcccggcctacgctcagaatcatggcgtctacctaactgacccccagggccttgttttggacatttactaccagggcactgaggcagagattcagcggtgtgtcaggcctgatgggcgggtgccactggtctctggggttgtcttcttctctgtggagactgccgagcgcctcctagccacccacgtgagcccgcccctggatgcctgcacctacctaggcttggactccggagcccggcctgtccagctgtctctgttttttgacattctccactgcatggctgagaacgtgaccagggaggacttcctggtggggaggcccccagagttggggcaaggcgatgcagatgtagcgggttatctgcagagcgcccgggcccagctgtggagggagcttcgcgatcagccccttaccatggcctatgtctccagcggcagctacagctacatgacctcctcagccagtgagttcctgctcagcctcacactccccggggctcctggggcccagattgtgcactcccaggtggaggagcagcagcttctggcggccgggagctctgtggtcagctgcctgctggagggccctgtccagctgggtcctgggagcgtcctgcagcactgccacctgcagggccccattcacataggcgctggctgcttggtgactggcctggatacagcccactccaaggccctgcatggccgggagctgcgtgaccttgtcctgcagggacaccacacgcggctacacggctccccgggccacgccttcaccctcgttggccgtctggacagctgggagagacagggggcaggcacatatctcaacgtgccctggagtgaattcttcaagaggacaggtgttcgagcctgggacctgtgggaccctgagacgctgcccgcagagtactgccttcccagcgcccgcctctttcctgtgctccacccctcgagggagctgggaccccaggacctgctgtggatgctggaccaccaggaggatgggggcgaggccctgcgagcctggcgggcctcctggcgcctgtcctgggagcagctgcagccgtgcctggatcgggctgccacgctggcctctcgccgggacctgttcttccgccaggccctgcataaggcgcggcacgtgctggaggcccggcaggacctcagcctgcgcccgctgatctgggctgctgtccgcgagggctgccccgggcccctgctggccacgctggaccaggttgcagctggggcaggagaccctggtgtggcggcacgggcactggcctgtgtggcggacgtcctgggctgcatggcagagggccgtgggggcttgcggagcgggccagctgccaaccctgagtggatgcggcccttctcatacctggagtgtggagacctggcagcgggcgtggaggcgcttgcccaggagagggacaagtggctaagcaggccagccttgctggtgcgagcggcccgccactatgagggggctggtcagatcctgatccgccaggctgtgatgtcagcccagcactttgtctccacagagcaggtggaactgccgggacctgggcagtgggtggtggctgagtgcccggcccgtgtggatttctctgggggctggagtgacacgccaccccttgcctatgagcttggcggggctgtgctgggcctggctgtgcgagtggacggccgccggcccatcggagccagggcacgccgcatcccggagcctgagctgtggctggcggtggggcctcggcaggatgagatgactgtgaagatagtgtgccggtgcctggctgacctgcgggactactgccagcctcatgccccaggggccctgctgaaggcggccttcatctgtgcagggatcgtgcatgtccactcggaactccagctgagcaccagcagcatcctggcaggcactgccctggctgccttgcagcgagccgcaggccgggtggtgggcacggaagccctgatccacgcagtgctgcacctggagcaggtgctcaccactggaggtggctggcaggaccaagtaggtggcctaatgcctggcatcaaggtggggcgctcccgggctcagctgccactgaaggtggaggtagaagaggtcacggtgcctgagggctttgtccagaagctcaatgaccacctgctcttggtgtacactggcaagacccgcctggctcggaacctgctgcaggatgtgctgaggagctggtatgcccgacttcctgctgtggtgcagaatgcccacagcctggtacggcaaactgaggagtgtgctgaaggcttccgccaaggaagcctgcctctgctgggccagtgcctgacctcgtactgggagcagaagaagctcatggctccaggctgtgagcccctgactgtgcggcgtatgatggatgtcctggccccccacgtgcatggccagagcctggctggggcaggcggtggaggctttctctatctgttgaccaaggagccacagcaaaaggaggccttggaggcggtgctggccaagaccgagggccttgggaattacagcatccacctggttgaagtggacactcagggcctgagcctgaagctgctggggaccgaggcctcaacctgttgccctttcccatgaagctggcttctctctgcaacaggagaaaacctggagctacagtgtcccccaccttccttgccccatgggaacctccacctcctactccccacccacctctgcgaatctgctcccaaaggaagctgaccagagcaagatctgggcaagcagagagtgcctgggacaggactgtgacctggtggacaggggcctagatgtagcctctgttcctcctggacataggaaggtcccaagcttagtatcccacgtggcctttacaaatcctatggctggccttctcattccacaagggccctggaaagggttgacagccagccttggcatatggctgggagtcccttagcaaggccaaccctgaagaggccctttgaggcattccctatggcttagagttgtagacttacactcaaccctcatgtgagcgtgggagtgagggtggcggtcccttgccaagttggtagcagtgacccagtgattcactgccatcccaggccttaactagcaaaactacggagcgtgccaagtgacctggtgcctgtgggaagtgggttctcaggactggcattcttggaataaattcactctgtccttgca

SEQ ID NO: 2056 - DNA, 475 bp, Homo sapiens
gtccctgctcatgcttgagctggcccaggaccgcttgcagttcgagactgtggaagtctcggagcccagcatgctgcagaagatcctcaccaccaggcggcgggagaccgggggcaacgagccactgcccgtgcccacgctgcagcaccatttggcaccgccggcggaggccaggaaggtgccctccgcctcccaggtccaagccatcaagtgctttctttccaaatgctggagtctgaacatcagtaccaaggagtacgcctacctcaaggggaccgtgctctttaacccgggaaaagggaaggaaaatgattgcaatcatcattaacatcatttaaaccaagtggtcaactgctaattacttgaatacaagttaaagaactttgcaacgatattatcatcatggaagatcaaaggaccttcaaaagcagcctcctcttattactttccttataaaaacttacatccacttaaa

SEQ ID NO: 2057 - DNA, 2021 bp, Homo sapiens
gagctcccacgctgctgttcttccatttccagcttttaaagagcacccgccccttcgaaccaccgaggtcatgggcgaacacaccggagcgcagcaccgcgcccccccgcacacaccgcccgcctccgcgcccttgcccagaccgaggcggccgacgcgcctgcgtgcgcgctaggtataaataggtcccaggaggcagccactgggcagaactgggctacgggcgccgcgggccatggcgggcgagaaccaccagtggcagggcagcatcctctacaacatgcttatgagcgcgaagcaaacgcgcgcggctcctgaggctccagagacgcggctggtggatcagtgctggggctgttcgtgcggcgatgagcccggggtgggcagagaggggctgctgggcgggcggaacgtggcgctcctgtaccgctgctgcttttgcggtaaagaccacccacggcagggcagcatcctctacagcatgctgacgagcgcaaagcaaacgtacgcggcaccgaaggcgcccgaggcgacgctgggtccgtgctggggctgttcgtgcggctctgatcccggggtgggcagagcggggcttccgggtgggcggcccgtggcactcctgtaccgctgctgcttttgtggtgaagaccacccgcggcagggcagcatcctctacagcttgctcactagctcaaagcaaacgcacgtggctccggcagcgcccgaggcacggccagggggcgcgtggtgggaccgctcctacttcgcgcagaggccagggggtaaagaggcgctaccaggcgggcgggccacggcgcttctgtaccgctgctgcttttgcggtgaagaccacccgcagcagggcagcaccctctactgcgtgcccacgagcacaaatcaagcgcaggcggctccggaggagcggccgagggccccctggtgggacacctcctctggtgcgctgcggccggtggcgctcaagagtccacaggtggtctgcgaggcagcctcagcgggcctgttgaagacgctgcgcttcgtcaagtacttgccctgcttccaggtgctgcccctggaccagcagctggtgctggtgcgcaactgctgggcgtccctgctcatgcttgagctggcccaggaccgcttgcagttcgagactgtggaagtctcggagcccagcatgctgcagaagatcctcaccaccaggcggcgggagaccgggggcaacgagccactgcccgtgcccacgctgcagcaccatttggcaccgccggcggaggccaggaaggtgccctccgcctcccaggtccaagccatcaagtgctttctttccaaatgctggagtctgaacatcagtaccaaggagtacgcctacctcaaggggaccgtgctctttaacccggacgtgccgggcctgcagtgcgtgaagtacattcagggactccagtggggaactcagcaaatactcagtgaacacaccaggatgacgcaccaagggccccatgacagattcatcgaacttaatagtacccttttcctgctgagattcatcaatgccaatgtcattgctgaactgttcttcaggcccatcatcggcacagtcagcatggatgatatgatgctggaaatgctctgtacaaagatataaagtcatgtgggccacacaagtgcagtagtgcagttcaccatgagggaagaataaagagctgtgggcaaaagagtgtaaaatattttaaaataaactttcttaatatttttacatgcagagtatttttgtattcaattaaagaaataattttattccagacagtcacaaatttctctgttccatagttaaagaagacatttgccaacaggtagcatagctctgtacatcttttaaaaaaaaaatagcagggtactagtataataagctattttcacaagtgtagcaatttcatggaacctgctcaaatcaaatttgtacatattgttataataaattttaaggtcttaactattaacttgattgaaaaaagctt

SEQ ID NO: 2058 - DNA, 7032 bp, Homo sapiens
atgttgcgagccacagctccctgctggttcccccctggatacccagaagctaagaaggtggccgaggaggcggccctggaggcaagccgccatttgggaggggagcagagccaggccggtgctcccgaaggcagcaagatgttgcgagccacagctccctgctggttccgccctggatacccagaagctaagaaggtggccaaggaggcggccccggaggcaagccgccatttgggagcggagcagagcccggccggtgctcccgaaggcagcaagatgttgcgagccacagctccctgctggttcccacctggatacccagaagctaagaaggtggccgaggaggcggccctcgaggctccagaattcccactgccctctcatcagcctgcccagagcttcgggctctgggtgccccagatgcacaagcaggcctcagcatttgtggacatccaggcggagccccaaaacaggggtccggcggtgcccccagcgtggcccaagatggtgacggagtcgtgctacttccctgcgcagaggggatcggcctgccgcttgccagccgccccaaggctgacagagaggccctcgggagtccgcatctcagcccccaggaagaggaagacgatcgcccactcttccagcccttgcttggtcacaggttacacagatgccaagagaacccgggtggccagcagcagccaacgctcccgtggctccaaggtcggcagacagccagggaagacgcgcaacaggtcagggatggcatgcaagaccaccgccaccaccagctctaagcgaatcgtccgtcgtgcatccttaccgagtttgagtttgaagaaacccattatcctccgaagctctgggtgccaagtccccaccgtcctccgccgaggctatctccaactgttcaccgaagagtgtctcaagttctgcgcctccaagcaggaggccgaggagaaggcgctgaacgaggagaaggtggcctacgactgcagccccaacaagaacaggtacctgaacgtggtcctgaacaccctcaagagactgaagggcctgacccccagctccatgcccggcctcagcagggccgccctgtacagccgcctccaggagttcctgctcacccaggaccagctcaaggagaacggctaccccttcccgcaccccgagcggcccggaggcgccgtcctcttcactggccaggggaaggggcccggcgactcctcctgtagggtctgctgccgttgtggcaccgagtacctggtgtcctcctcgggccgctgtgtacgcgaccagttgtgttattatcactgggggcgggtccgctcgagccaggtggctggaggccgggttagccagtacacctgctgtgcagctgctcctggctctgtgggctgccaggtggcaaagcagcacgtgcgggacggccgcaaggagagcctcgatggcttcgtggagaccttcaagaaagagttgtccagagacgcttatccaggaatctacgccttggactgtgagatgtgctacaccacgcatggcctagagctgacccgcgtcaccgtggtggacgccgacatgcgagtggtgtacgacaccttcgtcaagcccgacaacgagatcgtggactacaacaccaggttttccggagtcaccgaggccgacgtcgccaagacgagcatcacgttgccccaagtccaagccatcctgctgagctttttcagcgcccaaaccatcctcatcgggcacagcctggagagcgacctgctggccctgaagctcatccacagcaccgtggtggacacggccgtgctcttcccgcactacctgggtttcccctacaagcgctccctcaggaatctcgcggccgactacctggcacagatcatccaggacagccaggacggccacaactccagcgaggacgcaagcgcctgcctgcagctggtgatgtggaaggtccgacagcgcgcccagatccagccacgccaccggtccgcctctcccgccgccctggcctgtccttagccccaggcctcttccaaaaccgccatcagtcccgagagctcaccctgcccacctcgccgcaaagcgaaagaaactggagcagccggcggcaggagagggcaaaaagccaagagtaaccccaaccccccactcccggtcccccggaatccctgccgcggcccctcgggcctgtccacatccctctgcccctcccagacctctgtccttccaccaatcgcctcccgcagccccgagccgccactcccagtcccccgagtccctgccgcgcgccctcgcgcctgttcacatccctctgcccatccgagacctctgtctttacaccactagccaccccacgtgggacttccatggcttctgagtacaaggccagccccccggcccaccagctttcggaatgcctgcttacctctttttctgtagaggcaccacagggaggtgggtgaagcacttcggctctggagttacagatctgggttcaaggccaaattccaccacttactaggtttgtaatattggacagataacgtctttgcgcttctaccttttggtctttaaagtgtgatcaaaagagacttagactcccacatagtaataataataataatggcaaacttaacaccccactgtcaacattagacacaccaacgagacagaaagttaaaaaaggatatccgggaattgaactcagctctgcaccaagcggacctaggagacatgtacagaacgctccaccccaaatcaacagaatatacattcttctcagcaccacatcacacttatttccacattgaccacatagttggaagtaaagcactcctcagtaaaagtaaaataacagaaattattacaaacggtctctcagaccacattgcaatcaaactagacctcaggattgagaaactcactcaaaaccgctcaactgcatggaaaccgtacaagctgctcctgaatgagtacagggtacataacgaaatgaaggcagaaataaagatattctctgaaagcaatgagaacaaagacacaacataccagaatctctgggacacatttaaagcagtgtgtagagggaaatttatagcactaaatgcccacaagggaaagcaggaaagatcaaaaatgcataccctaacatcaccattaaaagaatgagagaagcaagggcaaacacattcaaaagctagcagaaggcaagaaataactaagatctgagcaggactgaaggagatagagacacaaaaaacgtgggatggttttttagtatgtggaaaaattctttgatggtttttccttgaaaaagtgaaacctaaatccactccgtttggatgtgggacgatttgcggttgttgcttcctaaacataaactacgtttaggctgatatttcagacaatgaaacctttgagtgcccgtagcgggaagatctcggttgctgagtgcagggaaggaggatgtaattccatcatatactctctctgtgcctaccgcatttggaaccatgcgagtgatacctatttataaaataaaataaaccaagcacaagtacgaacttagcaacactatattgagttaatagaacggtatcttgtatttcttctgtccaggtatacttataaatgcctgcagggatttcaccacctcagggtggagagactgaatgcttgtgagggaattaggatggtggaatattggtgttaccagggaagggggcgggatgtttgaaaatgctatgtttactcgttcttgggttccaataaaggagaaacagggcacaggagtcggaaggactagtggcaatagtgatgaaaggacctccttatcatgctggcaatgttaattacccaggtgtaggaagccatacactgaggcggaagatcgcaagtcagagtggccggcaggcacaacctcctggcacaccagaggcaggtcttcaatacccactggtttccccaacaggctgcgtaagggaccctgagccacagtgagttggtcaaatgctcctgacagtgtggagaaaccaacagacaaaacgtgggtgcaaaagtgatgagaccccacactttacactcgtggtgacaatgaagctattaagtaacagcttctcaacctatgctgtttcctgttggatgcacataatccatttgcactgcagacaattttaggatgtggtttacagtaaggtggatggtaccttatggcaaaaatctctcagaaatttatgtgtggttttaaagtcattccagtcctagcacgttgtgcttttcagagacgccatagctgtttttccctttgtaatatcaaagcagtaatatgttctctggaggcctgttgggtgaatttaatggaatcaagttaagtaggtgccagaaccattgctgttttccctccatagccctgccacccactgtaaaaaggttgatgagattacttaatgatttccaattaagttgtatttccaaatatcatgatttccattttaatgtagttggtatggagctctgtgagtgtgtgcttcttttattatggatcacgttcagcttctttttatttgcctcctagtcataatagtaaaactctactcctctactccgaggagtccctaccacccatctcatcactttccagcccagcactcttcatgctcattcatttaaagcattcaacattgtgtaaatgaatcttggaaggccaaagctactgaatttagcgaatttgtggaggcattgccacaaatcagccaggtgaagtttcacacaatcgaagactgcacaactcctagaaggcagcactatgctgcaaacccagacggccactcttctcacccctcgtccgtttgctgttctggataatgaggttcaaaagtcacctaggcaactgccaaaatagctgaaatggagaaagggcttcaggctggtgactagcagaggtccacctgacccccgtaagctgctgaacaagtagggctgccagaaatgtcccactagggaatttggtagagacgaagacatgctcaccggacaagggttcctcccaggatacgcccgagcggaagaagcgggctctgagccacgccctttcaccctcctctaccccgccctgggctggtgaaggtgcgcgccaggatgtggactactgagccctgaagaaataagtccttccactttgaccccatggaggattgcctgtgaggaacttaaacgagtctaccagtgtctagacacgggggcaggtctgtccggcacagcagctccctcaaggaggagaagagtgaggagaaaggaaactcaagtctcaccattctgtcctgggagagaagaggaggatctcatctctcatctgtccaaacaaggcaaggagactttctctcatctttccaagcaaggcaaggagactttttatcattaggaaacaaaaagaatttagaaggaatgaaagcagcccgtaaggtgaattcctaaggactgcccattgaaactgacaaaattgcccttgtttgatgagaggaatgagcagagcattgatgtggtgaacaaggatctagtgagactttcccagcatgtttctaccaaagctttatctaagcttctcagaacactctcctaataagcagatgtttggcctttcagaaagtcaacaagcaaaatgccttgagtgtcccaaaacactgatgccatgatgtgggctcctgactggcctccttttcctttgactggaccgctgccacctcttggtagccatcgctttcatgatgctttgccttggagatcatattggtgaagccatgttccaactgccgcttacaatttgtcagagggatgcgtcaggatcgtgatccctcctgtttaaaatttccactgatagctctcgtcgtaaatgcagctgatctgggcacagtggttttcacagccactgcaggattcatcttccacatcttctcacctcttcttgaaacaagctatacattcgtaaagagttcatttctttggggtagtgtccttacaagcttttcttaaaacgtcaatgatgtcttcaatcttccacccaagcttcaccataaatttgatgtttcctcttgctgcaattttcgtggaattcatgttgctctgacgggagtccttttcagtggatgtctcatccttcttagtgcctcaaactagatctagttcagaaaggttatcagaagttaggacaagtttattttagtgcaaaccagtggaaatccatgcatagtttcttcaccatgtgcattttctatgaacctttggaagaccacctgtgttgaacattgcccaagtcctgggagagaagtgggtgcggtccgcttcctgtcctcaatttgcccgcagcggcggagtgcacagagcagggaaaggcagccccagagggatcccgccctccagcatgcagcagactgctggcccagtcctggctccaaggggtgctgtgtgggcccaagcaagttgaccaacctccctgaaccttaatttaatcctaggtagcccaattccagtagccattataggactgccctgccgggacagttacttaactcaggaaaagcaacctagctccaagtttagcaaccgggagttccagttgattccattagcgcaccccctgaggcattcccaagctggagtctggtggaagatgaggctcagtgtgattggactgaagcaccaacctatcaaggagaagtcccacccagtctgccctgtgcctatataaaggcgacaagtggcggccgcagcactcattgaagccgccagttgggagaggagcagagccaggccggtgctcccgaaggcagcaagatgttgcgagccacagctccctgctggttcccccctggatacccagaagctaagaaggtggccgaggaggcggccctggaggcaagccgccatttgggaggggagcagagccaggccggtgctcccgaaggcagcaagatgttgcgagccacagctccctgctggttccgccctggatacccagaagctaagaag

SEQ ID NO: 2059 - DNA, 2703 bp, Homo sapiens
ggagagagcgaagtcaagtctccagggccgctggcgacttcggaagccgcgcgcccggcgctctcggccgcccccggccgctcgcccccgccgcgccgccgccctcgcccccgggctcgcccttggcccccggcggccgcgaaagggtgcgggagacgcggagccggaggaggaggcgcagccgctgcccgagccgcagccgcagccggagcccgagccgcggggcgggtgcgaagatgcacacgacccagaaggacacgacgtacaccaagatcttcgtcggggggctgccctaccacaccaccgacgccagcctgcgcaagtacttcgaggtcttcggcgagatcgaggaggcggtggtcatcaccgaccggcagacgggcaagtcccggggctatggatttgtcaccatggctgaccgggctgctgccgaaagggcctgcaaggatcccaatcccatcattgatggcagaaaggccaacgtgaacctggcatacttaggagcaaaaccaaggatcatgcaaccaggttttgcctttggtgttcaacaacttcatccagcccttatacaaagacctttcgggatacctgcccactatgtctatccgcaggcttttgtgcagccgggagtggtcattccacacgtccagccgacagcagctgccgcctccaccaccccttacattgattacactggagctgcatacgcacaatactcagcagctgctgctgctgccgccgccgctgctgcctatgaccagtacccctatgcagcctctccagctgctgcaggatatgttactgctgggggctatggctacgcagtccagcagccaatcaccgcagcggcacctgggacagctgccgccgccgctgcagcagctgctgccgctgcagcatttggccagtaccagcctcagcagctgcagacagaccgaatgcaatagaccagccatctgatcaaagttgaattgttttctctttccctcccaattttccaatttttagtagctaataagagagttaacattgacttaacagctttaaaaaaaaaaacagccatgctattgtgaagcagagttattattttttttatactccaggtagtgttctagatgagaaagaggtaagaatgaggggaatgggcacaattttggaaatcaatcccaaagagcctgagtaaatgaaaggccactacgaaatgacgccaggagtaacaacggaacttcacttttgtaacgggatttttatttttgctctttttatagtatcagggaagcaaactgccttttacaagttagaaaatgctgtttgaatctagttgaaccagggaatacagagcgagcaatatgtagcttgaattacatttaaaagcagattttttacaaacaaaatggcgaaagcactgattgtcatttttagcagtcacttaaggcctatagaacttttttcaagtcggaaggtcctgttcttactatctcaaaaatgggcatcgaacaatcaatctaggagcgtggcagtgggtaaaatggtggacaggcaccaaagctattttctcatctgtcctgtggatgagtggaactgtggaacaagtgatgtggaattaatgggtgcaacagctgtacagacaatcaataacacacacagttctggaaagaacacatcacttgtgcttgtttgatgagcttgtcacattctaatccctctccccatcctgtttcaattttgggaaacttgtatctgctggtgtcagcaattctgattctgaaataggatcaggcttttactacaacagccttctctttctatttattgtgtcgactcgtggcttatgaataaaggcaggcaaagtttgcagaactgtcttaaggacatttattttttttccctttttaagtaattttacactttagtatctatttcagagtcatatttaaaactatttattagtgactacagtacatgagacaacaaggttactgagattacaattcttcaaaggttaatgataatgtggtttatactgtgccttaatagtaatgctatttaagatatttatttttaagttttactatgctgcactctaaagaaaggaactttagatgtgacactgtaaaattatgtattcatctcatggcataaattatttagtaagtctagatgtagcgtattaaatattaacctattcaactaaagatgttgacttggatttatttaaattcatatgtgcactgtataagagagtactcttacattaacacattttagtttagtttttagatttttttttaaacgatatattgctagtttcatgcttcctcctctgattttgcctgtgtagatttcatttattggtaattcattagtttaacactattatgtagtttttaaatgctgctttacatttttcttctgaaactgcaatacttgcaatttttattcttaaactaaattgaatactattttacactgtattggatttttatacttgaacaatttcatacaagggaagacaggttagcatttttatggactttctccattatcactggatttactttaagtattcccatactagacagtgttatgtaatgtagacatgactctcctgtgcaaattatttattcgttgtgtatattgctttataacatttcagatcttctaatctattcacttgtattaaatataatttttaaaaacttc

SEQ ID NO: 2060 - DNA, 5440 bp, Homo sapiens
gggagattcgggaccatggcacctgtgcacggcgacgactctctgtcagattcagggagttttgtatcttctcgagcccggcgagaaaaaaaatcaaagaaggggcgccaagaagccctagaaagactgaaaaaggctaaagctggtgagaagtataaatatgaagtcgaggacttcacaggtgtttatgaagaagttgatgaagaacagtattcgaagctggttcaggcacgccaggatgatgactggattgtggatgatgatggtattggctatgtggaagatggccgagagatttttgatgatgaccttgaagatgatgcccttgatgctgatgagaaaggaaaagatggtaaagcacgcaataaagacaagaggaatgtaaagaagctcgcagtgacaaaaccgaacaacattaagtcaatgttcattgcttgtgctggaaagaaaactgcagataaagctgtagacttgtccaaggatggtctgctaggtgacattctacaggatcttaacactgagacacctcaaataactccaccacctgtaatgatactgaagaagaaaagatccattggagcttcaccgaatcctttctctgtgcacaccgccacggcagttccttcaggaaaaattgcttcccctgtctccagaaaggagcctccattaactcctgttcctcttaaacgtgctgaatttgctggcgatgatgtacaggtcgagagtacagaagaagagcaggagtcaggggcaatggagtttgaagatggtgactttgatgagcccatggaagttgaagaggtggacctggagcctatggctgccaaggcttgggacaaagagagtgagccagcagaggaagtgaaacaagaggcggattctgggaaagggaccgtgtcctacttaggaagttttctcccggatgtctcttgttgggacattgatcaagaaggtgatagcagtttctcagtgcaagaagttcaagtggattccagtcacctcccattggtaaaaggggcagatgaggaacaagtattccacttttattggttggatgcttatgaggatcagtacaaccaaccaggtgtggtatttctgtttgggaaagtttggattgaatcagccgagacccatgtgagctgttgtgtcatggtgaaaaatatcgagcgaacgctttacttccttccccgtgaaatgaaaattgatctaaatacggggaaagaaacaggaactccaatttcaatgaaggatgtttatgaggaatttgatgagaaaatagcaacaaaatataaaattatgaagttcaagtctaagccagtggaaaagaactatgcttttgagatacctgatgttccagaaaaatctgagtacttggaagttaaatactcggctgaaatgccacagcttcctcaagatttgaaaggagaaactttttctcatgtatttgggaccaacacatctagcctggaactgttcttgatgaacagaaagatcaaaggaccttgttggcttgaagtaaaaagtccacagctcttgaatcagccagtcagttggtgtaaagttgaggcaatggctttgaaaccagacctggtgaatgtaattaaggatgtcagtccaccaccgcttgtcgtgatggctttcagcatgaagacaatgcagaatgcaaagaaccatcaaaatgagattattgctatggcagctttggtccatcacagttttgcattggataaagcagccccaaagcctccctttcagtcacacttctgtgttgtgtctaaaccaaaggactgtatttttccatatgctttcaaagaagtcattgagaaaaagaatgtgaaggttgaggttgctgcaacagaaagaacactgctaggttttttccttgcaaaagttcacaaaattgatcctgatatcattgtgggtcataatatttatgggtttgaactggaagtactactgcagagaattaatgtgtgcaaagctcctcactggtccaagataggtcgactgaagcgatccaacatgccaaagcttgggggccggagtggatttggtgaaagaaatgctacctgtggtcgaatgatctgtgatgtggaaatttcagcaaaggaattgattcgttgtaaaagctaccatctgtctgaacttgttcagcagattctaaaaactgaaagggttgtaatcccaatggaaaatatacaaaatatgtacagtgaatcttctcaactgttatacctgttggaacacacctggaaagatgccaagttcattttgcagatcatgtgtgagctaaatgttcttccattagcattgcagatcactaacatcgctgggaacattatgtccaggacgctgatgggtggacgatccgagcgtaacgagttcttgttgcttcatgcattttacgaaaacaactatattgtgcctgacaagcagattttcagaaagcctcagcaaaaactgggagatgaagatgaagaaattgatggagataccaataaatacaagaaaggacgtaagaaagcagcttatgctggaggcttggttttggaccccaaagttggtttttatgataagttcattttgcttctggacttcaacagtctatatccttccatcattcaggaatttaacatttgttttacaacagtacaaagagttgcttcagaggcacagaaagttacagaggatggagaacaagaacagatccctgagttgccagatccaagcttagaaatgggcattttgcccagagagatccggaaactggtagaacggagaaaacaagtcaaacagctaatgaaacagcaagacttaaatccagaccttattcttcagtatgacattcgacagaaggctttgaagctcacagcgaacagtatgtatggttgcctgggattttcctatagcagattttacgccaaaccactggctgccttggtgacatacaaaggaagggagattttgatgcatacgaaagagatggtacaaaagatgaatcttgaagttatttatggagatacagattcaattatgataaacaccaatagcaccaatctggaagaagtatttaagttgggaaacaaggtaaaaagtgaagtgaataagttgtacaaactgcttgaaatagacattgatggggttttcaagtctctgctactgctgaaaaaaaagaagtacgctgctctggttgttgagccaacgtcggatgggaattatgtcaccaaacaggagctcaaaggattagatatagttagaagagattggtgtgatcttgctaaagacactggaaactttgtgattggccagattctttctgatcaaagccgggacactatagtggaaaacattcagaagaggctgatagaaattggagaaaatgtgctaaatggcagtgtcccagtgagccagtttgaaattaacaaggcattgacaaaggatccccaggattaccctgataaaaaaagcctacctcatgtacatgttgccctctggataaattctcaaggaggcagaaaggtgaaagctggagatactgtgtcatatgtcatctgtcaggatggatcaaacctcactgcaagtcagagggcctatgcgcctgagcagctgcagaaacaggataatctaaccattgacacccagtactacctggcccagcagatccacccagtcgtggctcggatctgtgaaccaatagacggaattgatgctgtcctcattgcaacgtggttgggacttgaccccacccaatttagagttcatcattatcataaagatgaagagaatgatgctctacttggtggcccagcacagctcactgatgaagagaaatacagggactgtgaaagattcaaatgtccatgccctacatgtggaactgagaatatttatgataatgtctttgatggttcgggaacagatatggagcccagcttgtatcgttgcagtaacatcgattgtaaggcttcacctctgacctttacagtacaactgagcaacaaattgatcatggacattagacgtttcattaaaaagtactatgatggctggttgatatgtgaagagccaacctgtcgcaatcgaactcgtcaccttccccttcaattctcccgaactgggcctctttgcccagcctgcatgaaagctacacttcaaccagagtattctgacaagtccctgtacacccagctgtgcttttaccggtacatttttgatgcggagtgtgcactggagaaacttactaccgatcatgagaaagataaattgaagaagcaattttttacccccaaagttctgcaggactacagaaaactcaagaacacagcagagcaattcttgtcccgaagtggctactccgaagtgaatctgagcaaactcttcgctggttgtgccgtgaaatcctaagggaatcccaggagtaaccaaggagggggtagttgaaaaatcccagcttcctctgtgcctccactctggccctaaatgctcctccagcatctgtttctcccttgggactgtgtctcatgtttgtgtgaatgtagaccaggaaagggggctgcaaaaatgttgagtctaatgttcgtaagcatcatagaaattcctgtcttcatattaagatgtactgctttaaaacacaactccagagcccctccccaagctcccctccccaagctcctgaagacccggtttctgagggagggaaattgctacttggattgagagtagctggaatgtaagtgaccccaggctttgcctcagggcctttagcctatgtcccccccacataaagagagcttctcagagcctgactgaagagctgacgttttgctttttcatatgccaattaaacccggtctaaatccaaatgcttctccagccatccaggagtggctgtccttttcagtcttgtcttttatataggtagctgagggggaagatttagaagccttgcactcactaaatagattaaacagagcaggcttgtttgttgaattgctccaaagtccaacagacacacactgagcaggtgttttacactcacattccctttttgccccttaaatagaaagtgcaggtaaaggtttatacaacaagaaagcacattgaaaataatttgatactctaacaatccattaacatgtgtaggggttacggtgaggatcactgtgttgtattcagaaaaacggggagagggatgcttaattggccctggcgcttgctatttttttctcatttcttcacaataggaccgtctttggcagcagcaaaatgtatttcagtatggcagtctttcctctcttacattattggtaagattatactaacaaaatgtttccccttgtacaattatgctgtgtttttaaaaaacattgacctgtgtgtttttataaaagaaaaagtatgttgtgccttcttcttaagaataaagttttctaaagggaaa

SEQ ID NO: 2061 - DNA, 6111 bp, Homo sapiens
ctttgtggtctacagccacaccaccccaaatgtgcctgatcttgtctgatcttggaagctaagcattgttgggcctagttaggacctggataggagaaatcccttatggctaactatatgtcagaaagcatcagcttttctcgatggacccattcatctaatgaaatatgcctgtactattttaaaaagctttgtatttcgtcatagaaaagttcatccccccagaatgaaaatgaggacatttgagaaggtgatttaaggtgtggacatttgagaaggtgtcctatcaaattagtaaaccaaaggaaaagtactgaatagattaatccaaaacacttactgttttttaaacgaagaggatttcaccttgacagaaaaacaacttttattcaatatgtatttcctgaaattaaagagacaagtacagactgaaaggaaaatagattcgtaaataagctacgtcaactctatcctgctgaggatagctcagtgatgttaaatcctttacaaatccctggttgtcttcctacagacaagactgctttttgatgggactgatattaagagaaataggacctttggggcattcaactccttgataaaacttaaaagtatcggcatgagtggcttaacagaggaaataaagaagttttcaactaaatccaaaagtgcggtcattttctttactgctgttattttaaaaacctcttcataaccattgaaaaagaatcgacaactattttaaaagattaaagaaaggcagatgtctgcaaataattcccctccatcagcccagaagtctgtattacccacagctattcctgctgtgcttccagctgcttctccgtgttcaagtcctaagacgggactctctgcccgactctctaatggaagcttcagtgcaccatcactcaccaactccagaggctcagtgcatacagtttcatttctactgcaaattggcctcacacgggagagtgttaccattgaagcccaggaactgtctttatctgctgtcaaggatcttgtgtgctccatagtttatcaaaagtttccagagtgtggattctttggcatgtatgacaaaattcttctctttcgccatgacatgaactcagaaaacattttgcagctgattacctcagcagatgaaatacatgaaggagacctagtggaagtggttctttcagctttagccacagtagaagacttccagattcgtccacatactctctatgtacattcttacaaagctcctactttctgtgattactgtggtgagatgctctggggattggtacgtcaaggactgaaatgtgaaggctgtggattaaattaccataaacgatgtgccttcaagattccaaataactgtagtggagtaagaaagagacgtctgtcaaatgtatctttaccaggacccggcctctcagttccaagacccctacagcctgaatatgtagcccttcccagtgaagagtcacatgtccaccaggaaccaagtaagagaattccttcttggagtggtcgcccaatctggatggaaaagatggtaatgtgcagagtgaaagttccacacacatttgctgttcactcttacacccgtcccacgatatgtcagtactgcaagcggttactgaaaggcctctttcgccaaggaatgcagtgtaaagattgcaaattcaactgccataaacgctgtgcatcaaaagtaccaagagactgccttggagaggttactttcaatggagaaccttccagtctgggaacagatacagatataccaatggatattgacaataatgacataaatagtgatagtagtcggggtttggatgacacagaagagccatcacccccagaagataagatgttcttcttggatccatctgatctcgatgtggaaagagatgaagaagccgttaaaacaatcagtccatcaacaagcaataatattccgctaatgagggttgtacaatccatcaagcacacaaagaggaagagcagcacaatggtgaaggaagggtggatggtccattacaccagcagggataacctgagaaagaggcattattggagacttgacagcaaatgtctaacattatttcagaatgaatctggatcaaagtattataaggaaattccactttcagaaattctccgcatatcttcaccacgagatttcacaaacatttcacaaggcagcaatccacactgttttgaaatcattactgatactatggtatacttcgttggtgagaacaatggggacagctctcataatcctgttcttgctgccactggagttggacttgatgtagcacagagctgggaaaaagcaattcgccaagccctcatgcctgttactcctcaagcaagtgtttgcacttctccagggcaagggaaagatcacaaagatttgtctacaagtatctctgtatctaattgtcagattcaggagaatgtggatatcagtactgtttaccagatctttgcagatgaggtgcttggttcaggccagtttggcatcgtttatggaggaaaacatagaaagactgggagggatgtggctattaaagtaattgataagatgagattccccacaaaacaagaaagtcaactccgtaatgaagtggctattttacagaatttgcaccatcctgggattgtaaacctggaatgtatgtttgaaaccccagaacgagtctttgtagtaatggaaaagctgcatggagatatgttggaaatgattctatccagtgagaaaagtcggcttccagaacgaattactaaattcatggtcacacagatacttgttgctttgaggaatctgcattttaagaatattgtgcactgtgatttaaagccagaaaatgtgctgcttgcatcagcagagccatttcctcaggtgaagctgtgtgactttggatttgcacgcatcattggtgaaaagtcattcaggagatctgtggtaggaactccagcatacttagcccctgaagttctccggagcaaaggttacaaccgttccctagatatgtggtcagtgggagttatcatctatgtgagcctcagtggcacatttccttttaatgaggatgaagatataaatgaccaaatccaaaatgctgcatttatgtacccaccaaatccatggagagaaatttctggtgaagcaattgatctgataaacaatctgcttcaagtgaagatgagaaaacgttacagtgttgacaaatctcttagtcatccctggctacaggactatcagacttggcttgaccttagagaatttgaaactcgcattggagaacgttacattacacatgaaagtgatgatgctcgctgggaaatacatgcatacacacataaccttgtatacccaaagcacttcattatggctcctaatccagatgatatggaagaagatccttaatcactgagctaacctaaataaggaaggatttcattttatggactgatattttgctgtgtaacttgttctttgtagattgtcatctgcagtgctgcaaagatatgaagaaatatgataacgaataagtgacaccagtactgtagttcataatgagtaggtacaggcgggaaactgaataataagaagtcataatggaatcaaggtgaagctttttataaacttttttagcctaagcaataactggttttgtattttttcttaatccttcactttaatacaataggctcacttaatttgtcttcccatttctctttatatatatatatataaatataaatatatgtttgtttgtttttttaatgaaaaacaagtcaagctagcatccagttactatatagcttggctaaattatacaagacttacaagattgattactcgacaggcttgtatttaagaggtaactgtgaggttaccattatgtgatgttactataaggacttttaacattggtttaacaaaccatagaggcattgaagggtttttcttagatgcctagaaaaagcgcactgggctgttttacctttcttttttaggtcaatcaagactccaaaatagtgattcctaacctttttggagttgctctgctactctgaatatgttctatacagcataaggattgtcaccttctgtgtgttgcaacagcttctaagataattagggacaaatgatgttacaaaaggaagagtactgctggtctaagtgctgagttgtatgtctttgcatagctccactctgctgctaaatatgcatgttctgactgacaccatcttgatgccagtactggattccagcattcagcaggtgcagatctcggctttacacaatttatctttacctagggttcagtcagtaatttctgctttttagcagggccagtgcagggtcagttaatgctacagttactgtatagcaaacagtatccttttttctccttcccctagcctattgggctttgcagatatctggagtgttttaaagtcaattattttaagcagtttgaggggatgtgtaggagtggagcatgaaacagtttataaggctggggctgtattatcagcacagcaaattaaagaatgaaagaagtacttctttttacatttcagctccagcagccagctatttaaaaaatatttttaaatatcttccccaaagtttaagatgtgggaccatctacttgtaagaaacagtggcttatttcttcatttctcagtaatcattgtaaacctttttttttttcttctccactctaacaaaagtaaaagaacaaaacttttgctgaggtcttggactccactacttgttagttatgttggcctggacagatggcaggtctgtcggcagttcctcagtctgtaaaatgaagattatcattcttgcctctccctttgtcacagtgttgtcgtgaagatcagatatgtatgaatgcagtcaaataaactaaaaactaggaaagtgttaactatcgttgcccaccgaatttgaggtagcaaaaaaaaaaaagaatgttctggtacatgaacagactgagaaggcctttcgacatccctgaagctagtctcctgtctagactaaaaatatccttgaaagaatagtagcaaacagtatgcagtactcctgtgttctaagttcttttatgttttagtttaccctcacagcagccatagtgttaagtcattatgagcttcatcttaaagataagaaaactgaggcaaggggagattaacttactgccaaatttcaaacagttagtagtatttgagaccagtagtatggctctaatcttacccttagccctcccaaccattatgctgtactatctacccataaatacctccaggaaacattcccctcttggtaatttgtccttctatagaagcttcaaagattaaatcaaattaattttcaaaaaaaatttttttttagaaatgttattttccctgtgatagaggatgacttcccagtttcaccaaagtctgtttatatcaacacacacaaaatggaataattctgagtcactaggcaatcaatctactgtggttttactatgtaaggtgaaaattaactggaacgatgtttgtttgctatacttacatagtcaaactttacaagccatgaaattaattgcactctttgtatttgttgttaaatgcctaagaagttttctaaaaattttgtaaaggcactgtcagagaatctggagttgaatgattattccagatactgtataacctgcataactttttgtctttaagtcgtgtttgtaaaagaagtaattgctagaaacatttgataatgtacaaagtagtctataatgactgttcagtacatttttaatatttttttggttatatccaactttttgtaaatatactggaagcttgataataaaatgtatttcctatcaccatacttttccatgtgaaaacctgagcctatttctagtataagtatccaaagaaaagtttgacctggttgtgttattttaccagaccttggtaaaagaactattttggaaacagtatttgtaaatggaactaatgctatatttaaaaacactgatttttttttaacctgccaaaaataaaaaaaagctcattttataattttctactaaa

SEQ ID NO: 2062 - DNA, 5486 bp, Homo sapiens
ccagttttgggctggttggcgcggaatcgggagattcgggaccatggcacctgtgcacggcgacgactgtgagataggggcgagtgctctgtcagattcagggagttttgtatcttctcgagcccggcgagaaaaaaaatcaaagaaggggcgccaagaagccctagaaagactgaaaaaggctaaagctggtgagaagtataaatatgaagtcgaggacttcacaggtgtttatgaagaagttgatgaagaacagtattcgaagctggttcaggcacgccaggatgatgactggattgtggatgatgatggtattggctatgtggaagatggccgagagatttttgatgatgaccttgaagatgatgcccttgatgctgatgagaaaggaaaagatggtaaagcacgcaataaagacaagaggaatgtaaagaagctcgcagtgacaaaaccgaacaacattaagtcaatgttcattgcttgtgctggaaagaaaactgcagataaagctgtagacttgtccaaggatggtctgctaggtgacattctacaggatcttaacactgagacacctcaaataactccaccacctgtaatgatactgaagaagaaaagatccattggagcttcaccgaatcctttctctgtgcacaccgccacggcagttccttcaggaaaaattgcttcccctgtctccagaaaggagcctccattaactcctgttcctcttaaacgtgctgaatttgctggcgatgatgtacaggtcgagagtacagaagaagagcaggagtcaggggcaatggagtttgaagatggtgactttgatgagcccatggaagttgaagaggtggacctggagcctatggctgccaaggcttgggacaaagagagtgagccagcagaggaagtgaaacaagaggcggattctgggaaagggaccgtgtcctacttaggaagttttctcccggatgtctcttgttgggacattgatcaagaaggtgatagcagtttctcagtgcaagaagttcaagtggattccagtcacctcccattggtaaaaggggcagatgaggaacaagtattccacttttattggttggatgcttatgaggatcagtacaaccaaccaggtgtggtatttctgtttgggaaagtttggattgaatcagccgagacccatgtgagctgttgtgtcatggtgaaaaatatcgagcgaacgctttacttccttccccgtgaaatgaaaattgatctaaatacggggaaagaaacaggaactccaatttcaatgaaggatgtttatgaggaatttgatgagaaaatagcaacaaaatataaaattatgaagttcaagtctaagccagtggaaaagaactatgcttttgagatacctgatgttccagaaaaatctgagtacttggaagttaaatactcggctgaaatgccacagcttcctcaagatttgaaaggagaaactttttctcatgtatttgggaccaacacatctagcctggaactgttcttgatgaacagaaagatcaaaggaccttgttggcttgaagtaaaaagtccacagctcttgaatcagccagtcagttggtgtaaagttgaggcaatggctttgaaaccagacctggtgaatgtaattaaggatgtcagtccaccaccgcttgtcgtgatggctttcagcatgaagacaatgcagaatgcaaagaaccatcaaaatgagattattgctatggcagctttggtccatcacagttttgcattggataaagcagccccaaagcctccctttcagtcacacttctgtgttgtgtctaaaccaaaggactgtatttttccatatgctttcaaagaagtcattgagaaaaagaatgtgaaggttgaggttgctgcaacagaaagaacactgctaggttttttccttgcaaaagttcacaaaattgatcctgatatcattgtgggtcataatatttatgggtttgaactggaagtactactgcagagaattaatgtgtgcaaagctcctcactggtccaagataggtcgactgaagcgatccaacatgccaaagcttgggggccggagtggatttggtgaaagaaatgctacctgtggtcgaatgatctgtgatgtggaaatttcagcaaaggaattgattcgttgtaaaagctaccatctgtctgaacttgttcagcagattctaaaaactgaaagggttgtaatcccaatggaaaatatacaaaatatgtacagtgaatcttctcaactgttatacctgttggaacacacctggaaagatgccaagttcattttgcagatcatgtgtgagctaaatgttcttccattagcattgcagatcactaacatcgctgggaacattatgtccaggacgctgatgggtggacgatccgagcgtaacgagttcttgttgcttcatgcattttacgaaaacaactatattgtgcctgacaagcagattttcagaaagcctcagcaaaaactgggagatgaagatgaagaaattgatggagataccaataaatacaagaaaggacgtaagaaagcagcttatgctggaggcttggttttggaccccaaagttggtttttatgataagttcattttgcttctggacttcaacagtctatatccttccatcattcaggaatttaacatttgttttacaacagtacaaagagttgcttcagaggcacagaaagttacagaggatggagaacaagaacagatccctgagttgccagatccaagcttagaaatgggcattttgcccagagagatccggaaactggtagaacggagaaaacaagtcaaacagctaatgaaacagcaagacttaaatccagaccttattcttcagtatgacattcgacagaaggctttgaagctcacagcgaacagtatgtatggttgcctgggattttcctatagcagattttacgccaaaccactggctgccttggtgacatacaaaggaagggagattttgatgcatacgaaagagatggtacaaaagatgaatcttgaagttatttatggagatacagattcaattatgataaacaccaatagcaccaatctggaagaagtatttaagttgggaaacaaggtaaaaagtgaagtgaataagttgtacaaactgcttgaaatagacattgatggggttttcaagtctctgctactgctgaaaaaaaagaagtacgctgctctggttgttgagccaacgtcggatgggaattatgtcaccaaacaggagctcaaaggattagatatagttagaagagattggtgtgatcttgctaaagacactggaaactttgtgattggccagattctttctgatcaaagccgggacactatagtggaaaacattcagaagaggctgatagaaattggagaaaatgtgctaaatggcagtgtcccagtgagccagtttgaaattaacaaggcattgacaaaggatccccaggattaccctgataaaaaaagcctacctcatgtacatgttgccctctggataaattctcaaggaggcagaaaggtgaaagctggagatactgtgtcatatgtcatctgtcaggatggatcaaacctcactgcaagtcagagggcctatgcgcctgagcagctgcagaaacaggataatctaaccattgacacccagtactacctggcccagcagatccacccagtcgtggctcggatctgtgaaccaatagacggaattgatgctgtcctcattgcaacgtggttgggacttgaccccacccaatttagagttcatcattatcataaagatgaagagaatgatgctctacttggtggcccagcacagctcactgatgaagagaaatacagggactgtgaaagattcaaatgtccatgccctacatgtggaactgagaatatttatgataatgtctttgatggttcgggaacagatatggagcccagcttgtatcgttgcagtaacatcgattgtaaggcttcacctctgacctttacagtacaactgagcaacaaattgatcatggacattagacgtttcattaaaaagtactatgatggctggttgatatgtgaagagccaacctgtcgcaatcgaactcgtcaccttccccttcaattctcccgaactgggcctctttgcccagcctgcatgaaagctacacttcaaccagagtattctgacaagtccctgtacacccagctgtgcttttaccggtacatttttgatgcggagtgtgcactggagaaacttactaccgatcatgagaaagataaattgaagaagcaattttttacccccaaagttctgcaggactacagaaaactcaagaacacagcagagcaattcttgtcccgaagtggctactccgaagtgaatctgagcaaactcttcgctggttgtgccgtgaaatcctaagggaatcccaggagtaaccaaggagggggtagttgaaaaatcccagcttcctctgtgcctccactctggccctaaatgctcctccagcatctgtttctcccttgggactgtgtctcatgtttgtgtgaatgtagaccaggaaagggggctgcaaaaatgttgagtctaatgttcgtaagcatcatagaaattcctgtcttcatattaagatgtactgctttaaaacacaactccagagcccctccccaagctcccctccccaagctcctgaagacccggtttctgagggagggaaattgctacttggattgagagtagctggaatgtaagtgaccccaggctttgcctcagggcctttagcctatgtcccccccacataaagagagcttctcagagcctgactgaagagctgacgttttgctttttcatatgccaattaaacccggtctaaatccaaatgcttctccagccatccaggagtggctgtccttttcagtcttgtcttttatataggtagctgagggggaagatttagaagccttgcactcactaaatagattaaacagagcaggcttgtttgttgaattgctccaaagtccaacagacacacactgagcaggtgttttacactcacattccctttttgccccttaaatagaaagtgcaggtaaaggtttatacaacaagaaagcacattgaaaataatttgatactctaacaatccattaacatgtgtaggggttacggtgaggatcactgtgttgtattcagaaaaacggggagagggatgcttaattggccctggcgcttgctatttttttctcatttcttcacaataggaccgtctttggcagcagcaaaatgtatttcagtatggcagtctttcctctcttacattattggtaagattatactaacaaaatgtttccccttgtacaattatgctgtgtttttaaaaaacattgacctgtgtgtttttataaaagaaaaagtatgttgtgccttcttcttaagaataaagttttctaaagggaaa

SEQ ID NO: 2063 - DNA, 497 bp, Homo sapiens
gcctatatttctttggttttcaattacgagtggctcttctcagcaagtgttccatgatggttgagcccttcttgggaacctggaagctggtctccagtgaaaactttgaggattacatgaaagaactgggagtgaatttcgcagcccggaacatggcagggttagtgaaaccgacagtaactattagtgttgatgggaaaatgatgaccataagaacagaaagttctttccaggacactaagatctccttcaagctgggggaagaatttgatgaaactacagcagacaaccggaaagtaaagagcaccataacattagagaatggctcaatgattcacgtccaaaaatggcttggcaaagagacaacaatcaaaagaaaaattgtggatgaaaaaatggtagtggaatgtaaaatgaataatattgtcagcaccagaatctacgaaaaggtgtgaagaaaggtccacagcaatgaaaacttgttcactgacaaggaa

SEQ ID NO: 2064 - DNA, 3272 bp, Homo sapiens
gcgggagtcgccggcggaggcgaggaggagctctgcgcggcgcggcgggcgatccgagccgggacgggctgcaggcgggggtgctgcagaggacacgaggcggcgggctggagacatggaccgcggcgagcaaggtctgctgagaacagacccagtccctgaggaaggagaagatgttgctgccacgatcagtgccacagagaccctctcggaagaggagcaggaagagctaagaagagaacttgcaaaggtagaagaagaaatccagactctgtctcaagtgttagcagcaaaagagaagcatctagcagagatcaagcggaaacttggaatcaattctctacaggaactaaaacagaacattgccaaagggtggcaagacgtgacagcaacatctgcttacaagaagacatctgaaaccttatcccaggctggacagaaggcctcagctgctttttcgtctgttggctcagtcatcaccaaaaagctggaagatgtaaaaaactccccaacttttaaatcatttgaagaaaaggtcgaaaacttaaagtctaaagtagggggaaccaagcctgctggtggtgattttggagaagtcttgaattcggctgcaaatgctagtgccaccaccacggagcctcttccagaaaagacacaggagagcctgtgagattcctacctttgttctgctacccactgccagatgctgcaagcgaggtccaagcacatcttgtcaacatgcattgccatgaatttctaccagatgtgcttttatttagctttacatattcctttgaccaaatagtttgtgggttaaacaaaatgaaaatatcttcacctctattcttgggaaacaccctttagtgtacatttatgttcctttatttaggaaacaccattataaaaacacttatagtaaatggggacattcactataatgatctaagaagctacagattgtcatagttgttttcctgctttacaaaattgctccagatctggaatgccagtttgacctttgtcttctataatatttcctttttttcccctctttgaatctctgtatatttgattcttaactaaaattgttctcttaaatattctgaatcctggtaattaaaagtttgggtgtattttctttacctccaaggaaagaactactagctacaaaaaatattttggaataagcattgttttggtataaggtacatattttggttgaagacaccagactgaagtaaacagctgtgcatccaatttattatagttttgtaagtaacaatatgtaatcaaacttctaggtgacttgagagtggaacctcctatatcattatttagcaccgtttgtgacagtaaccatttcagtgtattgtttattataccacttatatcaacttatttttcaccaggttaaaattttaatttctacaaaataacattctgaatcaagcacactgtatgttcagtaggttgaactatgaacactgtcatcaatgttcagttcaaaagcctgaaagtttagatctagaagctggtaaaaatgacaatatcaatcacattaggggaaccattgttgtcttcacttaatccatttagcactatttaaaataagcacaccaagttatatgactaatataacttgaaaattttttatactgaggggttggtgataactcttgaggatgtaatgcattaataaaaatcaactcatcattttctacttgttttcaatgtgttggaaactgtaaaatgatactgtagaacctgtctcctactttgaaaactgaatgtcagggctgagtgaatcaaagtgtctagacatatttgcatagaggccaaggtattctattctaataactgcttactcaacactaccaccttttccttatactgtatatgattatggcctacaatgttgtatttgttatttattaaattgtgattgttttattattgtttatgccaaatgttaactgccaagcttggagtgacctaaagcattttttaaaagcatggctagatttacttcagtataaattatcttatgaaaaccaaattttaaaagccacaggtgttgattgttataaaataacatgctgccattcttgattgctagagtttttgttagtactttggatgcaattaaaactatgtgctatcacatgtgaaaagcttaataaattccatctatcagtagtataggtctcaatatttattatgagaccagtggtctggaaacagcttgttgtaccgaatcaactggagtctatgcttaaaaaaaaaaaatttttttttaaccatccttaaattattgcttaatggtatcatattaacatattctaaataagggctttaaggcacaggctgttgaagcattttctcagaggagtggatctgtagaagtctgtctttctatagaaatattgtgcttactcaagtgttaaattattttttctatgaactagtctacttcttaaaattcaaacatattcttttgatcacattgtttcttgagcatcctgccctgctactaacttttcaacaaggcaaaatggagtaaagtggcaatttctttagatgagtgaaataccctcaagtctcttttctgcccaaaaagggaaaagtgatagaaatgggggtggcaagtggggtgagtggatgaaggtgggtattgggggtggctgtgaaagaaaataatggagaatcacttttctagacatctacctatacttaatctaagaaacaaagtaatctactgtaaagtactctgccccttgaaagaagtattaaaaagagtgaggatggatttagaaaaaaacatgaatttagaaatattcaaaatggtttttgtggcagattcaatattatgaattcacagatatttaaagaatgagaaacatagtaattagtagaaatgccagaaacagttcctggttcctcttgtgtttgacactaagaaaatagcaagagtgtgaaatctcagatacttatgaaatctcacagatgtaaggactcaagtgtagaagaaaatatccccttcttacaaaaagaaatgtcaatttatggagtttgtgggaaatagggcaagaattcttatgcttatgagagccaagtagtcagtggaagagagtagagctcaaaactggattatcaccttagcaacttagaatagtttgaaatagaaaaaaagtatttaatttggatctggatctgttaagatatgcacagtctattttttgtatagtattggaaaataaaaatgctataatttg

SEQ ID NO: 2065 - DNA, 2563 bp, Homo sapiens
gcctgaactgtttgtacctctgggccatattgcagaaccctgcccttctttgttgactgaggaaagctcgctccctgcccaggtttttcattgttgatcgaaattaacaccaggtggtgaatagagcccctcctaaggttgctcaggataaatcatttattaaataggtctgcttatcaggaggggcgtgaaggctcccaaaaggaaatgctggcacctgggcccagaagccagggcctctaactcctggggttgatttcttcagtgaagttgcaccctacaaagggaatatggccaaagcggcactcaactgaaggctgatatcaggcgattagacagccatgcattctgcgtttgtctggaatggattgtagagagatggacttatatgaggactaccagtccccgtttgattttgatgcaggagtgaacaaaagctatctctacttgtctcctagtggaaattcatctccacccggatcacctactcttcagaaatttggtctgctgagaacagacccagtccctgaggaaggagaagatgttgctgccacgatcagtgccacagagaccctctcggaagaggagcaggaagagctaagaagagaacttgcaaaggtagaagaagaaatccagactctgtctcaagtgttagcagcaaaagagaagcatctagcagagatcaagcggaaacttggaatcaattctctacaggaactaaaacagaacattgccaaagggtggcaagacgtgacagcaacatctgcttacaagaagacatctgaaaccttatcccaggctggacagaaggcctcagctgctttttcgtctgttggctcagtcatcaccaaaaagctggaagatgtaaaaaactccccaacttttaaatcatttgaagaaaaggtcgaaaacttaaagtctaaagtagggggaaccaagcctgctggtggtgattttggagaagtcttgaattcggctgcaaatgctagtgccaccaccacggagcctcttccagaaaagacacaggagagcctgtgagattcctacctttgttctgctacccactgccagatgctgcaagcgaggtccaagcacatcttgtcaacatgcattgccatgaatttctaccagatgtgcttttatttagctttacatattcctttgaccaaatagtttgtgggttaaacaaaatgaaaatatcttcacctctattcttgggaaacaccctttagtgtacatttatgttcctttatttaggaaacaccattataaaaacacttatagtaaatggggacattcactataatgatctaagaagctacagattgtcatagttgttttcctgctttacaaaattgctccagatctggaatgccagtttgacctttgtcttctataatatttcctttttttcccctctttgaatctctgtatatttgattcttaactaaaattgttctcttaaatattctgaatcctggtaattaaaagtttgggtgtattttctttacctccaaggaaagaactactagctacaaaaaatattttggaataagcattgttttggtataaggtacatattttggttgaagacaccagactgaagtaaacagctgtgcatccaatttattatagttttgtaagtaacaatatgtaatcaaacttctaggtgacttgagagtggaacctcctatatcattatttagcaccgtttgtgacagtaaccatttcagtgtattgtttattataccacttatatcaacttatttttcaccaggttaaaattttaatttctacaaaataacattctgaatcaagcacactgtatgttcagtaggttgaactatgaacactgtcatcaatgttcagttcaaaagcctgaaagtttagatctagaagctggtaaaaatgacaatatcaatcacattaggggaaccattgttgtcttcacttaatccatttagcactatttaaaataagcacaccaagttatatgactaatataacttgaaaattttttatactgaggggttggtgataactcttgaggatgtaatgcattaataaaaatcaactcatcattttctacttgttttcaatgtgttggaaactgtaaaatgatactgtagaacctgtctcctactttgaaaactgaatgtcagggctgagtgaatcaaagtgtctagacatatttgcatagaggccaaggtattctattctaataactgcttactcaacactaccaccttttccttatactgtatatgattatggcctacaatgttgtatttgttatttattaaattgtgattgttttattattgtttatgccaaatgttaactgccaagcttggagtgacctaaagcattttttaaaagcatggctagatttacttcagtataaattatcttatgaaaaccaaattttaaaagccacaggtgttgattgttataaaataacatgctgccattcttgattgctagagtttttgttagtactttggatgcaattaaaactatgtgctatcacatgtgaaaagcttaataaattccatctatcagt

SEQ ID NO: 2066 - DNA, 342 bp, Homo sapiens
ccccgcgctgcacgctctcgaggccctgccgtgtcccgccctcgggctccaaggcctgaactaacaactgaggcgggagaaccagcacgaagatgtgtacctccctacgagcaccggcccggaatgcagtgtgctgttacaactcccccgccgtcatactacccatatccgaaccttagatgggacacaagtcacttcaagaagtctggtggtccccagagaaacaactatgttatccatcctgagtttgtgtctgagacctatcccgactatcgttgctggtagagcctgggcttgctgtgccaagggggcagagcaataaataaactcttcaaccccaaa

SEQ ID NO: 2067 - DNA, 1692 bp, Homo sapiens
agaaagaaggggagaagaagcggggggatgggtggagggtagaggggagaaaaatacgtgacaaagaaaacattctctgcctgggaggagactctctgagggtgtagagctagagggagcattcactggccatgccagtagttaccactgatgctgagtcagaaacaggtatcccaaaatccctttccaatgagcctccctcagaaaccatggaggaaatagagcacacatgcccacagcctcgactgaccctgactgcacctgccccatttgctgatgaaaccaactgccagtgtcaagcaccccatgaaaaactgaccattgctcaggcccgcttaggaacaccagctgacaggcctgtcagagtatacgccgatggaatatttgacctcttccactcaggtcatgcaagagcccttatgcaagcaaaaacactgtttcccaacagctacttgttggtaggagtttgcagtgatgatctcacccacaaattcaaaggtttcaccgtgatgaatgaagccgagagatacgaagctctcagacactgtcgctacgtagacgaagttatcagagatgctccctggacactcacgccagagtttctggaaaaacacaagattgactttgtggctcatgatgacattccgtattcctctgctggctctgatgatgtttacaagcacataaaggaagcagggatgttcgttccaacgcagagaacagaaggcatctcaacatcggacatcattaccagaattgttcgtgactatgatgtttatgcccgacgtaacctccagagagggtatacagccaaggaactgaatgtcagctttataaatgagaagaggtaccgtttccagaaccaagtggacaaaatgaaggaaaaagtcaagaatgtggaggaaagatcaaaggaatttgtgaacagagtggaagaaaagagccatgatctaattcaaaagtgggaagagaagtcaagggaattcattggcaacttcctagaactgtttggacctgatggagcatggaagcagatgttccaggagaggagcagccggatgctgcaggccttatccccgaagcagagccctgtgagcagcccaacccggagccggtccccttcccgctccccatcgcccaccttctcatggcttccactcaaaacctcacccccttcctcacccaaagcagcctcagcctctatcagcagcatgagcgagggggatgaggatgaaaagtagaggctgctgggaggcaagagccgcaccatgcaggatggggaggagggcgagagtcacagggttgcctgggtggtgtttgaagggtaatagtcacaggagctgcagctcagcagagagaccctgaactctgctaagggaaggtcttgggaccagttctctctcactctccgtacagctgaagagttgggcgaggtgcagagacttctagctggacaacctacacaaaccttagcgtctagagtcactctaaccttgctaaggaaggatgcagagttccctagagagacttgcactgatggggtgacttctgctttggtccttccaccacccccaccaagtaaaccacctgtggcagcggctgttccctcaacctgctacttctgcgtccataagggtcctgcacgttgcctcccaccaccccagctctgccagaataaaattgtttccaata

SEQ ID NO: 2068 - DNA, 5307 bp, Homo sapiens
aaagggtagaggcctctagagaagataaaaagatcaggagcaggcatggtaggccatcaggagtgcatcatggaagaggacaatcgcgctccccaattgtggcgcaagaccctgactgcacctgccccatttgctgatgaaaccaactgccagtgtcaagcaccccatgaaaaactgaccattgctcaggcccgcttaggaacaccagctgacaggcctgtcagagtatacgccgatggaatatttgacctcttccactcaggtcatgcaagagcccttatgcaagcaaaaacactgtttcccaacagctacttgttggtaggagtttgcagtgatgatctcacccacaaattcaaaggtttcaccgtgatgaatgaagccgagagatacgaagctctcagacactgtcgctacgtagacgaagttatcagagatgctccctggacactcacgccagagtttctggaaaaacacaagattgactttgtggctcatgatgacattccgtattcctctgctggctctgatgatgtttacaagcacataaaggaagcagggatgttcgttccaacgcagagaacagaaggcatctcaacatcggacatcattaccagaattgttcgtgactatgatgtttatgcccgacgtaacctccagagagggtatacagccaaggaactgaatgtcagctttataaatgagaagaggtaccgtttccagaaccaagtggacaaaatgaaggaaaaagtcaagaatgtggaggaaagatcaaaggaatttgtgaacagagtggaagaaaagagccatgatctaattcaaaagtgggaagagaagtcaagggaattcattggcaacttcctagaactgtttggacctgatggagcatggaagcagatgttccaggagaggagcagccggatgctgcaggccttatccccgaagcagagccctgtgagcagcccaacccggagccggtccccttcccgctccccatcgcccaccttctcatggcttccactcaaaacctcacccccttcctcacccaaagcagcctcagcctctatcagcagcatgagcgagggggatgaggatgaaaagtagaggctgctgggaggcaagagccgcaccatgcaggatggggaggagggcgagagtcacagggttgcctgggtggtgtttgaagggtaatagtcacaggagctgcagctcagcagagagaccctgaactctgctaagggaaggtcttgggaccagttctctctcactctccgtacagctgaagagttgggcgaggtgcagagacttctagctggacaacctacacaaaccttagcgtctagagtcactctaaccttgctaaggaaggatgcagagttccctagagagacttgcactgatggggtgacttctgctttggtccttccaccacccccaccaagtaaaccacctgtggcagcggctgttccctcaacctgctacttctgcgtccataagggtcctgcacgttgcctcccaccaccccagctctgccagaataaaattgtttccaatagaggtggcaaagtgcttctgaaatagtcgagaaaaagacagattccaacctcctcagtccagccactgagacctgatgttggaacgcatcagctccttccagttccatgaatgtggctcatagacaaagccttgctttaggctggttataaaaggtcatctagtgtgaaccttaactttttattcaaaggacagttttgtcaagaactccacgtaaggcctgatgtgctcctggttgtactttctcatcactggtttgacttcattgttttgcagaaattaccttaatccgtgggaactgcaacaaagaaaaacttcctaatatataaaaaagaggagctgctttgctttgcctccaggtttagcggacaagaaatgtctcctgaagcttctccttaaaggatgctattatggaatggcttttcccatttctgaccagttaacagtttcatagacctcaagtaacagtttgaggtatcaaacatagtataccaatagggggtgctacctgcacgtatctgttctatatatgctccaatatgtcatccccgggtgtatcccatgtgcaatatgagtatatagtggtggcattttataatagaccccactcctgcgctccaccataatactcctctgaaatccttggtctcaagaaacatctgttctcttgtgacttgggcactttgtcaagcttattccagattcctgtggaaacgttttatcccaaccaggaaattagtattttgttctcgtggcctcctataacatttttgggtgaaggagaactcaagactttttacagagaactgtgggctcagttatgatctcagcatctgaatggtctaggtagtatcaccattatctctggccctaggtttgccaagtaggatgaagactctaagtgttcctgctgagttgtccaaaggtcctgctccttagtcacctgtgcgaaatgagcagggagagttaaggcatagaaccaaactctttgggttattgtatgggtatgccagtaaattcagacacagagctggggtctgactgaatagaggcccaaaccagcaacttgtaggcagagcccagaatctcttgtgatagaaataccccttttcagaggccttgggaaccagccttctaggtgacaaggggacaaccagtgaaggaaggcggcatgtctttccccttcttgttggggttgaactacctccctatccacttggagatgagtgctgtctgctgtgaagcaaaactatgaggctgagctggcttggaacctctttgttcttggcactttccttctccaggactctgggaagcactcatatgggacagagggctggcaggaacatggcatgtgaagaagaaaacttctttttgcagtcaagggccacccagaatattgctcttcagagagggacaagggcctcattcttccatttggtctctgtcttccatcatgcactcaggtcaagccatgcaagtctgcctaccatttgagttagttggcacttgtagcagtgaaggatgaggccagccaggcaagggaaggtggcgggaacaagggaagagaaaaggaggaaagaagttcctggagggaggaaaggaggataaagaaaatctgctctcataaaaccatttcaggacctcactttacaggtgagactctcttgggaaggcctttgtgcccctgctccatggcccagggcagatagattcacttttacctgaatcttatactctggagcaaatagtgtatcaggctgactatacatttgcaggccttacacgccatactgacaggtgccacttacgtgactcatcagataatgtcaccattgctgccaattatgggaaataactaatgcctattccagggatgagcccaaaccacacataaatgggttctaaatctcaccctcctaacctgcagtgagtccccccgttccaccctcttgaggctgcaaatctactgagaaggaatgggaaggattctacaacccaacttttgatactttttggccatctctcagtctctcccagcccctacccccacaccacctccctgctcccaggcagagaccgggttgcactttgttagggccagcaggtcaactgtaatggccaagagtgagttaaggctggaatgagaaatatgccccaagcttggaggggtaagcaggaataacacaaagcaaggaaagagattctttttgccctagtgaggaaaggaagcttcagaatgagggctggaggatagcaacttaggactgcagaagggggcagcttatgaagatgggagaaagtgggactgaagttgtaggggagcaggagggtagtgattttccgcttttctttctttctttcttttactttctttctctttctttctctctctctctctttctttttctttcttctttctctttttctttcctctttttctttctttctttttctttctctttcttccttctttctttcattcttctttgttctttcttctttctttctttttttttttttttgagatggagttttgctcttgttgctcaggctggagtgcaatggcacaatctcggctcactgcagcctccacctcccaggttcaaggggttcttctgcctcagcctcccaagtagctgggattacaggtgcctgccacgacacccagctaatttttgtatgtttagtagagacggggtttcaccatgttggccaggctggtctcaaattcctgacctcaggtgattctcccgcctcggcctcccaaagtgctgggattatgagcacgagccacggcgtccagccgattttccgctccctttcaagtgttaactcaccccctgacaggtgaagagggaagggttccttttacgcacaaccaaggttagcaaatgcccatgcaggatatggggtccctgcctctctggttgcttcatttcagcacttctatattagctgcttatggggaccctaaaatgaactggtcacccctccaccagctaagaaacaagggtgggattgctgtgccataagtcacactgaacgacttgcttctggcaagcatgctcctgtgtgtcaggaccttaccaaggcaaagaaatgccaggctcaagaggagcaggacgtgagacattggcctggcttctaacctggtctgagtggaagagacacagcttagggatttcagttttgctcttaggctactagatactgttatttcaccccctgagggagggacaggaagagcacggatttattttctctccgtcttcagtacttattttagcatctagtcataccccagggagagatgcgagacggtgtcactggctcagctgaagcagatgagcccgtctctagcagagatgtgcctgtttcttaggcatccgttcagcactagtcttggccatcagatttttaaaaaagaaatagctcatgaggcatttgcaacttctcctctctagacttctttctagttttcctctgttgtgtcactgcgatgtgtccagggacaaagccataagtagagcatacatacttaagactatgctgtacatataagacaagacctgtctgggttaaagcacgaccttatgcccaagcatttactctggtgctgaataacgcgaactactggaatcagcctcccccaactctgcgcgccccctgcccccctgctcctatcccattcttgctctcaaatggaccacaccattctcaactcgtttataaataaagggatgcagaattgca

SEQ ID NO: 2069 - DNA, 715 bp, Homo sapiens
atggctgataaatccaaatttattgaatacattgacgaagctttagaaaaatcaaaagaaactgcactctctcatttatttttcacctatcaggggattccttaccccatcaccatgtgcacctcagaaactttccaagcgctggacaccttcgaagccagacatgatgacatcgtgctagcatcttatccaaagtgcggttcaaactggattctccacattgtcagtgaattaatatatgctgtttctaaaaaaaagtataaatatccagaattcccagttcttgaatgtggggattcagaaaaatatcagaatctggctgctggaataaaacagattgctgagttcttgggattctttctaactggggagcaaattcaaactatctcagtccagagcaccttccaagccatgcgtgcgaagtctcaggacacacacggtgctgtcggcccattccttttccgcaaaggtgaagttggtgattggaaaaatttgttcagtgaaattcagaaccaggaaatggatgaaaaattcaaagagtgcttagcaggcacctccctcggagcaaagttgaagtatgaatcatattgccagggttgattccagtcaattcagcaggcctagatttattttccttaataataattaagtgtaaataattaaatgataattcaatcaaataatcaaataataattaaacaatattgaaatctaa

SEQ ID NO: 2070 - DNA, 9233 bp, Homo sapiens
gaggagagggcgcgttagtgagcagcgactgtggcattgatgtttgagcatacttctgaactggcttttgttgagactatcagtatagaagcatgcgctgtcccaaatccgctgttactatgagaaatgaagagctgcttttaagtaacggcacagccaacaagatgaacggagctttggatcactcagaccaaccagacccagatgccattaagatgtttgtcggacagatcccccggtcatggtcggaaaaggagctgaaagaactttttgagccttacggagccgtctaccagatcaacgtcctccgggaccggagtcagaaccctccgcagagtaaaggttgttgtttcgtaacattttatacaagaaaagctgcacttgaggcccagaatgcactgcacaatattaaaactttacctgggatgcatcatcccattcagatgaaacctgcagatagtgaaaagtccaacgctgtggaagacagaaaattgttcataggaatggtatcgaagaaatgtaatgagaacgacatcagggtgatgttctctccatttggccagatagaagaatgccggatcctccggggacctgatgggctgagtcgaggctgtgcgtttgtcacattttctacaagggcaatggcacagaatgcaatcaaagccatgcatcagtctcagaccatggagggctgctcttcacctatcgtggtgaagtttgctgacactcagaaggacaaagagcaaaggcgcctccagcagcagctcgctcagcagatgcagcagctcaacactgccacctgggggaacctgacagggctgggcggactgaccccacagtatctggcgctcctgcagcaggccacctcctccagcaacctgggtgcgttcagcggcattcaacaaatggcaggcatgaatgctttacagttgcagaacctggcgacgctggctgctgctgcagctgcggcccagacctcagccaccagcaccaatgcaaaccctctctctaccacgagcagcgccctgggagccctcacgagtcccgtggctgcttcaacccccaactccactgctggtgcagccatgaactccttgacctctctcgggactctgcaaggactggctggagccactgttggactgaataatattaatgcactagcaggtatggcggctctgaatggaggacttggcgccacaggcttgacgaatggcacggctggcaccatggacgccctcacccaggcctactcaggaattcaacagtacgcagccgccgcgctgcccactctgtacagccagagcctgctgcagcagcagagcgctgcaggcagccagaaggaaggtccagagggggcaaacctctttatttaccaccttccacaggaatttggagaccaggacattctgcagatgttcatgccttttggaaatgttatctctgctaaagtcttcattgacaaacagaccaatctgagcaagtgctttggttttgttagctacgacaatccagtctctgcacaagctgctatccaagctatgaatggctttcagatcggcatgaaacgcttgaaggtgcagctgaagcgttccaaaaacgacagcaaaccttactgatcctaaccccagaggctccctgctctcattttagctttcttagggtaagtcccacgagccagcctgtctcaacagggaaggcagaggaggaccacattgccaacttttaccaagagagacggttatttttacaataaggcctccatgtccccacccacttcccctacccagtttgccataattaaaacttgggctactttgtttctattgagtaattcctcctccagttgtgccactgtattctcctttgttttgcgatttgaatctccttttacctttttttttaatttttttcatttttgcttttttttaaagagaagcatatacacaaataaatggcatcttgagaatttaaaaggcaaacaaacaaacgctaatgtgcaattctaactctgaaaccactggtgccccgagagcactgcctggagaattcacccctccttgcccggcgcccgcccccggagggagggcccggtgcttagaggttaacttggtggcctaggagagggagaagccaggagaagcacttactccaaccacacgtctttccactacatcggcttgttttactaagtaggattttattttagggttcaaagaaacatgacatttattggtcaaaatattacactggttgtctattttgttattgttttattttagtttttagaaaggattaatgtacaaaaagatttagagatctgtttcttaaagctacagggtttaaaaaataaaaatgagtgaaaatacttgatgtttcttgaaagataaatttaataataataaataaatacataaatacataaataaaaaagaaagccacaggcctgtaaattttatttgtaaaaaagcatttctatttttatacaaaatttttactgcctcagaaataatggaagttatttattgcctattgttaacttattgggtacctaaagagcagttctctgtctagctagaaccttctgaagtagtctctagaggaattgttctaggaatgggctttttttcaccgttgaaccctagacctgaagttcatgctttatcctctcgttgtttgtatctgtctgattattttgtttgtaacttccattatctagtttacagttcagtcgtctgactttccccgtatgtcacatttgttgaaactggaccttctccccctgtccctcaccccaaaacacccggaatccatcccgtttcgctctctccagatggattctcttggggtttcattgtgctgtggataaggagtgtaagaaatgcaaattatgtgaatggctcggagactccctaatgacctaagatttgcattagtttttctcctgcacccttaaaagtgattttgttgccgctgcatagattctgtgtaactttttactcttccttgttttttccctagacatcttcatgcccgttagttcatcgtttgcctagcatgtccctgtggcgtctcaaaaaaaagtttcatcgtcccgtcattgtttctgatgtctttctgacctcacatcatatttggttctcctactgacctttgatctagtttgacctttgaaatttgcatgtgacctcatctagctatgaattctgggaagtcaatgtgaaaaacattgctgcattcatgcaagactgaaatttattattagacaaattcattatagaaaaaacctgtggcaaaaacgtttctttcttattttttttcttttcctaaaacagacttgaaagtattatacagggattggcattcttcccggtcactggtaacaatagcaatatgtgtccagggacacagaatgttggtttctaacagactacttccaaaaacagtttgagaaaaaaactgtctgattttaagtctctagaggtctgtaatagtttttacatttttcaggcagtgtaaagttttttgataaggccattttaggtggctcactttctcattaagatatatatatagaaccactttttgtagattagtataagaaaaatatttaccctgttttggggcaaatgctacctatttgtgtcaccttttgctgaactcacagttagacaatccatggtttaatgcacatgaaattacctatattttatactgtttcaatgtacaggagaaaggttactgtaaactgtgttatgttggtgcttctgtgaattaagttgtggtttcatcatgagtcttaatgttctttgttgataagacaagtttagaattggtttacttaatacaaaaaaaaaaaaaagaatttcaaaaaaaaaagttgtttgcttaaaaaaaatttcatgtgagggaaaaaaaaaaaacctattccagaataagttttgtgttggcttgtgaagcattgatgtcattttttttaattgtggactatttagatgtgtttgtgttcagcaaaatgtgatgtttttttcttttaaagaaaaaaagtgaaaatatatagtgccaaattccaaaggtacttccttcctagagcttcagtgtgtttcttgtgagaagtaatttgataacatgggtattttattatgtgttttgtataaatccctaatatttaaaaaaaaaaacaaaacaaaaaaaggttacaaagtttgttaacttgctatcctgtggtcttgttgcctgaaattgttattgtttgttatttctctctgatgttttttgtaagacattgtataagtgcccatgtcccacttttttaaccactccgcacatcagtgctgtgaaggcaacctcaccatgtattttcttcataatctatggaaacctctaaggtgagaaagttttgaacttttaaccctttctacccagagctatctggaatgttgatgactttttatactgtcatgatttgagtttgttttggggtgtttccaatttggatttttttccctgcatctatcctctaagttgtttcggtttgactactttgttctttggttaagatccaaaagaaaacagaaaacaattccacgaggccaatctaaagggaaaaaatcctacactacttttactacttttgattatttctcatttttgggaaaagaattcctaatgtgctactagaattccttcttcagttttaacgagtaattggataaaccctgagggaaaacggaggtagattcagcacctaacaatcctgtatgcttttgagatcacgtttagtgctatgtcctagtctagaatattttcatataccttgcagtaaaacgactttgtggcaggacagtctcttgaggggttttgtttctgtttcctaaatactcctaaataatatttctaatcagccattatgctggggcatctctgatcccagtaggtacctctgaatataccaggtgtctggagttagaagcccatagccctttcccagcctttttggtttttttaattgaacacatttcatctaagtaaagctcagttctttatcacaatttactgaccaaatacctagcaccagttcctgctgccactttttaaagtgccatatgactttctacgaacaggtaccttgctgtcttgacaaatcctaatgtcacgcctacagccccaacacaagctccagtcttcctcttcggcatgccctggaagcttcttggcctcagctccccttccccgctcagcaccctgttaggatcagtgtgtgtggatgggatagccctgggatggaaaggactagcctctactgatgcaaaaaaacaaaaagcaacacaaacgtttccttcttatagcacatgcacttccttacaatgacatgatttgtattatcctcacatgtgtttactactgctggggccttccttcatcctctgagggctattttgtactttctgcagcaatcagcttaataacaacacttattgcacctgtctctctctgagaacacggtgtgtctcgacacgtaccacgtacgtggaaacacaagagcccaccacttgaatttctaagaccatttcattctgaaacttcttatcaattacctaaatctcaacgaaaaacaatttactgaagccgactcccctccccatctccctctcaacctcaacccacctgcatgcatctcccccagaggaaacactgagggtaggggacaggaggctcaggacgcgccctctgaatcgagtgtttcttcttcacaagtcaccaagagaggacatgagggggaaagtcctttttgcccttctccaaaaaataaccttccacagagacaaactgtccttctatccacttttatcttttaataaatatcaaaaggaaaaagctgcaagggtgcaaagggcctgtgccagaagaaaacacacacagggaaaccgctttttttaatcaattgtagagaatagtcatttttaatctaaattagagaattgtgatacaatggcagtcctcaaaggcgtaacgagttcatctttctttcaccataggggttatagttggcttgtgctactctggaatcattttactgtttgtttttattatcttaagtgctaattaaaaaaaaaataaaattttaaaaaaacctgtagtttcattacctttttgaataatgtcatacaaaaaatgtatttgtttttttgtgctgtgagaattgatgtttgtagattaataatcattttgtttagaattacaaaatagtttttaaatattgtctgagaaaagccaaagttaatgcaacctagtggaaactgtaagaccatttgagtattgtttgttttattgatgcatttggattttgttgtttgatggaatttgagccaaaaaaaaaatacgcaggctttcctatttctacaactgattgtacttatgcattttgtaccagtggaactttttatactggagattaaaaaaaaaatggaaatttttgtggcttgctctggtgggcccctgacaatgactgatttcaagtttgatttcgggttgattgattgattgattgatagaaagaaagttgcttttcttttgagaattaaaaactttggcttgatttcttttttccctttgcttatatctagcattagaattttgtcttaaaataacagcggtaagtttcactttttattctgtattgtgcagttacacaataaggtaattagatttagaagtactcagtcactttaagtggataaatgtattagttaaaactttagggtttgcttttttgctgtttagatcaaagttttttctgattcttctgtcctcattgtgaacataaccgtgtagttgaaacagtcaaacttatttttgtaatgtatgttattgtgtgatgcagttttttgcttctgtctccaatattaaaccattttcctaatacttgtttctctctctgcgtgttgtattgttggtagtcattatatgttggtgatacatctgcacacctcactgtttcacgtatctgtttttttctctatgttgtgtaaaaagatacagtcgattccacttaagtgaatatctgatttggggaagaggaaactgcacagcagccacctttgatttatgtacaaccgcccacttgaactcctgcttccaagatttatacacttttttcctacagttcacctcagtaactgcctttggggttggatttgccaaggtgttttacggtcttttgaccacacaggttaatttccccttctctcccctccctcatgagtctatccacgcagttcttaacatacattccaaactgctgcggggtttcctctccacacccacgaggccaaacccgcatcattacagtccaactcttcttagacactaatcactttctaaaagaagtgagttctccagggaagaaaaatcaacttagccagtgaaaagggttaaacttaagtctattatttgttgccctcaatcaaaagatatgtatagaaaagtcatttaaattatttatttctacaagctaattgaatccaggagcagctttaattattaacactaacggaagagaaaagaagtatttccaagggctcaaatggaagctgtactcagtccggtggaggcagggggaggtaaagtttctcacactcaagtcgtcttcatagtttactgtccttttccaaacaaaagctaataacgccatacgcatccacacactccctcctggatgaacctaagtctcgtccccactgtcaccccaaggccagttatcaaaaactgttccttctctgccctcaaagactgaagccgcaggccctgttctgcctctgctcaggaatctgattgctcttaaagtgctcttacaagattccgtcgatgtttgctccctctgtcttatctctccttccagtattttcagacgcacaagctctgactcaggccacccagcacctggcagccttcctctgcgtgccagtgaaatctctcccagtaggtgctcaggctcttcaccctctcgttgcagcagcccctctggcccgagattgtattttctagtctgctcaagaacagaggggcctggcgaggtggaggaagggaggctccctccccggggctggccgcctcagtgatggtgatgccaccagctccagcctgcacggatggagctcacttcctaccatcacttctgctttcagtctcctcatagccttcggcagtctcctctgaaaacacactgcctacgttagtgggaaaggatggctaagggtgtgatttctttttattagggaggtgggagggggatgttgggaggcatggggggtgattaaattatcatttccaaggtgcaagtgtttatttttcaaatctataagtacatagttccaccattttggcacaagacaaaatactcatgctaagcaaaggaagagaaagacaaagccagtttttgttgcttttctaaagcaacaaataattctccaaagaaggggatgaaaatgctagttcctttaagcacttactgactgtaaagttggtccctgcttaaattcatacccatagttttgagtcggtatgacaccactgcagtgtgagcaaggtgaatccgtgtgccatgcatggaccaccttgggataccgcagcaccatcaacatccgccttgctgatggaagccacacacgctgcccagcccacagcagtcgcacgcagccgatgggctcggactcttagctggcaggctaggacacacagtgaacattaatgtactgtgaatcgttcctgataagtgaataaaacattgtgaccaaacaatcagcttattcacttatcaggaatcgactgttctgctaatttgctgttgttgtttttcatctctgttgtagttcactatttttgctgtgttctgttttctcctctcatgcttgggcaaatcactgggaatattatcttcatgtgaccatgaaacgtttctattgagtgaaaatgatatcttaacaaaatctatgcacttgctatcaggaacacaatactggatgtgtcttatatatattgaactatatagtactcgatttcttaaataaagcttaagaaaggactctgttgtgtgtaaagttaatgtgattatttttcaaagcagtgtttctaaggggtatttttgttcttttaagtcttgagtgatacaggatatttttcattaaaattatatcactggctttatgacttaatattcaataaattgactttgg

SEQ ID NO: 2071 - DNA, 2114 bp, Homo sapiens
acagcccggcccctgccctgcaccaggccactgccctgttggtgaggagggtcggaggggcgacctccctgccccctgctccaagctccccacccccacctggaacctgccggcaggaagcctggccctggagggtggtcacggcccctccccagatgcccggcccacgagaggccaatggggagcagccaggaggagggactccggtgtcagccaagccagccagaccacgacgcagatggacactgtgggccggacctggagggggcagaaagagcctctgccacacccggaccccctgggctcctgaacagccaccggcctgcagactcggatgacactaacgccgccgggccctcagctgccctcctggaggggctcctgctggggggtgggaagccatcgccccacagcacccggccggggcccttcttctacattggaggcagcaacggggccacaatcatcagctcctactgcaaaagcaagggctggcagcgcatccatgacagccgccgggacgactacacgctgaagtggtgtgaggtcaagagccgagacagctacggcagcttccgggaaggagagcagctgctgtaccagcttcccaacaacaagctcctcaccaccaagatcgggctgctcagcacccttcggggacgggcacgggccatgagcaaggccagcaaggtgccggggggggtccaggccaggctggaaaaggacgcagcagcgcccgccctggaggacctcccgtggacaagcccaggatacctcaggccacagagggtcctgagaatggaagagtttttcccagagacctaccgcctggacctcaaacacgagagagaggcctttttcaccttgtttgatgaaacccagatatggatctgcaagcccacagcctccaaccagggcaaaggcatcttcctgctccggaaccaggaggaagttgccgccctgcaggccaagacccggagcatggaggacgaccccatccaccacaagacgccgttccgggggcctcaggcgcgggtggtgcagaggtacatccagaacccgctgctggtggacgggagaaagtttgacgtgcgctcctacctgctcattgcctgcaccacaccctacatgatcttctttggccacggctatgctcgcctcacccttagcctttacgacccccattccagcgacctcggcggccacttgaccaaccagttcatgcagaagaagagccctctgtacatgctgctgaaggagcacacggtgtggagcatggaacacctcaaccgctacatcagtgacacgttctggaaggcccggggcctcgccaaggactgggtcttcaccaccctcaaggtgcgtccactgtgccctccagtctgggagtgagatccctcggggcgggggtgtgtggtcaggctgggcaccaggcacacagatgtccgtggcgtgcgtgggcggctgcgctgaagtgtgacctgaccgtgtggaaccaaacccttccagcgtctctgctcacttagctggcagtgcctgtccccagcagccagcaaaggcccggacggaaagcccagtcgggggtctgtcggcacgagtcccgcgggcagcctcgccgtagggtcaggggacagctcggcttcagtgacagccaccatgtgaagagtctttgttcctttcagatcctccacttggcaggcagggccaacagcagcccccgggccaggtgtcctggagcagcagcagctgcccgtgcaggcccggactctccctagctaagggccatgtgcggtggagtgtcctaattttgcagggttcctttctgtgggggtacctgtggggtacttcaaacagccctagcagcaaaggcccttgagcagcgcggtgtgaaactgggataaaaacggggcttggccgaaggacttttatctgtcttggtcaccccggccaggccccggaagcagcagccagggatggtccttcctcacccacaggcgtgtgtcactgtggctgggacggcagcgctcagaggagcctccagttactttcctcacatctcccaaactctctcttaattgcgataattcacagaacataaaattcacgatcttaaa

SEQ ID NO: 2072 - DNA, 2259 bp, Homo sapiens
aggaccttgtgggctgggcagcggcctccggccgggaggcaccagctcttcgaacaatgtttaaaagtctcttctgttcatcctaccggggtgccgtctcctgccggtcttttcatctcaccagggccctcgcccgggcaccccccggccaatggaccacagctgcacccggttcatccaccgccggggaccacccactcggacccgagccggcttcaagaggggcaagaggccaaggatccagcagaggcctcgggctcgagtctcagggaccatccctgcgtcacgtctgcacccagcaccggcctcacagcccggcccctgccctgcaccaggccactgccctgttggcccggcccacgagaggccaatggggagcagccaggaggagggactccggtgtcagccaagccagccagaccacgacgcagatggacactgtgggccggacctggagggggcagaaagagcctctgccacacccggaccccctgggctcctgaacagccaccggcctgcagactcggatgacactaacgccgccgggccctcagctgccctcctggaggggctcctgctggggggtgggaagccatcgccccacagcacccggccggggcccttcttctacattggaggcagcaacggggccacaatcatcagctcctactgcaaaagcaagggctggcagcgcatccatgacagccgccgggacgactacacgctgaagtggtgtgaggtcaagagccgagacagctacggcagcttccgggaaggagagcagctgctgtaccagcttcccaacaacaagctcctcaccaccaagatcgggctgctcagcacccttcggggacgggcacgggccatgagcaaggccagcaaggtgccggggggggtccaggccaggctggaaaaggacgcagcagcgcccgccctggaggacctcccgtggacaagcccaggatacctcaggccacagagggtcctgagaatggaagagtttttcccagagacctaccgcctggacctcaaacacgagagagaggcctttttcaccttgtttgatgaaacccagatatggatctgcaagcccacagcctccaaccagggcaaaggcatcttcctgctccggaaccaggaggaagttgccgccctgcaggccaagacccggagcatggaggacgaccccatccaccacaagacgccgttccgggggcctcaggcgcgggtggtgcagaggtacatccagaacccgctgctggtggacgggagaaagtttgacgtgcgctcctacctgctcattgcctgcaccacaccctacatgatcttctttggccacggctatgctcgcctcacccttagcctttacgacccccattccagcgacctcggcggccacttgaccaaccagttcatgcagaagaagagccctctgtacatgctgctgaaggagcacacggtgtggagcatggaacacctcaaccgctacatcagtgacacgttctggaaggcccggggcctcgccaaggactgggtcttcaccaccctcaagaagcggatgcagcagatcatggcccactgctttctggccgccaagcccaagctggactgcaagctgggttactttgacctcattggctgtgacttcctgattgatgacaacttcaaggtatggctgctggagatgaattctaacccagccctgcacaccaactgcgaggtcctgaaggaggtcatcccaggtgtggtcatcgagaccctggacctggtgctcgagaccttccggaagagcctgcgcggccagaagatgttgcctctgctgtcccagcgccgcttcgtgctcctgcacaacggtgaggccgacccgcggccgcacctggggggctcgtgcagcctccgccgctggccgcccctgcccacccgccaggccaagtcctccgggccacccatgccgcatgccccagaccagccgggcgcccgcaggcctgcgccacctcccttggtgccgcagcgtccccggccacccggccccgacctggacagcgcccacgatggggagccccaggccccgggcacggagcagtcgggcacaggcaacaggcacccggcgcaagagccttccccggggacagccaaggaggaacgcgaggagcctgagaacgcgaggccctaggggcagccacccgcgcccagcgccccgcgccccgcgccccagccgtgctgcctgccctcagggacctataaagcccactttgctac

SEQ ID NO: 2073 - DNA, 2283 bp, Homo sapiens
cccaggaccttgtgggctgggcaggtcgtgcgtcctttgacagcggcctccggccgggaggcaccagctcttcgaacaatgtttaaaagtctcttctgttcatcctaccggggtgccgtctcctgccggtcttttcatctcaccagggccctcgcccgggcaccccccggccaatggaccacagctgcacccggttcatccaccgccggggaccacccactcggacccgagccggcttcaagaggggcaagaggccaaggatccagcagaggcctcgggctcgagtctcagggaccatccctgcgtcacgtctgcacccagcaccggcctcacagcccggcccctgccctgcaccaggccactgccctgttggcccggcccacgagaggccaatggggagcagccaggaggagggactccggtgtcagccaagccagccagaccacgacgcagatggacactgtgggccggacctggagggggcagaaagagcctctgccacacccggaccccctgggctcctgaacagccaccggcctgcagactcggatgacactaacgccgccgggccctcagctgccctcctggaggggctcctgctggggggtgggaagccatcgccccacagcacccggccggggcccttcttctacattggaggcagcaacggggccacaatcatcagctcctactgcaaaagcaagggctggcagcgcatccatgacagccgccgggacgactacacgctgaagtggtgtgaggtcaagagccgagacagctacggcagcttccgggaaggagagcagctgctgtaccagcttcccaacaacaagctcctcaccaccaagatcgggctgctcagcacccttcggggacgggcacgggccatgagcaaggccagcaaggtgccggggggggtccaggccaggctggaaaaggacgcagcagcgcccgccctggaggacctcccgtggacaagcccaggatacctcaggccacagagggtcctgagaatggaagagtttttcccagagacctaccgcctggacctcaaacacgagagagaggcctttttcaccttgtttgatgaaacccagatatggatctgcaagcccacagcctccaaccagggcaaaggcatcttcctgctccggaaccaggaggaagttgccgccctgcaggccaagacccggagcatggaggacgaccccatccaccacaagacgccgttccgggggcctcaggcgcgggtggtgcagaggtacatccagaacccgctgctggtggacgggagaaagtttgacgtgcgctcctacctgctcattgcctgcaccacaccctacatgatcttctttggccacggctatgctcgcctcacccttagcctttacgacccccattccagcgacctcggcggccacttgaccaaccagttcatgcagaagaagagccctctgtacatgctgctgaaggagcacacggtgtggagcatggaacacctcaaccgctacatcagtgacacgttctggaaggcccggggcctcgccaaggactgggtcttcaccaccctcaagaagcggatgcagcagatcatggcccactgctttctggccgccaagcccaagctggactgcaagctgggttactttgacctcattggctgtgacttcctgattgatgacaacttcaaggtatggctgctggagatgaattctaacccagccctgcacaccaactgcgaggtcctgaaggaggtcatcccaggtgtggtcatcgagaccctggacctggtgctcgagaccttccggaagagcctgcgcggccagaagatgttgcctctgctgtcccagcgccgcttcgtgctcctgcacaacggtgaggccgacccgcggccgcacctggggggctcgtgcagcctccgccgctggccgcccctgcccacccgccaggccaagtcctccgggccacccatgccgcatgccccagaccagccgggcgcccgcaggcctgcgccacctcccttggtgccgcagcgtccccggccacccggccccgacctggacagcgcccacgatggggagccccaggccccgggcacggagcagtcgggcacaggcaacaggcacccggcgcaagagccttccccggggacagccaaggaggaacgcgaggagcctgagaacgcgaggccctaggggcagccacccgcgcccagcgccccgcgccccgcgccccagccgtgctgcctgccctcagggacctataaagcccactttgctacaa

SEQ ID NO: 2074 - DNA, 693 bp, Homo sapiens
gcggcggcggcagcggcagcggcagcggcgctgagttttgtctcccgggccgtctgggcgcgcgcgggtgtcccaggtaccccgccgcctccctccttcccgcaggactcgtccctcctggccctgggccccaacggtgcccgcctgcccggcggtcggtcagcgcacagggcacggcttcctctgcttctcccggaccacttagtctcaacccgggtgtgtttgcactactagagactcacttttccccttcgtctttctctccctttctgtctttctgtgtctcctccaagaatgaaatatgactgaggactctcagagaaactttcgttcagtatattatgagaaagtggggtttcgtggagttgaagaaaagaaatcattagaaattctcctaaaagatgaccgtctggatactgagaaactttgtacttttagtcagaggttccctctcccgtccatgtaccgtgcattggtatggaaggtgcttctaggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatga

SEQ ID NO: 2075 - DNA, 1276 bp, Homo sapiens
gcggcggcggcagcggcagcggcagcggcgctgagttttgtctcccgggccgtctgggcgcgcgcgggtgtcccaggtaccccgccgcctccctccttcccgcaggactcgtccctcctggccctgggccccaacggtgcccgcctgcccggcggtcggtcagcgcacagggcacggcttcctctgcttctcccggaccacttagtctcaacccgggtgtgtttgcactactagagaatgaaatatgactgaggactctcagagaaactttcgttcagtatattatgagaaagtggggtttcgtggagttgaagaaaagaaatcattagaaattctcctaaaagatgaccgtctggatactgagaaactttgtacttttagtcagaggttccctctcccgtccatgtaccgtgcattggtatggaaggtgcttctaggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatgatgaagtgtttcttgccatagctaaagccatggaggaaatggtggaagatagtgtcgactgttactggatcacccgacgctttgtgaaccaattaaataccaagtaccgggattccttgccccagttgccaaaagcgtttgaacaatacttgaatctggaagatggcagactgctgactcatctgaggatgtgttccgcggcgcccaaacttccttatgatctctggttcaagaggtgctttgcgggatgtttgcctgaatccagtttacagagggtttgggataaagttgtgagtggatcctgtaagatcctagtttttgtagctgtcgaaattttattaacctttaaaataaaagttatggcactgaacagtgcagagaagataacaaagtttctggaaaatattccccaggacagctcagacgcgatcgtgagcaaggccattgacttgtggcacaaacactgtgggaccccggtccattcaagctgaacgcacccgctggttgtggaccgtctgccaggcaccacagtgagcattgtgttcttggcatgtgatctgggaaactgattgaataatacacttttcttgctttggtgctcaaagtggtttttttcccccaataaaattatttaattgaaa

SEQ ID NO: 2076 - DNA, 1045 bp, Homo sapiens
gatgtcacgtccggcggcggcggcagcggcagcggcagcggcgctgagttttgtctcccgggccgtctgggcgcgcgcgggtgtcccagaatgaaatatgactgaggactctcagagaaactttcgttcagtatattatgagaaagtggggtttcgtggagttgaagaaaagaaatcattagaaattctcctaaaagatgaccgtctgggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatgatgaagtgtttcttgccatagctaaagccatggaggaaatggtggaagatagtgtcgactgttactggatcacccgacgctttgtgaaccaattaaataccaagtaccgggattccttgccccagttgccaaaagcgtttgaacaatacttgaatctggaagatggcagactgctgactcatctgaggatgtgttccgcggcgcccaaacttccttatgatctctggttcaagaggtgctttgcgggatgtttgcctgaatccagtttacagagggtttgggataaagttgtgagtggatcctgtaagatcctagtttttgtagctgtcgaaattttattaacctttaaaataaaagttatggcactgaacagtgcagagaagataacaaagtttctggaaaatattccccaggacagctcagacgcgatcgtgagcaaggccattgacttgtggcacaaacactgtgggaccccggtccattcaagctgaacgcacccgctggttgtggaccgtctgccaggcaccacagtgagcattgtgttcttggcatgtgatctgggaaactgattgaataatacacttttcttgctttggtgctcaaagtggtttttttcccccaataaaattatttaattg

SEQ ID NO: 2077 - DNA, 4116 bp, Homo sapiens
ggcgcctgcggcggcgacagcggcagctgcggcgcgaccaggccgggcacctccgagcgcaaggacagcgcgaggtccgcgcagcccagcgcagccatggagccccgcgcggactcactctatgatgtccctgtcggtgcggccgcagcgccgtctgctcagcgcccgggtcaataggagccagtccttcgcaggcgtcctcggcagccacgagcgggggcccagcctctccttcaggagtttcccggtcttcagcccgccggggcccccacggaagccccccgcgctctcccgagtgtccaggatgttttccgtggctcacccagccgccaaggtgccgcagcccgagcggctggacctggtgtacacggcgctgaagcggggcctgacggcctacttggaagtgcaccagcaggagcaagagaaactccaggggcagataagggagtccaagaggaattcccgcttgggcttcctgtatgatctggacaagcaagtcaagtccattgaacgcttcctgcgacgactggagttccatgccagcaagatcgatgagctgtatgaggcatactgtgtccagcggcgtctccgggatggtgcctacaacatggtccgtgcctacaccactgggtccccgggaagccgagaggcccgggacagcctggcagaggccactcgggggcatcgcgagtacacggagagcatgtgtctgctggagagcgagctggaggcacagctgggcgagtttcatctccgaatgaaagggctggctggcttcgccaggctgtgtgtaggcgatcagtatgagatctgcatgaaatatgggcgtcagcgctggaaactacggggccgaattgagggtagtggaaagcaggtgtgggacagtgaagaaaccatctttctccctctactcacggaatttctgtctattaaggtgacagaactgaagggcctggccaaccatgtggttgtgggcagtgtctcctgtgagaccaaggacctgtttgccgccctgccccaggttgtggctgtggatatcaatgaccttggtaccatcaagctcagcctggaagtcacatggagccccttcgacaaggatgaccagccctcagctgcttcttctgtcaacaaggcctccacagtcaccaagcgcttctccacctatagccagagcccaccggacacaccctcacttcgggaacaggctttctataacatgctgcgacggcaggaggagctggagaatgggacagcatggtccctgtcatctgaatcttcagacgactcatccagcccacagctctcaggcactgcccgccactcaccagcccctaggcccctggtgcagcagcccgagccccttcccatccaagttgccttccgcaggcctgagacccccagctctgggcccttggatgaggagggggccgtggccccagtcctggcaaatgggcatgcaccctacagtcggactctgagccacatcagtgaggctagtgtagatgctgccttggctgaggcttcagtggaggccgttggcccagaaagcctagcctggggacctagcccacctacacacccagctcccacccatggagagcaccccagtcctgttcctcctgccctggaccctggccactctgccacaagctctaccctcggtacaacaggctctgtccccacatctacagaccctgccccatctgcacacctagactcagttcataagtccacagactctggcccttcagaactgccaggccccactcacaccactacaggctctacctatagtgccattaccactacccacagtgctccaagccccctcactcacactactacaggctccacccacaagcccataatctctacccttactactacaggccctaccctcaatatcataggcccagtccagactaccacaagccccacccacactatgccaagccctacccataccacagcaagccccactcatacttccacaagccccacccatacccccacaagtcccacccacaaaaccagtatgtcacctcccaccactacaagtcctacccccagtggtatgggcctagtccagactgccacaagtcccacccatcctaccacaagccccacccatcccaccacaagccccatccttataaatgtaagcccttccacttctctagaacttgctaccctctccagcccctccaaacactcagaccccaccctcccaggcactgactcccttccctgtagtcccccagtctccaattcctacactcaggcagaccctatggcccccagaactccccacccaagtcctgcccattccagtaggaaacccctcacaagccctgccccagatccctcagagtctacggttcagagtctaagccccactccctcacccccaacccctgcaccccagcattcagacctttgcctggccatggctgtccagaccccagtcccaacggcagccggagggtctggggacaggagcctggaggaggcactgggggccctaatggctgccctggatgactaccgtggccagtttcctgagctgcagggcctggagcaggaggtgacccgcctagaaagtctgctcatgcagagacaaggtctgactcgcagccgggcctccagtctcagcatcactgtggagcatgccttggagagcttcagcttcctcaatgaagacgaagatgaagacaatgatgttcctggggacaggcctccaagcagcccggaggctggggctgaggacagcatagactcacccagtgcccgccccctcagcacggggtgtccagctctggatgctgccttggtccggcacctgtaccactgcagtcgcctcctgctgaaactgggcacatttgggcccctgcgctgccaggaggcatgggccctggagcggctgctgcgggaagcccgagtactggaggcagtatgcgagttcagcaggcggtgggagatcccggccagctctgcccaggaagtggtgcagttctcggcctctcggcctggcttcctgaccttctgggaccagtgcacagagagactcagctgcttcctctgcccggtggagcgggtgcttctcaccttctgcaaccagtatggtgcccgcctctccctgcgccagccaggcttggctgaggctgtgtgtgtgaagttcctggaggatgccctggggcagaagctgcccagaaggccccagccagggcctggagagcagctcacagtcttccagttctggagttttgtggaaaccttggacagccccaccatggaggcctacgtgactgagaccgctgaggaggtgctactggtgcggaatctgaactcggatgatcaggctgttgtgctgaaggccctgagattggcgcccgaggggcgtctgcgaagggacgggctgcgggccctcagctccctgctcgtccatggcaacaacaaggtcatggctgctgtcagcacccagctccggagcctgtcactgggccctaccttccgggagagggccctcctgtgcttcctggaccagctggaggatgaggacgtgcagactcgagtggctggctgcctggccctaggctgcatcaaggctcccgagggcattgagcccctggtgtacctctgccaaactgacacagaagctgtgagggaagctgcccggcaaagcctacagcagtgtggagaagagggacagtctgcccatcgacggctggaggagtccctggacgccctgccccgcatctttgggcctggcagcatggccagcacagcattctaaactattcacccatgggttcctggtgcccctttccccccactttcagggctcaccaggcactggcagggagggtaagggctggctccagatacccctcccccacagattcctagcaatgaaaatctaatatattcttctgttgcccctggggttggagagtcagtgcctgcagtcaagtgcctcccagcctcggctcagcacatcccttgccacaaatcagtgtctggggcttggccaccctgccgctgcccagccacatcccttggttttgtattttatttacagagttttacagaaaataaaaaagcaaaatgtctttccta

SEQ ID NO: 2078 - DNA, 154 bp, Homo sapiens
gagccatggcggacgaggagcttgaggcgctgaggagacagaggctggccgagctgcaggccaaacacggggatcctggtgatgcggcccaacaggaagcaaagcacagttcaacagaagaaaagtaatggactctgatgaagatgacgattat

SEQ ID NO: 2079 - DNA, 960 bp, Homo sapiens
gcggaccgtgctgggagcggcgcggctggagcgcagcgccgaagggactggcagggctgaagtgtgcgggacagcaagcccccgaatagccccggctgccacctcgcaggacccaaggccacgcgcgccgggcccagctgagccgcctcatgaagccgcccgcggcgcagggcagccccgcggccgccgcggccgcagccccggccctggactcggcggccgcggaggacctgtcggacgcgctgtgcgagtttgacgcggtgctggccgacttcgcgtcgcccttccacgagcgccacttccactacgaggagcacctggagcgcatgaagcggcgcagcagcgccagtgtcagcgacagcagcggcttcagcgactcggagagtgcagattcactttataggaacagcttcagcttcagtgatgaaaaactgaattctccaacagactctaccccagctcttctctctgccactgtcactcctcagaaagctaaattaggagacacaaaagagctagaagccttcattgctgatcttgacaaaactttagcaagtatgtgaaacaagaagttctgggtcctttcatcataagggagaagcttcagaaagttccgaggacctgctaaaatcagctactagaatctgctgccagaggggacaaagacgtgcactcaaccttctaccaggccactctcaggctcaccttaaaatcagcccttgatcccatttctgggcaatttagacagtgaaactgactttgtttacctgcttgcagcatattagaacagacgatccatgctaatattgtattttctcttaaaacatagctttcctgtaatttaaagtgcttttatgaaaatatttgtaattaattatatatagttggaaatagcagtaagctttcccattataatatatttttgtatacaaataaaatttgaactgaagtctgcttcct

SEQ ID NO: 2080 - DNA, 1917 bp, Homo sapiens
aaagggcgctccgcgcatgcgcacaggatccggctcgggaggcggaccctggctgccatcttgcagtgcgcgggaaccgccgccgccgccgctggccaaaaagcggagcccaggggaagcgtgtcctgctcagaccgccttccttctccattgccacccgtgccgaacagccaggctgcccaattgcaactgtagaccaatgaactaatccatcgcccgcagcccgactctcagcagcggttcgtcccggtgcccacccccgcgaagcggagcgcccgggcacctagcctccctgccggccacctagcctccctgccggccacgatgccgaacgtgctgctgccgcccaaggagagcaacctcttcaaacgcatcttgaaatgttatgaacagaagcagtacaaaaatggcctcaagttttgcaagatgattctgtcgaacccaaaatttgctgaacatggagagactttggctatgaaaggattaacactgaactgtttaggaaaaaaagaagaagcttatgagtttgttcgtaaaggacttcgtaatgatgtcaagagtcatgtctgttggcatgtatatggactcttgcagcgttctgataaaaaatatgatgaagctataaaatgttaccgaaatgccctcaaattagataaagataacctgcaaattttgagggatctctcactgttgcagatccaaatgagagaccttgaaggttaccgagagacaagataccagcttcttcagttgcgccccacacagcgtgcctcctggattggatatgctattgcataccatttgctgaaagattatgatatggccctaaaactgttggaagaatttagacaaactcagcaagttcctccaaacaaaatagattatgaatatagtgaattgatattataccagaatcaagtgatgagagaggcagatctgttgcaggaatctttggaacatatagaaatgtatgagaaacaaatatgtgataaacttttggtggaagaaattaaaggggaaatactgttgaaattgggaagattaaaagaagccagtgaagtgttcaaaaacttgattgatcgaaatgcagaaaattggtgttattatgaaggcttggaaaaagctctacaaattagcactttagaagagaggcttcaaatttatgaagaaattagtaagcagcaccccaaagcaattacacccagaagattacctttgactcttgtcccaggtgaaagatttagagaactaatggataagttcctgagggttaacttcagtaaaggctgcccacccttgtttactactttgaaatctttatattacaatacagaaaaggtttctataatccaggaacttgttactaattatgaagcctctcttaaaacgtgtgacttttttagcccatatgagaatggggagaaggaacccccgacaacactactctgggttcagtatttcctggcacagcactttgataaacttggacagtattctttggctttggattatattaatgctgcaattgctagtactccaactctaatagaattattctatatgaaagcaaaaatttacaagcatataggtaatctcaaagaagctgcaaagtggatggatgaagcacagtctttggacacagctgatagattcatcaattccaaatgtgcaaaatacatgcttcgagcaaatatgataaaagaagcagaggaaatgtgctccaagttcacaagggaaggaacatctgccatggaaaatctaaatgaaatgcagtgtatgtggtttcagacagaatgcatttcagcttatcagcgtctggggagatacggggatgccttgaaaaaatgtcatgaagtagaaaggcactctccttccacatggaccacaggaggaaaagagccgcaaatgcacccctga

SEQ ID NO: 2081 - DNA, 4347 bp, Homo sapiens
aaagggcgctccgcgcatgcgcacaggatccggctcgggaggcggaccctggctgccatcttgcagtgcgcgggaaccgccgccgccgccgctggccaaaaagcggagcccaggggaagcgtgtcctgctcagaccgccttccttctccattgccacccgtgccgaacagccaggctgcccaattgcaactgtagaccaatgaactaatccatcgcccgcagcccgactctcagcagcggttcgtcccggtgcccacccccgcgaagcggagcgcccgggcacctagcctccctgccggccacctagcctccctgccggccacgatgccgaacgtgctgctgccgcccaaggagagcaacctcttcaaacgcatcttgaaatgttatgaacagaagcagtacaaaaatggcctcaagttttgcaagatgattctgtcgaacccaaaatttgctgaacatggagagactttggctatgaaaggattaacactgaactgtttaggaaaaaaagaagaagcttatgagtttgttcgtaaaggacttcgtaatgatgtcaagagtcatgtctgttggcatgtatatggactcttgcagcgttctgataaaaaatatgatgaagctataaaatgttaccgaaatgccctcaaattagataaagataacctgcaaattttgagggatctctcactgttgcagatccaaatgagagaccttgaaggttaccgagagacaagataccagcttcttcagttgcgccccacacagcgtgcctcctggattggatatgctattgcataccatttgctgaaagattatgatatggccctaaaactgttggaagaatttagacaaactcagcaagttcctccaaacaaaatagattatgaatatagtgaattgatattataccagaatcaagtgatgagagaggcagatctgttgcaggaatctttggaacatatagaaatgtatgagaaacaaatatgtgataaacttttggtggaagaaattaaaggggaaatactgttgaaattgggaagattaaaagaagccagtgaagtgttcaaaaacttgattgatcgaaatgcagaaaattggtgttattatgaaggcttggaaaaagctctacaaattagcactttagaagagaggcttcaaatttatgaagaaattagtaagcagcaccccaaagcaattacacccagaagattacctttgactcttgtcccaggtgaaagatttagagaactaatggataagttcctgagggttaacttcagtaaaggctgcccacccttgtttactactttgaaatctttatattacaatacagaaaaggtttctataatccaggaacttgttactaattatgaagcctctcttaaaacgtgtgacttttttagcccatatgagaatggggagaaggaacccccgacaacactactctgggttcagtatttcctggcacagcactttgataaacttggacagtattctttggctttggattatattaatgctgcaattgctagtactccaactctaatagaattattctatatgaaagcaaaaatttacaagcatataggtaatctcaaagaagctgcaaagtggatggatgaagcacagtctttggacacagctgatagattcatcaattccaaatgtgcaaaatacatgcttcgagcaaatatgataaaagaagcagaggaaatgtgctccaagttcacaagggaaggaacatctgccatggaaaatctaaatgaaatgcagtgtatgtggtttcagacagaatgcatttcagcttatcagcgtctggggagatacggggatgccttgaaaaaatgtcatgaagtagaaaggcatttttttgagataactgatgaccaattcgacttccatacatactgcatgagaaagatgacccttcgtgcctatgttgaccttttgagattagaagatatactcagaagacatgccttttatttcaaggctgctagatcagcgattgaaatatacttgaaattgtatgataatcccttaaccaatgaaagcaaacaacaagaaataaactcagaaaacttgtcagccaaagaattgaagaaaatgcttagcaagcagagaagagctcagaaaaaggctaaactagaagaagaaagaaagcatgcagaaagagaacgtcaacagaaaaatcaaaagaaaaaaagagatgaagaagaagaagaagccagtggccttaaggaagaacttatacctgaaaaattagaaagggtagaaaatccattagaggaagccgttaagttccttatacctcttaagaaccttgttgctgataacattgacactcatctgttagcatttgaaatatattttagaaaaggaaagtttctgttaatgctgcagtctgtcaaacgagcttttgccattaacagtaataacccatggttacatgaatgtttaattagattttctaaatctgtgtctaatcatagtaatcttccagacattgtgagcaaagttctatctcaagaaatgcagaaaatatttgtcaaaaaggatttggaaagttttaatgaggattttctgaaacgtaacgctacctctcttcagcatctactttcaggtgctaaaatgatgtattttctggacaagtcaaggcaggagaaagcaattgctatagccactagactagatgaaactataaaagataaagatgtaaagacattaataaaggtttctgaagcactgcttgatggcagctttgggaactgtagttcccaatatgaagaatataggatggcctgtcataacctgcttccttttacatctgccttcttgcctgctgtgaatgaagtcgacaatcctaatgtggcactgaaccatacagctaattatgatgtcttggcaaatgaaatttgaaatcttctagaaagtagactcctatagactcaaagctgaattgagatcagggtttcttttccagggtgcattttaatatacgtatgaaatgaaatatttggttaggatttttaaatggcatattctgtaagcttattttgttctttacccgacctgccaatttacataaccatctgttaaaattacctgtttattcttacacagttttgtggtagctccgatcgcttctgtataattataatttcttactaagctaagttgtatacaaccccactgtattattttctttagattctgatttcaggatctgtgctttgattccttgtctgttttatcgtatatttgcttgctttttaattaaagcacatcagttttaaagtgttaactatatgttaacaatatggaggctgggcgtggtggctcacacctgtaatcccagcactttgggaggcccagactggcggatcacctgaggtcaggagatcgagatcagcctggccaacatggtgaaaccccttctctactgaaaatacaaaaattagccagacgtgatggcacatacctgtaatccaagctgcccaggagctgaggccggagaatcgcttgaacctgggaggtggaggttgcagtgagccgagatcatgccactgcactccagcctgggcaacagagcaagactccatctcgaaaaaaaggaattcctcttggcagatattgaagtttatttgaaaatttaattcgtccttttttcattgtaatatttcatggtttactatttccttttagtattcatgaaaatggtattttctggttgaataagggtactctagttttatgtagatgatttcagaatgtgaaggctggtttgcctgtcagtcatggaaattcactggtaaaattgttgaatatttctctctcccagtcttaaaagcccacaggcaagaattaatgctttcttaactaagttactttgagtattaacaagtagcttatactgaggtgtgcttcaagggagcattatagggcagaaaacaaattaaaatgaaatgttgttgttatagccatgcattgaccattaaatgcattttaatatctcggcaaaatgagatttgaaactcattagtttaactcttaaaacatagtgttgttaaacagtattttttgggggcgggtggatagctttttgttctatcttgtacagaaaacagtaatggaatcactcatgttcagaaccttgtaaatatgtctgtaatattaatgcttccctttattaagacaaatatacattcaaaaagggagattttatttagacacacattttcttttcaccctaatctatttagattcatacttattgagacgggaaaaactcgctgtaaaataatgccaacctagataatgctataataaattattttgtacacagtt

SEQ ID NO: 2082 - DNA, 2230 bp, Homo sapiens
ctttctgtgctgatcttggaggcagagtggctgcctgcattcattccacggtccattccacagcttgttccaaagacagtctgctcatgatgtagcttctgcacttgacaaattattttcatgcacgaggcccttgaaaatgttgacagtcttgtgacatccatggagggccttatttgacggtcacaaaggagcggttcctagaaggtgagcgcggacggtatgcaaagttgtgaatccagtggtgacagtgcggatgaccctctcagtcgcggcctacggagaaggggacagcctcgtgtggtggtgatcggcgccggcttggctggcctggctgcagccaaagcacttcttgagcagggtttcacggatgtcactgtgcttgaggcttccagccacatcggaggccgtgtgcagagtgtgaaacttggacacgccacctttgagctgggagccacctggatccatggctcccatgggaaccctatctatcatctagcagaagccaacggcctcctggaagagacaaccgatggggaacgcagcgtgggccgcatcagcctctattccaagaatggcgtggcctgctaccttaccaaccacggccgcaggatccccaaggacgtggttgaggaattcagcgatttatacaacgaggtctataacttgacccaggagttcttccggcacgataaaccagtcaatgctgaaagtcaaaatagcgtgggggtgttcacccgagaggaggtgcgtaaccgcatcaggaatgaccctgacgacccagaggctaccaagcgcctgaagctcgccatgatccagcagtacctgaaggtggagagctgtgagagcagctcacacagcatggacgaggtgtccctgagcgccttcggggagtggaccgagatccccggcgctcaccacatcatcccctcgggcttcatgcgggttgtggagctgctggcggagggcatccctgcccacgtcatccagctagggaaacctgtccgctgcattcactgggaccaggcctcagcccgccccagaggccctgagattgagccccggggtgagggcgaccacaatcacgacactggggagggtggccagggtggagaggagccccgggggggcaggtgggatgaggatgagcagtggtcggtggtggtggagtgcgaggactgtgagctgatcccggcggaccatgtgattgtgaccgtgtcgctaggtgtgctaaagaggcagtacaccagtttcttccggccaggcctgcccacagagaaggtggctgccatccaccgcctgggcattggcaccaccgacaagatctttctggaattcgaggagcccttctggggccctgagtgcaacagcctacagtttgtgtgggaggacgaagcagagagccacaccctcacctacccacctgagctctggtaccgcaagatctgcggctttgatgtcctctacccgcctgagcgctacggccatgtgctgagcggctggatctgcggggaggaggccctcgtcatggagaagtgtgatgacgaggcagtggccgagatctgcacggagatgctgcgtcagttcacagggaaccccaacattccaaaacctcggcgaatcttgcgctcggcctggggcagcaacccttacttccgcggctcctattcatacacgcaggtgggctccagcggggcggatgtggagaagctggccaagcccctgccgtacacagagagctcaaagacagcgcccatgcaggtgctgttttccggtgaggccacccaccgcaagtactattccaccacccacggtgctctgctgtccggccagcgtgaggctgcccgcctcattgagatgtaccgagacctcttccagcaggggacctgagggctgtcctcgctgctgagaagagccactaactcgtgacctccagcctgccccttgctgccgtgtgctcctgccttcctgatcctctgtagaaaggatttttatcttctgtagagctagccgccctgactgccttcagacctggccctgtagcttttctttttctccaggctgggccgtgagcaggtgggccgttgagttacctctgtgctggatcccgtgcccccacttgcctaccctctgtcctgccttgttattgtaagtgccttcaatactttgcattttgggataataaaaaaggctccctcccctgcccctcagcttctctctggttttctca

SEQ ID NO: 2083 - DNA, 636 bp, Homo sapiens
ggcaagatggcgccggtgggggtggagaagaagctgctgctaggtcccaacgggcccgcggtggcggccgccggcgacctgaccagtgaggaggaggaaggccagagcctatggtcctccattctgagcgaagtgtccacccgcgccaggtccaagctgccgtccggcaagaacatcctggtcttcggtgaagatggttctggtaaaacaaccctcatgactaaactacaaggagctgagcatggcaaaaaaggaagaggcctagaatatctctacctcagtgtccatgatgaggaccgagatgatcacacgcgctgcaacgtgtggattctggatggagacttgtaccacaaaggcctgctgaaatttgcagtttctgctgaatccttgccagagaccctcgtcatttttgttgcagacatgtctagaccttggactgtgatggaatctctgcagaaatgggctagtgttttacgtgagcacattgataaaatgaaaattccaccagaaaaaatgagggagctggaacggaagtttgtgaaagattttcaagactatatggaacctgaagaaggttgtcaagagggcccactttctaacagggtggagcaaatgagaccaagaaatcattggtaa

SEQ ID NO: 2084 - DNA, 1243 bp, Homo sapiens
aactggaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaaggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctg

SEQ ID NO: 2085 - DNA, 1657 bp, Homo sapiens
gcggcgcgcgcgcaggtcggtgcgtctgtcgggggcgcgctcgggtacctgtaccccacgtagtcgccggttaccgatcggactaagttccagtggtgatttacaagtcaagttaaaatgtccccagaagtggccttgaaccgaatatctccaatgctctcccctttcatatctagcgtggtccggaatggaaaagtgggactggatgctacaaactgtttgaggataactgacttaaaatctggctgcacatcattgactcctgggcccaactgtgaccgatttaaactgcacataccatatgctggagagacattaaagtgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaaggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctgaaa

SEQ ID NO: 2086 - DNA, 1752 bp, Homo sapiens
ggtacctgtaccccacgtagtcgccggttaccgatcggactaagttccagaagcaagagataaagtaataatgggtactgtggggaaaaacacagaagaacaattcggtaatatagtggtgatttacaagtcaagttaaaatgtccccagaagtggccttgaaccgaatatctccaatgctctcccctttcatatctagcgtggtccggaatggaaaagtgggactggatgctacaaactgtttgaggataactgacttaaaatctggctgcacatcattgactcctgggcccaactgtgaccgatttaaactgcacataccatatgctggagagacattaaagtgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaaaagagagagcaacagagatggggaggaatccagctctgcctgacatccaggcatcctctccaaattgcatagggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctgaaa

SEQ ID NO: 2087 - DNA, 2534 bp, Homo sapiens
atgatccgagcttttccaacaactaccccacgcagtcttcatctcttcacttcatctactttcctggctcgcgcccttccaggagcctttcccaccggagcctgcgaggagagactcagtgttcctgaaagtacacctttcacagcagtcttaaagtttgcagcagaagaatttaaagttcctgctgcaacaagtgcaattattaccaatgatggaataggaataaatcctgcacagactgctggaaatgtttttctaaaacatggttcagaactgcggattattcctagagatcgtgttggaagttgttaatatctgctacttggaacatacgattgcctttcagaataaatattggtattttttgttgttgtaaaattgaaatcaggcatttaacatactatgaaaacaccaggagtcaatgattaatgaaaggtgactcatctgtccctttttgttgtccatactcttcctatgaagagggaatgcgtatgaattaaggctactactgtcacagaagatcatagtctttgatgctacctcacaacacaaacaggtagttcgttgggggcaaatgaattagccaactgttaactggaagcttttgataatttttttttttagaacaatttggaacattaaaatttactgaatcgtatatattcatctgagataaaaatataaaaagaattatggaccctggatggcaatttgcttgatagcatctgatttgcagactcataatttgatttttaattaaatatataggttgtgatgaagtgaatagacatatcagtgaacagttaactatattaaatttttatcatttactttttttaagattcagacctcagttatataaatttcagtttaatatcaaccaaaaaattaaaattttaatctaacccttatgtgtataaattggtgtcccataccagcttttaatggtggacctatagaatccagtacttttaatggtgggaatttacagtagaagcatcctttgctgagttatacattcctttatcaatctcttttgatacaacatttaaaacaagtagcttcaagaaaccactggtgttttgaggatagtatttctaaatagcattcaggaacagagtattattgcacagatctgaagatcaaaaaaaagctcaaggaaatacagatcggaagtgctgatgagttatatttattgaaaacccaacttttaaggaagtgctaagatcagtcacccatgtgaataagaagccaggaaaggaaagatggggaagcccagatcaccaggcttctattaaggaggaaagcaacagaggaaacagtgaaggggaacagaagggggtagcaaagtgttacagaaaagcggactggatagacaaaactgcagaaggtgtatgttggggagaactgaaagggaaaacaaaatacttgacatagtcttaagtagaagaaggcagttagagaaaacaaagtatctactggccttgtcaacatacagacttcaaaataccccttatgagaatccaaagaatgatgtgtgtaagggaagattttatttgcccttccggaagaaatcagtatctatgcaaatcttgaaagacgaaatcaaagcccattaatgattcagaatcagtgcttgacctcctgtattctgaatggtgaactctggaagcagggattgtgtctggctctttttagagctggaaatgtagtggctttcattaaatacttgctgtaaagtctttctaagaccaattattatcttagcatgtttcagtatcttctctatcataggccctaagttcattgggggaaaaaaaataagaagattcaacagaatcagcatttgaagtgtaccattggtagttgtttatgaaattaccagatattcataaatgtgacaaatgaacagcaggattatgaattatcaaaggaaaaagtatttgctgaggtgaaaaaatctgatgtttgaggaagtttttatttttatttatttgttttgtttttttttttttgaggcagactctctgtcgccaggcttctcctgcctcagcctcacgagtagctgggactacaggcatgcaccaccacgcccagctaatttttgtatttttagcagagacagggaggaagtttttatttttataaacaaaatctgatgttcagaggccccgtttcttacaataaatgttgagtcttagttaagcaggaatttatgaacacccatttcctgactttttgctttaatttagatttttctccatcctgtttctagcacaaaaatttgcctgctgtgttacaaaaataaatttatgttgtcctgtgccataaagtgatatatttaatatttttattctttggttttgaacattgtaagttcctaaaaacattttattaaacaagtagacattttgttattaaaaaaatgtgatctgtaatttctttgtgcagaatgatttgaagtattgtattcagtttacatgcgttattggtttataattaatatctaatgaaaatacatgttgttatattgt

SEQ ID NO: 2088 - DNA, 2664 bp, Homo sapiens
gggctctgagccggaggttttgttgtgagggtcggttgtcaagcagcggccaatcaaggcaggggatggaggcaagtgggggtcgcgcctggagcggagcctcggcctccggagccgcagctgcagccctgtattgagctgagatggctcgagcctaacattccatgatccaggatcgtgacagatgtgcacaggctgctgctgttgctgctgtgggtaatttggaaccacgaggcaccccagggccagaagacgaggcattctgtctgcctggatgtgtgggaactctctgccaacttgattggtggatctggggggggatccacccccaccccacgaggaaagcacagtttattttgtgggtggggcttcaggtgccagccagctgaaggatggccacccctgtggtcaccaagacagcctggaagttgcaagagatcgtcgcgcatgccagcaacgtgtcctcactggtgctgggcaaagcctccgggcggctgctggctacaggcggggatgactgccgcgtcaacctgtggtccatcaacaagcccaactgcatcatgagcctgacgggccacacatccccagtggagagcgtccgcctcaacacccccgaggagctcatcgtggccggctctcagtcgggctccatccgtgtctgggacctggaagctgccaaaattcttcgcacactcatgggacacaaagccaacatctgcagcctggatttccacccgtacggcgagtttgtagcctctggttcccaggacacaaacatcaagctctgggacatcaggaggaaaggctgtgtcttccgatacagggggcacagccaggccgtgcggtgtctccggttcagccccgatgggaagtggttggcgtcggccgcagatgaccacaccgtgaagctctgggatctcactgccggcaagatgatgtctgagttccctggtcacacggggcctgtcaacgtggtcgagtttcaccccaacgagtacctcctggcctccggcagctctgacaggacaatccgcttctgggacctggagaagttccaggtggtgagctgcatcgaaggggagcctgggcccgtcaggagcgtcctcttcaacccagacggctgctgcctgtacagcggctgccaggactcactgcgtgtctacggctgggaacctgagcggtgctttgatgtggtcctcgtcaactggggcaaggtggccgacctggccatctgcaatgaccagttgataggtgtggccttctcccagagcaacgtctcctcctacgtggtggatctgacgcgtgtcaccaggactggcacggtggcccgggaccctgtgcaggaccaccggcccctggcacagccactgcccaaccccagcgcccccctccggcgcatctatgagcggcccagcacaacctgcagcaagcctcagagggtgaagcagaactcagagagcgagcgccgcagccccagcagcgaggatgaccgggacgagcgcgagtcccgcgcggagatccagaacgccgaggactacaacgagatcttccagcccaagaacagcatcagtcggacgccaccccggagaagtgagcccttccctgcacccccagaggacgacgcagccacagcaaaggaggcagcaaagcccagccctgccatggatgtgcagttcccggtgccaaatctggaggtcctgccccggcccccagtggttgcttccacacctgcacccaaggctgagcctgccatcatccctgccacccggaacgagcccatcgggctgaaggcctccgacttcctgcccgccgtgaagatcccccagcaggccgagctggtggacgaggatgccatgtcacagatccgcaaaggccacgacaccatgtgtgtggtgctcaccagccgccacaagaacctggacactgtgcgggctgtgtggaccatgggcgacatcaagacgtcggtggactccgctgtggccatcaacgacctgtcggtggtggtggacctcctgaacatcgtcaaccagaaagcctccctgtggaagctggacctgtgcaccaccgtcctgccacagattgagaagcttctgcagagcaagtatgagagctacgtccagacgggctgcacctccctgaagctgatcctgcagcggtttctgcccctcatcacagacatgctggcggccccaccctctgtgggtgtggatatcagcagggaggagaggctgcataagtgccggctctgctacaagcagcttaagagcatcagcggcctggtcaagagcaagtcaggcctgagcggccgccatggcagtaccttccgcgagctgcacctgctcatggccagtctggactgaggaaagcagtgggcaggggcgctcggcagcccacagggcctggcctcagcccccactcctgttccttgtgcacccactggcccatgagcctctgcctggcccctgctgctgtcctgtggccgtcctggaggaggtgatgctggtccctggccacctctacagccctgaactcttgagacaactctctccagcaatagctgcccagctttgcccaactgttgcttcttggggcagcgaactgagccctggggctgctgctgtaatttataaggcaaattttattaaatttgtaactattcccagg

SEQ ID NO: 2089 - DNA, 404 bp, Homo sapiens
gcagttgttgttggttgggggccttttggccggtgacggagactgcccaggtgtggtcaccatgttcctctccgcggtcttctttgccaagagcaagtcaaatgaaacaaagagtcctcttcgtggaaaagaaaaaaatacgctccctttaaacggtggattgaaaatgactttgatttataaagagaagactgagggcggggatactgattcagaaatcctgtagcgtgtaataaaagaagaggaaatggcatggaatcactgcctcctgtgatttgaaggccattgtgaaggaaaacaatgcagtgaaagaaagttcttcatattaggacagatatcattgcatcacatttatttatctttctgggtatttttatagcccttaataaaaaatattaaaatag

SEQ ID NO: 2090 - DNA, 4255 bp, Homo sapiens
gactcccgggtccccgcgccggactgggactgggagcaggcagcccgggcggagcgggccggtgccgaggacggccccaggcattgctctgccccgggcattgcgcggcgcgcgtgagggggatgcggcaggaggcggcgcggcgggaggagtaggcggcggcgccctcgggagggagctgcgcgcgggccagacggcgcccggaggctccgcagtgccgccgccgtcgcccgggaggctccgcgcgggagccatgtaaccctgcggcgggctccgggctgctccgtccttccccagctcccgggctagcgcggcagcggggccacgatgaagaagcagttcaatcgcatgcgccagctggccaaccagacggtgggcagggctgaaaagacagaagttttgagtgaagaccttcttcaggtggagaagcgtctggagctggtgaaacaggtgtcccacagcacgcacaagaagctcaccgcatgtctgcagggccagcaaggggcagaggctgacaagcgctccaaaaagttgcctttgacaacactggctcagtgtctgatggaggggtcagctatcctgggagatgacacacttcttgggaagatgctgaaactctgtggagagacggaggacaagctggctcaggagctgatacattttgagttgcaagtagagagagacgtgattgagcccctgtttttgctggcggaggtggaaatcccaaatattcaaaagcagaggaaacacttagccaagttggtgctggacatggattcctcacgaaccaggtggcagcagacttccaagtcttcaggtttgtccagcagcttacagcctgcgggtgccaaggctgatgccctcagggaagaaatggaagaggctgccaacagagtggagatttgcagggaccagctctcagctgatatgtacagttttgtggccaaagaaattgactatgcaaactactttcaaacgctaatagaagtgcaagctgaataccacaggaagtccctgacactattgcaggctgtattgcctcagatcaaagcacaacaggaggcctgggtagagaagccttccttcgggaagccgctggaggagcacctcaccatcagcggccgggagatcgccttccccatcgaggcgtgtgtgaccatgctgcttgagtgtgggatgcaggaggagggactcttccgagtagccccctctgcctccaaactgaagaagctgaaagcggccctggactgctgcgtggtggatgtgcaggagtactcggcagacccccacgcaattgcaggagctttgaaatcttacctccgagagttgccagaacctcttatgacctttgaactctatgatgagtggatccaggcttccaatgtccaggagcaagacaagaagcttcaggctctatggaatgcttgtgaaaagttgcccaaggccaatcacaacaacatccgatacttgataaaatttttatccaagctgtcagaatatcaagatgtaaacaagatgactcccagtaatatggcaattgttttaggacccaacctcctatggccacaagcagaagggaacattacagagatgatgaccacagtgtcgctgcaaattgttgggatcattgaacctatcatccagcatgcagactggttcttccctggggagatagagttcaacattactggcaattatgggagtccagtacacgtgaaccataatgccaactacagctcaatgccctccccagacatggaccctgctgaccggcgccagcccgagcaggcccgccggcccctcagcgtcgccacggataatatgatgctggagttttacaaaaaggatggccttaggaaaatccaaagcatgggtgtgagggtcatggacacaaactgggtggctcgaagaggctcctcggccggtcggaaagtgtcctgcgccccgccctccatgcagcctcccgccccgcccgccgagctggctgcgcccctgccttcgccgctgccggagcagcccctggacagccccgcggcccccgcgctctctccatccggcctgggcctccagcctgggcccgagcgcaccagcacaacaaaaagcaaggaactttctccaggctctgcacagaaaggaagtccaggctccagccagggcacagcctgtgcagggactcaaccaggggctcaacctggagctcagccgggcgccagccccagccccagccagccgcctgcagaccagagtcctcacaccctccggaaagtttcaaagaagctggcaccgattccacccaaggtcccctttggccagccgggggctatggcagaccagtccgctggccagccgtccccagtcagcctgtcccccaccccgcccagcaccccgtcaccctatggactgagctaccctcaggggtactccttggcctcgggccagctctccccagctgcagctcctcccctggcctctccttctgtctttacaagcactttgagcaaatcgcggcccactcctaagccgcgacagagacctactctgccgcctcctcagcctcccacagtaaacctctcggcctctagtccacagtccacggaggcccccatgctagatggcatgtcccctggggaaagcatgtctacagatcttgtccactttgatattccctcgatccacatagagctcgggtcgacgctccgcctgagtcccctggagcacatgcggcgacactcagtaactgacaagagggactcggaggaggagtctgagagcaccgccctctgacatgacaccgcccatcctgcctcgcgtgtacatacatcacgggccctaggaacgccgccaggagcagcgtccatgagcttgccaagtgttctctgctggctctttcctgccactgccaacacgaggttggaatttggcagaaaattgtgatctccagtccgtgtggtgatgctggtggtgcaggttttgtttgttcctttcgggtggtgacttcggccttttgtttgacctttgccttttgactttgtgcctcttttgatccactttcagcctccatgccagaaaacacccacctctccatccaaggctggtcaggaacgtcctttgcagggtcggggtggtgcgggagaggctcactttgcctggttagacccaagggctgctaccttttccttggacggctcatgtcaggtcttgcaggatcagtttaatggccacagaaaggaagcaggacagcagggcccctctcacccacaactggaccaggtccaggattctagcagtcctggggcactgacctttgccagctacctgggggagggcttgccactggaaaacctttcaggccgcccccatcagtgggctccaaagtaaatggctgaaaacaaaaatgtttcacttcctaacagttttcctttttccactgtgtgactgaaagctcctatatcattttatatttctgaatctataaaacaaaacaaacaagcctgacagtgtctggaggagccaaaggtggcctccctgtccccaaatatattggctatatgagagtaattttacccctctacgtacctaaaggcacccagttcactagtctgtggggtcctggagcctgtctcttctttctggaggttcaaactgaatagcaataattacgttacccaaagcatgtggaggaaaagtgaaaccagccacggagacgctggcccacgggctcggcctgcggtgtggcctgctttgctcaccagcgtcagccgctcatttccttctcatgaagtcccatctggtcatggggacgagggccgggagggcaccgggtagccttttcacacttggggattaggggagtgagaaaagatttgggccatgcatgcaaagtcaaagtttaaaattttatccttttcaaatagatgatataatatacctatacatgatataatatttgtatatatgaaatctctctatatttgtttaatttgagccattcaatctaaaccaatgtacaggtgtacaatgaaaaatttaaatgcttagttatttttcccaacacagtgtaaagtcaccctcctctgagagtgggatgtgcagagttttgatgttgcagctttgctcacttcctggcaagggcaggtcatgcctcaatttgtaatgggagtctggggtaagggtgggggttgaaagttgttatctttaaatacatgtacaaatcgttgtcaaaagtaacgttattaaaatagatttattatccctg

SEQ ID NO: 2091 - DNA, 2406 bp, Homo sapiens
gatttgtggttggctgaggtggaggaacaaaatggcggcgccggcggcgtgaccgggccctctggcccacagccgttggtagcggtggcagcagtactgctgccccaactcgctgtgccccctttctcagcccacgacatcgccacgacagcgaggcagcgaccgccaccgagaaagaggtggtggcccagcctggaaccttgagaaaccctcgcaaactgtggcctggcggaaatcctggtgtgctgcagggatcaggctgactccacgccctgtaacaccgggaaacgcctcggtggccatttccagcagccctcatcctcagccttgcgggccggtgggccccggaggcctccatcctcccctagaggggtcagggctgagcccagcctccatctttgcctctcaggatgacaaacaacagcggctccaaagccgaactcgttgtgggagggaaatacaaactggtgcggaagatcgggtctggctcctttggagacgtttatctgggcatcaccaccaccaacggcgaggacgtagcagtgaagctggaatctcagaaggtcaagcacccccagttgctgtatgagagcaaactctacacgattcttcaaggtggggttggcatcccccacatgcactggtatggtcaggaaaaagacaacaatgtgctagtcatggaccttctgggacccagcctcgaagacctctttaatttctgttcaagaaggttcaccatgaaaactgtacttatgttagccgaccagatgatcagcagaattgaatacgtgcatacaaagaattttctacaccgagacattaaaccagataacttcctgatgggtactgggcgtcactgtaataagttgttccttattgattttggtttggccaaaaagtacagagacaacaggaccaggcaacacataccgtacagagaagataaacacctcattggcactgtccgatatgccagcatcaatgcacatcttggtattgagcagagccgccgagatgacatggaatccttaggctacgttttcatgtattttaatagaaccagcctgccgtggcaaggactaagggctatgacaaaaaaacaaaaatatgaaaagattagtgagaagaagatgtccacccctgttgaagttttatgtaaggggtttcctgcagaattcgccatgtacttgaactactgtcgtgggctgcgctttgaggaagtcccagattacatgtatctgaggcagctattccgcattcttttcaggaccctgaaccaccaatatgactacacatttgattggacgatgttaaagcagaaagcagcacagcaggcagcctcttccagtgggcagggtcagcaggcccaaacccagacaggcaagcaaactgaaaaaaacaagaataatgtgaaagataactaagcgtgaatgaggaacagaagaagcagagcagatgattcgagcagcatttgtttctccccacatctagaaattgtagttcatatgtacaccagctagtggctgtgaacaaccatttagttggtgtaaaaaactttatttcaatataaactgactctggggagcgttggtgatgctgtatcccaaagtgtagcctctgtaattgtgaatattaactgaggtagtgaaacgtggtgtctggttttctattgcatttattcaagtagaaaagttaactaaatggttgacacacacgaattggtggagacattgtccatatgccaattttttgttaaaaccttttattttgaactagactgctttgagatatcatttcagaaggacagtattcagccacagctgcaaaggttgtaaatgcttatgattgagcatttttagggtttctccatccctggggtttgcaaattgttcacataaagagcattcttaaaatggttggcttcttgtctgtaagccagctgatctagtagtaaccaaaaattccagttttgagaataggaaagattccgcctgcttacctgtgaagacataagaaaatcttagtaactaccagattatctttagaattccacattaactatatcatgttctcggtattttaaaaacaacaacaaccatatttgtcacagaaatttagttaacatcttacaactgaacatgtatgtacatggcttagataaatgtaatcaccgtaaacacccatatgatctgggattttgttcatattttgaaatgggagcttttatgttttacaagttcactaaaatctgaaaactgtttctataaggaaataatacttttttaaacaacaaccaaaaaatgccttgctgattcactaggaaataaaaatctccccaattttttgatagtcaacttcgagccatttgttacatgatattcccttgcaagtaaattttatttcatt

SEQ ID NO: 2092 - DNA, 2163 bp, Homo sapiens
gcggagcgcagctgtgagggagtcgctgtgatccggggccccggaacccgagctggagctgaagcgcaggctgcggggcgcggagtcgggaggcctgagtgttccttccagcatgtcggagggggagtcccagacagtacttagcagtggctcagacccaaaggtagaatcctcatcttcagctcctggcctgacatcagtgtcacctcctgtgacctccacaacctcagctgcttccccagaggaagaagaagaaagtgaagatgagtctgagattttggaagagtcgccctgtgggcgctggcagaagaggcgagaagaggtgaatcaacggaatgtaccaggtattgacagtgcatacctggccatggatacagaggaaggtgtagaggttgtgtggaatgaggtacagttctctgaacgcaagaactacaagctgcaggaggaaaaggttcgtgctgtgtttgataatctgattcaattggagcatcttaacattgttaagtttcacaaatattgggctgacattaaagagaacaaggccagggtcatttttatcacagaatacatgtcatctgggagtctgaagcaatttctgaagaagaccaaaaagaaccacaagacgatgaatgaaaaggcatggaagcgttggtgcacacaaatcctctctgccctaagctacctgcactcctgtgacccccccatcatccatgggaacctgacctgtgacaccatcttcatccagcacaacggactcatcaagattggctctgtggctcctgacactatcaacaatcatgtgaagacttgtcgagaagagcagaagaatctacacttctttgcaccagagtatggagaagtcactaatgtgacaacagcagtggacatctactcctttggcatgtgtgcactggagatggcagtgctggagattcagggcaatggagagtcctcatatgtgccacaggaagccatcagcagtgccatccagcttctagaagacccattacagagggagttcattcaaaagtgcctgcagtctgagcctgctcgcagaccaacagccagagaacttctgttccacccagcattgtttgaagtgccctcgctcaaactccttgcggcccactgcattgtgggacaccaacacatgatcccagagaacgctctagaggagatcaccaaaaacatggatactagtgccgtactggctgaaatccctgcaggaccaggaagagaaccagttcagactttgtactctcagtcaccagctctggaattagataaattccttgaagatgtcaggaatgggatctatcctctgacagcctttgggctgcctcggccccagcagccacagcaggaggaggtgacatcacctgtcgtgcccccctctgtcaagactccgacacctgaaccagctgaggtggagactcgcaaggtggtgctgatgcagtgcaacattgagtcggtggaggagggagtcaaacaccacctgacacttctgctgaagttggaggacaaactgaaccggcacctgagctgtgacctgatgccaaatgagaatatccccgagttggcggctgagctggtgcagctgggcttcattagtgaggctgaccagagccggttgacttctctgctagaagagaccttgaacaagttcaattttgccaggaacagtaccctcaactcagccgctgtcaccgtctcctcttagagctcactcgggccaggccctgatctgcgctgtggctgtccctggacgtgctgcagccctcctgtcccttccccccagtcagtattaccctgtgaagccccttccctcctttattattcaggagggctgggggggctccctggttctgagcatcatcctttcccctcccctctcttcctcccctctgcactttgtttacttgttttgcacagacgtgggcctgggccttctcagcagccgccttctagttgggggctagtcgctgatctgccggctcccgcccagcctgtgtggaaaggaggcccacgggcactaggggagccgaattctacaatcccgctggggcggccggggcgggagagaaaggtggtgctgcagtggtggccctggggggccattcgattcgcctcagttgctgctgtaataaaagtctactttttgct

SEQ ID NO: 2093 - DNA, 4089 bp, Homo sapiens
acagcctgcggggaacgtagctagctgcaagcagaggccggcatgaccaccgagcagcgacgcagcctgcaagccttccaggattatatccggaagaccctggaccctacctacatcctgagctacatggccccctggtttagggaggaagaggtgcagtatattcaggctgagaaaaacaacaagggcccaatggaggctgccacactttttctcaagttcctgttggagctccaggaggaaggctggttccgtggctttttggatgccctagaccatgcaggttattctggactttatgaagccattgaaagttgggatttcaaaaaaattgaaaagttggaggagtatagattacttttaaaacgtttacaaccagaatttaaaaccagaattatcccaaccgatatcatttctgatctgtctgaatgtttaattaatcaggaatgtgaagaaattctacaggtataaaagatgttgaaacagaagatcttgaggataagatggaaacttctgacatacagattttctaccaagaagatccagaatgccagaatcttagtgagaattcatgtccaccttcagaagtgtctgatacaaacttgtacagcccatttaaaccaagaaattaccaattagagcttgctttgcctgctatgaaaggaaaaaacacaataatatgtgctcctacaggttgtggaaaaacctttgtttcactgcttatatgtgaacatcatcttaaaaaattcccacaaggacaaaaggggaaagttgtcttttttgcgaatcagatcccagtgtatgaacagcagaaatctgtattctcaaaatactttgaaagacatgggtatagagttacaggcatttctggagcaacagctgagaatgtcccagtggaacagattgttgagaacaatgacatcatcattttaactccacagattcttgtgaacaaccttaaaaagggaacgattccatcactatccatctttactttgatgatatttgatgaatgccacaacactagtaaacaacacccgtacaatatgatcatgtttaattatctagatcagaaacttggaggatcttcaggcccactgccccaggtcattgggctgactgcctcggttggtgttggggatgccaaaaacacagatgaagccttggattatatctgcaagctgtgtgcttctcttgatgcgtcagtgatagcaacagtcaaacacaatctggaggaactggagcaagttgtttataagccccagaagtttttcaggaaagtggaatcacggattagcgacaaatttaaatacatcatagctcagctgatgagggacacagagagtctggcaaagagaatctgcaaagacctcgaaaacttatctcaaattcaaaatagggaatttggaacacagaaatatgaacaatggattgttacagttcagaaagcatgcatggtgttccagatgccagacaaagatgaagagagcaggatttgtaaagccctgtttttatacacttcacatttgcggaaatataatgatgccctcattatcagtgagcatgcacgaatgaaagatgctctggattacttgaaagacttcttcagcaatgtccgagcagcaggattcgatgagattgagcaagatcttactcagagatttgaagaaaagctgcaggaactagaaagtgtttccagggatcccagcaatgagaatcctaaacttgaagacctctgcttcatcttacaagaagagtaccacttaaacccagagacaataacaattctctttgtgaaaaccagagcacttgtggacgctttaaaaaattggattgaaggaaatcctaaactcagttttctaaaacctggcatattgactggacgtggcaaaacaaatcagaacacaggaatgaccctcccggcacagaagtgtatattggatgcattcaaagccagtggagatcacaatattctgattgccacctcagttgctgatgaaggcattgacattgcacagtgcaatcttgtcatcctttatgagtatgtgggcaatgtcatcaaaatgatccaaaccagaggcagaggaagagcaagaggtagcaagtgcttccttctgactagtaatgctggtgtaattgaaaaagaacaaataaacatgtacaaagaaaaaatgatgaatgactctattttacgccttcagacatgggacgaagcagtatttagggaaaagattctgcatatacagactcatgaaaaattcatcagagatagtcaagaaaaaccaaaacctgtacctgataaggaaaataaaaaactgctctgcagaaagtgcaaagccttggcatgttacacagctgacgtaagagtgatagaggaatgccattacactgtgcttggagatgcttttaaggaatgctttgtgagtagaccacatcccaagccaaagcagttttcaagttttgaaaaaagagcaaagatattctgtgcccgacagaactgcagccatgactggggaatccatgtgaagtacaagacatttgagattccagttataaaaattgaaagttttgtggtggaggatattgcaactggagttcagacactgtactcgaagtggaaggactttcattttgagaagataccatttgatccagcagaaatgtccaaatgatatcaggtcctcaatcttcagctacagggaatgagtaactttgagtggagaagaaacaaacatagtgggtataatcatggatcgcttgtacccctgtgaaaatatattttttaaaaatatctttagcagtttgtactatattatatatgcaaagcacaaatgagtgaatcacagcactgagtattttgtaggccaacagagctcatagtacttgggaaaaattaaaaagcctcatttctagccttctttttagagtcaactgccaacaaacacacagtaatcactctgtacacactgggatagatgaatgaatggaatgttgggaatttttatctccctttgtctccttaacctactgtaaactggcttttgcccttaacaatctactgaaattgttcttttgaaggttaccagtgactctggttgccaaatccactgggcacttcttaaccttctatttgacctctgcgcatttggccctgttgagcactcttcttgaagctctccctgggcttctctctcttctagttctattctagtctttttttattgagtcctcctctttgctgatcccttccaagggttcaatatatatacatgtatatactgtacatatgtatatgtaactaatatacatacatacaggtatgtatatgtaatggttatatgtactcatgttcctggtgtagcaacgtgtggtatggctacacagagaacatgagaacataaagccatttttatgcttactactaaaagctgtccactgtagagttgctgtatgtagcaatgtgtatccactctacagtggtcagcttttagtagagagcataaaaatgataaaatacttcttgaaaacttagtttactatacatcttgccctattaatatgttctcttaacgtgtgccattgttctctttgaccattttcctataatgatgttgatgttcaacacctggactgaatgtctgttctcagatcccttggatgttacagatgaggcagtctgactgtcctttctacttgaaagattagaatatgtatccaaatggcattcacgtgtcacttagcaaggtttgctgatgcttcaaagagcttagtttgcggtttcctggacgtggaaacaagtatctgagttccctggagatcaacgggatgaggtgttacagctgcctccctcttcatgcaatctggtgagcagtggtgcaggcggggagccagagaaacttgccagttatataacttctctttggcttttcttcatctgtaaaacaaggataatactgaactgtaagggttagtggagagtttttaattaaaagaatgtgtgaaaagtacatgacacagtagttgcttgataatagttactagtagtagtattcttactaagacccaatacaaatggattatttaaaccaa

SEQ ID NO: 2094 - DNA, 4621 bp, Homo sapiens
tagttattaaagttcctatgcagctccgcctcgcgtccggcctcatttcctcggaaaatccctgctttccccgctcgccacgccctcctcctacccggctttaaagctagtgaggcacagcctgcggggaacgtagctagctgcaagcagaggccggcatgaccaccgagcagcgacgcagcctgcaagccttccaggattatatccggaagaccctggaccctacctacatcctgagctacatggccccctggtttagggagggttattctggactttatgaagccattgaaagttgggatttcaaaaaaattgaaaagttggaggagtatagattacttttaaaacgtttacaaccagaatttaaaaccagaattatcccaaccgatatcatttctgatctgtctgaatgtttaattaatcaggaatgtgaagaaattctacagatttgctctactaaggggatgatggcaggtgcagagaaattggtggaatgccttctcagatcagacaaggaaaactggcccaaaactttgaaacttgctttggagaaagaaaggaacaagttcagtgaactgtggattgtagagaaaggtataaaagatgttgaaacagaagatcttgaggataagatggaaacttctgacatacagattttctaccaagaagatccagaatgccagaatcttagtgagaattcatgtccaccttcagaagtgtctgatacaaacttgtacagcccatttaaaccaagaaattaccaattagagcttgctttgcctgctatgaaaggaaaaaacacaataatatgtgctcctacaggttgtggaaaaacctttgtttcactgcttatatgtgaacatcatcttaaaaaattcccacaaggacaaaaggggaaagttgtcttttttgcgaatcagatcccagtgtatgaacagcagaaatctgtattctcaaaatactttgaaagacatgggtatagagttacaggcatttctggagcaacagctgagaatgtcccagtggaacagattgttgagaacaatgacatcatcattttaactccacagattcttgtgaacaaccttaaaaagggaacgattccatcactatccatctttactttgatgatatttgatgaatgccacaacactagtaaacaacacccgtacaatatgatcatgtttaattatctagatcagaaacttggaggatcttcaggcccactgccccaggtcattgggctgactgcctcggttggtgttggggatgccaaaaacacagatgaagccttggattatatctgcaagctgtgtgcttctcttgatgcgtcagtgatagcaacagtcaaacacaatctggaggaactggagcaagttgtttataagccccagaagtttttcaggaaagtggaatcacggattagcgacaaatttaaatacatcatagctcagctgatgagggacacagagagtctggcaaagagaatctgcaaagacctcgaaaacttatctcaaattcaaaatagggaatttggaacacagaaatatgaacaatggattgttacagttcagaaagcatgcatggtgttccagatgccagacaaagatgaagagagcaggatttgtaaagccctgtttttatacacttcacatttgcggaaatataatgatgccctcattatcagtgagcatgcacgaatgaaagatgctctggattacttgaaagacttcttcagcaatgtccgagcagcaggattcgatgagattgagcaagatcttactcagagatttgaagaaaagctgcaggaactagaaagtgtttccagggatcccagcaatgagaatcctaaacttgaagacctctgcttcatcttacaagaagagtaccacttaaacccagagacaataacaattctctttgtgaaaaccagagcacttgtggacgctttaaaaaattggattgaaggaaatcctaaactcagttttctaaaacctggcatattgactggacgtggcaaaacaaatcagaacacaggaatgaccctcccggcacagaagtgtatattggatgcattcaaagccagtggagatcacaatattctgattgccacctcagttgctgatgaaggcattgacattgcacagtgcaatcttgtcatcctttatgagtatgtgggcaatgtcatcaaaatgatccaaaccagaggcagaggaagagcaagaggtagcaagtgcttccttctgactagtaatgctggtgtaattgaaaaagaacaaataaacatgtacaaagaaaaaatgatgaatgactctattttacgccttcagacatgggacgaagcagtatttagggaaaagattctgcatatacagactcatgaaaaattcatcagagatagtcaagaaaaaccaaaacctgtacctgataaggaaaataaaaaactgctctgcagaaagtgcaaagccttggcatgttacacagctgacgtaagagtgatagaggaatgccattacactgtgcttggagatgcttttaaggaatgctttgtgagtagaccacatcccaagccaaagcagttttcaagttttgaaaaaagagcaaagatattctgtgcccgacagaactgcagccatgactggggaatccatgtgaagtacaagacatttgagattccagttataaaaattgaaagttttgtggtggaggatattgcaactggagttcagacactgtactcgaagtggaaggactttcattttgagaagataccatttgatccagcagaaatgtccaaatgatatcaggtcctcaatcttcagctacagggaatgagtaactttgagtggagaagaaacaaacatagtgggtataatcatggatcgcttgtacccctgtgaaaatatattttttaaaaatatctttagcagtttgtactatattatatatgcaaagcacaaatgagtgaatcacagcactgagtattttgtaggccaacagagctcatagtacttgggaaaaattaaaaagcctcatttctagccttctttttagagtcaactgccaacaaacacacagtaatcactctgtacacactgggatagatgaatgaatggaatgttgggaatttttatctccctttgtctccttaacctactgtaaactggcttttgcccttaacaatctactgaaattgttcttttgaaggttaccagtgactctggttgccaaatccactgggcacttcttaaccttctatttgacctctgcgcatttggccctgttgagcactcttcttgaagctctccctgggcttctctctcttctagttctattctagtctttttttattgagtcctcctctttgctgatcccttccaagggttcaatatatatacatgtatatactgtacatatgtatatgtaactaatatacatacatacaggtatgtatatgtaatggttatatgtactcatgttcctggtgtagcaacgtgtggtatggctacacagagaacatgagaacataaagccatttttatgcttactactaaaagctgtccactgtagagttgctgtatgtagcaatgtgtatccactctacagtggtcagcttttagtagagagcataaaaatgataaaatacttcttgaaaacttagtttactatacatcttgccctattaatatgttctcttaacgtgtgccattgttctctttgaccattttcctataatgatgttgatgttcaacacctggactgaatgtctgttctcagatcccttggatgttacagatgaggcagtctgactgtcctttctacttgaaagattagaatatgtatccaaatggcattcacgtgtcacttagcaaggtttgctgatgcttcaaagagcttagtttgcggtttcctggacgtggaaacaagtatctgagttccctggagatcaacgggatgaggtgttacagctgcctccctcttcatgcaatctggtgagcagtggtgcaggcggggagccagagaaacttgccagttatataacttctctttggcttttcttcatctgtaaaacaaggataatactgaactgtaagggttagtggagagtttttaattaaaagaatgtgtgaaaagtacatgacacagtagttgcttgataatagttactagtagtagtattcttactaagacccaatacaaatggattatttaaaccaagtttatgagttggttttttttcattttctatttgtattttattaagagtgtcttttcttatgtgattttttttaattgctatttgatatggtttggctatatgtccccacccaaatctcatcttgaattataatccccatgtgtcaagggagggacctgacgggaggtgattggatcacgggggcagttgtccccatgctgttcttgggatagtgagttagttctcatgagatctgatggttttataagtgtttgacaattcctcctttacacacactctctctctcatctgctgccatgtaagacttgcctgcttccccttctgccatgattgtaagtttcctgaggcctcctcagccatgtggaactgtgaatctattaagcctcttttctttataaatga

SEQ ID NO: 2095 - DNA, 4353 bp, Homo sapiens
tagttattaaagttcctatgcagctccgcctcgcgtccggcctcatttcctcggaaaatccctgctttccccgctcgccacgccctcctcctacccggctttaaagctagtgaggcacagcctgcggggaacgtagctagctgcaagcagaggccggcatgaccaccgagcagcgacgcagcctgcaagccttccaggattatatccggaagaccctggaccctacctacatcctgagctacatggccccctggtttagggaggaagaggtgcagtatattcaggctgagaaaaacaacaagggcccaatggaggctgccacactttttctcaagttcctgttggagctccaggaggaaggctggttccgtggctttttggatgccctagaccatgcaggttattctggactttatgaagccattgaaagttgggatttcaaaaaaattgaaaagttggaggagtatagattacttttaaaacgtttacaaccagaatttaaaaccagaattatcccaaccgatatcatttctgatctgtctgaatgtttaattaatcaggaatgtgaagaaattctacagatttgctctactaaggggatgatggcaggtgcagagaaattggtggaatgccttctcagatcagacaaggaaaactggcccaaaactttgaaacttgctttggagaaagaaaggaacaagttcagtgaactgtggattgtagagaaaggtataaaagatgttgaaacagaagatcttgaggataagatggaaacttctgacatacagattttctaccaagaagatccagaatgccagaatcttagtgagaattcatgtccaccttcagaagtgtctgatacaaacttgtacagcccatttaaaccaagaaattaccaattagagcttgctttgcctgctatgaaaggaaaaaacacaataatatgtgctcctacaggttgtggaaaaacctttgtttcactgcttatatgtgaacatcatcttaaaaaattcccacaaggacaaaaggggaaagttgtcttttttgcgaatcagatcccagtgtatgaacagcagaaatctgtattctcaaaatactttgaaagacatgggtatagagttacaggcatttctggagcaacagctgagaatgtcccagtggaacagattgttgagaacaatgacatcatcattttaactccacagattcttgtgaacaaccttaaaaagggaacgattccatcactatccatctttactttgatgatatttgatgaatgccacaacactagtaaacaacacccgtacaatatgatcatgtttaattatctagatcagaaacttggaggatcttcaggcccactgccccaggtcattgggctgactgcctcggttggtgttggggatgccaaaaacacagatgaagccttggattatatctgcaagctgtgtgcttctcttgatgcgtcagtgatagcaacagtcaaacacaatctggaggaactggagcaagttgtttataagccccagaagtttttcaggaaagtggaatcacggattagcgacaaatttaaatacatcatagctcagctgatgagggacacagagagtctggcaaagagaatctgcaaagacctcgaaaacttatctcaaattcaaaatagggaatttggaacacagaaatatgaacaatggattgttacagttcagaaagcatgcatggtgttccagatgccagacaaagatgaagagagcaggatttgtaaagccctgtttttatacacttcacatttgcggaaatataatgatgccctcattatcagtgagcatgcacgaatgaaagatgctctggattacttgaaagacttcttcagcaatgtccgagcagcaggattcgatgagattgagcaagatcttactcagagatttgaagaaaagctgcaggaactagaaagtgtttccagggatcccagcaatgagaatcctaaacttgaagacctctgcttcatcttacaagaagagtaccacttaaacccagagacaataacaattctctttgtgaaaaccagagcacttgtggacgctttaaaaaattggattgaaggaaatcctaaactcagttttctaaaacctggcatattgactggacgtggcaaaacaaatcagaacacaggaatgaccctcccggcacagaagtgtatattggatgcattcaaagccagtggagatcacaatattctgattgccacctcagttgctgatgaaggcattgacattgcacagtgcaatcttgtcatcctttatgagtatgtgggcaatgtcatcaaaatgatccaaaccagaggcagaggaagagcaagaggtagcaagtgcttccttctgactagtaatgctggtgtaattgaaaaagaacaaataaacatgtacaaagaaaaaatgatgaatgactctattttacgccttcagacatgggacgaagcagtatttagggaaaagattctgcatatacagactcatgaaaaattcatcagagatagtcaagaaaaaccaaaacctgtacctgataaggaaaataaaaaactgctctgcagaaagtgcaaagccttggcatgttacacagctgacgtaagagtgatagaggaatgccattacactgtgcttggagatgcttttaaggaatgctttgtgagtagaccacatcccaagccaaagcagttttcaagttttgaaaaaagagcaaagatattctgtgcccgacagaactgcagccatgactggggaatccatgtgaagtacaagacatttgagattccagttataaaaattgaaagttttgtggtggaggatattgcaactggagttcagacactgtactcgaagtggaaggactttcattttgagaagataccatttgatccagcagaaatgtccaaatgatatcaggtcctcaatcttcagctacagggaatgagtaactttgagtggagaagaaacaaacatagtgggtataatcatggatcgcttgtacccctgtgaaaatatattttttaaaaatatctttagcagtttgtactatattatatatgcaaagcacaaatgagtgaatcacagcactgagtattttgtaggccaacagagctcatagtacttgggaaaaattaaaaagcctcatttctagccttctttttagagtcaactgccaacaaacacacagtaatcactctgtacacactgggatagatgaatgaatggaatgttgggaatttttatctccctttgtctccttaacctactgtaaactggcttttgcccttaacaatctactgaaattgttcttttgaaggttaccagtgactctggttgccaaatccactgggcacttcttaaccttctatttgacctctgcgcatttggccctgttgagcactcttcttgaagctctccctgggcttctctctcttctagttctattctagtctttttttattgagtcctcctctttgctgatcccttccaagggttcaatatatatacatgtatatactgtacatatgtatatgtaactaatatacatacatacaggtatgtatatgtaatggttatatgtactcatgttcctggtgtagcaacgtgtggtatggctacacagagaacatgagaacataaagccatttttatgcttactactaaaagctgtccactgtagagttgctgtatgtagcaatgtgtatccactctacagtggtcagcttttagtagagagcataaaaatgataaaatacttcttgaaaacttagtttactatacatcttgccctattaatatgttctcttaacgtgtgccattgttctctttgaccattttcctataatgatgttgatgttcaacacctggactgaatgtctgttctcagatcccttggatgttacagatgaggcagtctgactgtcctttctacttgaaagattagaatatgtatccaaatggcattcacgtgtcacttagcaaggtttgctgatgcttcaaagagcttagtttgcggtttcctggacgtggaaacaagtatctgagttccctggagatcaacgggatgaggtgttacagctgcctccctcttcatgcaatctggtgagcagtggtgcaggcggggagccagagaaacttgccagttatataacttctctttggcttttcttcatctgtaaaacaaggataatactgaactgtaagggttagtggagagtttttaattaaaagaatgtgtgaaaagtacatgacacagtagttgcttgataatagttactagtagtagtattcttactaagacccaatacaaatggattatttaaaccaa

SEQ ID NO: 2096 - DNA, 2398 bp, Homo sapiens
agaatggcctcggacacccaggcagtccctgacgtgtcggggaggagccgggcgcggaggtacgctgagtggagctcggggctgcgtaggggagctgagccgagcggctgggcgggcctggccgggccggcggaggggagacgtcggttgagcggcggcgaacatgcgcttttgacacattggaggctttcttgatcatggatggtgaagatataccagatttttcaagtttaaaggaggaaactgcttattggaaggaactttccttgaagtataagcaaagcttccaggaagctcgggatgagctagttgaattccaggaaggaagcagagaattagaagcagagttggaggcacaattagtacaggctgaacaaagaaatagagacttgcaggctgataaccaaagactgaaatatgaagtggaggcattaaaggagaagctagagcatcaatatgcacagagctataagcaggtctcagtgttagaagatgatttaagtcagactcgggccattaaggagcagttgcataagtatgtgagagagctggagcaggccaacgacgacctggagcgagccaaaagggcaacaatagtttcactggaagactttgaacaaaggctaaaccaggccattgaacgaaatgcatttttagaaagtgaacttgatgaaaaggaatctttgttggtctctgtacagaggttaaaggatgaagcaagagatttaaggcaagaactagcagttcgggaaagacaacaggaagtaactagaaagtcggctcctagctctccaactctagactgtgaaaagatggactccgccgtccaagcatcactttctttgccagctacccctgttggcaaaggaacggagaacacttttccttcaccgaaagctataccaaatggttttggtaccagtccactaactccctctgctaggatatcagcactaaacatcgtgggggatctcttacggaaagtaggggctttagaatccaaattagcagcttgcaggaattttgcaaaggaccaagcatcacgaaaatcctatatttcagggaatgttaactgtggggtgctgaatggcaatggcacaaagttctctcgatcagggcatacatctttcttcgacaaagggcaagaaaaagtcatatttcccacgttgttcatggggcagtaaacggctttgaccccgctcctcctcctcctggtctgggctcctcgcgtccatcgtcagcgccgggtatgctgcctctcagtgtgtgagtgcctagcctccaggtgggggctcctgccctcctccaacaacccaggacacccacgcctcacccctcggtgcctgggcccagccccgtgcccctccgtctgcctccgcacggctggcagagggcaggctgcatgcagtggcggctactgggccctgcccagccccggaactctgcgcgatatcaatactggctattttctcttctcgccgtagtgccgttggtttcacatgattgcacttttgtgggtcgcaaggtgatacatacgtgtattacttggtcactggatgcagaagtacccattcatcacacctgccccatagcccccactctgctgtactgataggatttagttgtgttttaggacattgcaaatcttctagaagttctcccccaaatcaggtcaatgtgtgccctcctgagctcccacccaggcatctccagtgctcatgatcatgtgtcccccaactccacccctcacagtttgggcctgtttctggcaaagagtcaggaaggttactgaattagggaacattttctgcaccttctgattttacttaagcagctaccattccatggacttgcctcccagagcagcacaatgcccgtctgagccccacgtggcaggagcctctgggacggggcacacacaggcccagcctctgtgctgtctcctcctccgtgcgcctcagactcggggtgagggaggcgggcagcctctcgccagccttcccgtccttcagttcaacgacatctttggagtgtttttgttttctcttccaagggccgtcccgttgtgttaggaagggtgagtggctggttccagggtgggccggtgccagctccggggtggactgaacagcggcggctgtccctgtgcatcctttgattactctcatgctgcatttactgtttacatttgttttattgtacataggtttgtaaacattattgcctgagatatttgtatataacttgggctttgtagcttttatttattcagaacgcatacggcatgttaatgactctgatggtgtcctcctctgggcagctgtataggatcatcatgtggttacaaaaaatacttccctcaaaaaaattcttttaatgtggaaacaataaatttcac

SEQ ID NO: 2097 - DNA, 3675 bp, Homo sapiens
gctgcgagggttgccgaaggcgcacggatctgggcgctgaaaaagccaggatttggcaatggctttgctgtgtggccttgggcaagtcactctgcgtatctgggtttcacttccttcccaatccgaaaacgggattgggttccttgcagcccgggcattcctgaggagcggcggcatggaggctctcaccactcagctggggccggggcgcgagggcagttcctcgcccaactccaagcaggagctgcagccgtactcgggctccagcgctctcaaacccaaccaggtgggcgagacgtcgctgtacggggtgcccattgtgtcgctggtcatcgacggccaggagcgcctatgcctggcgcagatctccaacaccctcctcaagaactacagctataatgagatccacaaccgccgcgtggccctgggcatcacgtgcgtgcagtgcacgccggtacagctggagattctgcgtcgggccggggccatgcccatctcgtcgcgccgctgcggcatgatcactaagcgagaggccgaacgcctgtgcaagtcgttcctgggcgagcacaaaccacccaagctgcccgagaacttcgccttcgatgtggtgcacgagtgcgcgtggggctcgcgtggtagcttcatccctgcgcgttacaacagctctcgtgccaagtgcatcaagtgcggctactgcagcatgtacttctcgcccaacaagttcatcttccactcgcaccgaacacccgacgccaagtacacgcagcccgatgccgccaacttcaactcctggcgtcgtcacctcaaactcagtgacaagtcggccacagacgaactgagccatgcttgggaggacgtcaaggccatgtttaatggcggcacgcgcaagcggaccttctccctacaaggaggcggcggaggcggtgccaatggcgggtcgggtgggcaggggaagggtggtgctggcggcggtggcggcggtggcccagggtgcggtgcagagatggccccaggcccgccgccccacaaaagcctgcgctgtggcgaagatgaggctgccgggcctccggggccacctccaccccacccgcagcgcggacttggcctggcgactggagctagtggcccggcgggcccaggagggcccggtggcggcgccggcgtacgaagctacccggtgatcccggtgcccagcaaaggctttgggctcctgcaaaagctgcccccaccacttttcccccatccttacggcttccctacggccttcggcctatgccccaaaaaggacgacccggttttaggcgcgggcgagccaaagggcggtcctggcactgggagcggcggcggcggcgcggggacaggcgggggtgcggggggcccgggagccagccacttgcccccgggggcaggggcgggcccgggcggcggcgccatgttctgggggcatcaaccctccggggcagccaaggacgcagcggcagtggctgcagcggccgccgccgccactgtgtacccgacgtttcccatgttctggccagcagcaggcagcctcccggtaccgtcctaccccgctgctcagagccaagccaaggccgtggcggcagccgtggcggcggcagcggcggcggcagcggcagctgctggcagcggtgccccagagcccctggacggtgccgagccagccaaagagagtggcctcggcgcggaggagcgctgcccgagcgctctgtcccgcgggcccctggacgaagacggcacggacgaggcgctgccaccgcccctggccccgttgcccccgccgcccccgccgcccgcacgcaaaggctcctacgtgtcggccttccggccggtggtcaaggacaccgagagcatcgctaagctctacgggagcgcccgggaggcgtacggcgcggggcctgctcgggggccgggacccggcgctgggagcggcggctacgtgagcccggactttctgagcgagggcagctccagctacaattccgcctcgcccgacgtggacaccgcggacgagcccgaggtggacgtggaatccaaccgcttccccgacgacgaggacgcccaagaggagaccgagcccagcgcacccagcgcagggggcggcccagacggtgaacagcccactggacccccttccgccacctcctctggcgcggacggtcccgcaaactctcccgacggcggcagcccccgcccccggcgccgcctcgggccacccccagctggccggcccgcatttggggacttggcagccgaagacttggtgcggagacctgagaggagcccgccaagcggcggcggcggctacgagctgcgagagccttgcgggcccctaggaggccccgcgccggccaaggtgttcgcgcccgagagggatgagcacgtgaagagcgcggcggtggcgctggggcccgcggcctcctacgtctgcacccccgaggcccacgagccagataaggaagacaatcactcgcccgccgatgatttggaaacgaggaaatcctatccagaccaaaggagtatctcccagccaagtcctgcaaatacagacagaggcgaagatgggcttaccttggatgtcacaggaactcatttggtggagaaagatatcgagaacctggccagagaggaattgcaaaaactgctcctggaacaaatggagctccgcaagaagctggaacgggaatttcagagtctcaaagataattttcaggatcaaatgaagagggaattggcttatcgagaagaaatggtgcaacagctgcaaattgtcagagataccctgtgtaacgaactcgaccaggagcggaaggcgcgctatgccatccagcagaaattgaaagaagcccacgacgccctgcaccatttctcctgcaagatgctgacgccccgccactgcactggcaactgctccttcaagccaccgctgttgccctagggccggcctggccgcacccctgcgccctcaagccatgctgctccttgtaaatacccgctgctgcggtggccctgagcgaggaacaagccattcggacccgaccgatgtaaatacagccgcccgtccgcccgccttcctcccgggctccccggccttgcccgccccctcccgggcgtccctgtccagggccccggcttggtttccaagtgtaaataccgcctcgcgcctcaaatccccctaccccgtgtgaactctagggcatcggacctcaaggggttaactggacagacggggggcgggaggggagagcgccccctcccattgtatagccttgaacccgattgtgaatacaatgtagcaacttcgctggcgcctgccccgcactccccgtcccgtccacttctgaaactcctgttcctaatgacaaagtggctatgtgcaatggatataaatgtactgtgagtctctcggttcagtattaggttcactttaatttatttatgctgtaagttatttttgcttccttctcctggacccacttccagtcccgttttgcattcccctttggattttgctttggctattttttgttgtaacctcttgatgtaacagcactttaaaagggcgacaactgactcacgagatggcaaccacctggagcctgtttggggagaccaccctgtacccgtgactttcgtttttaataataataataataa

SEQ ID NO: 2098 - DNA, 2160 bp, Homo sapiens
atcccgcccccgttgccgggatacgccgcggcgcacggcagttagtgggtaggcctgagagccgaggaaaactgagcgtgggcctcagaaagaagttaaggcacccgcgagccgggcaactgccctccttccgcgccggcggagcgattaaagtgaagaaacaatggccagcaatcacaaatcttcagcagctcgccctgtttcaagaggtggagttgggttaacaggaaggcctccttctgggatacgacccctatcaggaaatattcgagtggcaactgcaatgccacctgggacagcaagaccaggttctcgtggttgtcccatagggactggtggagttctgtcttctcaaatcaaagttgcccatcgccctgtaacacaacaaggtttgactggaatgaaaactgggacgaaaggtccccagaggcaaattttagacaaatcttactatcttgggcttcttagaagtaaaataagtgaacttacaactgaagttaataaacttcagaagggaatagaaatgtacaatcaagagaattcagtatatttgtcatatgaaaagagggctgagactttagctgttgagataaaagagcttcaaggacaactagcagactacaacatgttggtagataaacttaataccaacactgaaatggaagaagtaatgaatgattacaatatgcttaaagctcaaaatgatcgagaaacacaaagtttggatgtcatatttactgaaagacaagcgaaagaaaaacaaatcagaagtgtcgaagaagaaattgaacaggaaaaacaagcaacagatgacattatcaaaaatatgtcttttgaaaaccaagtcaagtacctagagatgaaaaccacaaatgagaaactgttacaggaattagatacacttcaacaacaattggattcacagaacatgaaaaaagagagcctggaagcagaaatagctcactcccaggtgaaacaggaggcggtattgctgcatgaaaaactttatgagttggagtcccatcgagatcaaatgattgcagaagacaaaagcataggatctccaatggaagagagagagaaattacttaagcagattaaagatgataatcaggaaatagccagcatggaaagacagttaacagatacaaaagaaaagataaatcagtttattgaagaaattagacaacttgacatggatttagaggaacaccaaggtgaaatgaaccagaaatacaaggagctaaagaaaagggaggaacatatggacacttttattgagacttttgaggaaacaaagaatcaggaactgaaacgaaaggcacagatagaagccaacattgttgcactcttggagcactgcagtcgaaatataaatcgtatagaacagatatcctctatcaccaatcaagagctaaagatgatgcaggatgacctcaattttaaatctactgaagtgcagaaatcacaaagtacagctcagaatttgacttcagacattcaacgtctgcagttggatctgcagaaaatggagcttctagaaagtaagatgactgaagaacagcattctctaaaaagcaaaattaagcaaatgacaactgatctggagatatataatgatttgccagctttaaaatcatcaggtgaagaaaagataaagaaattacatcaggagagaatgatattatcaacccacagaaatgcctttaagaaaataatggagaagcaaaacatagagtatgaggcactaaaaacacaattgcaagaaaatgagacacattctcagcttacaaatttggagagaaagtggcaacaccttgagcaaaataattttgcgatgaaagaattcatagcaaccaagagtcaagagagtgattaccagccaattaagaaaaatgtgaccaagcagattgcagagtacaataaaaccatcgtggatgctttacatagcaccagcggaaactgagtttaagtccactgaaagtctctaaggaagtatcctcttgctgctaaacttggtacaagttgactaccaaaaaaaaaaaaagcttacttttggagtttacctaaaatttctgaatgttataatttttgtggcctcttttaagaatgatattttaaaatagtaaatagttcaataaatggtttgcatattaaaaa

SEQ ID NO: 2099 - DNA, 1389 bp, Homo sapiens
aaacagtgctacccacagagtgaacaagagagagtcatttgggaaacaaaaggagaattttacagagagagagggatagctaaaactacgtgagcctggcgagggtgcagagcagaaagtagagactgtccgaagactgctatctgggacgagacaagttgttaaagggacaggagagaaagcagagctatttcaagagtgagccacagaagggaatccagaggccatctaagcgaggaagggtctacaggcagtgagtgaaggccaggagcagggcccaggccaggcacgaccaccgaggggatgaacttcacagtgggtttcaagccgctgctaggggatgcacacagcatggacaacctggagaagcagctcatctgccccatctgcctggagatgttctccaaaccagtggtgatcctgccctgccaacacaacctgtgccgcaaatgtgccaacgacgtcttccaggcctcgaatcctctatggcagtcccggggctccaccactgtgtcttcaggaggccgtttccgctgcccatcgtgcaggcatgaggttgtcctggacagacacggtgtctacggcctgcagcgaaacctgctagtggagaacattatcgacatttacaagcaggagtcatccaggccgctgcactccaaggctgagcagcacctcatgtgcgaggagcatgaagaagagaagatcaatatttactgcctgagctgtgaggtgcccacctgctctctctgcaaggtcttcggtgcccacaattacaaacgccagaagagtgagctcagcgatggcatcgcgatgctggtggcaggcaatgaccgcgtgcaagcagtgatcacacagatggaggaggtgtgccagactatcgaggacaatagccggaggcagaagcagttgttaaaccagaggtttgagagcctgtgcgcagtgctggaggagcgcaagggtgagctgctgcaggcgctggcccgggagcaagaggagaagctgcagcgcgtccgcggcctcatccgtcagtatggcgaccacctggaggcctcctctaagctggtggagtctgccatccagtccatggaagagccacaaatggcgctgtatctccagcaggccaaggagctgatcaataaggtcggggccatgtcgaaggtggagctggcagggcggccggagccaggctatgagagcatggagcaattcaccgtaagggtggagcacgtggccgaaatgctgcggaccatcgacttccagccaggcgcttccggggaggaagaggaggtggccccagacggagaggagggcagcgcggggccggaggaagagcggccggatgggccgttgggcccttatagtgcctacgttagtctgtgtggagcccct

SEQ ID NO: 2100 - DNA, 1967 bp, Homo sapiens
acagtaaaattaatctgctctctggggagtaagggacaaacagtgctacccacagagtgaacaagagagagtcatttgggaaacaaaaggagaattttacagagagagagggatagctaaaactacgtgagcctggcgagggtgcagagcagaaagtagagactgtccgaagactgctatctgggacgagacaagttgttaaagggacaggagagaaagcagagctatttcaagagtgagccacagaagggaatccagaggccatctaagcgaggaagggtctacaggcagtgagtgaaggccaggagcagggcccaggccaggcacgaccaccgaggggatgaacttcacagtgggtttcaagccgctgctaggggatgcacacagcatggacaacctggagaagcagctcatctgccccatctgcctggagatgttctccaaaccagtggtgatcctgccctgccaacacaacctgtgccgcaaatgtgccaacgacgtcttccaggcctcgaatcctctatggcagtcccggggctccaccactgtgtcttcaggaggccgtttccgctgcccatcgtgcaggcatgaggttgtcctggacagacacggtgtctacggcctgcagcgaaacctgctagtggagaacattatcgacatttacaagcaggagtcatccaggccgctgcactccaaggctgagcagcacctcatgtgcgaggagcatgaagaagagaagatcaatatttactgcctgagctgtgaggtgcccacctgctctctctgcaaggtcttcggtgcccacaaggactgtgaggtggccccactgcccaccatttacaaacgccagaagagtgagctcagcgatggcatcgcgatgctggtggcaggcaatgaccgcgtgcaagcagtgatcacacagatggaggaggtgtgccagactatcgaggacaatagccggaggcagaagcagttgttaaaccagaggtttgagagcctgtgcgcagtgctggaggagcgcaagggtgagctgctgcaggcgctggcccgggagcaagaggagaagctgcagcgcgtccgcggcctcatccgtcagtatggcgaccacctggaggcctcctctaagctggtggagtctgccatccagtccatggaagagccacaaatggcgctgtatctccagcaggccaaggagctgatcaataaggtcggggccatgtcgaaggtggagctggcagggcggccggagccaggctatgagagcatggagcaattcaccgtaagggtggagcacgtggccgaaatgctgcggaccatcgacttccagccaggcgcttccggggaggaagaggaggtggccccagacggagaggagggcagcgcggggccggaggaagagcggccggatgggccttaaggcctgcgccgacccgaccctgctcgagagcccgcgctagagtcggggaggatctgcgcagagaccgcagcatcacccaaatcggcgccggccccgggaggatctcaataaagaactcgagcgtcccagacccgtatctcctttcgctgcccaaccccgcagcctgggcttcgaaggcgacccgcccaccatcctgcccttcccagaacctgagaccgtctggggggcggaagccaaatgaacccctattgggcacctctgtgatgccaggagcgaactggtgagcccagcgccctgggaagagggccgagggcggggcggtggtgccgggacctctgaggtcctggggatttggggacccttggggtccacatgcacctggctgacctggctgaaagccgctgtctcggagccccccacagcattttgttcccctcccgctggcccgggggccccaccttcccacgggttcccacgctgctgtgactgccctgcctctacgacaaaagccaacgggtcttcagtacttttattaaaaaatagtcacgca

SEQ ID NO: 2101 - DNA, 1098 bp, Homo sapiens
cactcactcacacactcactcactcacacacctcccccagctcaccgcctccccactccagcatggccgcctccaccatgtccatctgctccagcgcctgcactgactcttggcgggtagtcgactgcccagagagctgctgcgagccctgctgctgtgccccagcccccagcttgaccctggtctgcaccccagtgagctgtgtgtccagcccctgctgccagacggcctgtgagcccagcgcctgccaatcaggctacaccagctcctgcacaaccccatgctaccagcagtctagctgccagccggattgctgcacctcctccccctgccagcaggcctgctgtgtgcctgtctgctgtgtgcccgtctgctgcgtgcccgtctgtaacaagcctgtgtgcttcgtgcctacctgctccgagtcttccccttcatgctgccagcagtctagctgccagccaacttgctgcacctcctccccatgccagcaggcctgctgtgtgcctgtctgctctaagtccgtctgctatgtgcctgtgtgctctggggcttccacttcatgctgccagcagtctagctgccagcctgcttgctgcaccgcctcctgctgcagaccctcctcctccgtgtccctcctctgccaccctgtgtgcaagtccacctgctgcgtgcccgtcccctcctgcggtgcctctgcctcctcctgccagcccagctgctgccgcacggcctcctgtgtttccctcctctgccgccccgtgtgctcccgccctgcctgctacagcctctgctctggccagaagtccagctgctgacagccctggatgtgatccggagtcccttcccaccaggggctgacctcccagctgccccagcaagctctgccctctctggctttgacaccctcagaaggtggggcaggctctttgtcttggggaccaggatgctcccccagtccttcccagatgatggctgcctgtgggaccccagctactcccccagacccaagttctgcagaactaacccccagcaggcctggttccaccctgggcagcaccccctctagttctaataaagccgcctctgtctcacacc

SEQ ID NO: 2102 - DNA, 1595 bp, Homo sapiens
catctcctccagttcaatccccagcatggccgcgtccactatgtctgtctgctccagcgacctgagctacggcagccgcgtctgccttcctggttcctgtgactcttgctccgactcctggcaggtggacgactgcccagagagctgctgcgagcccccctgctgcgcccccagctgctgcgccccggccccctgcctgagcctggtctgcaccccagtgagccgtgtgtccagcccctgctgcccagtgacctgtgagcccagcccctgccaatcaggctgcaccagctcctgcacgccctcgtgctgccagcagtctagctgccagctggcttgctgtgcctcctccccctgccagcaggcctgctgcatgcccgtctgctgcaagactgtctgctgcaagcctgtgtactgtgtgcctgtctgcagtggggattcttcatgctgccagcagtctagctgccagtcagcttgctgcacctcctccccctgccagcaggcctgctgtgtgcccatctgctgcaagcctgtctgctctgggatttcctcttcgtgctgccagcagtctagctgtgtgagctgtgtgtccagcccctgctgccaggcggtctgtgagcccagcccctgccaatcaggctgcatcagctcctgcacgccctcgtgctgccagcagtctagctgccagccggcttgctgcacctcctccccctgccagcaggcctgctgtgtgcctgtctgctgcaagcccgtctgctgtgtgcccacctgctctgatgattccggttcatgctgccagccagcttgctgcacctcctcccaaagccagcagggctgctgcgtgcccgtctgctgtaagcctgtgtgctgtgtgcctgtctgctctggggcttccagttcatgctgccagcagtctagctgccagccggcttgctgcaccacctcctgctgcagaccctcctcctccgtgtccctcctctgccgccctgtgtgcaggcccacctgctgcgtgcccgtcccctcctgctgcgcccccacctcctcctgccaggccagctgctgccgcccagcctcctgtgtgtctctcctttgccgccccgcatgctcccgcccagcctgctgtggccccacctcaacccagaagtccagctgctgagtgatctccttaagatcatccaaagcctgagtgctcactgccacctgcacccctggattctttacccttgacggctctccacatcccgctcctaagccctgcagtggacatcagtggtcagctggccatccagtgtgcgcttctcctcctagaagcagctcagctgtttctccaagtcttgactttcccccaattacccagccctgcttccccagcaacaggtgggcagtgaccccagcaaggccagcgggtgctcccaggccatagcccggtgtggggagaaacgagggtagacacgtaccaactgtgggtttctcgtcactgtcccagctcagtggcgagccctgctcctcccctgctgtgggcctgggcctctttctctgtcttccctgaccacgggagcaggtcagacccttctaataaactcctttcctaaaaagta

SEQ ID NO: 2103 - DNA, 4401 bp, Homo sapiens
aaggccctgcgagattctgtgccccttgtcgggccgcttgtttggctgctgccgtcacctcatggcgacgcgggtagaggaggcagcgcggggaagaggcggcggcgccgaagaggcgactgaggccggacggggcggacggcgacgcagcccgcggcagaagtttgaaattggcacaatggaagaagctggaatttgtgggctaggggtgaaagcagatatgttgtgtaactctcaatcaaatgatattcttcaacatcaaggctcaaattgtggtggcacaagtaacaagcattcattggaagaggatgaaggcagtgactttataacagagaacaggaatttggtgagcccagcatactgcacgcaagaatcaagagaggaaatccctgggggagaagctcgaacagatccccctgatggtcagcaagattcagagtgcaacaggaacaaagaaaaaactttaggaaaagaagttttattactgatgcaagccctaaacaccctttcaaccccagaggagaagctggcagctctctgtaagaaatatgctgatcttctggaggagagcaggagtgttcagaagcaaatgaagatcctgcagaagaagcaagcccagattgtgaaagagaaagttcacttgcagagtgaacatagcaaggctatcttggcaagaagcaagctagaatctctttgcagagaacttcagcgtcacaataagacgttaaaggaggaaaatatgcagcaggcacgagaggaagaagaacgacgtaaagaagcaactgcacatttccagattaccttaaatgaaattcaagcccagctggagcagcatgacatccacaacgccaaactccgacaggaaaacattgagctgggggagaagctaaagaagctcatcgaacagtacgcactgagggaagagcacattgataaggtgttcaaacataaggaactgcaacagcagctcgtggatgccaaactgcagcaaacgacacaactgataaaagaagctgatgaaaaacatcagagagagagagagtttttattaaaagaagcgacagaatcgaggcacaaatacgaacaaatgaaacagcaagaagtacaactaaaacagcagctttctctttatatggataagtttgaagaattccagactaccatggcaaaaagcaatgaactgtttacaaccttcagacaggaaatggaaaagatgacaaagaaaattaaaaaactggaaaaagaaacaataatttggcgtaccaaatgggaaaacaataataaagcacttctgcaaatggctgaagagaaaacagtccgtgataaagagtacaaggcccttcaaataaaactggaacggttagagaagctgtgcagggctcttcagacagaaaggaatgagctcaatgagaaggtggaagtcctgaaagagcaggtatccatcaaagcggccatcaaagcggcgaacagggatttagcaacacctgtgatgcagccctgtactgccctggattctcacaaggagctgaacacttcctcgaaaagagccctgggagcgcacctggaggctgagcccaagagtcagagaagcgctgtgcaaaagcccccgtccacaggctctgctccggccatcgagtcggttgactaagatgaggtgtgatcactgtattgagagatatattttgtgtataactttctctgttagtagttaactattggttttgtggtgaaaattttcttactttttctaccatatctgtattttcttagaactactggacttatgtggtacaggaggctgcttagcagttttgaatagtttaatctataaattttcctcagctgtgttgcacatcagcctcgttctccctccactggaatgcatgtgttcattgccttgtcctttctctccctgctccttgcacattatcatcctaatgaaaatttcactgacagggccgaccattacaagggaactttgttctgacgatggttccttgatgtgaaaacaatattaatttaaacgtcttagcccccccccccataatattattcagaaaaacaaaataccaaggcgattagttttgtctaataacccatttaaatgccaagtaaaaataaaactcctagtgttgggtcagaagcatatttgattgaaattagctttttgaaaacatttatatctcgggacaaattgagatggccacatgcctagaatcctaagtttcggcagaatatgtatataaagatgtcacttgtggacaaaatagtacatagaggcaaatcactagacaaataagcttagtgtttacgtgactgaacagtcatcctgctttggtttcaggtgtgggatttggaccatgaggggctcccgtagaggatggcggtttgtgtttgattctgatttgggatttcagtacatattctccacttcccatagaaggccacttattctttgaaaactggtgttcatgtttgccgttcaatgaagtcccttgtcaaagacaaggacggtcaattcacgtgtcactttcactaggcagaagtttctccaataccttctggctacttgaaagttactacaaaaattccaccagcaaagtactccaggtttttcaaaagggaattttcattatggatcagtaccaaccgaaattgattttcatttccaaaacaaacactggcaccaacatttttactttgggaagacttggcagagtgttagtcatgatctgttacttacgtgttcagtctgttttctcacccccttcttagttaccatctcttttttaagaagaaaaaagaaaagccacagtattatcaaggtctctacacttggactgggggaaaatttgaaattaagcacataacttttgaattagttctttgtttcaatgttgaatgtggcgcagttatgcagatgattaatcaggctgcactgatggaagttttgactttgtccctggtataatttgcattgaaatgctttatgaaataaaaggttctactagaactgatgttagcacattccactgagcaaaactatcagactgacacttgttaaattgcttactggactgaataaactctgttttgtccagttaaaagggttttctctttgttacaagtgttatttgtaaagtcctgtcacattcatggtcgaaactgggttgaaagaattgaaaattgtccaacagatagatagataggaaaccgcctggagtggaggagggttgtatctaagcctccactatcagtcatgttaattcaaggggccacagtggaggaaaataaatccacaaagtagattatctaattaccatcaaaatgagtcagaagcaaaaaacaccaccctccaacagcctcttaggagtacaccctgttctgctactaaaatactagactcatttccctggtggtgggggggaatgcaggtatagatcagaaatataatccaccttaaaattagtactaatgatcacattatttcacaagaactctgctggatgtacagctcttaacattttattaagccatttgtgtagcccaccacgtttctttgtggtgcttgtcctgtgtggaagattgtaaatcttgggcctgttgcatacttccaagggctttaaagcaatgtgattaacagtacttggcctgctgcttttggcttactttgtatttttagctagatgctattatagtgttgaaaggatatggattctgtctgggatgcatttgttgtcctttcagaacccttcctcccattaccctgtgaataaaaacaaatgggaccccctgagaaggacatcttcctacagtgatcacctcaccagcccagtgttgtggctttgtagcgcaccccgtatctaccatattctagaacactgtaatgctactaggctggcccagaaaaggtttaaatgttgaattcacttaaattgcaattgttgcaccatcatggaatcgtgatgtgtattatttatattggcggtggactccaaggtgtagagaaaacttgggtcttgggtaatatggaccatttcatcctcagacttgttaggagtacatttcttggtcttgagaccagtatttttcagttatgtatgcaactgcctttattacacctggttatcacaattcaattctcaggtgttgcagaaaaatctacctctttcagactgtagatggaaataactgtgaaaaaaatgatgcagatatcttctagtttgtgctaaacacactgctttatttttacagcccacgtctttcatgaggatacgaattgttaagaggcagtctcgttttgcttttcaaagacattttgtagagatttttcactaatgtgaatctgattttatctacttgattctgtatagattaagtaaatatgtatgataaacttaa

SEQ ID NO: 2104 - DNA, 412 bp, Homo sapiens
agtatgcaccgcgatgcgcgcctcaccctgcatctcccagcccgcagccagctggcatcctagaccctctgccctgcgaccaacagccgggagcggaccagacaccagaactcccggaacggttgaagacggttccgctccctgtcccgcctttcgcagcccagcagtttcgccctgcggagaggagccttgctgtttccaaatctctcctgctgaagagacattggagctagggcggctagtttcacctggtaattgtgacaccctgtctcctcgagctgcaggcttttatgcttgtcatgttcgaagtttgataccttgcagatcaacaaagggccggtggcctctcactgcctccgcggcagggttgtcaagacatgcgcagtgcggcccgtccctagggctgggttaa

SEQ ID NO: 2105 - DNA, 2605 bp, Homo sapiens
gtccactgggcttggagtcagtggcaataaccaggggcaataaccaggcgtgtcccaggggggagccccgctctgcagccctgtgcgccgtagagagctggacttaggctggcagcatggccgagttcagggtcagggtgtccaccggagaagccttcggggctggcacatgggacaaagtgtctgtcagcatcgtggggacccggggagagagccccccactgcccctggacaatctcggcaaggagttcactgcgggcgctgaggaggacttccaggtgacgctcccggaggacgtaggccgagtgctgctgctgcgcgtgcacaaggcgcccccagtgctgcccctgctggggcccctggccccggatgcctggttctgccgctggttccagctgacaccgccgcggggcggccacctcctcttcccctgctaccagtggctggagggggcggggaccctggtgctgcaggagggtacagccaaggtgtcctgggcagaccaccaccctgtgctccagcaacagcgccaggaggagcttcaggcccggcaggagatgtaccagtggaaggcttacaacccaggttggcctcactgcctggatgaaaagacagtggaagacttggagctcaatatcaaatactccacagccaagaatgccaacttttatctacaggctggctctgcttttgcagagatgaaaatcaaggggttgctggaccgcaaggggctctggaggagtctgaatgagatgaaaaggatcttcaacttccggaggaccccagcagctgagcacgcatttgagcactggcaggaggacgccttcttcgcctcccagttcctgaatggtctcaaccctgtcctgatccgccgctgtcactacctcccaaagaacttccccgtcactgatgccatggtggcctcagtgttgggtcctgggaccagcttgcaggctgagctagagaagggctccctgttcttggtggatcacggcatcctctctggcatccagaccaatgtcattaatgggaagcctcagttctctgcggccccaatgaccctgctataccagagcccaggctgcgggccgctgctgcctctcgccatccagctcagccagacccccggcccaaacagccccatcttcctgcccactgatgacaagtgggactggttgctggccaagacctgggtgcgcaatgccgagttctccttccatgaggccctcacgcacctgctgcactcacatctgctgcctgaggtcttcaccctggctaccctgcgtcagctgccccactgccaccctctcttcaagtccacaggcatcggcattgaaggcttctctgagttgatacagaggaacatgaagcagctgaactattctctcctgtgtctgcctgaggatatccggacccgaggagttgaagacatcccaggctactactaccgtgatgatgggatgcagatctggggtgcagtggaacgctttgtctctgaaatcatcggtatctactacccaagtgatgagtctgtccaagatgacagagagctccaggcctgggtcagagagatcttctccaagggcttcctaaaccaggagagctcaggtataccctcctcactggagacccgggaagccctggtgcagtatgtcaccatggtgatattcacctgctccgccaagcatgcggctgtcagtgcagggcagtttgactcctgtgcttggatgcccaacctgccacccagcatgcagctgccaccacccacctccaaaggcctggcaacatgcgagggcttcatagccaccctcccacctgtcaatgccacatgtgatgtcatccttgctctctggttgctgagcaaggagcctggagaccaaaggcccctgggcacctatccggatgagcacttcacagaggaggcccctcggcggagcatcgccaccttccagagccgcctggcccagatctcgaggggcatccaggagcggaaccagggcctggtgctgccctacacctacctagaccctcccctcatcgagaacagcgtctccatctaaatcccaggggaacacaggcccagatgacatccctttgaccacatcgctctaggataactggcacccagagaaaaggactcctcagaaaaaacaggcccccatgtgcctctcctgggacaaccagactctgtaactcacccccaccaccatacacacacacaaaaacagaaacaaaatcaaaacagagaaagcagaaaatctaccaagaacagagtctcaggacagaaccactgagtcttttggaggctccaagcctcaaagtgcccgcagagcccaccttgagggttttgctagttggttttgttttgcgttttacagccgtggggggaagcacataatcccgccccagggcccactagcatccactgattggaccttatggtcacccaactcaaggacagccaccaagaagtggctgccaaagagactgggcgcagtggctcatgcccataatcccagcactttgggagatggaggcgggaaaatcatttgaggtcagaagttcaaggccagcctggacgacatagcgagactccacctctacc

SEQ ID NO: 2106 - DNA, 2713 bp, Homo sapiens
cactgggcttggagtcagtggcaataaccaggggcaataaccaggcgtgtcccaggggggagccccgctctgcagccctgtgcgccgtagagagctggacttaggctggcagcatggccgagttcagggtcagggtgtccaccggagaagccttcggggctggcacatgggacaaagtgtctgtcagcatcgtggggacccggggagagagccccccactgcccctggacaatctcggcaaggagttcactgcgggcgctgaggaggacttccaggtgacgctcccggaggacgtaggccgagtgctgctgctgcgcgtgcacaaggcgcccccagtgctgcccctgctggggcccctggccccggatgcctggttctgccgctggttccagctgacaccgccgcggggcggccacctcctcttcccctgctaccagtggctggagggggcggggaccctggtgctgcaggagggtacagccaaggtgtcctgggcagaccaccaccctgtgctccagcaacagcgccaggaggagcttcaggcccggcaggagatgtaccagtggaaggcttacaacccaggttggcctcactgcctggatgaaaagacagtggaagacttggagctcaatatcaaatactccacagccaagaatgccaacttttatctacaggctggctctgcttttgcagagatgaaaatcaaggggttgctggaccgcaaggggctctggaggagtctgaatgagatgaaaaggatcttcaacttccggaggaccccagcagctgagcacgcatttgagcactggcaggaggacgccttcttcgcctcccagttcctgaatggtctcaaccctgtcctgatccgccgctgtcactacctcccaaagaacttccccgtcactgatgccatggtggcctcagtgttgggtcctgggaccagcttgcaggctgagctagagaagggctccctgttcttggtggatcacggcatcctctctggcatccagaccaatgtcattaatgggaagcctcagttctctgcggccccaatgaccctgctataccagagcccaggctgcgggccgctgctgcctctcgccatccagctcagccagacccccggcccaaacagccccatcttcctgcccactgatgacaagtgggactggttgctggccaagacctgggtgcgcaatgccgagttctccttccatgaggccctcacgcacctgctgcactcacatctgctgcctgaggtcttcaccctggctaccctgcgtcagctgccccactgccaccctctcttcaagctgctgatcccgcacacccgatacaccctgcacatcaacacactcgcccgggagctgcttatcgtgccagggcaggtggtggacaggtccacaggcatcggcattgaaggcttctctgagttgatacagaggaacatgaagcagctgaactattctctcctgtgtctgcctgaggatatccggacccgaggagttgaagacatcccaggctactactaccgtgatgatgggatgcagatctggggtgcagtggaacgctttgtctctgaaatcatcggtatctactacccaagtgatgagtctgtccaagatgacagagagctccaggcctgggtcagagagatcttctccaagggcttcctaaaccaggagagctcaggtataccctcctcactggagacccgggaagccctggtgcagtatgtcaccatggtgatattcacctgctccgccaagcatgcggctgtcagtgcagggcagtttgactcctgtgcttggatgcccaacctgccacccagcatgcagctgccaccacccacctccaaaggcctggcaacatgcgagggcttcatagccaccctcccacctgtcaatgccacatgtgatgtcatccttgctctctggttgctgagcaaggagcctggagaccaaaggcccctgggcacctatccggatgagcacttcacagaggaggcccctcggcggagcatcgccaccttccagagccgcctggcccagatctcgaggggcatccaggagcggaaccagggcctggtgctgccctacacctacctagaccctcccctcatcgagaacagcgtctccatctaaatcccaggggaacacaggcccagatgacatccctttgaccacatcgctctaggataactggcacccagagaaaaggactcctcagaaaaaacaggcccccatgtgcctctcctgggacaaccagactctgtaactcacccccaccaccatacacacacacaaaaacagaaacaaaatcaaaacagagaaagcagaaaatctaccaagaacagagtctcaggacagaaccactgagtcttttggaggctccaagcctcaaagtgcccgcagagcccaccttgagggttttgctagttggttttgttttgcgttttacagccgtggggggaagcacataatcccgccccagggcccactagcatccactgattggaccttatggtcacccaactcaaggacagccaccaagaagtggctgccaaagagactgggcgcagtggctcatgcccataatcccagcactttgggagatggaggcgggaaaatcatttgaggtcagaagttcaaggccagcctggacgacatagcgagactccacctctaccaaaaaataaaaattaaaaaacaaa

SEQ ID NO: 2107 - DNA, 3477 bp, Homo sapiens
ggctgccaacggttttgagcgtagggggaggcgtgagagggggatctcaggggaggaggtcaatcgcttgccccccactttggcaaattggggactgaggactggaagggtggagagtaggcggaaccaggtggtcgtcggggcagaggatctcgggctaggcttgagggcggcgtgcttcttagggacgacttagggcgtgactgagggttcacaaggtttcttttggggtggtcgggagggagagattctagggaacaaggaagctcgctatggctttcttgccaggaggggtcgaagggaaagtacaagggagctggagctgaccctgggtagaacgggtgaagggatgggggagcgtgaggttccgccctctcttgagactggaaccaattgagggactagtagggcagggggacagaaattgggctcctagtggatttgggtccgtttccgttgggacgttttgggtgtgagaacttaagagctcagttgaccggggatagcctgtgccggagttgatctgcagcttccagcactcgtagtcgggaagaggagcttcagcagcgctgttgtcccacagtaggtcttctgtccgcacccgctctgcgctgcaccctcttaacgctgttcccaggagctggggaaagggatgcttttgcccactcccatggcccctggaactggtggaaacctttcctctaaccagaaagcctcgatatccttaattcaccaaggatccttggcgtggagtcttcctcccttctcccaagtctttctccgtgaacttttcctcctggactttgctaaagcagaacctcccagctctttgctgtctccggttgtctcttccctgtattcatggcaacatcagctgacagccccagttcacccctcggggcggaggatctcctgagtgattcatcagaaccccctgggctcaaccaagtgtcgtctgaagtgacctcccagctctatgcttctttgcgcctcagccggcaggcggaggccacggcccgagcccagctgtatttaccctccacctccccgcctcatgaagggttagacggcttcgcccaagaattgagtcgaagcttgtcagtcggattggaaaagaacttgaagaaaaaggatggttctaagcatatctttgagatggaaagtgttcggggtcagctccagaccatgctccaaacctcacgtgatacagcctatcgggatcctctcattcctggcgctggctcagagagacgggaagaggactcctttgacagtgatagcacagccaccttgctcaacacccggcccctgcaagacttgtctccatctagctcagcccaagccctggaggagctgtttccccgctacaccagccttcggccagggcctccactcaatcccccagattttcaggggctgagagatgcattggattcagagcatacccgccgcaagcattgtgagcgccatattcagagcctgcagacccgagtgttagagctacagcaacaattagccgtggctgtggctgccgaccgcaagaaagataccatgattgaacaactggacaagaccctggcccgtgtggtggagggctggaaccggcatgaggctgagcggacagaggttctcaggggacttcaagaggaacaccaggcagcagagctcaccagaagcaagcagcaggagacagtaacccgcctggaacaaagcctttctgaggccatggaggccctgaatcgtgagcaggaaagtgccagactgcagcaacgggaaagagagacactggaggaggaaaggcaagctctgactctgaggttggaggcagaacagcagcggtgctgtgtcctgcaggaagagcgggatgcagctcgggctgggcaactgagtgagcatcgagagttggagactcttcgggctgccctagaagaagaacggcagacctgggcccagcaagagcaccagcttaaggaacactaccaggcgctgcaggaggagagccaggctcagctggaaagggagaaggagaagagccagagggaagcccaggccgcctgggagacccagcaccagttggcattggtgcagtctgaggtgcggcggctggaaggagagctggatacagctcggagagagagagatgccctgcagctggaaatgagcttggtgcaggcccggtatgaaagccagcggatccagctggagtcggagctggctgtgcagctggagcagcgggtgacagagcggctggcgcaggctcaggagagcagcctacggcaagcagcctccctcagggaacatcacaggaagcagctgcaggacctgagtggacagcaccagcaggagctggccagtcagctagctcagttcaaggtggaaatggcagaacgagaggaacggcaacagcaggtggctgaggactacgagctcaggctcctcctgctggaccctccagccccgggcctcaggagcccgagaaggaggagaggagggtctggactatgcctcccatggccgtggccctgaagcctgtattgcagcagagccgggaagcaagggacgagctacctggagcgcctcctgttctttgcagttcctcctcagatcttagcctcctgttgggcccctcttttcagagccagcattctttccagcccctggagcccaaaccagacctcacttcatccacagctggggccttctctgcacttggggccttccatcccgatcatagggcagaaaggccattccctgaggaagatcctggacctgacggggagggcctcctaaagcaagggctgccgcctgctcagctggagggcctcaagaattttttgcaccagttgctggagacagtgccccagaacaatgagaacccttctgtcgacctgttgccccctaagtctggtcctctgactgtcccatcttgggaggaagcccctcaagtgccacgtattccaccgcctgtccacaaaaccaaagttcccttagccatggcatccagtcttttccgggtccctgagcctccctcctcccattcacaaggcagtggtcccagcagtggttccccagagagaggtggagatgggcttacattcccaaggcagctgatggaggtgtctcaactgttgcgactctaccaggctcggggctggggggctctgcctgctgaggatctcctgctctacctgaagaggctggaacacagcgggactgatggccgaggggataatgtccccagaaggaacacagactcccgcttgggtgagatcccccggaaagagattccctcccaggctgtccctcgccgccttgctacagcccccaagactgaaaaacctcccgcacggaagaaaagtgggcaccctgccccgagtagcatgaggagccgggggggagtctggagatgagcccccctaccctctctcctctttgttctctcattgttgttattttaataaatgctcattagtctgt

SEQ ID NO: 2108 - DNA, 3770 bp, Homo sapiens
gtggtctcgcgggcgggtgacgtcatcgaggcgagagaggcggagccgtggacagtgggcgggaggctgccaacggttttgagcgtagggggaggcgtgagagggggatctcaggggaggaggtcaatcgcttgccccccactttggcaaattggggactgaggactggaagggtggagagtaggcggaaccaggtggtcgtcggggcagaggatctcgggctaggcttgagggcggcgtgcttcttagggacgacttagggcgtgactgagggttcacaaggtttcttttggggtggtcgggagggagagattctagggaacaaggaagctcgctatggctttcttgccaggaggggtcgaagggaaagtacaagggagctggagctgaccctgggtagaacgggtgaagggatgggggagcgtgaggttccgccctctcttgagactggaaccaattgagggactagtagggcagggggacagaaattgggctcctagtggatttgggtccgtttccgttgggacgttttgggtgtgagaacttaagagctcagttgaccggggatagcctgtgccggagttgatctgcagcttccagcactcgtagtcgggaagaggagcttcagcagcgctgttgtcccacagtaggtcttctgtccgcacccgctctgcgctgcaccctcttaacgctgttcccaggagctggggaaagggatgcttttgcccactcccatggcccctggaactggtggaaacctttcctctaaccagaaagcctcgatatccttaattcaccaaggatccttggcgtggagtcttcctcccttctcccaagtctttctccgtgaacttttcctcctggactttgctaaagcagaacctcccagctctttgctgtctccggttgtctcttccctgtattcatggcaacatcagctgacagccccagttcacccctcggggcggaggatctcctgagtgattcatcagaaccccctgggctcaaccaagtgtcgtctgaagtgacctcccagctctatgcttctttgcgcctcagccggcaggcggaggccacggcccgagcccagctgtatttaccctccacctccccgcctcatgaagggttagacggcttcgcccaagaattgagtcgaagcttgtcagtcggattggaaaagaacttgaagaaaaaggatggttctaagcatatctttgagatggaaagtgttcggggtcagctccagaccatgctccaaacctcacgtgatacagcctatcgggatcctctcattcctggcgctggctcagagagacgggaagaggactcctttgacagtgatagcacagccaccttgctcaacacccggcccctgcaagacttgtctccatctagctcagcccaagccctggaggagctgtttccccgctacaccagccttcggccagggcctccactcaatcccccagattttcaggggctgagagatgcattggattcagagcatacccgccgcaagcattgtgagcgccatattcagagcctgcagacccgagtgttagagctacagcaacaattagccgtggctgtggctgccgaccgcaagaaagataccatgattgaacaactggacaagaccctggcccgtgtggtggagggctggaaccggcatgaggctgagcggacagaggttctcaggggacttcaagaggaacaccaggcagcagagctcaccagaagcaagcagcaggagacagtaacccgcctggaacaaagcctttctgaggccatggaggccctgaatcgtgagcaggaaagtgccagactgcagcaacgggaaagagagacactggaggaggaaaggcaagctctgactctgaggttggaggcagaacagcagcggtgctgtgtcctgcaggaagagcgggatgcagctcgggctgggcaactgagtgagcatcgagagttggagactcttcgggctgccctagaagaagaacggcagacctgggcccagcaagagcaccagcttaaggaacactaccaggcgctgcaggaggagagccaggctcagctggaaagggagaaggagaagagccagagggaagcccaggccgcctgggagacccagcaccagttggcattggtgcagtctgaggtgcggcggctggaaggagagctggatacagctcggagagagagagatgccctgcagctggaaatgagcttggtgcaggcccggtatgaaagccagcggatccagctggagtcggagctggctgtgcagctggagcagcgggtgacagagcggctggcgcaggctcaggagagcagcctacggcaagcagcctccctcagggaacatcacaggaagcagctgcaggacctgagtggacagcaccagcaggagctggccagtcagctagctcagttcaaggtggaaatggcagaacgagaggaacggcaacagcaggtggctgaggactacgagctcagactggcccgggagcaagcgcgagtgtgcgaactgcagagtgggaaccagcagctggaggagcagcgggtggagctggtggaaagactgcaggccatgctgcaggcccactgggatgaggccaaccagctgctcagcaccactctcccgccgcccaaccctccagctcctcctgctggaccctccagccccgggcctcaggagcccgagaaggaggagaggagggtctggactatgcctcccatggccgtggccctgaagcctgtattgcagcagagccgggaagcaagggacgagctacctggagcgcctcctgttctttgcagttcctcctcagatcttagcctcctgttgggcccctcttttcagagccagcattctttccagcccctggagcccaaaccagacctcacttcatccacagctggggccttctctgcacttggggccttccatcccgatcatagggcagaaaggccattccctgaggaagatcctggacctgacggggagggcctcctaaagcaagggctgccgcctgctcagctggagggcctcaagaattttttgcaccagttgctggagacagtgccccagaacaatgagaacccttctgtcgacctgttgccccctaagtctggtcctctgactgtcccatcttgggaggaagcccctcaagtgccacgtattccaccgcctgtccacaaaaccaaagttcccttagccatggcatccagtcttttccgggtccctgagcctccctcctcccattcacaaggcagtggtcccagcagtggttccccagagagaggtggagatgggcttacattcccaaggcagctgatggaggtgtctcaactgttgcgactctaccaggctcggggctggggggctctgcctgctgaggatctcctgctctacctgaagaggctggaacacagcgggtacaagcctgggaggaaggaggaaggattctccgggtggaagctggattatggggagtggagtgggactgatggccgaggggataatgtccccagaaggaacacagactcccgcttgggtgagatcccccggaaagagattccctcccaggctgtccctcgccgccttgctacagcccccaagactgaaaaacctcccgcacggaagaaaagtgggcaccctgccccgagtagcatgaggagccgggggggagtctggagatgagcccccctaccctctctcctctttgttctctcattgttgttattttaataaatgctcattagtctgt

SEQ ID NO: 2109 - DNA, 3781 bp, Homo sapiens
agcacttgaagttcaggcagcgagagttgacatggggccagggctgcgcccctggggcgggttgaagacagggtgagtctcttgatattcaggaaatcatcgcgcacccagtcaccagcgttcgggagcctgtcgcagcgggaccgacggaatccggagcaggcgacagggcgcagaagcgggatgtacttctgttggggcgccgactccagggagctgcagcgccggaggacggcgggcagccccggggctgagctactgcaggcggccagcggggagcgccactctctgctgctgctgaccaaccacagggtcctctcgtgcggagacaacagcaggggtcagctgggccgcaggggcgcgcagcgcggggagctgccagaaccaattcaggcattggaaaccctaattgttgatctcgtgagctgcgggaaggagcactccctggctgtgtgccacaaaggaagggtcttcgcatggggagctggttctgaagggcagctggggattggagaattcaaggaaataagtttcacacctaagaaaataatgactctgaatgatataaaaataatacaagtttcctgtggacactaccactccctggcattatcaaaagatagccaagtgttttcgtggggaaagaacagccatgggcagctgggcttggggaaggagttcccctcccaagccagcccgcagagggtgaggtccctggaggggatcccactggctcaggtggctgccggaggggctcacagctttgccctgtctctctgtgggacttcgtttggctggggaagtaacagtgccgggcagctggccctcagtgggcgtaatgtcccagtgcaaagcaacaagcctctctcagtcggtgcactgaagaatctaggtgtggtttatatcagctgtggtgatgcacacactgcggtgcttacccaggacgggaaagtgttcacatttggagacaatcgctctggacagctgggatacagccccactcctgagaagagaggtccacaacttgtggaaagaattgatggcctagtttcgcagatagattgtggaagttatcacaccctggcatatgtgcacaccactggtcaggtggtatcttttggtcatggaccaagtgacacaagcaagccaactcatccggaggccctgacagagaactttgacattagctgcctgatttctgctgaagacttcgtggatgttcaagtcaaacacatttttgctggaacatatgccaactttgtgacaactcatcaggatactagttccacacgtgctcccgggaaaaccctgccagaaataagccgaattagccagtccatggcagaaaaatggatagcagtgaaaagaagaagtactgaacatgaaatggctaaaagtgaaattagaatgatattttcatctcctgcttgtctgactgcaagttttttaaagaaaagaggaactggagaaacgacttccattgatgtggacttagaaatggcaagagataccttcaagaagttaacaaaaaaggaatggatttcttccatgataactacgtgtctcgaggatgatctgctcagagctcttccatgccattctccacaccaagaagctttatcagttttcctcctgctcccagaatgtcctgtgatgcatgattctaagaactggaagaacctggtggttccatttgcaaaggctgtgtgtgaaatgagtaaacaatctttgcaagtcctaaagaagtgttgggcatttttgcaagaatcttctctgaatccgctgatccagatgcttaaagcagccatcatctctcagctgcttcatcagactaaaaccgaacaggatcactgtaatgttaaagctcttttaggaatgatgaaagaactgcataaggtaaacaaagctaactgtcgactaccagaaaatactttcaacataaatgaactctccaacttattaaacttttatatagatagaggaagacagctctttcgggataaccacctgatgtcagaaaagaaagcatacatgcttatgcatgaaacaattctgcaaaaaaaggatgaatttcctccatcacccagatttatacttagagtcagacgaagtcgcctggttaaagatgctctgcgtcaattaagtcaagctgaagctactgacttctgcaaagtattagtggttgaatttattaatgaaatttgtcctgagtctggaggggttagttcagagttcttccactgtatgtttgaagagatgaccaagccagaatatggaatgttcatgtatcctgaaatgggttcctgcatgtggtttcctgccaagcctaaacctgagaagaaaagatatttcctctttggaatgctgtgtggactctccttattcaatttaaatgttgctaaccttcctttcccactggctctgtataaaaaacttctggaccaaaagccatcattggaagatttaaaagaactcagtcctcggttggggaagagtttgcaagaagttctagatgatgctgctgatgacattggagatgcgctctgcatacgcttttctatacactgggaccaaaatgatgttgacttaattccaaatgggatctccatacctgtggaccaaaccaacaagagagactatgtttctaagtatattgattacattttcaacgtctctgtaaaagcagtttatgaggaatttcagagaggattttatagagtctgtgagaaggagatacttagacatttctaccctgaagaactaatgacagcaatcattggaaatactgattatgactggaaacagtttgaacagaattcaaagtatgagcaaggataccaaaaatcacatcctactatacagttgttttggaaggctttccacaaactaaccttggatgaaaagaaaaaattcctctttttccttacaggacgtgataggctgcatgcaagaggcatacagaaaatggaaatagtatttcgctgtcctgaaactttcagtgaaagagatcacccaacatcaataacttgtcataatattctctccctccctaagtattctacaatggaaagaatggaggaagcacttcaagtagccatcaacaacaacagaggatttgtctcacccatgctcacacagtcataatcacctctgagagactcagggtgggctttctcacacttggatccttctgttcttccttacacctaaataatacaagagattaatgaatagtggttagaagtagttgagggagagattgggggaatggggagatgatgatgatggtcaaagggtgcaaaatctcacacaagactgaggcaggagaatagggtacagagatagggatctaaggatgacttggacacactccctggcactgaagagtctgaacactggcctgtgattggtccattccaggaccttcatttgcataaggtatcaaaccacatcagcctctgattggccatgggccagacctgcactctggccaatgattggttcattccaggacattcatttgcataaggagtcaaaccacaccagtcttggattggctgtgagccaattcacctcagtctctaattggctgtgagtcagtctttcatttacatagggtgtaaccatcaagaaacctctacagggtacttaagccccagaagattttgctaccagggctcttgagccacttgctctagcccactcccaccctgtggaatgtactttcacttttgctgcttcactgccttgtgctccaataaatccactccttcaccaccca

SEQ ID NO: 2110 - DNA, 675 bp, Homo sapiens
gtattttacaaactgagaaagtagctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattggtggggatcagtcagcctcggaaccccttggaagagctcaggcctagccctaggggtcaaaatgtggggcctgggccccctgcccagacagtcctggtcccagctcctggaaagctctttgctcttagaagatctccctttcctccagcaaaatgtcatctcgccaggtgccatggcttgtacctgtaatcacagctactcaggaggctgaagcaggaggatcactggaggccaggagttggagaccagcctggatgacagagggagatcccatctctttaaaaaataaataaataaataaataataaatatcacttcttctgaagcct

SEQ ID NO: 2111 - DNA, 683 bp, Homo sapiens
gcatgcgcgccggcgaccacgcctaaatagccgcagcctctgcgcgtcgccctccacggttaccccggctctccgcccctccttctcgcggcgctcgagggaccatggccgatcctcgcgtgagacagatcaagatcaagaccggcgtggtgaagcggttggtcaaagaaaaagtgatgtatgaaaaagaggcaaaacaacaagaagaaaagattgaaaaaatgagagctgaagacggtgaaaattatgacattaaaaagcaggcagagatcctacaagaatccaggatgatgatcccagattgccagcgcaggttggaagccgcatatttggatcttcaacggatactagaaaatgaaaaagacttggaagaagctgaggaatataaagaagcacgtttagtactggattcagtgaagttagaagcctgaaacttttctcgtatggggtggtttttgcattaaatcctggggtccattttacaatccattatttttgaccactgctatgtgttcaagtagtatgagaatgtgattgtttttatctggttacatatatatttctttgtctaatttaatatgtcaaataaatgagttcatctaataaaattgtttattttatactttacaaaatttttaaattaaccttttatcattaaaccacatagactttatgacagagaa

SEQ ID NO: 2112 - DNA, 1798 bp, Homo sapiens
tcattactacagggcaggaagggcacgttctcatcagcatgagggagtgcctttccatccacatcggtcaagctggcatccagattggggacgcctgctgggaactctattgcctggaacatggaatccagccaaatggcgttgttcttgacactcaacaggatcagctggaaaatgcaaaaatggagcacacaaatgcatctttcgataccttcttctgtgagacaagagctgggaagcatgtgcctagagcactcttcgtggacttggagccaactgttatagatgggatccggacgggccagcaccgttcactcttccaccccgagcagctccttagcggaaaggaggatgctgctaacaattacgcgcgaggccgttactctgtggggtcggaggtcatcgaccttgtgctggagaggacccggaagctggcagaacagtgtggtggacttcagggatttttgattttccgaagctttggaggaggcactggttcagggtttacgtctctcttaatggagaggctcacaggagaatatagcagaaagactaagctggagttctcggtctacccagcccccaggatctccactgctgtggtagagccttataactctgtcctcaccacccactccaccacagagcacacggactgtaccttcatggtggacaacgaggccgtctatgatatatgccatcgtaaactcggtgttgaatgcccctctcatgccagcatcaatagattggtggttcaggtggtatcttccatcactgcctccctccggtttgaagggcccttgaatgtagacctaattgaattccagaccaacctggtaccttatccgagaatacatttccccatgacagccttcgcccccatcgtctctgctgacaaagcctaccatgagcagttctctgtgtcagacatcaccactgcctgctttgagtcctccaaccagctggtcaagtgtgatcctcggcttgggaagtacatggcctgctgcctactctatagaggggatgtggtccccaaggaagtgaatgcagcaatcgcagccacgaagtcgaggcactctgttcagtttgtagattggtgtccaactggtttcaaggtgggcatcaacaatcggccgcccacggtgatgccgggtggggacctggccaaagtccaccggtccatctgcatgctgagcaacaccacggcgattgtggaggcctgggcccgcctggaccacaagtttgacctcatgtacgccaagagagcatttctgcactggtacctcagagaaggcatggaagaagcagagttcttggaggccagggaagatctggcagccctggagagggactatgaggaagtggcgcaaagtttctgaggcatgtatgatgggtgcaaatgaatgtcaagttaaaatggcatgttttcttttcaagccgttatatgcctagtgggtagttcccctgatgagcagaaaaatgaactcaaatcaggcaagactctaggttccacactaaattaagtgggtcagtaccaacaatgaacacattatttcctggtctactggtacaagtcagctctgctacctgggagcctttggaagcttagagtcctttgaactgctgagtcacttctaggtgggatttttttgttttaccaagagacaatgaaatcctgaagtttatgcttttcctttctggtaccggaagtagaaaacagcacatgttgattacgaatgttttttcccccatgtctacattttttacactgattaaatcataaatattttcagtatga

SEQ ID NO: 2113 - DNA, 1282 bp, Homo sapiens
cctcccgcctcctctaggccgccggccgcgaagcgctgagtcacggtgaggctactggacccacactctcttaacctgccctccctgcactcgctcccggcggctcttcgcgtcacccccgccgctaaggctccaggtgccgctaccgcagcccctccatcctctacagctcagcatcagaacactctctttttagactccgatatggggtcctccaagaaagttactctctcagtgctcagccgggagcagtcggaaggggttggagcgagggtccggagaagcattggcagacccgagttaaaaaatctggatccgtttttactgtttgatgaatttaaaggaggtagaccaggaggatttcctgatcatccacatcgaggttttgaaacagtatcctacctcctggaagggggcagcatggcccatgaagacttctgtggacacactggtaaaatgaacccaggagatttgcagtggatgactgcgggccggggcattctgcacgctgagatgccttgctcagaggagccagcccatggcctacaactgtgggttaatttgaggagctcagagaagatggtggagcctcagtaccaggaactgaaaagtgaagaaatccctaaacccagtaaggatggtgtgacagttgctgtcatttctggagaagccctgggaataaagtccaaggtttacactcgcacaccaaccttatatttggacttcaaattggacccaggagccaaacattcccaacctatccctaaagggtggacaagcttcatttacacgatatctggagatgtgtatattgggcccgatgatgcacaacaaaaaatagaacctcatcacacagcagtgcttggagaaggtgacagtgtccaggtggagaacaaggatcccaagagaagccactttgtcttaattgctggggagccattaagagaaccagttatccaacatggtccatttgtgatgaacaccaatgaagagatttctcaagctattcttgatttcagaaacgcaaaaaatgggtttgaaagggccaaaacctggaaatcaaagattgggaactagtggaaagcggaagagcaggtcttgatgtgtcctagaattttgccatttctgagattgagccattgaaggcattccatttctaaagcttatttagccggtgcttctaaagaattccacactaacgtgataacatggtttttgtaacaataaatgtaggatatttcctggcacatgcaaataaacctaatcattgtttctttaaaaa

SEQ ID NO: 2114 - DNA, 1539 bp, Homo sapiens
accgaccggagcgccgatcagagcacctgcccgggccacacatttcctcctggagcacagcaagtgccgcctaaattacccgagtgagcatctcttcccggcacgagaggcagggaggccaaagggccgccaagctggcctgggagaggcgtagggcggagcgagagtggagtgacattcccgagggcggagccccagggcctccgagacccgtagactcccgcctcccgcctcctctaggccgccggccgcgaagcgctgagtcacggtgaggctactggacccacactctcttaacctgccctccctgcactcgctcccggcggctcttcgcgtcacccccgccgctaaggctccaggtgccgctaccgcagcgtgagtacctggggctcctgcaggggtccactagccctccatcctctacagctcagcatcagaacactctctttttagactccgatatggggtcctccaagaaagttactctctcagtgctcagccgggagcagtcggaaggggttggagcgagggtccggagaagcattggcagacccgagttaaaaaatctggatccgtttttactgtttgatgaatttaaaggaggtagaccaggaggatttcctgatcatccacatcgaggttttgaaacagtatcctacctcctggaagggggcagcatggcccatgaagacttctgtggacacactggtaaaatgaacccaggagatttgcagtggatgactgcgggccggggcattctgcacgctgagatgccttgctcagaggagccagcccatggcctacaactgtgggttaatttgaggagctcagagaagatggtggagcctcagtaccaggaactgaaaagtgaagaaatccctaaacccagtaaggatggtgtgacagttgctgtcatttctggagaagccctgggaataaagtccaaggtttacactcgcacaccaaccttatatttggacttcaaattggacccaggagccaaacattcccaacctatccctaaagggtggacaagcttcatttacacgatatctggagatgtgtatattgggcccgatgatgcacaacaaaaaatagaacctcatcacacagcagtgcttggagaaggtgacagtgtccaggtggagaacaaggatcccaagagaagccactttgtcttaattgctggggagccattaagagaaccagttatccaacatggtccatttgtgatgaacaccaatgaagagatttctcaagctattcttgatttcagaaacgcaaaaaatgggtttgaaagggccaaaacctggaaatcaaagattgggaactagtggaaagcggaagagcaggtcttgatgtgtcctagaattttgccatttctgagattgagccattgaaggcattccatttctaaagcttatttagccggtgcttctaaagaattccacactaacgtgataacatggtttttgtaacaataaatgtaggatatttcctggcacatgcaaataaacctaatcattgtttctttaaaaa

SEQ ID NO: 2115 - DNA, 1975 bp, Homo sapiens
agattgctgaaacaaaggaccaatgcccagggcggtccttaattcctccctgcagtttgaaactgtcaggttgccgtctaggtagcggttgtgcttgctgaggctgcacttgctgacactgcagctgcgacgcggctaagaggcgcagagcgaggagtcgggatttggtcgcgagcggcgacgagcatttgtgcagaatgtcatcagatgaggagaaatactcacttccagttgtgcaaaatgactccagtcgaggcagttctgtctcttcgaatcttcaggaagaatatgaagaactgcttcattatgctatagtgactccaaatattgaaccctgtgcttcacagtcatctcatcctaagggagaattggtgccagatgtcagaatttctacaattcatgatattcttcatagtcaaggaaataactctgaagtaagagaaactgcaatagaagttggaaaaggatgtgatttccatatttcaagtcattcaaagacagatgagtcatcaccagtgttatcgccaaggaagccttctcacccagtcatggattttttcagttcacatcttttagctgactcttcctcaccagcaacaaattctagtcatacagatgcccatgaaatacttgtgagcgattttcttgtttctgatgaaaaccttcagaagatggaaaatgtgcttgatctttggagttcaggtcttaagacaaacatcatatctgaactaagtaaatggagacttaattttattgactggcaccgaatggaaatgagaaaagagaaagaaaaacatgcagcacatttaaaacaactgtgtaatcagatcaatgaattgaaggagctgcaaaaaacctttgaaatctccattgggagaaaagatgaggtgatttctagcttgtctcatgccataggcaagcaaaaggaaaagatagagttgatgagaacattcttccactggcgaatcggccatgtcagagccagacaggatgtttatgaaggtaaactagctgaccagtactaccagagaactttactgaagaaagtctggaaagtctggcgttccgtagtgcaaaagcagtggaaagatgtggtagaaagagcttgtcaagcaagagctgaagaagtttgtatccagatttccaatgattatgaagccaaagttgctatgttatctggagctttggaaaatgcaaaagctgagattcaaagaatgcaacatgaaaaagagcactttgaagattccatgaaaaaagctttcatgaggggtgtatgtgcattaaatcttgaagccatgactatatttcaaaacagaaatgatgcagggatagactccacaaataataaaaaggaagagtatggtcctggtgttcaaggaaaagaacattctgctcatttggatccttcagctcctccgatgcccttaccagttacatcaccactgctgccatccccaccagccgccgtcggaggagccagcgcgactgccgttccctcagctgcttcgatgacttctaccagggctgcttccgcatcttctgttcacgttcctgtttctgctcttggtgcaggatctgcagctactgctgcatcagaagaaatgcaaaccattcctcaagcaactgcagcaaaatatccccggaccattcatcctgaaagtagtacctcagcttccagatcacttggaaccagatcagctcacacccagtctctcacaagtgttcattccataaaagtggttgactaaagtgaatatgtccatagtggggtcttttaatccctctggtcttaccaagggttagaagtcttttggttttaacttttccatattgttagaacatcatggagacatcatgttcatctgttcaaaattacaagaggctttttcaagctctaccatgctttgtaactatatgtagaaattattttaatgttattttttatttaagcaattaagtaaaacttttttaaatt

SEQ ID NO: 2116 - DNA, 1682 bp, Homo sapiens
agtcgccccggcaacagccgcctccctcgcgtcccccactccccctctgtctctccaaggaaaactaggcccctgcgcggccaacgcccaggatccgcaagctgcgcgcccacgagctccaccagcccattggagaaaagttactgttcagtccctgaaggcttgtgccataaaagagtgggagacattcccagggaggtgaggaatgaaagatcgaattaaagaccattaaagaccaaagggcatctaaatctgcagcaaccatcagctctcttttctttgagagtttcagcacccatttggactttcacaatcagagatggcagcggtaaaggcatcaacatcgaaagctaccaggccttggtattctcatccggtatatgcaagatactggcaacattatcatcaagcaatggcttggatgcaaagccatcacaatgcctacaggaaggccgtggaatcctgtttcaatcttccatggtacttaccttctgcgcttcttccccaaagctcttacgataatgaggctgcgtatcctcagtccttctatgaccatcatgtggcctggcaggactacccctgcagttcttcacatttcagaagatctgggcagcatccacgttacagcagtaggatccaggcatccacaaaagaagaccaagctttgtccaaagaggaagagatggagactgagtcagatgcagaggtagaatgtgacctgagcaatatggaaatcactgaagagctccgccagtactttgcagagaccgagaggcatagagaagaacgacggcggcagcagcagctggatgcagagcgcctggacagctatgtgaacgctgaccacgacctgtactgcaacacccgccggtcggtagaagccccaactgagaggcctggtgagcggcgccaggccgagatgaagcgtttgtacggggacagtgctgccaagatccaagccatggaggccgcggtgcagctgagctttgacaagcactgtgaccgaaagcagcccaagtactggccggtcatccccctgaagttctgagctcagggcacagggtacccagcctctccttcttccttttgggtacacgctctttatctctccttctgtacatttcttagggaaaggggactttgtactggggtacaggcatgttcaccacagtcccagtgggcctgtcacggggtggatgtactatgccagccacttggaggtctgcaggacatgttctgttgccaacatgataaattttctcctgacataaaataattttgcatatactatactggttttttatgttgttggtaacagttcaattcattaacgttcttgcctagagatactgcctggtgttttgcttttttatcttttcttgtctttaacctgtctgaactacacaaatgcctttaaaaaaccagatatcctctctgactctagctccattagcccccactaaaaatgagccaagtgtgtagtgagacaaataccactacctgtagtggagagggatgcatgttctataaagggccagagagtgaatatctttggcactgcaagccacacggtcagtgttgtgactactcaaccctccctttgtagtgtgaaagcagctgtagacagtaagtaaacaaatgggtgtggctgtgttctaataaaactttatttataaaaacag

SEQ ID NO: 2117 - DNA, 3306 bp, Homo sapiens
gggcgcccgagccggctgctcgtgccatggagcggagtcccgacgtgtcccccgggccttcccgctccttcaaggaggagttgctctgcgccgtctgctacgaccccttccgcgacgcagtcactctgcgctgcggccacaacttctgccgcgggtgcgtgagccgctgctgggaggtgcaggtgtcgcccacctgcccagtgtgcaaagaccgcgcgtcacccgccgacctgcgcaccaaccacaccctcaacaacctggtggagaagctgctgcgcgaggaggccgagggcgcgcgctggaccagctaccgcttctcgcgtgtctgccgcctgcaccgcggacagctcagcctcttctgcctcgaggacaaggagctgctgtgctgctcctgccaggccgacccccgacaccaggggcaccgcgtgcagccggtgaaggacactgcccacgactttcgggtgaggagcctgatagccgaagagagaaggaactttttaccaactcaccagtggatagtgacaaagacaaggctccaaaccagctctcctaaccttcagtccaggaggcaaggccaagtgcaggaacatggagcatgcactgcgggagaaggccaaggccttctgggccatgcggcgctcctagatgccatggccgaggagacaaggcagaagcaacttctggccgacgagaagatgaagcagctcacagaggagacggaggtgctggcacatgagatcgagcggctgcagatggagatgaaggaggacgacgtttcttttctcatgaaacacaagagccgaaaacgccgactcttctgcaccatggagccagagccagtccagcccggcatgcttatcgatgtctgcaagtacctgggctccctgcagtaccgcgtctggaagaagatgcttgcatctgtggaatctgtacccttcagctttgaccccaacaccgcagctggctggctctccgtgtctgacgacctcaccagcgtcaccaaccatggctaccgcgtgcaggtggagaacccggaacgcttctcctcggcgccctgcctgctgggctcccgtgtcttctcacagggctcgcacgcctgggaggtggcccttggggggctgcagagctggagggtgggcgtggtacgtgtgcgccaggactcgggcgctgagggccactcacacagctgctaccacgacacacgctcgggcttctggtatgtctgccgcacgcagggcgtggagggggaccactgcgtgacctcggacccagccacgtcgcccctggtcctggccatcccacgccgcctgcgtgtggagctggagtgtgaggagggcgagctgtctttctatgacgcggagcgccactgccacctgtacaccttccacgcccgctttggggaggttcgcccctacttctacctggggggtgcacggggcgccgggcctccagagcctttgcgcatctgccccttgcacatcagtgtcaaggaagaactggatggctgagctggcccggggctgccccggtcttgtgccacagcactgttttctttctgccctcttcctaatgcccacactgcttgggcactattgcgcccctgcctccttgccaggctcttcctcctgtcctgcctggtccttttccatgactccaggctgtgcctctctccatgtttggtcccttctgtgcccatggtcaggagctattcgggtggcacctcgctggccaggctctcccgagtcgtggcacctccacaatgtgaattttctgaatccctattccaggatttctgggaataatgtttacttctagaatgggcctgttgtaaaccatctcatcgaggtgtggtaaagccattggatgaggaggggactgccatggaaaggagagtttgttacttacggttctgagaggaggggccacataggaaagccccacggtgggtcagaaggcggaaggagggaggggaacgtgtgggcaagagacttcctctggtttcctcaggaggaaatgggcaaggcagagtaagcaggggagacaggtttaagggtagctggcttgagtaatttcagtggctctcaggataggggctgccctttttgtctgatacctggccccgggatagtcaggacaggtgaatgttggcctggggtgtgacagccctgggagagccatgtgaaggaggcagctggcgccatcgctccggattagttggtttccataggaaaggcatgctttcagccagatgcttgccatctctagggattgggggattggctagcctgggaggatcagtctgtccaggtcagcgaggccccagataccagagcatcaagagtacaggaaatacagttaatgcagggcctctgtgtggctggatcctccgtctccatcagatcagctctgattgatctattcttgcacgatttcctctgaacacagggttccagagtacttaaacacaacattttttaaatcgtgatttcggcctatttccttgccaggcctgtttccccaccaggaaatgagataggaggactggatgaggatgtcctgttatagttgctgtggaggaagttcctctggttaattctcatcagcgtctgcagaaaagaaggaaagagggcacccttttcagttgggaagaaaggagaggggtggcgccatggacgtggccctaaacgctgtgggagagggaagaggaggctgggcctcgctgccctcttgtctctgctgacttcagcctggtcatgcttgctctgccacttgcgatttcatccctaatttcttcctccaccatgcctgcagacttttccctgggcttgttttttctcgcacatctctgaagagtttttaatcttcagctcatcatgtcccaggaagtggcatcataaaaggaaatatttttttttcctaggagcagtgttaaaatctgggtcacattcctgaccaaggacagcatcctgccttctgcccatccccttcagttcacaaaagctgacattttaaacaaatcatgactcacacgtattaattggttataaatatgttgtgtacactggttagataaaacttaaggccacaaggagggcccaggtaggcgatgtcagtgtgtgaaggggctggattgggcgtggtgaggatgttggcaaaccagtgcatgcacctggttggaagatgctcagcctcacaaaagctccaagccctttgggagccaaagtgtctgagagtgtgaccctctcctgtaaagtatttatcccacccattaatataatttctgtataataaacttgacctgaaatt

SEQ ID NO: 2118 - DNA, 7551 bp, Homo sapiens
cggccgcggctgccatggcaacactacgccgccgccgccttttcacgcacgtcgcgagctaacggactcggcggcggcggcggcggcggcctgcgccccacccgcaccccatctggaccgcatcgctgaatgtgcccggacctgcgccttctgggtctctgaaagaagatgaatttggctgagatttgtgataatgcaaagaaaggaagagaatatgcccttcttggaaattacgactcatcaatggtatattaccagggggtgatgcagcagattcagagacattgccagtcagtcagagatccagctatcaaaggcaaatggcaacaggttcggcaggaattattggaggaatatgaacaagttaaaagtattgtcagcactttagaaagttttaaaattgacaagcctccagatttccctgtgtcctgtcaagatgaaccatttagagatcctgctgtttggccaccccctgttcctgcagaacacagagctccacctcagatcaggcgtcccaatcgagaagtaagacctctgaggaaagaaatggcaggagtaggagcccggggacctgtaggccgagcacatcctatatcaaagagtgaaaagccttctacaagtagggacaaggactatagagcaagagggagagatgacaagggaaggaagaatatgcaagatggtgcaagtgatggtgaaatgccaaaatttgatggtgctggttatgataaggatctggtggaagcccttgaaagagacattgtatccaggaatcctagcattcattgggatgacatagcagatctggaagaagctaagaagttgctaagggaagctgttgttcttccaatgtggatgcctgactttttcaaagggattagaaggccatggaagggtgtactgatggttggacccccaggcactggtaaaactatgctagctaaagctgttgccactgaatgtggtacaacattcttcaacgtttcgtcttctacactgacatctaaatacagaggtgaatctgagaagttagttcgtctgttgtttgagatggctagattttatgcccctaccacgatcttcattgatgagatagattctatctgcagtcgaagaggaacctctgatgaacatgaggcaagtcgcagggtcaagtctgaactgctcattcagatggatggagttggaggagctttagaaaatgatgatccttccaaaatggttatggtattggctgctactaatttcccgtgggacattgatgaagctttgcgaagaaggttagaaaaaaggatatatatacctctcccaacagcaaaaggaagagctgagcttctgaagatcaaccttcgtgaggtcgaattagatcctgatattcaactggaagatatagccgagaagattgagggctattctggtgctgacatcactaatgtttgcagggatgcctctttaatggcaatgagacggcgtatcaatggcttaagtccagaagaaatccgtgcactttctaaagaggaacttcagatgcctgttaccaaaggagactttgaattggccctaaagaaaattgctaagtctgtctctgctgcagacttggagaagtatgaaaaatggatggttgaatttggatctgcttgaatttctgtcagctctttaatttctggtatttttgttgataaaatacgaagaaattcctgcaatttttaaaaaacaagtttggaatttttttcagtggagtggttttcgcttaaaggaaaaaaaaatctaaaactgcgaagaatactaaatgtagttgagaaataattgatggcgagagtttgctagtctccctccccggctttgtgctggtattccacgtattcctgcattaatattgcacacccaaaccagtctatcagggaggctgaagcaagggcgcagtgtgatattttaggaatacagaagatttagaaatacccctatttctcatttgcagtttttttttccaattctgtgctctgtcaacatgagggacctatctatgtatgttgacttttaacatcaaaattggatttgtgtcaaacattcattgttaagagaagaatgacagtatattttggaggaaataatgaatttactaattaaacctttagaatttatgacttactgttagagtctgtcatatggttagaatttttacttccgctacccctgccatttcttctgctagctacttcataatatcttgagctttactgaggaatattctcacgctctgtggtatttgaatcattttgccaggtcatttctctgtctttagtattttttgctggtgcttcttacatttaatatggaaaggtgggaagaatattactgcattagatgtaattcttcattctagacttccaagtttgttttcacttttttgtgtgtgcgtgaaggagtctgtgtcacccaggctgtgtagtgcagtggttgatcttggctcactgcaacctctgcctcctagattcaagcaattctcctgtctcagcctcccaagtagctgggattacaggtgcgcaccaccatgcctggctgtgttttcacttttctttcaacatgttcaaccagatatatagccattatttttctcagctccagcattgtttgatttttcttgagtttgattttagtatttgagataaatacttttacattctaaacaagtccactctctgtggctaacgcaaaacaaatgaaatctttattgttttccaaacagctagtttaacaaaacagcatcatacatagtgaatgatgttcattggaaaattctaaaatttgtccttgtctaggttgagaacttttacacacactaagataaagatagaaatctgacatgctcactcaattcagcaggaattacacattagaaagaagccagaaaaataaatggcatatatccaatcacaagtaaatgatcctggcgttagtttttatgattacatgtgtctcattaggcaatttatgctttaatggtcaagcttttaaaaatttgtatttgataacatcctgaattctcagtttcgaatagtgcctactggtttaaaactaaaaataatacagctttttggacatttaaccaagatactaagaaggttttttttaaaaaaagagatttgattatttttccctgctaaaaactgtaaatgccttatgttcttttcagataacttaagtctgacctaaactccagtattcatctgatgctgtaaattgcccttctttctgagacacagattataagatgccagatcataagacatcatgattttattgtaattgaattcttcctaaaaattgagaggtttccttttattaacttttaaaataaagaaataagtagtttcattacgattattttgcaaactattgccagtcagaaatgcactttttttttccctgaagttttaggagccgtcactaaaacattagtcttgtgattgttaaaacttgtttgtaatgggttggtgcaaaagtaattgtggtttttccattactttcaatggcaaaaaccgcaattacttttgcaccagcctaacaatagttgattagttagaccttttctgggttttgtattgattatcttggtgtgcatttaattatttttctgaattcttcatggataatgacatagtaattgtgattcttttaataccagttaagcagtatttggcaacttaaacttcctgggagcctaactttactatgttaagtgagtcaggtgtgctttttatttcccttgtttctcattttgccctgtcagtggatggtagatgctttgtatatcttaaatcccttaaaggatcttaaagacatccctcaggtgttctatttaacttttattttattttattttatttatttatttattttgagactgagtcttgctctgtcgcccaggctggagtgcagtggcatgatctcggctcactgcaacttctgcctcccaggttcaagccattctcctgcctcggcctcctgagtagctgggattacagttgccgccacacccggcttatttttttgtatttttagtagaggcagagtttcaccatgttggccaggctagtctcgaactcctgacctcagatgatccgcccacattggcctcccaaagtgctgggattacaggtgtgatccaccgcacctggccctaacttttaatatacaacacacacacacacacacacacacacacacacacacacacacacacacacacacacactatttcagaagacagtgtgttgccttacccagaatgagtgctaggattacaggcgtgagacagacacacatacacacacatacacacacacagagtctttattgcagaagacagtgtgttgccttataggcgtgagacacacacacacacacacacacacacacacacacacacagtctttattgcagaagacagtgtgttgccttaccagaatgagtgcttggattacaggcgtgagccactgtgcccagccctaacttttaatgtacatcacacacacactcacactcacatacacacacacacacacactctgactgtctttattgcagaagacagtgtgttgccttacccagaatgagattgaattgttttgcttcgttttgttttgttattcagtgttgcggtagcagatgcattatcaaaggaaaaatatttggctcctttaattcctctgaaaacatgagtattttgagttctgcagcacaatgactgtaggactaagctaagtctgctttgcagatatctgatcagatagtcccttcattctgtagacgtgtattggttggtccaagacacagtgagtaggagctctgtggaccaagacaaagctggactagagagtacagttcaaacttggcagtttctctaacgactctgtatagcttctggcttctactactgaaacaagagtttagatcactgatggagaggcatagtaatctgtttgtgctttggaaaaatatataaaagtttttttcccctattttttgcactttaaatctgttttgaaattagaactgatatacatttatttgaataatgtgtaactattatggatctattttaatgaacaatttttaccatttcccaagctgcctgtttattataagcatgacatgtttactataaaccttttgcccccataatttctttttttaaaggaaattaatattagtaaaataaacacctctttaatggaagctgcaaccttctagtgatccaagtagacaatagatggtggcatcacagactttatctacacactttcgggtctgaccactacctcccacaatacctagccattttggaaggggaaaacatgcggtggtctagctgtatagctcagggcttaatttcagcttctgagattgtgatgtcatatttcactctcaaaacataggctgaaagcacgaattactcaaaaagtaagcaaaccaatacctggtgaatctatggacagtcatacacatacatcaggggaaaatgtgtgtgtacaacccaaatttacagtatgattgtcattctttgactttgttttgtatagcctgactctgttgaacatgaaattattagtactctaggttttggacagcttgagttcatttgaattccttccttaggaataagtttttatatacactgctaaatgtgtgatgagaatcataaaacactaaccagctgaggtagctgtgattcactttccccccaccctaacttgagataaaatgaaggactaggcaagtatttcatgttgtgtgagtggacttcggttccttcagtattgtctaggttattgagtctttctttgcctaatagtggattcccactcttaagataacttttattagtgataaatcagtttagggtatattctgtatgacaggcataaaatgttaagggtgaatgctggccttttccaagaaaaggccaccttaacttgtatgaggaaaaaatcctaactattctcttttttgtatctttttttccgtaactgttttgattgtatattttaaagaaaccacttaatttgtgatgcacgtaatatttgtgtgaacctgagaatatgtcacaataggaaaaagcagaaattatacttaggggacatgttaggggggtaaaaatatttaagcctcgaatgttttactgtcatctccactaactatttttacagaaaaagctaaaaactctgttgtaattattgtaagtttacttatttatacttttaaattaggcttttcatacttaaatttttttgacatttgcttttaatatttgtttcttaatgtggaaattgtgtattttaataatcaaattattaggataatagatatatttttaaacattcacctcattaacaaatagatctttgaatttttattaggttttttggctccagacaactgtttagctttaatgatatttctaaattcccagtgacttattaataaaaacaggaaaaatatttaggtaatgtcataaaatttattttacctttctcattttctgagaaaataaatgaaaaaaaccctagatattgctttattaccaacagtgtgtaggtttttgtacatatggaaatttgacacaaaaaaatagggaatttgtatagagaagtttccctcttataaaaggactcccatttgattgttcgaaactataaaatgcacttttactttaccatatctgaaatgacaaaatatcgccctttggaaaacctgactctttgcacgtgtaattcccagagtctacctcagttaaccaggcttagttttaggcaggaatgaattgaattaaattcagttcatcatctatgcagatttgtttcttttaagcacatccttccctcctgctgttgccctcctcccattaacttttctttttaatcttgaaattgtttaaaatattccatctttctttctctagcaaagtgtttgtattccaaataaggcctctgtgaaatgtctgaattacttttcccgtctttgttatggtcagcttcattatttggatgtattgcattcaaagcagcagttccaaacataacacacatctattttcttagagttttgtaaatacaaactaacctgatgacattaaaaattgtggatcctacatgttcctatgttcattctctaaaaacctgagtaactttatgaaaacacacaaacctggaaaaacatcacatttttgtcacatttttactgacaaatgtatattcatatgatggtacggcagcagggagtggcccccagttaacatggctgtgagtggacacagtgtctcgcaggatcactgcatgttatgatggcttgtaagtgcgttgttaagacttttgtttcagtgtttgtctcccagtatttgaacctaatttaaagaaaaagacgtttccaagttgtatttattaaatgtgtttttccttaccttttgtgctgctactttgctaatctcattagcttagctgtgtttgtgcataggttatatttggtaataaatttatagagtgttggttgtca

SEQ ID NO: 2119 - DNA, 1634 bp, Homo sapiens
gacagaaaaaaaaatctctctttgtcttgagggggctgttgagtggtcgcggacctgggctctgtgcgttgggaaagggaagtggaggtctctgaaagaagatgaatttggctgagatttgtgataatgcaaagaaaggaagagaatatgcccttcttggaaattacgactcatcaatggtatattaccagggggtgatgcagcagattcagagacattgccagtcagtcagagatccagctatcaaaggcaaatggcaacaggttcggcaggaattattggaggaatatgaacaagttaaaagtattgtcagcactttagaaagttttaaaattgacaagcctccagatttccctgtgtcctgtcaagatgaaccatttagagatcctgctgtttggccaccccctgttcctgcagaacacagagctccacctcagatcaggcgtcccaatcgagaagtaagacctctgaggaaagaaatggcaggagtaggagcccggggacctgtaggccgagcacatcctatatcaaagagtgaaaagccttctacaagtagggacaaggactatagagcaagagggagagatgacaagggaaggaagaatatgcaagatggtgcaagtgatggtgaaatgccaaaatttgatggtgctggttatgataaggatctggtggaagcccttgaaagagacattgtatccaggaatcctagcattcattgggatgacatagcagatctggaagaagctaagaagttgctaagggaagctgttgttcttccaatgtggatgcctgactttttcaaagggattagaaggccatggaagggtgtactgatggttggacccccaggcactggtaaaactatgctagctaaagctgttgccactgaatgtggtacaacattcttcaacgtttcgtcttctacactgacatctaaatacagaggtgaatctgagaagttagttcgtctgttgtttgagatggctagattttatgcccctaccacgatcttcattgatgagatagattctatctgcagtcgaagaggaacctctgatgaacatgaggcaagtcgcagggtcaagtctgaactgctcattcagatggatggagttggaggagctttagaaaatgatgatccttccaaaatggttatggtattggctgctactaatttcccgtgggacattgatgaagctttgcgaagaaggttagaaaaaaggatatatatacctctcccaacagcaaaaggaagagctgagcttctgaagatcaaccttcgtgaggtcgaattagatcctgatattcaactggaagatatagccgagaagattgagggctattctggtgctgacatcactaatgtttgcagggatgcctctttaatggcaatgagacggcgtatcaatggcttaagtccagaagaaatccgtgcactttctaaagaggaacttcagatgcctgttaccaaaggagactttgaattggccctaaagaaaattgctaagtctgtctctgctgcagacttggagaagtatgaaaaatggatggttgaatttggatctgcttgaatttctgtcagctctttaatttctggtatttttgttgataaaatacgaagaaattcctgc

SEQ ID NO: 2120 - DNA, 1749 bp, Homo sapiens
aaaatcccatggtgtccattcggttaaagcccatgttatttctctcccagttacctgccaaatcttctgtttagtgctgtggtaaatttcacctttatttacttactaaaaccatgctgacaagcataattagagagacattatttttataggacatctgaaattccaacgggcactactatggtgcaagtcaccattatcatctatgggataactccaaaatcccatattcactttaggtttaccatcagcttttgactggatactggcaaaaccaccttggtcacaatagtgctttgtgacataccatctcttacctgaatacctgcaaaaacccatggtcttcataaggtttgaaaacctaacatctgttacatggctatccacaaactgcccaggtaactgccatagctgggcatacaacatcttccggcatacctacagaaactcacggatacaattaacatggatttcatctttcatgagaaacaggaaggtttcctgtgtgctcagcactgtctgaacaatctattgcaaggagaatattttagccctgtggaattagcctcaattgcacatcagctagatgaagaagagaggatgagaatggcagaaggaggagtcaccagtgaagagtatcttgcatttttacagcagccttcagaaaacatggatgataccggtttcttctccattcaggtaataagcaatgccttgaagttctggggtttagagatcatccatttcaataatcctgaatatcagaagctcggcattgatcctataaatgaaagatcttttatatgtaattataaacaacactggtttactattagaaaatttggaaaacactggtttaacttgaattctctcttggcgggtccagaattaatatcagatacatgccttgcaaatttcttggctcgattacaacaacaagcatattctgtatttgttgtcaagggtgatctgccagactgtgaagctgaccaactcctgcagatcatcagtgtcgaagagatggatacaccaaaacttaatggaaaaaaattagtaaaacaaaaagagcatagagtctataaaacagtccttgaaaaagtatcagaagaaagtgatgagtctggaacatcagaccaagatgaggaggattttcagagggcccttgaactaagccgccaagaaaccaatagagaagatgaacatctccgcagtactattgagttaagcatgcaaggtagttccggaaacacatcgcaagatcttccaaagacatcatgtgtaactcctgcttcagaacagccgaagaaaataaaagaagactattttgaaaagcatcagcaggaacagaagcagcagcaacaacagtcagatctgccgggccacagttcatacctacacgaaaggccaacaacaagttcgagagcaattgagagtgatctcagtgatgacatcagtgaaggcacagtacaggccgctgtcgacaccattttagaaattatgagaaagaatttgaaaatcaaaggggaaaaataatgcctttaaaaataatttagatagtcatactttccaacattatcctgtgtgattatactgtaggatccattttggtcatctgtcaaagagatgaggaaataaggcttttagacagtttgcaaacaaaatgacgagagagatgtgggactaaataatgatcgttcaactactagccaaggagacattcagcaattaattaaatttaaattagctttc

SEQ ID NO: 2121 - DNA, 5910 bp, Homo sapiens
atggcggcccggagcgccccgagctgccacctgcggctcgagtgggtgtacggctaccggggccaccagtgccgcaacaacctctactacactgcggccaaggagatcgtatacttcgtggcgggggtcggcgtggtgtacagcccgcgggagcacaggcagaagttctaccggggccacagcgacgacatcatcagccttgcattgcatcctgaacgagtgttggtagcaacaggacaagttgggaaagagccttatatttgtatttgggattcatacactgtgcagaccatatcagttttaaaggatgttcatacacatggtatagcttgcttggcgtttgacttagatggacagcgcttggtttcagttggacttgattcaaagaatgcagtttgtgtttgggactggaaaaggggaaaaatgttgtctatggctcctggtcatacagatagaatatttgatatttcttgggatttgtaccagccaaataaacttgtcagctgtggtgtaaaacatatcaagttctggagtttatgtggaaatgctctgaccccaaaacgaggtgtctttggtaagacgggtgaccttcagacaatactgtgcctagcctgtgcaagggatgaattaacatattctggtgcactcaatggggatatatatgtttggaaaggaatcaatcttatacgaacaatacaaggagcccatgctgcaggaatttttagcatgaatgcttgtgaagaaggctttgctactggtggcagagatggttgtattcgtctttgggatttaacttttaaaccaattactgtgattgatctcagggaaacagaccagggatacaaaggtttgtctgtaaggagtgtgtgttggcgaggtgaccacattctagttggaacacaggacagtgaaatttttgaaattgtggtgcaagaaagaaataaaccttttctaattatgcaagggcattgtgaaggtgaactttgggcacttgctgtccatcctactaaacctttggctgtgactggaagtgatgatcgttcggtcaggatatggagcctagtagatcatgcattaatagcaaggtgtaatatggaagaaccaattcgttgtgcagctgtcaatgcagatggaatccatcttgcccttggaatgaaggatggctcattcactgtacttagagtaagagatatgacggaagttgtacatattaaagataggaaggaggcaattcatgagttaaaatattcaccagatggaacttaccttgctgttggatgcaatgacagctcggttgatatttatggagttgctcagcgttataaaaaagttggcgagtgtttgggatcccttagtttcatcactcatctggactggtcttcagacagtagatatttgcagacaaatgatggaaatgggaaaagacttttttatagaatgccaggaggaaaggaagtgacaagtacagaagaaataaaaggtgttcattgggcttcatggacatgtgtttcaggccttgaagtaaatggaatttggcccaagtattcagatatcaacgatataaattcagtagatggaaattatattggccaagttttagttacagctgatgactatggaattataaaattattccgatatccatgtttaagaaaaggggccaagtttagaaaatatattggccattcagctcacgtaactaatgtcagatggtcacatgattatcagtgggttatttctattggtggagcagatcactctgtctttcagtggaaatttattcctgaaagaaaactgaaagatgctgttcacatagcaccccaagaaagtctggctgactctcatagtgatgaatcagattcagatctgtctgatgttccagaactggattctgaaattgaacaagagacacagctcacctaccgtcgacaggtttacaaagaagatctacctcagcttaaagaacagtgcaaagagaaacaaaaaagtgctacttctaaaagaagagagcgggctccaggaaatagtattcgattacactttgttcacggttacagaggttatgactgtcgaagtaatctgttttatactcaaattggtgaaattgtgtaccatgtggcagcagtgggtgtcatttataatcgacagcaaaacacacagcgtttttatctgggtcatgatgatgatattctctgcctaactattcatcctttgaaagactacgtggcaacaggccaggttggtagagatccctcaattcatatatgggatacagagaccattaaaccattgtccatattaaagggccaccaccagtatggtgttagtgccgttgatttctcagcggatgggaaacgtttggcatcagttggcatagatgatagccatactgttgtgctctgggactggaagaaaggagagaaactttcaatagcaagaggaagtaaagataagatttttgttgtaaagatgaacccctatgtgcctgataaactaattacagctggaattaaacacatgaaattttggcgtaaagcagggggaggattgattggaagaaaaggctacataggcacactggggaaaaatgacacaatgatgtgtgcagtgtatggatggactgaagagatggctttttctggaacatccacaggagatgtgtgtatctggagagacatctttcttgtaaaaacagtgaaagcgcatgatgggccagtgttcagtatgcatgcattggaaaaagggtttgtaactggaggaaaagatggtatagtagctctttgggatgactcttttgaaagatgtctcaagacctatgctataaaaagagctgcattggccccaggatctaaaggtcttctcttggaagataatccatctatacgtgccatatcattaggacatggtcatattttagttggcacaaagaatggtgaaatactagaagtggataaaagtggcccaataacacttctggttcagggacacatggaaggagaggtgtggggtttagctacacacccttatctgcccatctgtgctactgtaagcgatgataaaaccttaagaatatgggatctctcacctagtcattgtatgttggctgtccggaagctgaaaaagggtgggaggtgttgctgtttttctcctgatggtaaagctttagccgtaggtctcaacgatggaagcttcttaatggcaaatgcggatactctagaggatcttgtgtcttttcatcacagaaaagatatgatttcagatattcgattttcacctggttctgggaaatatcttgctgtagcatcccatgacagctttatagatatatacaatgtaatgagtagtaaacgagtaggaatatgcaaaggagctaccagttacataacccatattgattgggatattagaggaaagcttttacaggtcaacactggtgctaaggaacaattattctttgaagctcccagagggaaaaaacaaaccatccccagcgtggaggtagaaaaaattgcttgggcatcatggacaagtgtacttggtttatgctgtgaaggaatttggccagtaattggagaagttacagatgtaactgcttcttgcctcaccagtgacaaaatggttctagctaccggggacgatttgggatttgtgaagttatttagatatcctactaaagggaaatttggaaagtttaagaggtatgtggcccatagtacacatgtcacaaatgttcgctggacttatgatgacagcatgttggttaccctaggcggtacagatatgtctttaatggtgtggacaaatgagatggaaggctatcgagaaaaaaggccttgtgatagtgaagaatccgacattgattctgaagaagatgggggctatgacagtgatgttacaagggagaatgaaatcagttacaccatcagagccttatcaacaaatattcgcccaatgttaggaatcaagcctcatttacaacaaaaagaaccctcaattgatgaaaggcctccagtgagcagggccccaccacagccagagaaactccagacaaacaatgtaggcaagaaaaagagacctatagaggaccttgtgttggagctcatttttggttatcgaggcagagactgtaggaataatgttcactatttaaatgatggtgatgatataatttatcacactgcatctgttggaattctgcacaatgttgctacaggttctcagagtttttatcaggaacataatgatgatattctgtgcctcacagtaaaccagcaccccaaatttatcaacatagtggcaactggccaagtaggtgattcagcagacatgtcagctacagctccttctattcacatctgggatgcaatgaacaagcagactttatctatcctaagatgctaccattcaaagggagtatgttcagtcagcttcagtgctactggcaaactattgctgtctgtgggactagacccagaacatactattaccatttggagatggcaggaaggtgccaaaattgccagcagagctggtcacaatcaacgtatttttgtggcagaattccgaccagattcagatacccagtttgtctcagtgggagtaaaacatgtgaagttctggaccctggcaggaagagctcttcttagcaaaaaagggctactgagcacactggaagatgcccggatgcagaccatgctcgctattgcatttggtgcaaataacttgacgtttacaggtaccatcagtggtgatgtctgtgtgtggaaagatcacatattgtgtagaatcgtggcgagagctcacaacgggcctgtgtttgccatgtacaccaccctgcgagatggacttatcgtgactgggggaaaggaaaggccgtcaaaagaaggaggagcggttaaactgtgggatcaggaactgaggcggtgccgtgccttcaggcttgagacaggacaagccacagattgtgttcgttctgtgtgcagaggcaaaggcaagatccttgttgggacaaggaatgctgaaataatcgaagttggagagaaaaatgcagcttgtaatattttagttaacggtcatgtggatgggccaatctggggactagcaacacatccttccagggattttttcctttctgctgcagaagatgggacagtgagactttgggatattgctgataaaaagatgttaaacaaagtgaatttgggacatgctgctcgtactgtgtgttacagccctgaaggggacatggtggctattggaatgaaaaatggagaatttatcattttactagtgagttctctaaaaatatggggaaagaagagagacaggagatgtgcaatccatgatatcagatttagtccggattcccggtatctggcagtaggttctagtgagaactcagtggatttttatgacctaacgctgggccccactcttaacagaatcagctactgcaaagacattccaagctttgtcattcaaatggacttctctgcagatagcagttatctccaggtctctagtggctgctataaacggcatgtctatgaagtgccttcaggaaaacatcttatggatcatgccgctattgacagaattacttgggctacatggactagtattctaggagatgaggttttgggaatctggtccagacatgctgagaaagctgatgtcaactgtgcctgtgtatctcattcaggaatcagtcttgttacaggagatgactttggcatggttaagttatttgacttcccatgtccagaaaaatttgcaaaacacaaaaggttcttgggtcattcgccccatgtgacaaatattcgatttaccagtggtgatcgacatgttgttagtgctggaggtgatgactgcagcttatttgtctggaaatgtgtacatacacctcactga

SEQ ID NO: 2122 - DNA, 1789 bp, Homo sapiens
tcctctcctattatgcaaacccacaccatggatccagcagactactctggccccagcatgctgctccttgggatgatgggagaagggggaaacctgtgttttctcttggttttagggtatgggtctacttctttgaacattcgctcagatcgtaaggtaaccccaagaatcggcatcactctctggtctgggcgcctggatagtcacgcatggagtccgcgaggtgctggcgccggagcacgctgggaacgccgggctcccggccggcctgacccggaagggctggcgcatggtaaccccagcttccctagcaaccaagcaggcgcaagaagcaaccagccgcgctatccgctcccgttgctaccggaatgcctcttcaggttagcgattacagctggcagcagacgaagactgcggtctttctgtctctgcccctcaaaggcgtgtgcgtcagagacacggacgtgttctgcacggaaaactatctgaaggtcaactttcctccatttttatttgaggcatttctttatgctcccatagacgatgagagcagcaaagcaaagattgggaatgacaccattgtcttcaccttgtataaaaaagaagcggccatgtgggagaccctttctgtgacgggtgttgacaaagagatgatgcaaagaattagagaaaaatctattttacaagcacaagagagagcaaaagaagctacagaagcaaaagctgcagcaaagcgggaagatcaaaaatacgcactaagtgtcatgatgaagattgaagaagaagagaggaaaaaaatagaagatatgaaagaaaatgaacggataaaagccactaaagcattggaagcctggaaagaatatcaaagaaaagctgaggagcaaaaaaaaattcagagagaagagaaattatgtcaaaaagaaaagcaaattaaagaagaaagaaaaaaaataaaatataagagtcttactagaaatttggcatctagaaatcttgctccaaaagggagaaattcagaaaatatatttactgagaagttaaaggaagacagtattcctgctcctcgctctgttggcagtattaaaatcaactttacccctcgagtattcccaacagctcttcgtgaatcacaagtagcagaagaggaggagtggctacacaaacaagctgaggcacgaagagcaatgaatactgacatagctgaactttgcgatttaaaagaagaagaaaagaacccagaatggttgaaggataaaggaaacaaattgtttgcaacggaaaactatttggcagctatcaatgcatataatttagccataagactaaataataagatgccactattgtatttgaaccgggctgcttgccacctaaaactaaaaaacttacacaaggctattgaagattcttctaaggaattctgttctcttgagggcattgaatgtcaggcctctgagcccaagctaagccatcatatccctagtgacctgcacgtatacatccagatggcctgaagcaagtgaagaatcacaaaagaagtgaaaatggccggttcctgccttaactgatgacattaccttgtgaaattccttctcctggctcagaacctcccccactgagcaccttgtgacccctgcccctgcccgccacagaataaccccctttgactgtaattttccattacctacccaaatcctataaaacggccccacccctatctcccttcgctgactgtcttttcggactcagcccgcctccacccaggtgattaaaaagctttattgctcac

SEQ ID NO: 2123 - DNA, 3940 bp, Homo sapiens
aggtgacgtcactggccaggccagccggcgccattttgaaagtggagtcgcctgcccctgccgctgccgccgccgccgtcgctgtcgtagtcgccgccgccgctgccggagaaagagcacgagcggggaagccccagagtgaaatctagcatcctgccggctggtctgcccgcccctccttccttttccccccggcccccgtcccctccccccgcaggtgccatccgccgccatccgccctctctacccccccatccccaggtgaggggggtgagttcaggaagcggagaccccgaggaacccagcagggtcaccatttgcagcgcaacatggcaggagctggaggagggaatgatattcagtggtgtttttctcaggtgaaaggagcagtagatgatgatgtagcagaagcagatataatttctacagtagaatttaatcattctggagaattactagcaacaggagataaaggtggtagagttgtcatctttcaacaggagcaggagaacaaaatccagtctcatagcagaggagaatataatgtttacagcaccttccagagccatgaaccagagtttgactacttgaaaagtttagaaatagaagaaaagatcaacaaaattaggtggttaccccagaaaaatgctgctcagtttttattgtctaccaatgataaaacaataaaattatggaaaatcagtgaaagggacaaaagaccagaagggtataacttgaaagaggaggatggaaggtatagagatcctactacagttactacactacgagtgccagtctttaggcctatggatctaatggttgaggccagtccacgaagaatatttgccaatgctcatacatatcacatcaactcaatttctattaatagtgattatgaaacatatttatctgcagatgatttgcggattaatctttggcatctggaaattacagacaggagttttaacattgtggatatcaagcctgccaatatggaagagctaacagaggtgattacagcagcagaatttcatccaaacagctgtaacacatttgtatacagcagcagtaaaggaactattcggctatgtgacatgagggcatctgccctctgtgatagacattctaaattgtttgaagaacctgaagatcccagtaacaggtcatttttttccgaaatcatctcctctatttcggatgtaaaattcagccatagtggtcgatatatgatgactagagactatttgtcagtcaaaatttgggacttaaatatggaaaacaggcctgtggaaacataccaggtgcatgaatacctcagaagtaaactctgttcactgtatgaaaatgactgcatatttgacaaatttgaatgttgttggaatggatctgacagtgttgtcatgactggatcttacaataatttcttcagaatgtttgacagaaacacaaagcgagacataaccctagaagcatcgcgggaaaacaataagcctcgcacagttctgaagcctcgcaaagtctgtgcaagtggcaagcgaaagaaagatgaaataagtgttgacagcctagacttcaataagaaaatccttcacacagcctggcaccccaaggaaaatatcattgccgtagctactacaaacaatctgtatatatttcaagacaaagtgaattagggttggcattcctagcagaagaacccacttcctgcttagttgagatagttgaatctagcattcgttcctataaaagagagaggtccattgtggcgcccctttccagtgtttgacagtgtgccattcgacaacacattgttatagctacatggagaaagctctgtggattcatcactgtggtgttctccatgtctgctagccatttaggtaagggtagggcacttttaatttaaatgacttcttgcaccatcttgcctaatggactagattggactgtatcaacattgatttactccactttttatgccttccattgtgatgacgtcaaacacagtgaaagccttcagtcatgctatgggatttaattgtgtatcctcattactgtatcatttgtggggtacaccccttccccctttttttaaattaaatacagctcattcttactgtggcttgtagcattcctcctcttctggcctcctggactgctccccttcatctcttacccttgccccctccacccggtcttggtggtggtatattaaaaaaagaaagaatgaaagcacacaaaatgagtcagtttggggtcagtggtataaagggggtatatgttgcaaacaaatgttttagtaacagttggctgtaatcactcctcgccgtgtctggcactgaaaataaggaaaaaaaacctactactgaataaaagtgacaaagaatggagaatctggttttctttttctttttaacctacctcttgtagccaatattttgtgtcatacctttgggcacagtgaaacaaaatgggttttcattgtttattggtatttttgttaattatttttaacaagtgttcttttacatgcaggaggagaggtattggttctctatgaacatattttgaatataggttttattaaggatttcacaatctataaatgctactagtttttttttttttttttaccatcatgagggtattggatacattgtgtctctatttaactcattatgtgttaatgaaattgttgtaaatgggaaccaaatttgtagaacttaatttctactttttagagtgcttaatttcatttttgccttactaaatagtcaaagacttataaaacatttttaacaagttagaacttttttgttattcagtcatataaaatagcagaaaactaacatcaagtgacactgcactaaatactttttttgtattttactgctatcaaatcagaatgaaatatactttaccatagatatttttcttctatttttggttttccaaagctatatgaaagacaaatttttaaaggtacagcgttcaaaaagtgcttaatgaactccaacagctgcctcaaataaaaatctgtatatgaatacattttccctaagcggtgatacattatccaaagatgaagagtgctcctatttttaataggtagaatgtacctttgtcagtcttgcagaaactttaatggagaagaaatggactttatttttgaaaggtgaaatgaacaggcatttatattattagagaatggtagtcttattttggtggaacataatgtaacaaccttgaatttcagaggactctgagtgcttctatgtccactacctattgttctattcttcaataatgaaaaagaattcaacgagccgaccgtgattccctctactacaaatattatgtcttgtaagttagcatttttagcacacaggagaaattttatgtaataaaattactgtatcttttggatttaacaaatttgtatttgaaacacattctatgtctgataattcttaatggcacttttactaatttatttggggatcttgggtacattcttaatttgtgtttattcttcacgcttgacttgcaagtgggatattcccctgccacaagtgtcaaacagtgatattcttcctgtgttgtgactggacagttttccagatcttttttgggagattttcctacagcttggttgtatgtcttgagataacaccaccaaacagctctcagaaattcttttttgattgatcagtagctatgatgattctcctccatgacactaaggattagtttatatatttaagagaaataattgctaaaattaaaatgcctctatcaaggaatgctattataaattattgttaacattctcaagtattaattttttaatttcattggtgtagcaaactctaagcccagccactcattttacatggccatggttaatctttttattaataaaaattatacttagaataaa

SEQ ID NO: 2124 - DNA, 4537 bp, Homo sapiens
gcggcgcgcacggtatggcggcggcggcggcggcggcggcgcgcgcctgagaagaggggacgccagcccggtcaggcctcggcgcggcctacacgctccgctcgctcgctcgctcccgcctcccgccccgcgcccggccatggcggagccgtcgtccgcccgacgcccggtgcctctcatcgagtcggagctgtacttccttatcgcccggtacctatcggcgggcccgtgtcggagagcggcccaggtgctggtgcaggagctggagcagtaccagttgttgccgaagagattggactgggagggcaacgagcacaacaggagctacgaggagttggtcttgtccaataagcatgtggctcctgatcatcttttgcaaatctgccagcgcatcggtcctatgttggataaagaaattccacccagtatttcaagagtcacttctttacttggtgcaggaaggcagtctttgctacgtacagcaaaagactgcaggcacacagtttggaagggctctgcctttgctgctcttcatagaggaagacctcctgaaatgccagtgaattatggttccccaccaaatcttgtggagatacatcgaggaaaacaactcacagggtgttccacttttagtacagcatttccaggaactatgtatcagcatataaaaatgcacagaaggattctcggacatctatctgctgtttactgtgtagcatttgataggacaggacatagaatctttacaggttcagatgactgtttggtaaagatttggtcaacacataatggccgcttgttatctacattaagaggtcattctgcagaaatttcagatatggcagtaaactatgagaatacaatgattgctgcggggagctgtgataaaattattagagtgtggtgcttgagaacttgtgccccagttgctgtgctccaaggacacacaggatcaattacatctttacagtttagcccgatggccaaaggctctcaaagatacatggtttccactggtgctgatgggacagtttgcttttggcaatgggatttagaatccttaaaatttagcccacgtcccctgaagttcactgaaaagcctaggccaggcgttcaaatgctttgttcttcttttagtgttggtggtatgtttttagccacaggtagtactgatcatgtaatcagaatgtattttttgggttttgaagcacccgaaaaaatcgcagaacttgaaagccacactgataaagtagatagtatccaattttgtaacaatggtgatcggttcctaagtggtagcagagatggaacagcacggatttggagatttgagcagttagaatggaggagcattttattggatatggctaccagaatctcaggggacttatcttccgaagaggaaaggtttatgaaacctaaagtaacaatgatagcttggaatcaaaatgatagcattgttgtcacagctgtgaatgatcatgtcctcaaagtgtggaattcttacactggacaactgcttcataacttaatgggacatgctgatgaagtatttgttctggagacacatccctttgattccagaattatgttatctgcaggacatgatggcagcatatttatatgggatattacaaaaggtaccaagatgaaacattattttaatatgattgaaggacaaggacatggagctgtgtttgactgtaagttttcacaggatggacagcattttgcctgtacagattctcatgggcaccttctgatatttggttttggatgcagcaaaccatatgaaaagattcctgatcagatgttcttccatactgactatcgaccacttattagagattctaataattatgtcttagatgagcaaactcagcaggctcctcatcttatgcctccaccattcttggtagatgtagatggaaatcctcatccaaccaagtatcagagattagtaccaggccgagaaaattctgcagatgaacatttgattccacagctgggctatgtggcaacaagtgatggagaggtgattgaacaaattataagcctgcaaaccaatgataatgatgaacgcagcccagaatcgagtattcttgatggaatgataagacagttgcagcagcagcaagatcagagaatgggagcagatcaggatactattccaagaggactttcaaatggtgaagaaacaccccggagaggttttagaaggctgagcttagacattcagtcccctccaaatattggtctgcgtcgtagtggacaagttgaaggtgttcgtcagatgcatcaaaacgctccacgcagtcagattgctacagaacgtgacctgcaggcttggaaacgaagagtggttgtaccagaggtaccactaggcatatttaggaagctggaagacttccgattagagaaaggtgaagaggaaagaaatctttatataataggaagaaaaagaaagactcttcagctctcacataagtcggattcagtggttttggtatcacagtctagacaaaggacatgtaggcgtaaatatccaaattatggtagaagaaatcgtagctggcgtgagttatcttctggaaatgagtcttcaagctctgtaagacatgagacttcctgtgatcagagtgaaggttctggttcttcagaagaggatgaatggagaagtgacagaaaaagtgagagttacagcgaaagttcaagtgactcttcatctagatattccgattggacagctgatgcgggcatcaatttgcagcctcctttaagaacatcatgtcgtcgacgaattactcgattttgtagtagttcagaagatgaaatatctactgagaatttatctcctccaaaaagaagacgaaagagaaagaaagaaaataagcctaagaaggagaatttgcggaggatgactccagcagagcttgcaaatatggagcatttatatgaatttcaccctccagtttggattactgacaccacacttagaaaatctccttttgttcctcaaatgggtgatgaggtaatatattttcgacagggtcatgaagcttatattgaggctgtaagaagaaataatatttatgaactgaaccctaataaggagccatggagaaaaatggatcttagggatcaagaattggttaaaatagttggaatacgatatgaagttgggccccctacactctgttgcctaaaactagcatttatagatccagcaactggaaaacttatggacaaatctttctctattagatatcatgatatgccagatgttattgactttcttgtattgcgtcaattttatgatgaagcaagacagaggaattggcagtcttgtgacagattccgctctattattgatgatgcttggtggtttggaacagtgttaagtcaagagccatatcaaccacagtatcctgatagtcatttccagtgttatattgttaggtgggataatactgaaattgaaaaacttagcccatgggacatggaaccaattcctgataatgttgatccacctgaagaattaggagctagtatttctgtcacaacagatgagctagagaaattgctctataaaccacaagctggtgaatggggtcagaaatcaagagatgaagaatgtgatagaattatcagtggtatagatcaacttttgaatcttgatatagcagcagcttttgcaggccctgttgatttgtgtacatacccgaagtactgtactgtagtagcttatccaaccgatctttacacaattcgaatgagacttgttaatcgattttacaggaggctgtctgcgttagtttgggaagtcagatatatagaacataatgccagaacatttaacgaacctgagagtgtaattgcaagatcagctaaaaagataactgaccaacttttaaaatttatcaagaatcaacactgtacaaatatctcagaactttctaacacatctgaaaatgatgagcaaaatgctgaggatttggatgatagtgatcttcctaaaacatcttctggaaggaggagagactacagagatattatagataccccaatggattttggaacagtaagggaaactctagatgcgggaaattatgacagccctttggagttttgcaaagacatccggctgatatttagcaatgcaaaagcgtatacaccaaacaaaagatcaaagatttatagtatgaccttgagattatctgccttatttgaagaaaaaatgaagaaaatctcttctgattttaaaattggtcaaaaattcaatgaaaaacttcgaagaagccagaggttcaagcaacggcaaaattgtaaaggtgacagtcagcctaacaaaagtatcagaaacctcaagccgaagaggttaaaatctcagacaaaaataattcctgagttggtaggttctcctacccagtctacctcaagtaggacagcttatcttggaacccacaagacaagtgctggtatctcttcaggtgttacttctggtctcttcagattcagcagaatcatcagaaaggag

SEQ ID NO: 2125 - DNA, 1034 bp, Homo sapiens
attatcctccttattgacaaacagagcggtcgcggcggcgactctcggcgtgcggtgatagccaagccatgggagacaagaagagccccaccaggccgaagcggcagccgaagccgtcctcggatgagggttactgggactgtagcgtctgcaccttccggaacagcgccgaggccttcaagtgcatgatgtgcgatgtgcggaagggcacctccacccgagataacaggaagagagcctggttaccatttggtggaacaatcctgctggctcaagcctctgcctagaaatttgggtcattctcttttttggacagtctggaaacctcgacctgtctcccagttggttgcacagcaggttactcagcagtttgtgcctcctacacagtcaaagaaagagaaaaaagataaagtagaaaaagaaaaaagtgaaaaggaaacaactagcaaaaagaatagccataagaaaaccaggccaagattgaaaaatgtggatcggagtagtgctcagcatttggaagttactgttggagatctgacagtcattattacagactttaaggagaaaacaaagtcaccgcctgcatctagtgctgcttctgcagatcaacacagtcaaagcggctctagctctgataacacagagagaggaatgtccaggtcatcttcacccagaggagaagcctcatcattgaatggagaatctcattaaagtttattttctccaatttcttagtcacttctgtcctaccatgcaaatacacagattatgccaagaggtaccacattttcatgacagatacattcatgcacaatccataatttgagttttacataaaatagaaatttgttagaatttgttagattttattgcaatgatgcctaccaaacatttccagacttaacattttggtctctgcagttaagtgccatgaaaatgtggttgaattattcattatgcagtgttattggtaagtgtattttcacttttagtttagtgaattctaacacataattcttgaattctctactatt

SEQ ID NO: 2126 - DNA, 1211 bp, Homo sapiens
ccctccctccctcctcccccgcccgcttccgcccggcttattatcctccttattgacaaacagagcggtcgcggcggcgactctcggcgtgcggtgatagccaagccatgggagacaagaagagccccaccaggaaacctcgacctgtctcccagttggttgcacagcaggttactcagcagtttgtgcctcctacacagtcaaagaaagagaaaaaagataaagtagaaaaagaaaaaagtgaaaaggaaacaactagcaaaaagaatagccataagaaaaccaggccaagattgaaaaatgtggatcggagtagtgctcagcatttggaagttactgttggagatctgacagtcattattacagactttaaggagaaaacaaagtcaccgcctgcatctagtgctgcttctgcagatcaacacagtcaaagcggctctagctctgataacacagagagaggaatgtccaggtcatcttcacccagaggagaagcctcatcattgaatggagaatctcattaaagtttattttctccaatttcttagtcacttctgtcctaccatgcaaatacacagattatgccaagaggtaccacattttcatgacagatacattcatgcacaatccataatttgagttttacataaaatagaaatttgttagaatttgttagattttattgcaatgatgcctaccaaacatttccagacttaacattttggtctctgcagttaagtgccatgaaaatgtggttgaattattcattatgcagtgttattggtaagtgtattttcacttttagtttagtgaattctaacacataattcttgaattctctactattggcatgtaacgaatttaaattttttataacatagtgcaagctgcctaaatatgtattatttgagaattgtgaaacagatagttatatgtatacaagtcaaagaacaacttaactattgctgcaacaggtttttcttaatggttatcctcttaaatacacctgctggtacttggtgtggttaaataggaaaattgttattaaataaagaatttgtatgaacctttgccaatgtttttgacacgttttactaattattgttcctgaattatgtttctggttttatctattttttgaggtttttttgtttgcttatttttcaaaacattcatttattgtaatgtttactagcggactagtaaacaat

SEQ ID NO: 2127 - DNA, 1793 bp, Homo sapiens
agatctgatcgctgctgccctgctctcctcctcctctcattcctctgcctcctggattcctgaagtttaggagaaataaggtagccaagggaaccacatggaagttgtgacagctcccagcggcgcgcccctttcgtgtgtgccggtacctcggcttaggagttgcccgctgacaccttgaatgaaggaggtccccttgccagccagcctgccgggatgggccattgctgctgcaagccttataactgccttcagtgcctggacaagacgaatgaaagtgcccttgtgaaagaaaaagagctgtcaatcgaacttgcaaacatcagggatgaagttgccttccatacagcaaagtgcgagaaactacaaaaggagaaggaggagctggagaggcggttcgaggacgaggtgaagaggctgggctggcagcagcaggccgagctccaggagctggaggagcggctgcagctgcaattcgaggcggaaatggcgcgcctgcaggaggagcacggtgaccagctgctgagcatccggtgtcaacaccaggagcaggtggaagatctcaccgccagccatgatgctgctctcctagagatggaaaataaccacacagttgccatcacaatcctgcaggatgaccacgaccacaaagtccaagaattgatgtccactcatgagcttgaaaagaaagaattggaagaaaattttgaaaaactgcggctgtcattgcaggaccaggtggacacgctgaccttccagagccagtctctgcgggacagagcccgccgcttcgaagaggccttgaggaagaacacagaggagcagctggagattgcattggctccttatcagcacttggaagaagacatgaagagtctgaagcaggtattagaaatgaagaatcagcaaatacacgagcaagaaaagaagattcttgagctggaaaagctggcagaaaagaacattatcctagaagaaaagatccaggttctccaacagcagaacgaagacctcaaagcaaggattgaccaaaacacagttgtcaccagacagctgtcggaggaaaatgctaacctccaggaatatgttgagaaggaaacccaggagaagaagagattgagccgaaccaatgaagagctgctttggaagctccaaactggggacccgaccagtccgattaaactctcgcccacatctcccgtttaccgcggctcctcctcggggccctcctctccggccagagtcagcacaacacccagatgacgccactacacggcctgcgggagctccggcttctcgtcctccggtctccaccctgagggagcaccgacccggtgccgccggagctggccctgtgcgcatgctcagtagctgcgaatgcatcctaggcgcgtcctcctctgatccccgtgtaagactgccctggtgtcggcacttaggaatgtgtaaatggtaaagtctgatgtgcaaacgttttaccatagttagagccaaaagaaagacacttgcaattgttcttgagcaatgaactttcactgcagaatttcaggttagttacaaaaagctcagttttcaatatacattgaataatcattgtgtactgcaccgatatgtgtgtatatttagatatacgtatatacacatgctgcggttctgaatttcattttttataacatgaagtgctgacatattttagtgaaggtcagcagttttctaacttgtgcctaagaattattgggaaatgaaaatgcatttctatctagcttcccaggaatatttctacccaaaataga

SEQ ID NO: 2128 - DNA, 2833 bp, Homo sapiens
ctccccgggcggctccggctcccgcagcgggacagacccacccgcccaggcttttatccggcaccggcagcgtcttcctttcctcccccgtctatggtggtggcggcggcggctcctcgggcggcggcggaagacgaggctgcggcgttgccatgaacagtggcggcggcctcccgcccccctcggccgccgcctccccttcctcctcctcgctggcggcggcggtggcggtggtggccccgccgggggtcgggggtgtccccggcggggcggcggtaggagtgaagctgaagtactgccgctactacgctaaggataagacttgcttctacggggaggagtgtcagttcctgcatgaggaccctgccgccggggctgccccgggcctcggcctccatagcaacagcgtccccctggctctggctggtgcacccgtggccggctttccgccgggagccgtcgcgggcgggggagctgggccgccccccgggcccaagaagccggacctgggggacccggggaccggagccgcagccggcggaggaggcagtagcgggggactcgatggaccgcggctggcaattccaggaatggatggaggtgctttaactgatacaagtctcacagattcctattttagcaccagctttattggagtcaatggatttggaagccctgtagaaacaaaatatcccctgatgcagagaatgactaatagtagcagctccccaagccttctaaatgacagtgccaagccatattcagcccatgatcctctaacatcacctgcttcatccttgtttaatgactttggtgccctcaacatctctcagagacgaaagccaaggaagtatcgcctggggatgctggaggagaggctagttccgatgggatcaaaggcacgaaaagcaaagaaccctattggctgccttgctgacaggtgtaaatcaggagtacccatcaatatggtttggtggaacagagtcacagaaaacaatttacagacaccaaatcctactgcaagcgagtttattcctaaaggaggatcaacctccaggctgagtaacgtgtcccagtcaaatatgtctgccttctctcaagttttctctcacccatccatgggaagccctgctactgctggattagcgccaggaatgtcgttgtctgctgggtcttcccctcttcattcccccaagattactccacatacttctcctgctcccagaagaagaagtcacactccaaatccagcaagttacatggtgccttctagtgcctctacatctgttaataatcctgtttctcagactccgtcttctggtcaggtgatccaaaaggaaactgttggtgggacgacttacttctatacagacacaactccagcacctttgactggaatggtgtttccaaactatcatatttatcctccaactgcacctcacgttgcttatatgcaaccgaaagcaaacgcaccttccttcttcatggctgatgaactccgacaggagctgatcaacagacatttaataacaatggctcaaattgatcaagcagatatgccagcagttcctacagaggttgacagctaccatagcctattccctctagaaccactgccacctcccaaccggatacagaaatcaagtaattttggatatattacatcttgctacaaagctgtaaacagcaaagatgatctgccatattgccttcggaggatacatggttttcgtcttgttaacacaaagtgcatggtgttggtcgacatgtggaagaaaattcaacactcaaatatcgtaactttgcgtgaagtatttaccactaaagcatttgctgagccctctcttgtgtttgcatatgatttccatgctggaggagaaactatgatgagcagacactttaatgaccctaatgctgatgcctacttcaccaagagaaagtggggtcagcacgagggaccattgcccaggcagcatgctggattattgccagaatctcttatttgggcatatattgtccaactaagttctgcattgcgtaccattcatacagcaggtttggcatgtcgagttatggatccaacaaagattctgataactggcaaaacaaggttgcgagtaaattgtgttggagtttttgatgttttaacatttgataacagtcaaaataataatccattggcattaatggcccagtaccagcaagcagatctgatatcattaggaaaagttgtgttggctttggcttgcaactctttggcaggaattcagcgagagaatttacagaaagccatggaactggtgacaatcaactattcctctgacctgaagaatctgattttgtatttgttgactgaccaaaacaggatgcgaagtgtaaatgacatcatgcccatgattggtgctcgattttatactcaattggatgctgctcaaatgagaaatgatgtcatagaggaagaccttgcaaaggaggttcaaaatggaagactgtttaggctcctagcaaaattgggaacaatcaatgagaggccggagtttcagaaggatcccacttggtcagagactggagaccgttatctgttgaaactctttagggatcatctttttcatcaggtgacagaagcaggtgctccctggattgacctcagtcatataatttcttgtcttaacaagctagatgctggtgtgccagaaaaaataagcctgatttccagagatgagaagagtgtacttgtggtgacctacagtgacttaaagcgctgctttgaaaatacttttcaagaactgattgcagctgcaaatggtcagttgtagtatttgctaaaaaagca

SEQ ID NO: 2129 - DNA, 1855 bp, Homo sapiens
ctgtggcgcttcccctgcgaggatggctaccctggttgtaaacaagctcggagcgggagtagacagtggccggcagggcagccgggggacagctgtagtgaaggtgctagagtgtggagtttgtgaagatgtcttttctttgcaaggagacaaagttccccgtcttttgctttgtggccataccgtctgtcatgactgtctcactcgcctacctcttcatggaagagcaatccgttgcccatttgatcgacaagtaacagacctaggtgattcaggtgtctggggattgaaaaaaaattttgctttattggagcttttggaacgactgcagaatgggcctattggtcagtatggagctgcagaagaatccattgggatatctggagagagcatcattcgttgtgatgaagatgaagctcaccttgcctctgtatattgcactgtgtgtgcaactcatttgtgctctgagtgttctcaagttactcattctacaaagacattagcaaagcacaggcgagttcctctagctgataaacctcatgagaaaactatgtgctctcagcaccaggtgcatgccattgagtttgtttgcttggaagaaggttgtcaaactagcccactcatgtgctgtgtctgcaaagaatatggaaaacaccagggtcacaagcattcagtattggaaccagaagctaatcagatccgagcatcaattttagatatggctcactgcatacggaccttcacagaggaaatctcagattattccagaaaattagttggaattgtgcagcacattgaaggaggagaacaaatcgtggaagatggaattggaatggctcacacagaacatgtaccagggactgcagagaatgcccggtcatgtattcgagcttatttttatgatctacatgaaactctgtgtcgtcaagaagaaatggctctaagtgttgttgatgctcatgttcgtgaaaaattgatttggctcaggcagcaacaagaagatatgactattttgttgtcagaggtttctgcagcctgcctccactgtgaaaagactttgcagcaggatgattgtagagttgtcttggcaaaacaggaaattacaaggttactggaaacattgcagaaacagcagcagcagtttacagaagttgcagatcacattcagttggatgccagcatccctgtcacttttacaaaggataatcgagttcacattggaccaaaaatggaaattcgggtcgttacgttaggattggatggtgctggaaaaactactatcttgtttaagttaaaacaggatgaattcatgcagcccattccaacaattggttttaacgtggaaactgtagaatataaaaatctaaaattcactatttgggatgtaggtggaaaacacaaattaagaccattgtggaaacattattacctcaatactcaagctgttgtgtttgttgtagatagcagtcatagagacagaattagtgaagcacacagcgaacttgcaaagttgttaacggaaaaagaactccgagatgctctgctcctgatttttgctaacaaacaggatgttgctggagcactgtcagtagaagaaatcactgaactactcagtctccataaattatgctgtggccgtagctggtatattcagggctgtgatgctcgaagtgtttttcagataatatgtgaccaatatactgggaaagaggtagtcacagagaaagggtaaaaggtcatgctgttacaggtgtagtttgtgtgcataaataatacttccgaattaaattatttaatatttgactgatttcaataactgtgaaaaataaaaaaggtgttgtattgcttgtgagaa

SEQ ID NO: 2130 - DNA, 3360 bp, Homo sapiens
gactacccggcgtgcgcgtcctcctgccggcctgcaggcccggggcctccgcctgcttccccacagctgctccttgcggccccgcttgcgttcacgctgtcgcccgggccggcgcggccgcgggcaaccgctccccctcccacacctaccccgccccctccccgccttttccgccctccggtccccctccctcggcccgctgctgctgctccagatgaggtgatggcaacggccaacttcggcaagatccagatcgggatttacgtggagatcaagcgcagcgatggtaaatacgagttcacagtataccagcaaaagtaggatttacatattattttgaagattctgggtgcacagcaacacctgtccctggtatacacccaagggagaggaaatcaccaccttgtgaagatatctgcactctcgcgttcattgcagcattattcacagtagccaagatagggaagcaacctaaatgtccatcgatgggccgaatacatcaagcaatggtaacatctttaaatgaagataatgaaagtgtaactgttgaatggatagaaaatggagatacaaaaggcaaagagattgacctggagagcatcttttcacttaaccctgaccttgttcctgatgaagaaattgaacccagtccagaaacacctccacctccagcatcctcagccaaagtaaacaaaattgtaaagaatcgacggactgtagcttctattaagaatgaccctccttcaagagataatagagtggttggttcagcacgtgcacggcccagtcaatttcctgaacagtcttcctctgcacaacagaatggtagtgtttcagatatatctccagttcaagctgcaaaaaaggaatttggacccccttcacgtagaaaatctaattgtgtgaaagaagtagaaaaactgcaagaaaaacgagagaaaaggagattgcaacagcaagaacttagagaaaaaagagcccaggacgttgatgctacaaacccaaattatgaaattatgtgtatgatcagagactttagaggaagtttggattatagaccattaacaacagcagatcctattgatgaacataggatatgtgtgtgtgtaagaaaacgaccactcaataaaaaagaaactcaaatgaaagatcttgatgtaatcacaattcctagtaaagatgttgtgatggtacatgaaccaaaacaaaaagtagatttaacaaggtacctagaaaaccaaacatttcgttttgattatgcctttgatgactcagctcctaatgaaatggtttacaggtttactgctagaccactagtggaaactatatttgaaaggggaatggctacatgctttgcttatgggcagactggaagtggaaaaactcatactatgggtggtgacttttcaggaaagaaccaagattgttctaaaggaatttatgcattagcagctcgagatgtctttttaatgctaaagaagccaaactataagaagctagaacttcaagtatatgcaaccttctttgaaatttatagtggaaaggtgtttgacttgctaaacaggaaaacaaaattaagagttctagaagatggaaaacagcaggttcaagtggtgggattacaggaacgggaggtcaaatgtgttgaagatgtactgaaactcattgacataggcaacagttgcagaacatccggtcaaacatctgcaaatgcacattcatctcggagccatgcagtgtttcagattattcttagaaggaaaggaaaactacatggcaaattttctctcattgatttggctggaaatgaaagaggagctgatacttccagtgcggacaggcaaactaggcttgaaggtgctgaaattaataaaagccttttagcactcaaggagtgcatcagagccttaggtagaaataaacctcatactcctttccgtgcaagtaaactcactcaggtgttaagagattctttcataggtgaaaactctcgtacctgcatgattgccacaatctctccaggaatggcatcctgtgaaaatactcttaatacattaagatatgcaaatagggtcaaagaattgactgtagatccaactgctgctggtgatgttcgtccaataatgcaccatccaccaaaccagattgatgacttagagacacagtggggtgtggggagttcccctcagagagatgatctaaaacttctttgtgaacaaaatgaagaagaagtctctccacagttgtttactttccacgaagctgtttcacaaatggtagaaatggaagaacaagttgtagaagatcacagggcagtgttccaggaatctattcggtggttagaagatgaaaaggccctcttagagatgactgaagaagtagattatgatgtcgattcatatgctacacaacttgaagctattcttgagcaaaaaatagacattttaactgaactgcgggataaagtgaaatctttccgtgcagctctacaagaggaggaacaagccagcaagcaaatcaacccgaagagaccccgtgccctttaaaccggcatttgctgctaaaggatacccagaaccctcactactgtaacatacaacggttcagctgtaagggccatttgaaagtttggaattttaagtgtctgtggaaaatgttttgtccttcacctgaattacatttcaattttgtgaaacactcttttgtctacaaaatgcttctagtccaggaggcacaaccaagaactgggattaatgaagcattttgtttcatttacacaaatagtgatttacttttggagatccttgtcagttttattttctatttgatgaagtaagactgtggactcaatccagagccagatagtagggggaagccacagcatttccttttaactcagttcaatttttgtagtgagactgagcagttttaaatcctttgcgtgcatgcatacctcatcagtgattgtacataccttgcccactcctagagacagctgtgctcaccttttcctgctttgtgccttgattaaggctactgaccctaaatttctgaagcacagccaagaaaaattacattccttgtcattgtaaattacctttgtgtgtacatttttactgtatttgagacattttttgtgtgtgactagttaattttgcaggatgtgccatatcattgaacggaactaaagtctgtgacagtggatatagctgctggaccattccatcttatatgtaaagaaatctggaattattattttaaaaccatataacatgtgattataatttttcttagcattttctttgtaaagaactacaatataaactagttggtgtataataaaaagtaatgaaattctga

SEQ ID NO: 2131 - DNA, 2505 bp, Homo sapiens
ctcgccgagatgacctgggcacctctgcgttgaatcggcaaatactgatcaagccgcatttattctgctctcaggaactctaagtctagcagagaagatgaggcggtagaagttcatcaatggcttggctggaggacaagcaaattgaggacattggcaacggagtgatcaaaatgatagatcatgaggcctaaaatgaataaggaaagaagagaagtggcagaggctgagaacagaaagagagggtggaggggctgtaaatcttgaagattagggtataatatgagtatatgggtaagaattggaagaattgtgtaggaggcagtagtcaaaaagtagaagcagtttggaagagtagttacaaatatcaagagccaggtggctaaaaggtggagctataggtcattgaagctcaagaaactgagtctctagggcattggttaagtcatctgtctagacttcaaagttgtctaggatgataattcagaagactgatctgtgccaaagtcacaggtttttcacgactgaaaacaacatagcaaaataagccaagatgtctgtggatccaatgacctacgaggcccagttctttggcttcacgccacaaacgtgcatgcttcggatctacattgcatttcaagactacctatttgaagtgatgcaggccgttgaacaggttattctgaagaagctggatggcatcccagactgtgacattagcccagtgcagattcgcaaatgcacagagaagtttctttgcttcatgaaaggacattttgataacctttttagcaaaatggagcaactgtttttgcagctgattttacgtattccctcaaacatcttgcttcctgaagataaatgtaaggagacaccttatagtgaggaagattttcagcatctccagaaagaaattgaacagttacaggagaagtacaagactgaattatgtactaagcaggcccttcttgcagaattagaagagcaaaaaattgttcaggccaaactcaaacagacgttgactttctttgatgagcttcataatgttggcagagatcatgggactagtgattttagggagagtttagtatccctggttcagaactccagaaaactacagaacattagagacaatgtggaaaaggaatcgaaacgactgaaaatatcttaattgctcagtagtcaaaaggaggagcctgtcaaaaagtagaatcataaggactgttcaaaccataaggactgttcaaatcataccagtgactgttcaaaccaaccatactttttattagatttgctttgtcaactctttcttgtattctgtgttttcctcttttttggtccactttgctgaggtatgaagtgtactactttgaactaggctgaagcatctgagtcttctaataagtgggaagggatccaacaaagaagccatgaccagttaaagatatttgcagagttacaccttggtcataagtcctttgtgaccttgattattttggcttactctttggatgagaccagacaagaaaaggattaaacgggtggctcctttaatattattattattgtttttgagacaaggtccctttctgtcacccaggttagagtagatttcagtggcacaatcttggctcactgcaacctctgtgtcctgggctcaagtgatcctcctgcctcagcctcccaagtagctaggaccacaggtgcgtgtcaccatgcttggctaatttttttgcagaaacgaggcctcactatattgtccaggctgagtggctcttttattaaccagtcattacactgcggaacagccaacatagagtacttgctctcgtcctgtgaattttctttcatgagggagtcaatatgtagtggaaagaagcatgtagcaaaaaagacaaccttgatctttaataaaaaagaagttggtttatttccaaaataaatcccctgacaaaaaacctggtgatgttaagcaattgactgtcttagagtccagcagaagaccttagacaaaaaaagcagaacccactggagtagaaaaggaagcatgtagcatatactcagtagtgaaatttaattttactgactgttaggtatctatgccaatttgttttcatacttcagttggttttggaatctgccttatacctaatatttatttattcacactcataagcatcaaatatttaatgccctcagtgggaaatttgtgtttaaactcaatggaatctaatatttctttatgtcgttagtccctgtaaaatgttaggtcacccaaggaaaggggagaaatagcaatggttgttcctaaggtattgcttgccctccatgtcttcctaaagagcagaacttggagtttctcctttatgtagagaagaagtaacttagggtgtatttgcaatgaaatattcatagatattgaaagcttgtgtttacatgaaatatgtttattatcaagaagtcctttttccaattctgtacattaaatatatgtgttttaaaggg

SEQ ID NO: 2132 - DNA, 2027 bp, Homo sapiens
aagtgcggacgcccggctcccggcgtggacgccatggtgctgtgcccggtgattgggaagctgctgcacaagcgcgtggtgctggccagcgcctccccacgccgtcaggagatcctcagcaacgcgggtctcaggtttgaggtggtcccctccaagtttaaagagaagctggacaaagcctccttcgctactccgtatgggtacgccatggagaccgccaagcagaaggccctggaggtggccaaccggctgtaccagaaagacctgcgggcccccgacgtggtcattggagcggacacgatcgtgacagtcggggggctgattctggagaagccggtggacaagcaggacgcctacaggatgctgtcccggttgagtgggagagaacacagcgtgttcacaggtgtcgcgatcgtccactgctccagcaaagaccatcagctggacaccagggtctcggaattctacgaggaaacgaaggtgaagttctcggagctgtccgaggagctgctctgggaatacgtccacagcggggagcccatggacaaagctggcggctacgggatccaggccctgggcggcatgctggtggagtccgtacacggggactttctgaacgtggtgggattcccgctgaaccacttctgcaagcagctggtgaagctctactacccgccccgtccggaggacctgcggcggagtgtcaagcacgactccatcccggccgcggacaccttcgaagacctcagtgacgtggaggggggcggctcggagcccactcagagggacgcgggcagccgcgatgagaaggccgaggcgggagaggcgggacaggccacggcagaggctgagtgtcacaggactcgggagaccctgcctccgttcccgacacgcctcctggagctgattgagggctttatgctatccaagggcctgctcaccgcttgcaaactgaaggtgttcgatttgttaaaagatgaagcaccccagaaggctgcggatattgccagcaaagtggacgcctctgcgtgtggaatggagaggcttctggacatctgtgctgccatggggctcctggagaagacagagcaaggttacagtaacacagagacagcgaacgtctacctggcatcggatggcgaatactctctgcacggcttcatcatgcacaataatgacctcacatggaacctctttacatacctggagtttgccatccgagagggaacaaaccagcaccacagggcgttggggaagaaggcggaagatctgttccaggatgcgtactaccagagcccggagacgcggctgaggttcatgcgggccatgcacggcatgacgaagctgactgcgtgccaggtggccacggccttcaatctgtcccgcttctcctccgcctgcgacgtgggaggctgcacgggtgcactggcccgagagctggcccgtgagtaccctcgtatgcaggtgactgtgtttgacctcccagacattatcgagctggccgcccacttccaaccccccggaccgcaggcagtgcagatccacttcgcagcaggtgactttttcagggaccccctccccagcgctgagctgtacgtcctgtgccggatcctgcatgactggccagacgacaaagtccacaagttactcagcagggtcgccgagagctgcaagccaggggccggcctgctgctggtggagacgctcctggatgaggagaagagggtggcgcagcgcgccctgatgcagtcactgaacatgctggtgcagactgaaggcaaggagcggagcctgggcgagtatcagtgcttgctggagctgcacggcttccaccaggtgcaggtggtgcacttggggggtgtcctggatgccatcttggccaccaaagtggccccctgaagcccaggcagcatgttcattatagggatgtcctcccccaggctgcaggtggaccgcccggtccccaagtaccataggacagtcacataggagcgtgtagtcgtgactgaataaagaaagcaaaagcc

SEQ ID NO: 2133 - DNA, 4059 bp, Homo sapiens
gtctgactccagcgaccgcgcgcgggttcgagggttggcggcgaggcgctcggtttctcttcttccgtccacccgcgcttcccgttccccgtcaccgccgctggcgtttgtagatttctttccgccagtgaagctgggttttctggagttggctctggcgctctggcccctggagtgtaatttcctacacgcagcgccgcagagtttatattctttgaaagtgtttgtagctttgtagaggtcctcttgttgatggtaggtgagcctaattctgcaagataaaagcctagtctctgacctggcagatgaaagatcaaatcagattgtggtttcctgctattagaatgccgtgctattagactttaaggctttttagccttctttaaaaaataaaaaaatttttacagtggaagaaaagcacaagaagtaaacttttacagtcgttgatttgactataacgctgatccccccaaatcaaagaatttttacttgttcctgcaaagctgctggagctcagaagctgattctatcacattgtaagatgcctttggataattctacagtcctcttaaatgaatctttagaacttggcaagtctcactagataccttcaatcatcattttgagctcaaagaattctgagacttatggttggtcatatagaagagtaccttgaacctatagtttcctgaagaatcagtttaaaagatccaaggagtacaaaaggcagttattggaggaattactcaacaaaaataaagaagtaaactaaaaaagatgaaggcataggatacaagtaacagggaatatgacctaactagagacccagggaatcaccaggatgatgatgaataatgatcacaagaagacagcttgtcctcaggagaagtacaaatgtctactacaagacgaaaacgtagtatgttatgttgtttaccgtaagctgtagtaaaatgagctcgattgttgacagagatgacagtagtatttttgatgggttggtggaagaagatgacaaggacaaagcgaaaagagtatctagaaacaaatctgaaaagaaacgtagagatcaatttaatgttctcattaaagaactgggatccatgcttcctggtaatgctagaaagatggacaaatctactgttctgcagaaaagcattgattttttacgaaaacataaagaaatcactgcacagtcagatgctagtgaaattcgacaggactggaaacctacattccttagtaatgaagagtttacacaattaatgttagaggctcttgatggtttttttttagcaatcatgacagatggaagcataatatatgtgtctgagagtgtaacttcattacttgaacatttaccatctgatcttgtggatcaaagtatatttaattttatcccagaaggggaacattcagaggtttataaaatactctctactcatctgctggaaagtgattcattaaccccagaatatttaaaatcaaaaaatcagttagaattctgttgtcacatgctgcgaggaacaatagacccaaaggagccatctacctatgaatatgtaaaatttataggaaatttcaaatctttaaacagtgtatcctcttcagcacacaatggttttgaaggaactatacaacgcacacataggccatcttatgaagatagagtttgttttgtagctactgtcaggttagctacacctcagttcatcaaggaaatgtgcactgttgaagaacccaatgaagagtttacatctagacatagtttagaatggaagtttctgtttctagatcacagggcaccacccataatagggtatttgccatttgaagttctgggaacatcaggctatgattactatcatgtggatgacctagaaaatttggcaaaatgtcatgagcacttaatgcaatatgggaaaggcaaatcatgttattataggttcctgactaaggggcaacagtggatttggcttcagactcattattatatcacttaccatcagtggaattcaaggccagagtttattgtttgtactcacactgtagtaagttatgcagaagttagggctgaaagacgacgagaacttggcattgaagagtctcttcctgagacagctgctgacaaaagccaagattctgggtcagataatcgtataaacacagtcagtctcaaggaagcattggaaaggtttgatcacagcccaaccccttctgcctcttctcggagttcaagaaaatcatctcacacggccgtctcagacccttcctcaacaccaaccaagatcccgacggatacgagcactccacccaggcagcatttaccagctcatgagaagatggtgcaaagaaggtcatcatttagtagtcagtccataaattcccagtctgttggttcatcattaacacagccagtgatgtctcaagctacaaatttaccaattccacaaggcatgtcccagtttcagttttcagctcaattaggagccatgcaacatctgaaagaccaattggaacaacggacacgcatgatagaagcaaatattcatcggcaacaagaagaactaagaaaaattcaagaacaacttcagatggtccatggtcaggggctgcagatgtttttgcaacaatcaaatcctgggttgaattttggttccgttcaactttcttctggaaattcatctaatatccagcaacttgcacctataaatatgcaaggccaagttgttcctactaaccagattcaaagtggaatgaatactggacacattggcacaactcagcacatgatacaacaacagactttacagagtacatcaactcagagtcaacaaaatgtactgagtgggcacagtcagcaaacatctctacccagtcagacacagagcactcttacagccccactgtataacactatggtgatttctcagcctgcagccggaagcatggtccagattccatctagtatgccacaaaacagcacccagagtgctgcagtaactacattcactcaggacaggcagataagattttctcaaggtcaacaacttgtgaccaaattagtgactgctcctgtagcttgtggggcagtcatggtacctagtactatgcttatgggccaggtggtgactgcatatcctacttttgctacacaacagcaacagtcacagacattgtcagtaacgcagcagcagcagcagcagagctcccaggagcagcagctcacttcagttcagcaaccatctcaggctcagctgacccagccaccgcaacaatttttacagacttctaggttgctccatgggaatccctcaactcaactcattctctctgctgcatttcctctacaacagagcaccttccctcagtcacatcaccagcaacatcagtctcagcaacagcagcaactcagccggcacaggactgacagcttgcccgacccttccaaggttcaaccacagtagcacacgtgcttcctctcttgacatcaagggaggaaggggatggcccattaagagttactcagatgacctgaggaaaggagggaaagttccagcagtttcatgagatgcagtattgagtgttctagttcctggaattagttggcagagaaaatgctgcctagtgctacagatgtacattaaataccagccagcaggaggtgatcataggggcatagccagttctgacagtgttttaggtgcctggatattttttgatggaaaaagaatatattgccaaatattaagaagctcagctatgaaatgacctccagggaatcagaaaggcactaatgatgttagtaacttttagtggttctgtgcctcttatcaagtgttacagaggacataccactgccatgtcaggggtttgcttacagtgatgccatgaagacagtccagtagacttggtagcgaccccctcccccaacccctctcccttttcagataatgatggaacagtaattactttcagaatgttgtgtgggttcaaattctctatgtacagatgatgtaaaaatatgtatatgtctagataaaaggagagaaagcaaaa

SEQ ID NO: 2134 - DNA, 2035 bp, Homo sapiens
ctggccgcctgttttttttgcagccgcgctgcgcgcaccgcgggctccgggctcagaagtgcggacgcccggctcccggcgtggacgccatggtgctgtgcccggtgattgggaagctgctgcacaagcgcgtggtgctggccagcgcctccccacgccgtcaggagatcctcagcaacgcgggtctcaggtttgaggtggtcccctccaagtttaaagagaagctggacaaagcctccttcgctactccgtatgggtacgccatggagaccgccaagcagaaggccctggaggtggccaaccggctgtaccagacagtcggggggctgattctggagaagccggtggacaagcaggacgcctacaggatgctgtcccggttgagtgggagagaacacagcgtgttcacaggtgtcgcgatcgtccactgctccagcaaagaccatcagctggacaccagggtctcggaattctacgaggaaacgaaggtgaagttctcggagctgtccgaggagctgctctgggaatacgtccacagcggggagcccatggacaaagctggcggctacgggatccaggccctgggcggcatgctggtggagtccgtacacggggactttctgaacgtggtgggattcccgctgaaccacttctgcaagcagctggtgaagctctactacccgccccgtccggaggacctgcggcggagtgtcaagcacgactccatcccggccgcggacaccttcgaagacctcagtgacgtggaggggggcggctcggagcccactcagagggacgcgggcagccgcgatgagaaggccgaggcgggagaggcgggacaggccacggcagaggctgagtgtcacaggactcgggagaccctgcctccgttcccgacacgcctcctggagctgattgagggctttatgctatccaagggcctgctcaccgcttgcaaactgaaggtgttcgatttgttaaaagatgaagcaccccagaaggctgcggatattgccagcaaagtggacgcctctgcgtgtggaatggagaggcttctggacatctgtgctgccatggggctcctggagaagacagagcaaggttacagtaacacagagacagcgaacgtctacctggcatcggatggcgaatactctctgcacggcttcatcatgcacaataatgacctcacatggaacctctttacatacctggagtttgccatccgagagggaacaaaccagcaccacagggcgttggggaagaaggcggaagatctgttccaggatgcgtactaccagagcccggagacgcggctgaggttcatgcgggccatgcacggcatgacgaagctgactgcgtgccaggtggccacggccttcaatctgtcccgcttctcctccgcctgcgacgtgggaggctgcacgggtgcactggcccgagagctggcccgtgagtaccctcgtatgcaggtgactgtgtttgacctcccagacattatcgagctggccgcccacttccaaccccccggaccgcaggcagtgcagatccacttcgcagcaggtgactttttcagggaccccctccccagcgctgagctgtacgtcctgtgccggatcctgcatgactggccagacgacaaagtccacaagttactcagcagggtcgccgagagctgcaagccaggggccggcctgctgctggtggagacgctcctggatgaggagaagagggtggcgcagcgcgccctgatgcagtcactgaacatgctggtgcagactgaaggcaaggagcggagcctgggcgagtatcagtgcttgctggagctgcacggcttccaccaggtgcaggtggtgcacttggggggtgtcctggatgccatcttggccaccaaagtggccccctgaagcccaggcagcatgttcattatagggatgtcctcccccaggctgcaggtggaccgcccggtccccaagtaccataggacagtcacataggagcgtgtagtcgtgactgaataaagaaagcaaaagcc

SEQ ID NO: 2135 - DNA, 1154 bp, Homo sapiens
aactccagggctagtgagctggaccggaagtaggtttctacccgaccgcattttacgtggtgctgcatttccggtagcggcggcgggaaatcggctgtgggagagaggctaggcctctgaggaggcgaatccggcgggtatcagagccatcagaaccgccaccatgacggtgggcaagagcagcaagatgctgcagcatattgattacaggatgaggtgcatcctgcaggacggccggatcttcattggcaccttcaaggcttttgacaagcacatgaatttgatcctctgtgactgtgatgagttcagaaagatcaagccaaagaactccaaacaagcagaaagggaagagaagcgagtcctcggtctggtgctgctgcgaggggagaatctggtctcaatgacagtagagggacctcctcccaaagatactggtattgctcgagttccacttgctggagctgccgggggcccagggatcggcagggctgctggcagaggaatcccagctggggttcccatgccccaggctcctgcaggacttgctgggccagtccgtggggttggcgggccatcccaacaggtgatgaccccacaaggaagaggtactgttgcagccgctgcagctgctgccacagccagtattgccggggctccaacccagtacccacctggccgtgggggtcctcccccacctatgggccgaggagcaccccctccaggcatgatgggcccacctcctggtatgagacctcctatgggtcccccaatggggatcccccctggaagagggactccaatgggcatgccccctccgggaatgcggcctcctccccctgggatgcgaggccttctttgacccttggccacagagtatggaagtagctccgcagaggcgtgggctcgattcctcagggccacgttaccacagacctgtttgtttcttatgctgttgttcgtggagtctcatgggattgtctggtttcccttacagggccccctcccccgggaatgcgcccaccaaggccctagactcatcttggccctcctcagctccctgcctgtttcccgtaaggctgtacatagtccttttatctccttgtggcctatgaaactggtttataataaactcttaagagaacattataattgca

SEQ ID NO: 2136 - DNA, 2301 bp, Homo sapiens
gggtggggcgtgttgacccccttaaaggcgccagagcccgcggtcacggctcaggttcccggtgcttcgcgcgtctgccgttgtcacaggccagggaggtggcaccaccaggcgaagcttggcgagattgtgtcgtcaagcgcgtacgggcgccaattggccgggcgatgtggcgtggactggcgctggcgcgagcgattggctgcgcggcccgggggcggggccagtgggcggtgcgcgccgcagactgtgctcaaagcgggcgccatccgggaccggcggttgtctgtggccggaggctgatcagtgttctagaacagatcagacattttgtaatgatgcctgaaataaacactaaccacctcgacaagcaacaggttcaactcctggcagagatgtgtatccttattgatgaaaatgacaataaaattggagctgagaccaagaagaattgtcacctgaacgagaacattgagaaaggattattgcatcgagcttttagtgtcttcttattcaacaccgaaaataagcttctgctacagcaaagatcagatgctaagattacctttccaggttgttttacgaatacgtgttgtagtcatccattaagcaatccagccgagcttgaggaaagtgacgcccttggagtgaggcgagcagcacagagacggctgaaagctgagctaggaattcccttggaagaggttcctccagaagaaattaattatttaacacgaattcactacaaagctcagtctgatggtatctggggtgaacatgaaattgattacattttgttggtgaggaagaatgtaactttgaatccagatcccaatgagattaaaagctattgttatgtgtcaaaggaagaactaaaagaacttctgaaaaaagcagccagtggtgaaattaagataacgccatggtttaaaattattgcagcgacttttctctttaaatggtgggataacttaaatcatttgaatcagtttgttgaccatgagaaaatatacagaatgtgaatatgtaggtaaatgattacagaaaaatttatctgcttaacaaacttagaatgactttttccttttaaatttagttctatcattaatttatcattaaatttagttctatcatttggtactatcattaatgtattatatacactgatactttaaaacttgtgtggaaaaaactaacttataattttgtatcacacaccctggatatgtgttctgtttctaagcgacatttgtgagagattattgtaaaatgagagcgagcaaataaaacttaatttaatctttgcagatacatacttatgggaaatttgaacaaatgagtgaaactctgtttttagtaggctgtgataaacatttccggagcacttgcagaggacttgctatttgccaggtgctttatgtatcattaaatttttctcatagttcagaaaaatgtgcaaaggaaactattgtctcgctccttcaaaacagtcttaattaactttcatattagcagattaaactagcagagcaggttcaagggaaattaaatgatatggaccctaatttgtatcattctgagttgattgtgtggtttattcattctggaaacatgttgatacttacagtcagccactgcttttgataagtgatattgattaggttgaatcttcttgtaaatagtatttaccagttagcaaagtctgtgttttcagaattacagtgagcacagaggtgttcataaaatgggaattgagtcccactcggtaagagttgcttaaacttgacactgttgacatttgggctggataaaacccctgtggtggggtctgtgctgtgcattgcaggatggtgagcagcgtccctctcatgtgacacccacagttatgccggatgttgccagatgcccctaggggacagagtcaacccccaactgaggaccactgtcctacagagtcaggaaatattgtagggagaaaaaaataacaacaacaaaggcctgtgttaatgttaaatagatgagattatggaatgtgtatattaatgttaaaaattgtaccttgatcaatgtactttttataaacttgccatagatatctcagatttgaaacctcaagacagatttattattcttaaatgctgtatgataatgaagaaaaataaaaatttatttcttgcaaagttaaatgtttgttaaattcaatagaatgactcatttatggttaactttgggcaatttataatttcagacaagactgtttagcaagtattttattgaaaagtaaaaaaaattgcaatttaa

SEQ ID NO: 2137 - DNA, 1931 bp, Homo sapiens
ggccaaccgcccggacctcggcgctttcttctaggatccgcatgaatcgctttgggctatcggaagagctatccccagttctcgggagaaagagtccgcgaccagcgtctgacctctcactcagagtccccagtcctgccttagtttccccagcgaccctgaatttggagttgctgtctctaagtgaaagctgaacctgcaaccccttgagggtttcagccgcagaggggcgggagaaagggcctggttggtaggcgggctcagcggttcgcgcccagttagccccgagcttcggagacccgagagaccagaggatggctgacacgaaggggcacccgagacagcgcctgggctttttcccgcccgcggttccaccgctctgaaaccgatttctaacagagagagacatagtcttgctctgttacccatgctggagtacggtggcgagatcacgactcactacaactttgaattcctggattcaagcaatcctcccatctcagcctcctgagtagctaaggactacagggcgactttgtcagtaccccaaactgtccccgcatgaggtcactctgcacggtcacgtgctcgagcccgcgggagcgccacatcgccagccgcacccctccacccccaacctgcccacgtgacccggcctagtttctccaggcccgtccctacgtctcactcgggaagccccgccccacgctgagcgctccgcctgcgaccctccgccacttacccaccccggctcaagcacgacccgtggatccacgtgctttttcttgtccaatgggagccggctcccgggcgcgaaggggcggggaggaaaggaacgactgtgctacgttgccagaaggggcgggacctgcaacgtccgacagaacgaggggacgtaacggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctctccccctgggccactcccgggggtgagggggttaccccttcccagtgttttttattcctgtggggctcaccccaaagtattaaaagtagctttgtaattccttgagcgcctggtttgactggggacttggggggatggggttggaagaatgactgccctttcccaccaaaaaagggagaactctttagattcagattgtgggtatgtagacttaataagtgaaacatcacagaagaagcctttattatacaatgacaaccaaacaagtactccggatatgcagtagaggaatcctctaagaaccatagagacttcttttctgtgatttttgttccccacccttgaacaccatctctaggatggagttggcctaagagtgaatgctgcaagatctgtgtttatgcctcttttcctcattcttcctcagtttgttcgtctgcttgaaagttggccaaaaaatcctgctgctcaccgacttcccgtggtcagctgctgtcaagcgttcactttctcttctgtcattcctcatggaatgagggtggttttgtcttcccgcttcccttgacctcaaaatcaggattaaaacctggggtagcctctgtgctcctttcttctatgccctggtttgttctgtggttctgggcttctt

SEQ ID NO: 2138 - DNA, 5404 bp, Homo sapiens
ggagtcggggtggcagcggcggcggttgccaggagcccgcgttgcagcctgagatccgtaatatggcggggaggaggaggagaaggcggcggcggaccgagctgcgctctgtcagtaccatttgagccattcgcttcctgacaaggcccgtggcgaggggagaggagctgaaggggccgtgggggatcagtgtgactgtgggaagatggaggagtatgagaagttctgtgaaaaaagtcttgccagaatacaagaagcatcactatccacagagagctttctccctgctcagtctgaaagtatctcacttattcgctttcatggagtggctatcctttctccactgcttaacattgagaaaagaaaggaaatgcaacaagaaaagcagaaagcacttgatgtagaagcaagaaagcaggttaacaggaagaaagctttactgactcgtgtccaggagattcttgacaatgttcaggttagaaaagcacctaatgccagtgattttgatcagtgggagatggaaacagtttactctaattcagaagtcagaaacttgaatgttcctgctacatttccaaatagctttccaagccatacggaacactctactgcagcaaagcttgataagatagctgggattttgccattggataatgaggaccaatgtaaaactgatggaatagacttagctagagattcagaaggatttaattctccgaagcaatgtgatagttccaatattagtcatgtagaaaatgaagcttttccaaagacctcttcagcaaccccacaagaaactcttatttctgatggtcccttctcagtaaatgaacaacaggatctaccacttttggcagaagtcatcccagatccctatgtaatgagtcttcagaatctgatgaaaaagtcaaaggaatatatagaaagagaacaatctagacgcagtctgagaggtagtatcaacagaattgttaatgagagtcatttagacaaagaacatgatgctgttgaagtggctgactgtgtaaaagagaaaggccagttgacaggcaaacactgtgtctcagttattcctgacaaaccaagccttaataaatcaaatgttcttctccaaggtgcttccactcaagcaagcagcatgagtatgccagttttagctagcttttcgaaagtggacatacctatacgaactggccatcccactgttctagagtctaattctgattttaaagttattcccacttttgttaccgaaaataatgttatcaaaagtcttacaggttcatatgccaaattacctagtccagagccaagtatgagtcctaaaatgcaccgaagacgttccaggacatcatcagcgtgtcatatacttataaataacccaataaatgcctgtgaattaagccctaaaggaaaagaacaggcaatggacttaattattcaagatactgatgaaaacacaaatgtgcccgaaattatgccaaagttaccaactgatttagcgggagtttgttcaagcaaggtttatgtgggcaaaaatacatctgaagtcaaagaagatgtggttttaggtaaatcaaatcaggtatgtcaatcttcaggaaatcatttagaaaataaagttactcatggacttgttactgtggaaggtcagttaacatccgatgagagaggcgcacacataatgaacagtacctgtgctgcgatgccaaagctgcatgaaccatatgccagcagtcagtgtatagcaagtccaaactttggaactgtgagtggactcaagccagccagtatgttagagaaaaactgcagtttgcaaacagaactgaataagtcttatgatgtaaaaaacccttctcctttattgatgcaaaaccagaatacgagacagcagatggacacacctatggtgtcctgtggaaatgaacaatttttggataacagttttgagaaagttaaacggagacttgatttagatattgatggtttgcaaaaagaaaactgcccttatgtcataacaagtggaataactgaacaagaaaggcaacatttgccagaaaaaagataccctaagggatctggcttcgttaacaagaataaaatgttaggaactagttccaaagaaagcgaggagttactaaaaagcaagatgttagcttttgaagaaatgcggaagagactagaagaacagcacgcccagcaattatcactactcatagctgagcaggaaagggaacaagaaagactgcaaaaggaaatagaagagcaggagaaaatgttaaaagagaagaaggcaatgacagcggaagcctctgagttggacattaacaatgcagtggaattagaatggagaaaaataagtgactctagtttgctggaaacaatgctgtctcaagcggactcactccatacttcaaattcaaatagttctggtttcacaaattctgccatgcaatatagctttgtttctgcaaacgaagcaccattctacctctggggatcatcaactagtggcttgaccaaactctcagtaacaaggccttttggaagagccaaaactagatggtctcaagtttttagtctggaaatacaagcaaaatttaacaaaataactgcagtggcaaaaggatttcttactcgtagacttatgcagacagataagctgaagcaacttcgacaaactgtaaaagatactatggaattcataagaagttttcagtcagaagcaccattaaagagaggcattgtttcagctcaagatgcttcacttcaggaaagagtgttagctcagttgcgagctgccttgtacggtattcatgacatattctttgtaatggatgcagctgaaagaatgtctattctacatcatgatcgagaagttcgcaaagagaaaatgctcaggcaaatggataaaatgaaaagtccacgagtggctctttcagctgcaacacagaagtctcttgataggaagaaatacatgaaagctgctgaaatgggaatgccaaataagaaatttctggttaaacaaaatccttctgaaacaagagtccttcagccaaaccaaggacagaatgcacctgttcataggctacttagtagacaaggaacccctaagacatcagtgaagggggttgtgcaaaatagacagaagccttcacagagcagagtgcctaacagagtgcctgtttcaggagtatatgcaggaaaaatccaaagaaagcggccaaatgttgcgacaatttaagaagacaacattcattaggataaaatggggggaaggattattattcatgttattttccctgcccaagactttatttaaccctggactccgtttacacagacaaagtgacatcagaaggctgagcacttatctggatcatttggtcagtttggtaattcctgctccacacccctattttcctcttaataatacgtttgggtgaagacaaattagtgtttagtaattgcatcatctctgtgcttacctatacaaacataagtttattttatatgcccagatgtctacagagaccctttttgtaaatgtcaaggacatttggatttacttttacagaatattgaaaagataagacaaattataaataagttctaaaacataaatttaattcatctctgcatagtgatttttgaatttgattcaaagggaaattattgcagaagaatgcctttccctcattttataactttaaaaacttggattaaccactcaatgtccactttctttgacttacagtataaccatgtagccaattgtggcccactaaaatctacagaagttaatgtgggtcaccattttggtcagaagcatacattcctgtcagacaactagttgtctgacagaaatgttaggcttcatgtatgttaccccagtactgttagaaacatttgtactaggttataagatctttctgtgacaggtaacaaatttggggaagacagcacaatcttcttgaatgtagctcttgggaatgcattattacatccatttctgtaacataataatatgttgcatgcagttatattttctatttagtctgtatattttgttcttcatagtctgttttttctagcatgcttgatttaggagagaataaagggctatataataataaatccagatttccggataagaatattgcctggttaaaattctgcattgcttaaagacacccatgtttaagatttttcatcactaacatatccattaaaagtatcaactggccaggcagggtggctcacgcctgtactcccagcattttgtgaggccaaggtgggtggatcacctgaggtcaggagtttgagaccagcctgaccaaacatggcgaaaccccatctgtactgaaaatacaaaaattaggcatggtggtgcatgcctgtagttccagctacttgggaggctgagacaggcgaattgcttgaacctgggaggcagaggttgcagtgagctgagactgtgccattgcactccagtcgggttaacagagcaagacactgtctcaaaaaaaaaaaaaaaaaaaagtatcaaccaacaaatgttaccaagataacgtgacttcatgagggagaatgtcactattaatttatcataccatttccaaaaagggctttgtgcttttcacataaaattgagacagtgtatatttaatctaatttaaattttaaagagatactggtattttgaaaatgcaacctatatatattcttaatatccttttaagaatatggagatgaagattgttttctccaattttctgtgccattttaaatttaactttgacatccagctatagacagaaataataagccaccctgggtgtaaacttgattttctttattgagatgtatcatgtattgaatgagtgaaccagaaaattagaagatggtcaaaaaaagtccaagttaccaattttttaaaatttataggcaaagtatcaaattgtcttcttaatatgataaactgtgctttatcattctgaaaactcaggatacagcttattcatagcattgtgggtctctccagtaagaaagatgctaaaagttttgtgcactttttgtgtgtgtaatgcaaattagttaaaacaaatagttttggagaaagttaaaactagctttagagtaaggatgagaaacttgagtgtttttaatttaaagataaaagcctgtgttttacacattcttttttggtgttcatagcttcttctcatacaggtgccagacactgtttgtgcttttgatggatttttatttatatactttttttgcttatttttactttgagtggaatgttcattaatgtaaattgtatttatttttatacttttattttcactagttttgcttctaggcaaaaagcaaaataaacttttcatcttaaagaaaa

SEQ ID NO: 2139 - DNA, 611 bp, Homo sapiens
cgggaagctggagcgggccggcggtgcagtcacgggggagcgaggcctgctgggcttggcaacgagggactcggcctcggaggcgacccagaccacacagtgattctcttctaccttccttagacactgggtcaaggagtaagcagaggataaacaactggaaggagagcaagcacaaagtcatcatggcttcagcgtctgctcgtggaaaccaagataaagatgcccattttccaccaccaagcaagcagagcctgttgttttgtccaaaatcaaaactgcacatccacagagcagagatctcaaagattatgcgagaatgtcaggaagaaagtttctggaagagagctctgcctttttctcttgtaagcatgcttgtcacccagggactagtctaccaaggttatttggcagctaattctagatttggatcattgcccaaagttgcacgcactgcctccttacctgtgaggaatgcaaaataaagcatggattaagtgagaagggagactctcagccttcagcttcctaaattctgtgtctgtgactttcgaagttttttaaacctctgaatttgtacacatttaaaatttcaagtgtactttaaaata

SEQ ID NO: 2140 - DNA, 1594 bp, Homo sapiens
ttttgagcccctgtctggatgacttcttgcggctgttctacccctccccctccccgcggtaccttgcacttttctccctccctgccccctctcgagtccaccctccgggccttctgcccctgatcgcttggttttccttgcagtcgcctgctgctgtcgtcgggaggtgggtgaggtgacgcaaacagccccgttgttgccctccgcgtatcccctcaccacctttgcggccatccacgactttcgcaccttccgccattttcctgcctgtgagggtggacagatcgcgctcgggtctcggcctcctgagtgccggtgactgcgggaggcgacggagtgcttctgggggtgtgagctggggaagttcgtggtcacggatgcgtgtggggttgctgctcagtctgtaacggcaggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctgggcactattatcaaaagtcaaaatatgactcaagtgtgagtggtcaatcatcttttgtgacatccccagcagcagacaacatagaaatgcttcctcattatgagccaattccattcagttcttctatgaatgaatctgctcccactggtattactgatcatattgtccaaggacctgatcccaaccttgaagaaagtcctaaaagaaaaaatattacatatgaggaattaaggaataagaacagagagtcatatgaagtatctttaacacaaaagactgacccctcagtcaggcctatgcatgaaagagtgccaaaaaaagaagtcaaagtaaacaagtatggagatacttgggatgagtgaaaaattacatcattggacatgaaggagtttcaacatccagcttcatctaggtggtcatgattacctgcatgctttgagctcagcagcagtcttcataaacacatttaaaacaagatcctgggtttttgtggtttgacttctatggtgttttaaaaaaacacagatttttagtgttaatattgtgtaaatgtactcaccttagggattcatttgaatgatggtattataccatgattgtatacagtttgtgaaattgttgcaagggcaaagataactcttaaaaaaccgtcgagattacaatgctctagaatcagcatataagaaaataaatgatatctgcatgttgaattggggtggatggggggagcaagcataatttttaagtgtgaagctttgcatcaagaaattattaaaaagctttttttctccagtattttc

SEQ ID NO: 2141 - DNA, 1593 bp, Homo sapiens
ccggcggtgctcgcaagcgaggcagccatgtcttatcccgctgatgattatgagtctgaggcggcttatgacccctacgcttatcccagcgactatgatatgcacacaggagatccaaagcaggaccttgcttatgaacgtcagtatgaacagcaaacctatcaggtgatccctgaggtgatcaaaaacttcatccagtatttccacaaaactgtctcagatttgattgaccagaaagtgtatgagctacaggccagtcgtgtctccagtgatgtcattgaccagaaggtgtatgagatccaggacatctatgagaacagctggaccaagctgactgaaagattcttcaagaatacaccttggcccgaggctgaagccattgctccacaggttggcaatgatgctgtcttcctgattttatacaaagaattatactacaggcacatatatgccaaagtcagttttcagtcattcagtcagtaccgctgtaagactgccaagaagtcagaggaggagattgactttcttcgttccaatcccaaaatctggaatgttcatagtgtcctcaatgtccttcattccctggtagacaaatccaacatcaaccgacagttggaggtatacacaagcggaggtgaccctgagagtgtggctggggagtatgggcggcactccctctacaaaatgcttggttacttcagcctggtcgggcttctccgcctgcactccctgttaggagattactaccaggccatcaaggtgctggagaacatcgaactgaacaagaagagtatgtattcccgtgtgccagagtgccaggtcaccacatactattatgttgggtttgcatatttgatgatgcgtcgttaccaggatgccatccgggtcttcgccaacatcctcctctacatccagaggaccaagagcatgttccagaggaccacgtacaagtatgagatgattaacaagcagaatgagcagatgcatgcgctgctggccattgccctcacgatgtaccccatgcgtattgatgagagcattcacctccagctgcgggagaaatatggggacaagatgttgcgcatgcagaaaggtgacccacaagtctatgaagaacttttcagttactcctgccccaagttcctgtcgcctgtagtgcccaactatgataatgtgcaccccaactaccacaaagagcccttcctgcagcagctgaaggtgttttctgatgaagtacagcagcaggcccagctttcaaccatccgcagcttcctgaagctctacaccaccatgcctgtggccaagctggctggcttcctggacctcacagagcaggagttccggatccagcttcttgtcttcaaacacaagatgaagaacctcgtgtggaccagcggtatctcagccctggatggtgaatttcagtcagcctcagaggttgacttctacattgataaggacatgatccacatcgcggacaccaaggtcgccaggcgttatggggatttcttcatccgtcagatccacaaatttgaggagcttaatcgaaccctgaagaagatgggacagagaccttgatgatattcacacaca

SEQ ID NO: 2142 - DNA, 3881 bp, Homo sapiens
aggccgccgcctgggtcgctcaacttccgggtcaaaggtgcctgagccggcgggtcccctgtgtccgccgcggctgtcgtcccccgctcccgccacttccggggtcgcagtcccgggcatggagccgcgaccgtgaggcgccgctggacccgggacgacctgcccagtccggccgccgccccacgtcccggtctgtgtcccacgcctgcagctggaatggaggctctctggaccctttagaaggcacccctgccctcctgaggtcagctgagcggttaatgcggaaggttaagaaactgcgcctggacaaggagaacaccggaagttggagaagcttctcgctgaattccgagggggctgagaggatcacctcctacgacttccacagcgagagtggcctcttcctcttccaggccagcaacagcctcttccactgccgcgacggcggcaagaacggcttcatggtgtcccctatgaaaccgctggaaatcaagacccagtgctcagggccccggatggaccccaaaatctgccctgccgaccctgccttcttctccttcatcaataacagcgacctgtgggtggccaacatcgagacaggcgaggagcggcggctgaccttctgccaccaaggtttatccaatgtcctggatgaccccaagtctgcgggtgtggccaccttcgtcatacaggaagagttcgaccgcttcactgggtactggtggtgccccacagcctcctgggaaggttcagagggcctcaagacgctgcgaatcctgtatgaggaagtcgatgagtccgaggtggaggtcattcacgtcccctctcctgcgctagaagaaaggaagacggactcgtatcggtaccccaggacaggcagcaagaatcccaagattgccttgaaactggctgagttccagactgacagccagggcaagatcgtctcgacccaggagaaggagctggtgcagcccttcagctcgctgttcccgaaggtggagtacatcgccagggccgggtggacccgggatggcaaatacgcctgggccatgttcctggaccggccccagcagtggctccagctcgtcctcctccccccggccctgttcatcccgagcacagagaatgaggagcagcggctagcctctgccagagctgtccccaggaatgtccagccgtatgtggtgtacgaggaggtcaccaacgtctggatcaatgttcatgacatcttctatcccttcccccaatcagagggagaggacgagctctgctttctccgcgccaatgaatgcaagaccggcttctgccatttgtacaaagtcaccgccgttttaaaatcccagggctacgattggagtgagcccttcagccccggggaagatgaatttaagtgccccattaaggaagagattgctctgaccagcggtgaatgggaggttttggcgaggcacggctccaagatctgggtcaatgaggagaccaagctggtgtacttccagggcaccaaggacacgccgctggagcaccacctctacgtggtcagctatgaggcggccggcgagatcgtacgcctcaccacgcccggcttctcccatagctgctccatgagccagaacttcgacatgttcgtcagccactacagcagcgtgagcacgccgccctgcgtgcacgtctacaagctgagcggccccgacgacgaccccctgcacaagcagccccgcttctgggctagcatgatggaggcagccagctgccccccggattatgttcctccagagatcttccatttccacacgcgctcggatgtgcggctctacggcatgatctacaagccccacgccttgcagccagggaagaagcaccccaccgtcctctttgtatatggaggcccccaggtgcagctggtgaataactccttcaaaggcatcaagtacttgcggctcaacacactggcctccctgggctacgccgtggttgtgattgacggcaggggctcctgtcagcgagggcttcggttcgaaggggccctgaaaaaccaaatgggccaggtggagatcgaggaccaggtggagggcctgcagttcgtggccgagaagtatggcttcatcgacctgagccgagttgccatccatggctggtcctacgggggcttcctctcgctcatggggctaatccacaagccccaggtgttcaaggtggccatcgcgggtgccccggtcaccgtctggatggcctacgacacagggtacactgagcgctacatggacgtccctgagaacaaccagcacggctatgaggcgggttccgtggccctgcacgtggagaagctgcccaatgagcccaaccgcttgcttatcctccacggcttcctggacgaaaacgtgcactttttccacacaaacttcctcgtctcccaactgatccgagcagggaaaccttaccagctccagatctaccccaacgagagacacagtattcgctgccccgagtcgggcgagcactatgaagtcacgttgctgcactttctacaggaatacctctgagcctgcccaccgggagccgccacatcacagcacaagtggctgcagcctccgcggggaaccaggcgggagggactgagtggcccgcgggccccagtgaggcactttgtcccgcccagcgctggccagccccgaggagccgctgccttcaccgccccgacgccttttatccttttttaaacgctcttgggttttatgtccgctgcttcttggttgccgagacagagagatggtggtctcgggccagcccctcctctccccgccttctgggaggaggaggtcacacgctgatgggcactggagaggccagaagagactcagaggagcgggctgccttccgcctggggctccctgtgacctctcagtcccctggcccggccagccaccgtccccagcacccaagcatgcaattgcctgtcccccccggccagcctccccaacttgatgtttgtgttttgtttggggggatatttttcataattatttaaaagacaggccgggcgcggtggctcacgtctgtaatcccagcactttgggaggctgaggcgggcggatcacctgaggttgggagttcaagaccagcctggccaacatggggaaaccccgtctctactaaaaatacaaaaaattagccgggtgtggtggcgcgtgcctataatcccagctactcgggaggctgaggcaggagaatcgcttgaacccgggaggtggaggttgcggtgagccaagatcgcaccattgcactccagcctgggcaacaagagcgaaactctgtctcaaaataaataaaaaataaaagacagaaagcaaggggtgcctaaatctagacttggggtccacaccgggcagcggggttgcaacccagcacctggtaggctccatttcttcccaagcccgagcagagggtcatgcgggccccacaggagaagcggccagggcccgcggggggcaccacctgtggacagccctcctgtccccaagctttcaggcaggcactgaaacgcaccgaacttccacgctctgctggtcagtggcggctgtcccctccccagcccagccgcccagccacatgtgtctgcctgacccgtacacaccaggggttccggggttgggagctgaaccatccccacctcagggttatatttccctctccccttccctccccgccaagagctctgccaggggcgggcaaaaaaaaaagtaaaaagaaaagaaaaaaaaaaaaaagaaacaaaccacctctacatattatggaaagaaaatatttttgtcgattcttattcttttataattatgcgtggaagaagtagacacattaaacgattccagttggaaacatgt

SEQ ID NO: 2143 - DNA, 9744 bp, Homo sapiens
gcgcggcgcgggagagcgcagtggcgccggcgggaaagggctgcggacctgcggcgccgcgttgtgcgttcgacgacgcggcaccggcttcgacgccctctgcccgctccagaagcagtaagaagacatgttggataacaagaagaggtgtagagtttgcatatatcaactgtggccttaatgagcatgttgacagcatcgatgctagacagacagtctttttactgctggattgtgcaagatatttaaccctattttgtttgaattatgacttaaatgtcaaacatcttaactaagaaaagggaaacattttagttttggaagtcagaatgccaaggagaaggaaaaatcttgggggaaatccttttcggaagactgcaaaccctaaggaagttgtcgtatccagtgttgctagtcgtgaggagccaaccactactctaccttccatgggtgagacaaaagttgatcaggaagaactcttcaccagtatctcagagatattttctgatctggatcctgatgtagtgtatttgatgctttctgaatgtgatttcaaaggtgagaaaaagtttagtttgaaccctgtccatcttataagaagactttgtgtactatgccatgattaatagtaatatagaaaaatgtcttgaaaatgctatggattgtctattagaattatctgccactgataccaagatagaagaatcatcttcacaaagtttcgttgcttctgagaaccaagtaggtgcagcagaaagtaaaataatggaaaaacgtcctgaagaagagagtgaagattcaaaaatggattcatttttggacatgcagctaactgaagacctggattccttaatacagaatgcttttgagaaattgaactcttctcctgatgaccaagtatactcatttttgccttcacaagatgttaatagttttaatgactcaagtgagtttataaatcctgattcaagtaatatgactcccattttttctacacaaaatatgaatttgaacggtgaaaatttagagaattctggttctactttaagtttaaacccattaccttcacattcagttttgaacgagtccaagtgttttataaaggataacacattggctttggaaagtaactacccggaagattctcttctcagtagttctttaaatgtagcaagtgactccatcgcaggttgtagcagtctcaatcaaaaacagaaagaacttttagaatctgagtgcgttgaggctcaattctctgaagctcctgtagatttggatgccagtgaacctcaggcttgtttaaaccttccagggcttgatttaccaggtacaggtggggatcagaaatctactcgggtctctgatgtgtttctaccttccgaagggttcaacttcaagccacacaaacatcctgaactgccaactaaggggaaggatgtgagttactgcccggtacttgctcctctcccattgctgttgcctcctccgccacctccaccgatgtggaatccaatgattcctgcttttgacctcttccaaggaaaccatggctttgtagctcctgttgtaaccacagctgcacactggagatctgtcaactacacatttccaccctcagttatttctcacacttccccaacaaaagtatggagaaataaagatggaacaagtgcttatcaagtacaagaaaccccagtttctcaggttgtaagaaagaagacatcttacgttggactagttcttgttcttctcagaggtcttccgggatctggaaaatcttttttggcaaggactttgcaagaggataatccaagtggagtcattcttagtactgatgattatttttatataaatggacagtaccagtttgatgtaaagtacttaggagaagcacatgaatggaaccagaatcgtgcaaaagaagcatttgagaagaagatatctcctataattatagataatacaaacctacaggcatgggaaatgaaaccatatgttgctttgtctcagaaacacaaatataaagtcctttttcgggaaccagacacatggtggaagtttaaaccaaaggaacttgcaaggcgtaacattcatggggtaagcaaagaaaaaataacaagaatgttggaacattatcaacgttttgtttcagtgccaataattatgagttcttcggttccagagaaaattgaacgtattgagttgtgtgcatattcttgtgaggatagaagcactagcccaagagacgatgaagatattatctctgaaaaagaagaaaatattttatctttatctttgaagcatctagagttcactgaagagaagaatcttgatgtaaccaaagaaacaatgttacctgagaatgttgcatatctctctaatgcagatttaaacaaaagaagaaaagaaataagtgatatgaatcctagcattcaaagtgctttaattctggaaactccacacatgtatttttctgactctgaaagcaaactacaggcaacagacaaaagtgaaaacgagcaaatagaaatggtggctgtaaaagggtatagtaaaactgacacagatagttctatggagagagtatcacctagtacttgctgtagtgaaaataatcaagaagactgtgatcttgcaaatagtggaccacttcaaaatgaaaaatcctcacctggtgaaatagtggaagaaagagcaacagtaacgaaaaaagcctttgggaaacaaaaaagcaaatcgactttggaaaagttcccaagacatgagctatcaaattttgttggtgactggccagttgataagactattggtcagaggacaaaaaggaacagaaaaactgaaaaaacttcatccgtacaaagcgacaaaaagtataattaccctcagtcacacaaattagttaacagtgtatctgtgaatacagattgtgtccagcaacgaggatctccacatgaaagtgtagaggatggcagaaagtcacagtgtgatgatgcttcagagccactcaatagctataaatatgatgcttataaaaatattgacaaaaactcattcaacattatgggtgactggccttcatctgattctttagctcagagggaacacagatcaagaatgccaaagactggtttaagtgagcccaacctagaaattggaacaaatgacaaaatgaatgaaatatccttatctacagcacatgaggcctgttggggcacaagctctcaaaaactaaagacattgggtagctccaatctaggaagttctgaaatgctgctcagtgaaatgacctgtgagagtcagacttgtctaagtaaaaagagtcatgggcaacacacatcgttgcctcttacttttaccaatagtgcaccaactgtttctggagtagtagaaccacaaacgttagctgaatgtcaagagcaaatgcctaagagagaccctggaaaagaagtaggcatgtgcacccagactgaaccacaggattttgctcttttatggaaaatagaaaagaataaaattagcatttcagattctatcaaagtattaacaggaagattagatggatttaagccgaaagttttcaatattaacacaaaatcagacgttcaagaagcaattccatatagagtaatgtatgataaaagcacgtttgttgaagaaagtgagcttaccagtgcagatgaatctgaaaatcttaacattctttgtaaactgtttggatccttttcattagaagccctgaaagacttatatgagaggtgcaataaagatattatttgggccacaagccttttgttggattctgaaactaagttatgtgaggatacagagtttgagaatttccaaaaatcgtgtgatggatcacaaattgggcctttttctctggggttgaatttgaaagaaattattagccaaagaggaactttagagaattctaattctcctgtgccagagtttagccatgggattggtattagtaacgctgactcacagtctacttgtgatgcagaaagaggaaactcagagcaggcggaaatgagagctgtcactcctgaaaaccatgaatcgatgacaagtatatttcccagtgctgctgtgggtctaaagaataataatgacatacttcctaacagccaggaagaacttttatatagcagtaagcagtcctttccaggtattctaaaagctactactcctaaagatatgagtgaaacagaaaaaaacctagtagtcacagagactggagacaacatacattctccttcacatttctctgatatttttaactttgtatctagtacttcaaatcttgaattaaatgaagaaatttattttactgattctcttgaaataaagagaaatgaaaattttccaaaggattatgtgaaattttcagatgaagaagaatttatgaatgaagatgagaaggaaatgaaggaaattctaatggcaggaagtagtttatcagctggagttagtggggaagataaaaccgagatattgaatcccactccagcgatggccaaatctctgaccatagactgtctggaattggcattaccccctgaactggcttttcaacttaatgaattatttggtcctgttggtattgattcagggtctctaacagttgaagattgtgtggttcatatagatctgaatctggcgaaagtgattcatgagaaatggaaagaatctgtaatggagcgacaaagacaagaagaggtgtcttgtggcaagtttatgcaagatccttccttggttggacatactgggcttgataatcctgaacaaaaatcatctcagagaacaggcaaaaaattactgaagactttaacagcatctgaaatgctacctttattggatcattggaatactcaaactaaaaaagtatcactcagagaaataatgtcagaagaaattgccttacaggaaaaacataatttgaaaagggagacccttatgtttgaaaaagattgtgccactaaactaaaggagaagcagctctttaagatatttccagccattaaccaaaattttctggtggacattttcaaggaccacaactattcattagaacacacagtgcaatttcttaactgtgttcttgaaggggaccctgtaaaaacagttgtagcccaagagtttgttcaccaaaatgagaatgtcacatctcatactggccagaagtctaaagagaaaaagccaaagaaattaaaagagactgaagaaacaccaagtgaactgtctttccaggactttgagtacccagactatgatgactacagagcagaggctttccttcaccaacagaagaggatggagtgctacagcaaggccaaagaagcttatcggatagggaaaaaaaatgtcgccaccttttatgcccagcagggtactcttcatgagcagaagatgaaagaagccaatcaccttgctgccatagagatctttgagaaagtcaatgcttcgctgctgccacagaatgttttagacctccatgggctgcatgtggatgaagctctagaacatttgatgagagttttagagaagaagactgaagaatttaagcagaacggtgggaagccctatttgtctgtgattacggggagaggaaaccacagccagggaggagttgctcgcatcaaaccagctgtcattaagtacctcataagccatagcttcaggttctctgaaattaaaccagggtgcttgaaagtcatgctaaagtaaaataaacatccttgaattagaagtatgaaggtttgtaggttaaaattacttttatttgcagtaattcagtcaattctaccctaaagatgtgttttattataaataatattcaattatgaaacaaaaaaattatgatgtttttcaaaatgcaagtgaggtttgattttttactgaatcaaatgcaaatgttacctgttaaagatattacagagaaattttattgattacaaaatatgtaagaaaattatcagctacagttttaaagtttaaaatgctctgattgtttctcagaaaaggttacctttgtattaattgttgtatgacatttagtaatgtcctaaaagtcttttgtgagaggtatttaaagtgctttgagacctgattcatgccccccaaagggtggtattaaaagaggaaaaaggacatagtagtggtagtaaagaaaaaaaggagatctaacaaaaacacttgaatattttttattttcaaaactaaacacataaaatgcttttattttgccatatcctacaggaaggaagacatgcttttgccctttcttctgctttgtatatgaccttgatcttttaccttttgttctgttcttctgtgtgcattttatggaaagaaagttgggtctgagattatattgtaattttatactttctatagacagaaaggttttcagagaaaaagaaatggttaaatatcttccagatgttgctgccttatcgaaatgcttctagaactgtctgtataagtcgtatttcagacagtactaaatacttatattttatttttgaggcatgtaattttaaaactgcagtaggttaaaattctattaaacaaatatagaaaatattttgtttataattggcctggtgtggtggcccacgcctgtaatcccagcactttgggaggccgaggtaggtggatcgcctgaggtcagaagttcaagaccagcctggccaacatggtgaatccccgtctctattaaaaatacaaaaattagctgggtgtggtggcgtgtgcctgtaatcccagctacttgggaggctgaggcaggagaaccgcttaaacctgggaggtggaggttgcagtgacccgagatcgagatcacaccactgcactcagcctgggtgacagagcaagactccgtctccaaaaaaaaaaaagaaaaaaaagagaaaatattttggttataatcataagaagaatccttacaatttaaaatattttcacttttattttgaaaaagagccaactttctcaaaggaagctgtcattaacttctgttgtttggttagctaataaattctgttagtatgcaagttaaacctgtgtaaaggaggttataatgtggtaaggtataattttccaatatgagacaatggcttaaatttgcctttggagatggagaatattttcaacatacataattttaacaaatagttttgttgctttttgttaagcttaaaaaaaaatttggatcagaaattataggattgagctggtaccaaaagaatcctaaagtacagaatggttttccaaaagagcagacatttcaatgaaaataaaaccccaaaacattttttttatatatcatgattgcatgcttttaaaataaggaggcttatcattgaattttagttccataaaaatgaaaatacatgtttattatttagaaatggttagtgactggtattgaagtattattcacacttatgtttgtaataatttatttaaagaatgccaacagtttagcacacttttgtaatctctagaacagttctatacattaaaaataaacattaaaaataaagcagttcctttaaacaacttactatgaaactataattgttaatgaaataagatattcctatgtatacattagtatgatttaagggtatgaaaaacagtgctaaaatgtggagttaattggaatgtgtgcagctgcatactcactttctgtgtttttatatttccttacctagttttaaaaatcatcacttttcggcacttcagctagacttatttcaatattataattatgattaatgaaggagcagtcagaagtagaggtgtggtattccgtgggcagaagtcaaatgaaaaaagctatattgtttacttgtttactatatcaatgttaatattatgccttattttgataaatcaaatagtatatcttaatcattgttgataaatatacaggcaaagtttgagcatcatatgtatttttatgaagctgcttaattccaaattgcctcccaccccactatctagcatagtttaagcaacacataattttgaaagaaaagtttgtaatccctcctttcttttttttgcccatttctaaatcctgtatgcccgcagtaaagatagtttggggattttaaaagttttctctattacccatttctaaatcctgtatgtcaaagatagtttggagattataaaaattttcatgtattggtgtaggttgagtatccctaatgagaaaattcaaaatctgaaatgcttcaaaatctgaaatttttcgagcacagacatgatgctcaaaggaaatactcacagagcattttacatttgtaggttagcgatactcaacaagtaaatataatgcacatgttctaaaatatccccccaaaccccagcaatccaaaacacttctggtcctaagcattttgagtaggggatactcactcaacctgtatatttgtgctaatacatgactcattagaatgattctttgtaaacttaatattttaaaagtacagcacttctgtagtatggaaggtttcagtaataattatattcattcagtagtctcttaccattatctcccagatggaaaaagaggactaatgtggaaaccccagagggtgtccagttggaccagggagatattagacacttaacagtattttcagtctgtccatctctttattccaatgtgagaaatggaagtgtttttttttttacgtttattggctcttcatatttctctacattatttttaatgtgcagtttcttcaattggttagtatttccatactatttgcaactttatggcctttaaatataggacatattatatagcagaaattttgactttaaatcctcttgagtagtatattttgagaagaaaagctatactgctcttctggatggtttccatcctttatttaggtcttttctttttgaattcaagtgttttgtatgcttagaaagtagacatgtataatattgagatcggttatttctgagctggaaattggaaactttggaaactcaggaaattgctctgacaatgttttaactgctctcaatttaagaaaatgacgaaatgtataaaaaagacaaaaataacgtgtgctgttttttccaagtgctttttctaagtgcttttccattgtgcaatgaggtgaagtttggtaatttttcggtgtagtagttaaatattgctcaatttttatttacatgtaaagaaaacagatttaaatgtttatgtggccaaaaggtgtcatttaaaaggtaaaataagtttatgtagaatgtatgttcatggtgcttatttttaaaatgtaattcaagtttacagtattacttaatgcttctttacagaatttaatagagaaacaaggctagaacacatctacatcctgaagagccgtttataacttcatattatatgatgacaaagttcattattttccttaaagttgagcaattgacttttatggtccaatgatgaacttattattaataaatgattgagttaactgtgaggcttctcattaaaatacaatattgcagctatcagttggagaatatattataaaattttcagacagtatatcagaaaaatgtttttatttgtactgtatagaaaatgtaattttgctgttaactctgtactttttaaattgaaaatgttttataaatttgcttttaaattttcttatgaagccatttgcaaattacatacttaatttaataaaatactttagccac

SEQ ID NO: 2144 - DNA, 2738 bp, Homo sapiens
gctcgcacccccgtcctccggccgcgacccccgcccgggaaccctagcccctggccgcggtcgcttcccggacctcgccccgcgcctccccctgcagcccgccccggccgcaccccctagcgtccccgcccccggccgcgccccctcatgggggccccctcggcggtccgggaggcggcgggcgcgccatgggcagcggcagcagccggagcagccggactctgaggcggcggcgcagccccgagagcctccccgcggggcccggagcggcagccctggagggcgggacccgccggcgggtgccggtggcggcggccgaggtcccgggggcagccgcggaggaggcgcccggccgcgaccccagccccgtggcgccccccgacggcagggacgagacgctgcgcctgctggacgagctgctggccgagtcggcggcctggggccccccggagcccgccccgcgccgcccagcccggctccgacccaccgcggtcgcggggagcgcggtgtgcgcagagcagagcacagagggccacccggggagcggcaatgtctctgaagccccaggcagcggtcgcaagaagcccgagaggccggcagccatctcctacgaccactcggaagaggggctgatggcgagcatcgagcgggagtactgccgctgaggacagcatgctccacccccgccaggcctcggaggcacctgctggctggggcaccctctgcttgcacagagctctagcaggagctgaaccacctccaaaacgcagtcactcccggatattcaaagctgccctttcaaatccactttcagaccgcgctgacctgggccagccactggcggtcatggttgctggtgggggcgattagctgtgtagacccacaggtgcgtgggcctgggccgccggcgcctcctccccaacgcggggagcctgcccagttcttctggagcctgaaatgcgtgcccctcttggttgcccgctctccacagtggggagggctcacgaggactaggtgacacaagcgagcccctcctggcatccgcgccacaacacttccggaaggttctgctgtggaaggtgcacccgcgctgctccctcagtctcgggcccatctctccaggggtggccgggtcagcttagtgcttctcaactttaactccctaatgagcagcctgggggtgctgttgacttgcagggcctgaggttctgtacgtctaaccagctcccagcccaggcccgagctccgaagccccaactgcactttgaggagcgagaaccccagctctgatctgccttgcagtgggaggtagagctcgtcactgcctctctgggcctcagtttccctctctggaaaatcagctctggcagctcttggaggccctccccagctctgacaatctggaactgctgccactgctggtcccctgccccaggcacagcagtgccttccctgcggggagccagcgcccaggtccaaccgggagagggtctgcctgatactggctttccagttctccctctcacaggcagcctggccagtgcctgcggggcttttaaattctcttcctgcctgggtggaaggtgggaaaccacagcagtgaggcaggaagagccttggaatgttcctggttgacagatgggaaaactgacctgcccaggacgccctgggaacagggggcggagctccggctagaggggactcctgtgtgggcgggcaggtctggagcctgggcccaggtgtggcctgctgggggacagctccgggggagagctgtggggagaacagcggtctagggaggcaggaggcaggcggcaggctcctccccagcagcctgcagggcatcaggacagagggggaaggaggagacagaagggaaagaaggagatagagggggaaggaggaaacagcgcggcttctgctgaagccagtacaagcctggttatctggcttgacccgcccacacggaggcctccccagcgttttctttttcccgagaagagctccagctcgcaggtccttagaacacagcagagcaggagcatctcaggaaccaacggccagctccttggcgctgtccccagccccacaggcctgctgcggccatccgcaaacgggcatttccttgaacttttgagagtgcctttgaccagctgttcgcagctgggaaactccaacttttgaagtcagagcttggagcggcccccgcaagggcgtggctcaaaccctccccagagctgggagccattgcttatgcaagcccgtttcttttgatgtaaagatggaagtcgttactatattttaataatgcaaatacatcttttaaaataagttaacatttcttaccaccagatggatcaggctttgaatttaaacatgtaaatgtttgtaattttatgtcattttgttaaaatgggacgctttcaattggtttccaagaaagatgatacctctgcattttctggtggaaaaggtgtaatacccttaatgagatcaaagtgttaggggaaaaaaattccaaaagtagttacaagctatatcaatgtcaaagtaaatgcacttcatcaaagctaagaagtcacaggaattgttctcaggtttttaaaaaaatttttcctgaattcaggaagtgtcttctgaatagcagctagccaaataaagcggtgtgtgtgtactgcagctgtaggtgaacttaaaaataataataaaaagaacaaataaagcagtgtgtaccagcc

SEQ ID NO: 2145 - DNA, 2216 bp, Homo sapiens
aaaagcgggcggcgggccgcattgtctgacggcgctccctctctgctttttgttctcgcctcgccgccccgcccctccgcagctctcgaggctcctcccgctgcgggtcggcgctcgccctcgctctcctcgccctccgccccggccccggccccgcgcccgccatggagaagactgagctgatccagaaggccaagctggccgagcaggccgagcgctacgacgacatggccacctgcatgaaggcagtgaccgagcagggcgccgagctgtccaacgaggagcgcaacctgctctccgtggcctacaagaacgtggtcgggggccgcaggtccgcctggagggtcatctctagcatcgagcagaagaccgacacctccgacaagaagttgcagctgattaaggactatcgggagaaagtggagtccgagctgagatccatctgcaccacggtgctggaattgttggataaatatttaatagccaatgcaactaatccagagagtaaggtcttctatctgaaaatgaagggtgattacttccggtaccttgctgaagttgcgtgtggtgatgatcgaaaacaaacgatagataattcccaaggagcttaccaagaggcatttgatataagcaagaaagagatgcaacccacacacccaatccgcctggggcttgctcttaacttttctgtattttactatgagattcttaataacccagagcttgcctgcacgctggctaaaacggcttttgatgaggccattgctgaacttgatacactgaatgaagactcatacaaagacagcaccctcatcatgcagttgcttagagacaacctaacactttggacatcagacagtgcaggagaagaatgtgatgcggcagaaggggctgaaaactaaatccatacagggtgtcatccttctttccttcaagaaacctttttacacatctccattccttattccacttggatttcctatagcaaagaaacccattcatgtgtatggaatcaactgtttatagtcttttcacactgcagctttgggaaaacttcattccttgatttgtgtttgtcttggccttcctggtgtgcagtactgctgtagaaaagtattaatagcttcatttcatataaacataagtaactcccaaacacttatgtagaggactaaaaatgtatctggtatttaagtaatctgaaccagttctgcaagtgactgtgttttgtattactgtgaaaataagaaaatgtagttaattacaatttaaagagtattccacataacttcttaatttctacattccctcccttactcttcgggggtttcctttcagtaagcaacttttccatgctcttaatgtattcctttttagtaggaatccggaagtattagattgaatggaaaagcacttgccatctctgtctaggggtcacaaattgaaatggctcctgtatcacatacggaggtcttgtgtatctgtggcaacagggagtttccttattcactctttatttgctgctgtttaagttgccaacctcccctcccaataaaaattcacttacacctcctgcctttgtagttctggtattcactttactatgtgatagaagtagcatgttgctgccagaatacaagcattgcttttggcaaattaaagtgcatgtcatttcttaatacactagaaaggggaaataaattaaagtacacaagtccaagtctaaaactttagtacttttccatgcagatttgtgcacatgtgagagggtgtccagtttgtctagtgattgttatttagagagttggaccactattgtgtgttgctaatcattgactgtagtcccaaaaaagccttgtgaaaatgttatgccctatgtaacagcagagtaacataaaataaaagtacattttataaaccatttactatggctttgtaacaattgcatacccatattttaagggacaggtgaatttactactttctaaagtttattgatacttcccttttatgtaaaatgtagtagtgatacctatatttccacattgtgcattgtgacacacttgtctagggatgcctggaagtgtataaaattggactgcatttcttagagtgttttactatagatcagtctcatgggccatctcttcctcagatgtaaatgatatctggttaagtgttatatggaataaagtggacattttaaaactagcaaa

SEQ ID NO: 2146 - DNA, 3502 bp, Homo sapiens
tttcttccgccgtccgccggtggcgaggcccaggctgtcgccgggtgtgcagcggcgtcgcggccagtagagggattctgggtaacggcccggacccccggctgggcttctggctcggcgcagcaggttccattcacgccaagtctgttggcagtggcagttgtagggccaagggcggttgtaggacccggagcagccggacatggaacaaccgtggccgcctccgggaccctggagcctccctcgggccgagggtgaggctgaggaagagagtgacttcgacgtgttccccagttctccccgctgcccgcagctgccaggcggcggcgcccagatgtatagccatggaattgaattggcttgccaaaagcagaaagagtttgtgaagagctctgtggcgtgcaaatggaatcttgctgaagctcaacagaaacttggtagcttagcactgcataattctgagtccttggatcaggagcatgccaaagcacaaacagcagtatcagaactgaggcaacgggaagaagagtggcgacagaaagaagaagctctagtacaaagagagaagatgtgtctgtggagcacggatgccattagcaaggatgtttttaataagagttttattaatcaagataaaagaaaagacacagaagatgaagataaatcagaatcatttatgcaaaaatatgagcaaaaaatcagacattttggtatgttgagtcgatgggatgatagccagagatttttgtctgaccatccataccttgtatgtgaagaaactgctaaatatcttattttatggtgttttcacctggaagctgagaagaaaggggctttaatggaacaaatagcacatcaagctgttgtaatgcagtttattatggaaatggccaaaaactgtaatgtggatccaagagggtgttttcgtttatttttccagaaagccaaagcagaggaagaaggttattttgaagcattcaaaaatgaacttgaagctttcaagtcaagagtaagactttattctcaatcacaaagttttcaacctatgacagttcagaatcatgttccccattctggtgttggatctataggtttattagaatccttaccacagaatccagattatcttcagtattctatcagtacagctctctgcagcttaaactcggtggtacataaagaagatgatgaacccaaaatgatggacactgtataatttggttaagactgctgaggccaagtgctattttgttacaagaaaggaagaacttggctattttcttgacacttttatgggtgctgcactttatttttgttcggtttttgatgggagggaaagagtactgaaatgttttgtaaattttttttaatgtgctgctaggttttttgttttgttttgttctgaagagaagagtggtaccatatgttgcaggaagtcaaactggactttttgtggctactaaatttgcttttaatcttattgttctcaattttggaatcaagtatgaaaatctgcacaaatgcaatgtttacaagaactggttgattctgggaggcatctgctacagtctctttttatatggatatgtacatgtcctattctacaaaaatgattaaagataaaaacatacttgtatcccactgctactttagctgtcaaatttggtgtttcatcacattaaaagcaataaatcagtagttggtaatgtactttactaaataagttggggggtacaatttttaaaagtcttaactcttaaatacttgactttcggcaccatcagttaaatccttgactataatacaaatttgatatatacattacatttaccctcaaattattctcaaaactatattccttagaatttgattttaccctgctgactttaagagttataataatatcaaatgtgatgagctaatatagattttctttttaaataagaataacttcaagctcactctttcttaacatagtctgggatctctcagggagtaagttttaaaagaatactaatggcttgtaagaacaaacaggaataataatctgatttttaaatttgtagttattttactcatgttgccttttaatttttgttattttggtttattttttgatgtagccttttaaaaaaggagtcttaaaaatgattttttttttaaaggcaagagaaatcttgtagtgctaactgccttgagctgccaattacctatttctgagaatttggtgactcttattggtaatgatggcatttacaacatttggcatttcccctttttcagctcagttaccatagaatacttccaagctttactacttcctctgtaagtcatttcagttatgccaggatatttgatgattttgtttatgtagaattaggtaacaaagccaattatgctatccttattattgaaggattaatcttatgacttaacataagctttggttatatttgggtgtagtctttggctaagtacccattaaggctagtagcaaacacttggaaggtggctaactgggactgggaatacgtgtctcaacttgagaaaccaaatagtgcgaagggactcagggtggccagacctgtgaccttggcctcatttgtatcttgttttcgctgaggtgatcagacacttagtaccctagaaatggactggaattattgaatcttcttctgtaacatcacaatcttcctggttttcagaataaacgtttttgtgcttttgatataaatatatactctataataaaatgtttgactaatttatatagtagtgtttgtcagcctgtactttttttttttttaaacccatgacctagtcgtagacatttttttctttttgttctgttctgaagcaagctcttatttttccctttctaccaaattgagagaatgggcagacacaggagccatattcctagtttcacagaaatgttacttgaattattattttcccttctttcccaggatttgcctgtaagcattcaaattgttttgaatttcattttgccttctctaagttagaggtatttaatgactgaagactggcaggagagaaagtatcaacaaactgagtaaactattcttgaggggcactgaaaagatgttctttgaaacttgatttatatatttttacttgcaaaagaatatactgtgttttgagtatgaaagtgtgattgggtctgttgtgggaaccactgactgatgccataatttgcacttaaaggctataaattacatagttagccgtactttagtactagaaacagtaaattgacatccttgaactaattcctaccttttttttgtttctgaagaaataaagagtatattaagcaaagggataatttatatttcaggttggacaatttaccctaaacaaattaaaccatggaaagtgcaaacacatgaatgaaacatttttttacatcaaagtatcatcaaagattcttgtttcatttgataaaattaatatttgaataaaaaaatttttaaatcaa

SEQ ID NO: 2147 - DNA, 1244 bp, Homo sapiens
ccgactatttcttccgccgtccgccggtggcgaggcccaggctgtcgccgggtgtgcagcggcgtcgcggccagtagagggattctgggtaacggcccggacccccggctgggcttctggctcggcgcagcaggttccattcacgccaagtctgttggcagtggcagttgtagggccaagggcggttgtaggacccggagcagccggacatggaacaaccgtggccgcctccgggaccctggagcctccctcgggccgagggtgaggctgaggaagagagtgacttcgacgtgttccccagttctccccgctgcccgcagctgccaggcggcggcgcccagatgtatagccatggaattgaattggcttgccaaaagcagaaagagtttgtgaagagctctgtggcgtgcaaatggaatcttgctgaagctcaacagaaacttggtagcttagcactgcataattctgagtccttggatcaggagcatgccaaagcacaaacagcagtatcagaactgaggcaacgggaagaagagtggcgacagaaagaagaagctctagtacaaagagagaagatgtgtctgtggagcacggatgccattagcaaggatgtttttaataagagttttattaatcaagataaaagaaaagacacagaagatgaagataaatcagaatcatttatgcaaaaatatgagcaaaaaatcagacattttggtatgttgagtcgatgggatgatagccagagatttttgtctgaccatccataccttgtatgtgaagaaactgctaaatatcttattttatggtgttttcacctggaagctgagaagaaaggggctttaatggaacaaatagcacatcaagctgttgtaatgcagtttattatggaaatggccaaaaactgtaatgtggatccaagagggtgttttcgtttatttttccagaaagccaaagcagaggaagaaggttattttgaagcattcaaaaatgaacttgaagctttcaagtcaagagtaagactttattctcaatcacaaagttttcaacctatgacagttcagaatcatgttccccattctggtgttggatctataggtttattagaatccttaccacaggctccaagattttaagaccagctttagccagtttaatctgttgtctacattgtgagaaggaaagtcttattcaaaagacaatgtgaggagagtcctatatttagttttaaacctcataaagtg

SEQ ID NO: 2148 - DNA, 5638 bp, Homo sapiens
accgcaaagaagtcgcgctttgattgggccgctgtcaggtgtcgctgcctgcaggttcggctgcgcgagcggagggaggcggttccctcttatgcttttcatctccatccccagccccacccacagccagggggcttgggttctgagctgatggggtacccccctctgcagagcgggatgagtgggtgttccggcagggatgtggtcattgacggccagtgagggcgagagtaccacggcccacttcttccttggagctggagatgaggggctgggcacccgtggaataggcatgaggccagaagagagtgacagcgagctccttgaggatgaggaggatgaagtgcctcctgaacctcagatcattgttggcatctgtgccatgaccaagaaatccaagtccaagccaatgactcaaatcctagagcgactctgcagatttgactacctgactgttgtcattctgggagaagatgtaatccttaatgaacctgtggaaaactggccatcctgccactgcctcatctctttccactccaaaggctttcctctggacaaagctgttgcttactccaagcttcgaaacccctttcttatcaatgatctggccatgcagtattacatccaagataggagggaggtgtaccggatcctgcaggaagagggtattgatctgcctcgatatgctgtgctcaaccgtgatcctgcccggcctgaggaatgcaacctgatagaaggtgaagaccaagtagaggtcaatggagctgtctttcccaagccctttgtggagaagccagtgagtgcagaagaccacaatgtttacatctactaccccagctcagctggaggaggaagccagcgtctctttcgtaagattggcagccgaagcagtgtttactctcctgagagcagcgtccgaaagacggggtcgtacatctatgaggagtttatgccaacagatggcacagatgtcaaggtgtatacagtggggccagattatgcccatgctgaagctagaaaatctccagctttggatgggaaggttgaacgagacagtgaggggaaagagattcgatatccagtcatgctgactgccatggaaaagctggtggccaggaaagtctgcgtagctttcaagcaaacagtttgtggatttgaccttcttcgtgccaatggtcattcctttgtgtgtgatgtcaatggctttagttttgtcaagaactcgatgaaatactacgatgactgtgccaagattctggggaacaccataatgcgggagcttgccccacagttccagattccatggtccatccccacggaggctgaggacattcccattgttcccaccacatctggcactatgatggaacttcgttgtgtcattgcaattattcgtcatggggatcgtactcccaagcagaagatgaagatggaagtgaaacacccaaggttttttgctctgtttgaaaaacatggtggctacaagacagggaaattaaaactcaagcgacctgagcagctccaggaggtgctggatatcacaaggctgttgttggctgaactggagaaagaaccaggtggtgagatcgaggagaagactggaaaactagagcagctgaagtctgtactggagatgtatggtcacttctcaggtataaaccggaaggtacaattgacttactaccctcatggagtaaaagcttctaatgaggggcaagatccacagagggaaactctggccccatctctgttgctggtactgaagtggggtggagaactgactcctgctggccgtgttcaggctgaggagctggggcgagcttttcgctgcatgtaccctggaggacagggtgactatgctggcttccctggttgtgggctgcttcgtctccatagcactttccgccacgatctcaagatctatgcctctgatgagggtcgtgttcagatgactgctgctgccttcgccaagggccttctggctctagaaggggagctgacacccattttggtgcaaatggtgaagagtgccaacatgaatgggctactggacagcgatggggattccttgagcagctgccagcaccgggtgaaggctcggctgcaccatattctacagcaggatgcgccctttggccctgaggactacgatcagctggctcccaccagaagtacttccctgctcaactccatgactatcatccagaatcctgtgaaggtctgtgatcaggtatttgccctgatcgaaaacctcacccaccagatccgggaacgaatgcaggaccccaggtctgtagacctgcagctctaccacagtgagacactagagctaatgctacagcgttggagcaagctggagcgtgactttcgacagaagagtgggcgctatgatatcagtaagatccctgacatctatgactgtgtcaagtatgatgtgcagcacaatgggagtctgggacttcaaggcacagcagagttgctccgtctctctaaggcactggctgatgtggtcattccccaggagtacgggatcagtcgggaggagaaactggaaattgctgtgggcttctgtcttccactgttgcggaagatactacttgacctgcagagaacccacgaggatgagtctgtcaacaagctgcatcccctgtactcccgaggcgtgctctccccaggtcgccacgttcgaacgcgtctctatttcaccagtgagagccatgtccactccctgctcagtgtcttccgttatggaggacttcttgatgagacccaggatgcacaatggcagcgagctttggattatcttagtgccatctcagagcttaactacatgacccagattgtcatcatgctttatgaggacaacacacaggatcccttatcagaggaacggttccatgtggagctacacttcagccccggagtgaaaggtgttgaggaagaaggcagtgccccggctggctgtggattccgtccagcctcttctgagaatgaggagatgaaaaccaaccaaggcagtatggagaacctgtgtccaggaaaggcatcagatgaaccagaccgggcattgcagacttcaccccagcctcctgagggccctggccttccgaggagatcacccctcattcgtaaccgaaaagctggttccatggaggtactttctgagacttcatcctcgaggcctggtggctaccggctcttttcatcttcacggccacccacagaaatgaagcagagtggcctaggctcacagtgcacagggctgttcagcaccacagtgctgggtggctcctccagtgccccgaatcttcaggactacgcccgcagccatggcaaaaagctaccacctgccagtctgaagcaccgagatgggtttgaagggtgttccatggtgcctaccatctaccctctggaaacactgcataatgccctttccctacgtcaagtgagtgaattcttgagtagagtctgccagcgccacactgatgcccaggcacaggcatctgcagccctctttgattccatgcacagcagccaggcctcagataacccattttctccaccacgtactcttcattcacctcccctgcaactccagcagcgctctgagaagcccccttggtacagcagtggcccttctagcactgtgtccagtgctggtccttcttcccctactacagtagatggtaactcccaatttggcttcagtgatcaaccctccctaaattcacacgtggctgaagaacatcaaggccttgggctgctccaggagacccctgggagtggagcacaagagctctccatagaaggggagcaagagctttttgaaccaaatcagtccccacaggtgccacctatggaaaccagccagccatacgaggaggtcagccagccatgtcaggaggtccctgacatcagccagccatgccaggacatttctgaggcgctcagccagccatgtcagaaggtccctgacatcagccagcaatgccaggagaaccatgacaatggtaaccacacatgccaggaggtccctcacatcagccagccatgccagaagtccagccaactgtgccagaaagtctctgaggaagtttgccagctatgtctggagaactccgaggaggtcagccagccatgccagggggtctctgtggaggttggcaagctggtccataagttccatgtaggggttggtagcttggtccaggaaacccttgtagaagttggcagcccagctgaagagatccctgaggaggtcatccagccataccaggagttctctgtggaggttggcaggctggcccaggagacttctgcgatcaatctgttatctcagggcatccctgagattgataaaccatcccaagagttccctgaggagattgatctgcaggcccaggaggtccctgaggagataaattagaagtcctgggtggtccctgaagtgattgatcagctgcctggagagggtattcctcaagcccagcatccatctggtgatccaaaccctcagagccagtctctagcccatgaccagcactcaccccttccaccagcaacatgtgattaattttctcattagtggtatcacactataccagccatttgagccagcaaccttttctgttggctaactcactggccagctctcaccagcggtgtctggggaagtagttctctttgtatgaagcatacctgtgccagagctgtggttgaggaggagccagttttaggttcgaagaagccattggctcctcacttagccattagacttgaataggatttccttggggtgggttggtctgtcattacccagccttctctgagcatcctaggaaatcacagattgttaaaggaaatgccgcttcactgctgaagacaccatctggcgacagcaaatgcaaaagaggggactctagggtcttcacttttctggggaaatgttcacgacttctcaaggtacgcttagaccatatgtgcattcaggggactcttgtctttgccagcactcctcaggtgagcccgggatggctatctgaaatgtctggaaaatagagtcccttccccaaacatctgacatggccactaaatctttagacttgccttatagatccttccatatcatccccaagtgccccttctgcctcagtcctgttcctctgggcaatagctctagggaaaagtaggtattagactgctgtgcaaaattcagagcaactacttaaaatgctctagaggattcttagccagtctgtgaaagtgggcctcctctgtggtggggctgtttggcttaggagatgctgtagtagtagagataatcaggttctattttaagcaatcagcagagatcaatattgtacagatacaagcaaaggtttaataaatatatatatatatatttatttctgtagttgtgccagggacagactggccaaagaccaaacactgcagggtccccaagaaatttgtccttatatcattgtgtctgagggccagatatgattatgaagctttttccaaagatccagggatgggaatgggagtgggtaggaggggtaatgcggtcattggagtcgggggctggaacattatgagtgctcaataaatataaactaatgagaatggtggtgatgga

SEQ ID NO: 2149 - DNA, 921 bp, Homo sapiens
agccaagttctttccatcatcctgggccctcacctctggcataggctcttggtagtgggggcccagacagggaggcacctgccacctgcttcccttctcagccacccacagccctcatagggcagaatgggactcttgctgatgtagccgggtcccaatgataagaagtcagaactgctgccagctgggtggaacaacaataaagacctgtatgtcctccggtatgagtataaggatgggtccagaaagctccttgtgaaagccatcaccgtggagagcagcatgatcctcaatgtgctggaatatggctcacagcaagtggcagacttgaccctgaacttggatgattatatcgatgcagaacacctgggtgacttccacaggacctacaagaacagtgaggagcttcggtctcgtattgtgtctggaatcatcacacctatccatgagcagtgggaaaaggctaatgtaagcagtccccaccgggagttcccccctgctaccgccagagaggtggacccactccggattcctccacaccacccacacaccagtcggcagcctccctggtgtgatcccctgggcccgtttgttgtcgggggagaagacttagacccttttgggcctcggagaggtggcatgattgtggatcccctgagatctggcttcccaagagcacttattgacccttcctcaggcctcccgaaccgacttcctccaggcgctgtgcccccaggagctcgctttgacccctttggacccattgggaccagcccacccggcccgaggcctgacagacgcgggcagtgatgagccctgttctggagtggaaagagcacgatagagcaccaggctaagaggcacgagatcaaggcggtagtcacttccgctctgcagctagcatttcaaccatatgtggat

SEQ ID NO: 2150 - DNA, 704 bp, Homo sapiens
atcatcctgggccctcacctctggcataggctcttggtagtgggggcccagacagggaggcacctgccacctgcttcccttctcagccacccacagccctcatagggcagaatgggactcttgctgatgtagacgccgaagtcgcgggcgctcatggcgggcctggaggtactgttcgcatcggcagcgccggccatcacctgcaggcaggacgcgctcgtctgcttcttgcattgggaagtggtgacacacggttacttcggcttgggtgtcggtgaccagccgggtcccaatgataagaagtcagaactgctgccagctgggtggaacaacaataaagacctgtatgtcctccggtatgagtataaggatgggtccagaaagctccttgtgaaagccatcaccgtggagagcagcatgatcctcaatgtgctggaatatggctcacagcaagtggcagacttgaccctgaacttggatgattatatcgatgcagaacacctgggtgacttccacaggacctacaagaacagtgaggagcttcggtctcgtattgtgtctggaatcatcacacctatccatgagcagtgggaaaaggctaatgtaagcagtccccaccgggagttcccccctgctaccgccagagaggtggacccactccggattcctccacaccacccacacaccagtcggcagcctccctg

SEQ ID NO: 2151 - DNA, 1737 bp, Homo sapiens
tcagctcgaccgcggagggcagctccaaaggggaccccaaaggtgcccacgcggggctggggcctcctgggcgtcgttgggagcggccactaccggcccgggtccgagctgtcagcctctccaaagcctgcgcgagaggagccgggacacgcctagcgcgggctccagtggccggtgtccagctgcctactttctgcccggatctctggctcctcatctctccggtctccgcagactaaagccctcgggatatgcagcagccatgcctgtgcacacgctgagccccggagccccgtccgcccccgccctaccttgccgcctgcggaccagggtccctggctacctgctacgggggccggcagatggtggagcccggaaaccgagcgctgtggagcgcctggaggccgacaaggccaagtacgtcaagagcctgcacgtggccaacacccgccaggagcctgtgcagcccctgctgtccaaacagccgctctttagccctgagactcgccgcacagtgctcacgcccagccgccgagccctgcctggcccctgccgacggccccagctggacctggacatcctcagcagcctcatcgacttgtgtgacagccccgtgtcccctgccgaggccagccgcactcctggacgggccgagggagccggccgtcctcccccagccacccctccgcgaccgccgcccagtacctctgcggtccgccgggtggacgtccgccccctgcccgcctcgcctgcccggccctgcccatcacccggccctgccgccgcctccagcccagcccggccgccgggtttgcaacgctccaagtcggacttgagcgagcgcttttctagggcagccgctgatctcgagcgcttttttaacttctgcggcctggacccggaggaggcgagagggttgggtgtggcccacctggcacgggccagctcggatatcgtgtccctggcagggcccagtgctgggccgggcagctctgaagggggctgctcccgccgcagctcggtgactgttgaggagcgggcccgggagcgcgttccctatggcgtgtcggtggtggagcgcaatgcccgcgtgatcaagtggttgtatgggctaaggcaggctcgggagagcccagcagctgaaggctaggcgccactgggcctggaattcgccacaggacggatcttacagaggcaagtggtccctggacctctcttgcatccattctctagacggccgtgtcagaggctccaccctgttgtgaacttggtatggaggcaaaggcttagaggctggaccagcattgttgggcaaggactgactctccaagggttttgttcttggctttggacacctgagaaccccctcctcccctcccccaatacaaggtttttgacatgagtgtactcctgcttagttcctcttgtggggctgcatttgcggtgctttgccctccccactgtgagtgaggggccaagggatctcctcaatcctgtctccccagcggctctgtttcctccttccttccttggcctctgtcctttgctgacttcctcttccttacccagcagaactcaccctggggtcggggcagtggggaggggcctatccactgctcttcctagtccttggcagctggcctaggtgggcagactataggagggactggttaggagtctgcattgctttgacttccctctccttggttaataaacacaaatgcttgtttctcaagg

SEQ ID NO: 2152 - DNA, 1809 bp, Homo sapiens
acttccccttccacggcgccccagggactttccctgcggtgggggccttcgacagtgagggccacccgctcagctcgaccgcggagggcagctccaaaggggaccccaaaggtgcccacgcggggctggggcctcctgggcgtcgttgggagcggccactaccggcccgggtccgagctgtcagcctctccaaagcctgcgcgagaggagccgggacacgcctagcgcgggctccagcagtggccggtgtccagctgcctactttctgcccggatctctggctcctcatctctccggtctccgcagactaaagccctcgggatatgcagcagccatgcctgtgcacacgctgagccccggagccccgtccgcccccgccctaccttgccgcctgcggaccagggtccctggctacctgctacgggggccggcagatggtggagcccggaaaccgagcgctgtggagcgcctggaggccgacaaggccaagtacgtcaagagcctgcacgtggccaacacccgccaggagcctgtgcagcccctgctgtccaaacagccgctctttagccctgagactcgccgcacagtgctcacgcccagccgccgagccctgcctggcccctgccgacggccccagctggacctggacatcctcagcagcctcatcgacttgtgtgacagccccgtgtcccctgccgaggccagccgcactcctggacgggccgagggagccggccgtcctcccccagccacccctccgcgaccgccgcccagtacctctgcggtccgccgggtggacgtccgccccctgcccgcctcgcctgcccggccctgcccatcacccggccctgccgccgcctccagcccagcccggccgccgggtttgcaacgctccaagtcggacttgagcgagcgcttttctagggcagccgctgatctcgagcgcttttttaacttctgcggcctggacccggaggaggcgagagggttgggtgtggcccacctggcacgggccagctcggatatcgtgtccctggcagggcccagtgctgggccgggcagctctgaagggggctgctcccgccgcagctcggtgactgttgaggagcgggcccgggagcgcgttccctatggcgtgtcggtggtggagcgcaatgcccgcgtgatcaagtggttgtatgggctaaggcaggctcgggagagcccagcagctgaaggctaggcgccactgggcctggaattcgccacaggacggatcttacagaggcaagtggtccctggacctctcttgcatccattctctagacggccgtgtcagaggctccaccctgttgtgaacttggtatggaggcaaaggcttagaggctggaccagcattgttgggcaaggactgactctccaagggttttgttcttggctttggacacctgagaaccccctcctcccctcccccaatacaaggtttttgacatgagtgtactcctgcttagttcctcttgtggggctgcatttgcggtgctttgccctccccactgtgagtgaggggccaagggatctcctcaatcctgtctccccagcggctctgtttcctccttccttccttggcctctgtcctttgctgacttcctcttccttacccagcagaactcaccctggggtcggggcagtggggaggggcctatccactgctcttcctagtccttggcagctggcctaggtgggcagactataggagggactggttaggagtctgcattgctttgacttccctctccttggttaataaacacaaatgcttgtttctcaagg

SEQ ID NO: 2153 - DNA, 2698 bp, Homo sapiens
cggcacctggcgagcggagccggagtcgggctggggaccgcggggtcgaggccggaccgcggcggggtcgggggagaaacgcgcgctgccctggcacgggcccccccccccggccgcgcggaatggtatggcccggccggagttaaggccggggggaggcggcgagtcccgcggcggcggcgacgatggggctgcgtgcaggaggaacgctgggcagggccggcgcgggtcggggggcgcccgaggggcccgggccgagcggcggcgcgcagggcggcagcatccactcgggccgcatcgccgcggtgcacaacgtgccgctgagcgtgctcatccggccgctgccgtccgtgttggaccccgccaaggtgcagagcctcgtggacacgatccgggaggacccagacagcgtgccccccatcgatgtcctctggatcaaaggggcccagggaggtgactacttctactcctttgggggctgccaccgctacgcggcctaccagcaactgcagcgagagaccatccccgccaagcttgtccagtccactctctcagacctaagggtgtacctgggagcatccacaccagacttgcagtagcagcctccttggcacctgctgccaccttcaagagcccagaagacacacctggcctccagcaggctgggccatgcagaagggatagcaggggtgcattctctttgcacctggcgagagggtctgactctgggcacccctctcaccagctacaaggccttggactcactgtacagtgtgggagccccagttcccacctctgtgacaataggatcatggccttacccttgaagcattaccgagaaggagaacagagatgggcttgaagagccacgtgctgccggctccaaattcccaaggacaaggatccctctgcatttttgtctatgtaacctcttatatggactacattcagctgcaaggaaaggaaaaccttgattgcagtggtttaaacaaacagaagattgtttttccacatagcatggattctggagatgggtggctaatggtattggttcaacaactccacgaaggtaggggtcacgtcttggatccttttgccttaatctcagtgctcgttacttcatggtcccaagatggctgctgtatccccaagaatcatgtctgcgttcaaggaaggaggggtggaggaagaggaagggccaaactagctggacccgtcaccttctatcagaaagtaaaacctcgtcagaagtctgtttcctgctctctccctctgcatatcttcacttagatgcccttggcccgagccagctaccattgcacctctagctgcaaacaaagctaagacagcagggaacagaattgtcatggctgaatagaccaatcgtgttccatctactgagactggcacactgcctcctgcaataaaactgggatcccattaccaagagagaaatgcagaattgtgtaccagttagcttttgctgtgtaacaaaccatccccaaacttggcagctagaaacaaaccctgtattttcccacaatcctatgggttggcaatttgggctgggctcaacagggcagttctgctgctcacacctgggatccctcatggagctaaggtcagctgttacctcagctgggcctggatggtctaggatagccttactcacttgcctggcaggtgacaggctgttggctggaattgcttggttctcctccatgtggcctctccagcaggctagctcaggcttattcacatgatggcttcaggattccaaagagagtgagagtagaagctgaaagacttcttgagttcttggcctggaactgggactaggacagtgtcacttctgctaagttcttttggtcagagcaaatcacaaggctttacccagattcaagggatgagaaacagactacatgtcttgatgaggggaaccacaaagagcttgtggccatttttcacctatcacaaataattttggatgggtatttatttggataaaggtatttccctcttccccctttctctctgtctcatggggcctcactctgccaagttggaaggcactaagacattgtcctggccctcagggtctaggggaagaggtgttggggcaggaagtgagtctctccatgggctggacccactgtagtaggagtgcctccttgtctgcactgctggtatggggttaggccaggtaggacattccagaggggcttctgaaaaccaagagtccctggggaaagggaacagagtaaggcaggccttgttctcactgccctctaagggaacttggtcactcggcacttttaagcctcagtttctccagttcaataataaggacaagagcttttcccatgcattctctttccccgggaaagttgactgaggtgaccagtaatagaattgaaaagggagagtgtcttcagtgcaatgtggcatcctggattgggtcttggaacaaaaacaggacattagtgggaaaattggaaatctgaaaaaagtctgaattttagttaatataccaatttcagtctcttggttttgacagatgtaccatggtgatgtaagatgttgaccttggggtaggctgggtgaagggtatacaggaactctttgtactatctctgcaacttctctgtaaatctagtatcattccaaaataaaagtttatttaatttaaaaaaaaaaa

SEQ ID NO: 2154 - DNA, 6208 bp, Homo sapiens
gcgctcccgcttgccgcagcctgcgtcgtctgccgccaccgcgcgccttcactgacctacaccaccgccgccgccgccgccgccgccgggctcgctggctggcccggtgcgggcggcggactcccgccggagaggactgccagcgccgccgccgccgccgcttcggcccgggcccgggccccgaccccgtcccgggccccagcgccggccgcccgcccggtcgggcgatgaagtgtcactatgaggcgctgggggtgcggcgcgacgccagcgaggaggagctcaagaaggcctatcggaagctggccctgaaatggcacccggataaaaatctggataatgccgcagaagcagctgaacaatttaaattaatccaagcagcatatgatgtgttgagtgaccctcaggaaagagcatggtatgataatcatagagaggccctacttaaaggtgggtttgatggcgaatatcaagatgacagcttagatttgctacgctatttcaccgttacctgttattctggttatggagatgatgaaaagggattttacacggtgtatcgtaatgtttttgaaatgattgccaaggaagaactagaatctgtgttagaggaagaggttgatgatttcccaacttttggagactcccagagtgactatgatacggtagtccatcctttctacgcttattggcagagtttctgcactcaaaagaattttgcatggaaggaagaatatgatacacgacaggcttcaaaccgctgggaaaaacgagccatggaaaaagaaaacaaaaagattcgggacaaagcaaggaaagagaagaatgagcttgtccgtcagctggtagctttcattcgtaaaagagataaaagagtgcaggcgcatcgaaaacttgtggaagaacagaatgcagagaaggcgaggaaagccgaagagatgaggcggcagcagaagctaaagcaggccaaactggtggagcagtacagagaacagagctggatgactatggccaatttggagaaagagctccaggagatggaggcacggtacgagaaggagtttggagatggatcggatgaaaatgaaatggaagaacatgaactcaaagatgaggaggatggtaaagacagtgatgaggccgaggacgctgagctctatgatgacctttactgcccagcatgtgacaaatcgttcaagacagaaaaggccatgaagaatcacgagaagtcaaagaagcatcgggaaatggtggccttgctaaaacaacagctggaggaggaagaagaaaatttttcaagacctcaaattgatgaaaatccattagatgacaattctgaggaagaaatggaagatgcaccaaaacaaaagctttctaaaaaacagaagaaaaagaaacagaaaccagcacaggatgtacctggcaaagattcatatctgcctgcagctcactttcagatggcttggggaaaaaagtgtgtgttgggagagagaagagatggagagagcgagcacaaatgtgccaaaatgttgcttgaaaacagacagaattatgatgacaatttcaatgtaaatggacctggagaaggagtaaaggttgatccagaagatactaacttaaatcaagacagtgccaaagaattggaagatagtccccaggaaaatgtcagtgtcacagagatcattaaaccatgtgatgatccaaaaagtgaagctaaaagtgttcctaaacccaaaggaaagaaaaccaaagatatgaaaaaacctgtcagagtacctgctgaaccacaaacaatgagtgttcttatcagctgtacaacctgccatagtgaatttccatctcggaataaactttttgaccatctaaaggccacaggtcatgcaagagcaccttcatcatcgtctttaaacagcgcaacaagtagtcaaagcaagaaagagaaacgtaaaaacagatagagattctgcctgtgcttttgtttgactgtctctagattttgaaaccaaaaaactgaactgaaatcatctaaagagttaaaatttcagtgatctgcaattaattacattgtggaagattattttttatcttgtaaaaacacttttttggtttaatatatatttttaaaacatttcactagtgattgaattctacttttgccatctgaattgacttgaatgtcttaaaacaggtaaatactgtaaagtgtgtattcttgatgtttattggctcatgtggacagaaatgtacagggagaattacattattttaacacacagaagtgcaactttctgctttattttctgaatttcacattacttttacttaatgcttttgtgttttgttaatacttcataatatgtgaaaaactcggatcttttaaaaagcatcatagatcatttttccatatgacactggttccgattttaaaaattatttttaaataaccgattattgattactgtattttttttctcaagaacagtgataggtagaaactaattgaacatttggtagtctttcaagaatagtgtctcttcaaggttttacttgatttaatttgatattttactggtttaccagtaaggtgtattgttcagttttttgctccgatttgaattgtggaggtggaagcaaattagtttacatggcatgtcctccctaggcacagtgacagctgtaaagtatgacggaacaaggtagcagatggtacagaatttatactatttaagaagagatgtggtgttcttcattgagtttttttcttcactattttcagaagtttttgttcttttttttttttccatcactcagtggagaaaagctttgttaatgaaagattttgtgatagagctgatgcttatacatctattctataacagtgatgaatattaacacaaaggaaatatggagaactgttataactgagtgttagaacagtcgtgtacattgatcagtattgagtccatttttaggatggattagtcagttcttttcattggtcttgaaagtaattttggctggtcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaagaaagtaattttaaactcactggcttgaaatgtgtgctttctgtacaatgaagttattgctttccatatatccttgaatcttcagattaacgaaatgaacaaattttcggttacagatcagctctcaaacactaaagtccttaatggcaaggtcttttctgatagcttcatggatagtattgatgatcagatttcttctgtgttattgtcttaaaaataagcatttgaaccttaatttaaattcttttcttttccatttagagatatgtttttttctttaccttcatacctttctatttcttgctaatttctatcactaattccttataattgtccctgctccccttcttgatctcttcagggggaatactaggcagttttgtatcttctgatctcgtaccctgagacttcatctgaatgtgctctgccgccttcttatctgaactagatgaattggccataattatgaataggaatattaatgaaccagaggacatactagtcacatgttattatacactaaaaaataggaagtcatcttgaaaggcagttaatgtactgcaaatgtccctatgacttctttgctttctcttataccaaacatgcaggtatttaatttgtttaatgagggttgagtggagttatgtgtcgcttttattcggattgacgaaaatcaaccataattttcaagggatcttcatgggttgtgactggaagctgaccttagtcttgcgtctcatcctttatgatgttgagaaatcatctaatttctcagaactttttcttatctctaacacagttattaccataataatattgtctccatttatcatacaggatcattatgaaagtaaaatgaagtagtatatatgaaaatgctttttaaacacaaaagctttatacaaaatattgttgaatttaaataaggtaaatcttttttagtttatatatttgcagactatacatgttggattaaatgggcaattaagttttataggaatttgcttcctaagtctacttttgaagaggaaaacaggaacgtaccatatattttgctaagggtaaaatatttttggtgaattgcagacatttaatttcacttgtctgaggtaaaacaataaactaaaatacatgggcatgcatcttacactgatcttattagaggtcagtgctaagtacccatcttgattgaagttagctcagatgtggagattcatagaatgagggtccaggagaagaaagttaggggaaatctcattttctttctgtaattcattcagtggtgccaaagctgggggttccctacaatggctatttagactttccctgcttcaaaataagagcagtatccttagctctagccaagcatttttctaattcctgcctttggtcacaaagaaggaaaagcagagctgtgaatgagttagtggaggtcaagtcacatcagagttcatgacctagtgattgctggtgaagtaatattggaattttggtaccatgagaagacttataaaggatttcatcagaagttttcattttttctaaatcctcccctacaaaattttcagattggaaattactcttgtatttgtagaagattgtctctaaaattgtggtttaactcacgcaggaagtaaaattcctatagcaagacatagtttcattttagaggacccccaaaatcccgtgaattctctggtgatgattctagcctaaccttcaacataaaataatgaagagaacttttaaacttttttatgaattcctaaacattaccatttatgtggcagaagttctgttccctataatctgcaatgctgaagtatctctattcaattcccttccttatctgttaaatttaatgtctttatactaaaaatataggctcttgggattggagaggaaaaattagaggtgattttcagatttcttgttctatggaagaggaagctgagctcagggagatatgagctccacagccacagctggttaggggcggctgccagtagaacagggcagatgcctggactcccaactcagtaggccttctgttacacctcaaaatgtgttacatgggaagaaaaagattaagaaaaagcaagataattttgaagaaggacgagaggaagaggcatgaacttgtcctaacaatgtcaaagaatattttaaaggtataccagttaaagtagtgtgtggctggtgccagtagaggtcagtcaagggatccctgacgagaataaagagcccagaaacaggtccatgtttatatgggaacttgatttttgacagatacggcaagctctatggggaaaacaatatgtactaccttatacccttccccaaaaacaaagggattaaagacctaaatatgaagacaaaacttttaaatgagaatctataaggttattttcatgattttgcaaatgggaaggatttctttaaagcaagacacaaaagcatacacaggaaaaaatgatgcataaaaacatggcttctgtagaacaatagagactgtaaaagaacaagctacagacaaggaaatgtttgcaatgcatggaactgtcaaaggattcgtatctggaatacattaaagaagcaaaagaacctcatacaaaagtcattgagtaaatgacagccatgcattagaacagcaattctcaaaacttttggtctcaagatccctttacactcttcaaaagtgagaaccccaaagagttttcatgtatgtgggttaaatctattgatattttctgttagaatttaaaaattatgttaaaaaaataagaagaatgactatttttcaaaacaaaaaatgagaagagtggtattgttttacatttttacaaatctctttaacatttagcttaataaaagatagctggcctctca

SEQ ID NO: 2155 - DNA, 2583 bp, Homo sapiens
gattcccggggttggtggcagcggcggtagcagcaatggactttctcctggggaacccgttcagctctccagtgggacagcgcatcgagaaagccacagatggctccctgcagagcgaggactgggccctcaacatggagatctgcgacatcatcaacgagacggaggaaggtgactctgctgctggaggtccaggggccacaggttgtgagtccctgctaagcaatgggctaggaagattctgatgtgatcagaacctggctggatacacaaaacagtcccaaagatgccctccgagcagtaaagaagagaatcgtggggaataagaacttccacgaggtgatgctggctctcacagtcttagaaacctgtgtcaagaactgcgggcaccgcttccacgtgctggtggccagccaggacttcgtggagagtgtgctggtgaggaccatcctgcccaagaacaacccacccaccatcgtgcatgacaaagtgctcaacctcatccagtcctgggctgacgcgttccgcagctcgcccgatctgacaggtgtggtcaccatctatgaggacctgcggaggaaaggcctggagttccccatgactgacctggacatgctgtcacccatccacacaccccagaggaccgtgttcaactcagagacacaatcaggacaggattctgtgggcactgactccagccagcaagaggactctggccagcatgctgcccctctgcccgccccgcccatactctccggtgacacgcccatagcaccaaccccggaacagattgggaagctgcgcagtgagctggagatggtgagtgggaacgtgagggtgatgtcggagatgctgacggagctggtgcccacccaggccgagcccgcagacctggagctgctgcaggagctcaaccgcacgtgccgagccatgcagcagcgggtcctggagctcatccctcagatcgccaatgagcagctgacagaggagctgctcatcgtcaatgacaatctcaacaatgtgttcctgcgccatgaacgagacaggggtctcactgtgttgcccaggctagtctcaaactcttggcctcaagcagtcctccctccttggcctccgaaagcattggtattacaggcatgagccaccacacccacctgcccaccttgtatcattctgttcaagagtcacatccccaagagagacttggattggctgagcttcattgtgcctaccagctggggtttgaacggttccgaacaggccagaccaccaaggccccaagtgaggccgagccggcagctgacctgatcgacatgggccctgacccagcagccaccggcaacctctcatcccagctggcaggaatgaacctgggctccagcagtgtgagagctggcctgcagtctctggaggcctctggtcgactggaagatgagtttgacatgtttgcgctgacacggggcagctcactggctgaccaacggaaagaggtaaaatacgaagccccccaagcaacagacggcctggctggagccctggacgcccggcagcagagcactggcgcgatcccagtcacccaggcctgcctcatggaggacatcgagcagtggctgtccactgacgtgggtaatgatgcggaagagcctaagggggtcaccagcgaagaatttgacaaattcctggaagaacgggccaaagccgcggaccgattgcccaacctctccagcccctcagctgaggggcccccgggtcccccatctggcccagcgccccggaagaagacccaggagaaagatgatgacatgctgtttgccttatgagtgtggggtctggcaccctgcagcccaggtccccactgctctcacacccttaggctgggacctccctccctcctctggtgttaaggctgctttgggggtggcttgttacccccttttcctcctctttgaagacggagctgccccagctgtggctgggggtgtggaggcagtgggatgaactgggggacaggtctgcgctgcagtgggatctggctgctctgcctcctttcccaccccagctgaccatgagactttgctgagaagtggaggccccaggacaggctggctggctggctggctgcttgacccagtgtgactctccttcactgagtgataccctgctccgggcccatgccccaaggagcccttcagagcccacactgccagtcgaggcctggctggaggctggccacagtggaaattctgccgagcctcttgtcccttccctgctctgctgcatggggccccatggctttggctggccactgagggtagggtgtggaggtgtggaggccccctgaggagctgcggcggcccaggtacgaagctgcaactctgcgcgcagtgggcgagatctcatcagccccaggctgcaggtgaggcttcaggggatgctggggccccactgcccctccgctgccttgccctccatccttcctctgttccttctggccgggcaccacagcactggggctcacctcttggttgatcctcttgtactgggagaggtgccttttgtatccccaattaaaggtagaaaacc

SEQ ID NO: 2156 - DNA, 6496 bp, Homo sapiens
ccgagccgggagccgagcgcgctgggcgcggccgtcccgctgccgccgccaagcccggagtgcgccagcggccatggttcccgcggcggcgccgggcgcctgagccccgggacgcaagcgctggaggcgggctgccggctgtgcgggcgctccggagagaccgacagaaggtgagcactgtgggctatgggatggatgaggtggagcaggaccagcatgaggcccgactcaaggagctgtttgacagttttgacacgacgggcacagggtccctggggcaggaggaactcaccgacctttgccacatgttgagcttggaggaggtggccccagtgctgcagcagacattacttcaggacaacctcttgggcagggtacattttgaccaatttaaagaagcattaatactcatcttgtccagaactctgtcaaatgaagaacactttcaagaaccagactgctcactagaagctcagcccaaatatgttagaggtgggaagcgttacggacgaaggtccttgcccgagttccaagagtccgtggaggagtttcctgaagtgacggtgattgagccactggatgaagaagcgcggccttcacacatcccagccggtgactgcagtgagcactggaagacgcaacgcagtgaggagtatgaagcggaaggccagttaaggttttggaacccagatgacttgaatgcttcacagagtggatcttcccctccccaagactggatagaagagaaactgcaagaagtttgtgaagatttggggatcacccgtgatggtcacctgaaccggaagaagctggtctccatctgtgagcagtatggtttacagaatgtggatggagagatgctcgaggaagtattccataatcttgatcctgacggtacaatgagtgtagaagattttttctatggtttgtttaaaaatggaaaatctcttacaccatcagcatctactccatatagacaactaaaaaggcacctttccatgcagtctttcgatgagagtggacgacgtaccacaacctcatcagcaatgacaagtaccattggctttcgggtcttctcctgcctggatgatgggatgggccatgcatctgtggagagaatactggacacctggcaggaagagggcattgagaacagccaggagatcctgaaggccttggatttcagcctcgatggaaacatcaatttgacagaattaacactggcccttgaaaatgaacttttggttaccaagaacagcattcaccaggcggctctggccagctttaaggctgaaatccggcatttgttggaacgagttgatcaggtggtcagagaaaaagagaagctacggtcagatctggacaaggccgagaagctcaagtctttaatggcctcggaggtggatgatcaccatgcggccatagagcggcggaatgagtacaacctcaggaaactggatgaagagtacaaggagcgaatagcagccttaaaaaatgaactccgaaaagagagagagcagatcctgcagcaggcaggcaagcagcgtttagaacttgaacaggaaattgaaaaggcaaaaacagaagagaactatatccgggaccgccttgccctctctttaaaggaaaacagtcgtctggaaaatgagcttctagaaaatgcagagaagttggcagaatatgagaatctgacaaacaaacttcagagaaatttggaaaatgtgttagcagaaaagtttggtgacctcgatcctagcagtgctgagttcttcctgcaagaagagagactgacacagatgagaaatgaatatgagcggcagtgcagggtactacaagaccaagtagatgaactccagtctgagctggaagaatatcgtgcacaaggcagagtgctcaggcttccgttgaagaactcaccgtcagaagaagttgaggctaacagcggtggcattgagcccgaacacgggctcggttctgaagaatgcaatccattgaatatgagcattgaggcagagctggtcattgaacagatgaaagaacaacatcacagggacatatgttgcctcagactggagctcgaagataaagtgcgccattatgaaaagcagctggacgaaaccgtggtcagctgcaagaaggcacaggagaacatgaagcaaaggcatgagaacgaaacgcacaccttagaaaaacaaataagtgaccttaaaaatgaaattgctgaacttcaggggcaagcagcagtgctcaaggaggcacatcatgaggccacttgcaggcatgaggaggagaaaaaacaactgcaagtgaagcttgaggaggaaaagactcacctgcaggagaagctgaggctgcaacatgagatggagctcaaggctagactgacacaggctcaagcaagctttgagcgggagagggaaggccttcagagtagcgcctggacagaagagaaggtgagaggcttgactcaggaactagagcagtttcaccaggagcagctgacaagcctggtggagaaacacactcttgagaaagaggagttaagaaaagagctcttggaaaagcaccaaagggagcttcaggagggaagggaaaaaatggaaacagagtgtaatagaagaacctctcaaatagaagcccagtttcagtctgattgtcagaaagtcactgagaggtgtgaaagcgctctgcaaagcctggaggggcgctaccgccaagagctgaaggacctccaggaacagcagcgtgaggagaaatcccagtgggaatttgagaaggacgagctcacccaggagtgtgcggaagcccaggagctgctgaaagagactcttaagagagagaaaacaacttctctggtcctgacccaggagagagagatgctggagaaaacatacaaagaacatttgaacagcatggtcgtcgagagacagcagctactccaagacctggaagacctaagaaatgtatctgaaacccagcaaagcctgctgtctgaccagatacttgagctgaagagcagtcacaaaagggaactgagggagcgtgaggaggtcctgtgccaggcaggggcttcggagcagctggccagccagcggctggaaagactagaaatggaacatgaccaggaaaggcaggaaatgatgtccaagcttctagccatggagaacattcacaaagcgacctgtgagacagcagatcgagaaagagccgagatgagcacagaaatctccagacttcagagtaaaataaaggaaatgcagcaggcaacatctcctctctcaatgcttcagagtggttgccaggtgataggagaggaggaggtggaaggagatggagccctgtccctgcttcagcaaggggagcagctgttggaagaaaatggggacgtcctcttaagcctgcagagagctcatgaacaggcagtgaaggaaaatgtgaaaatggctactgaaatttctagattgcaacagaggctacaaaagttagagccagggttagtaatgtcttcttgtttggatgagccagctactgagttttttggaaatactgcggaacaaacagagcagtttttacagcaaaaccgaacgaagcaagtagaaggtgtgaccaggcggcatgtcctaagtgacctggaagatgatgaggtccgggacctgggaagtacagggacgagctctgttcagagacaggaagtcaaaatagaggagtctgaagcttcagtagagggtttttctgagcttgaaaacagtgaagagaccaggactgaatcctgggagctgaagaatcagattagtcagcttcaggaacagctaatgatgttatgtgcggactgtgatcgagcttctgaaaagaaacaggacctactttttgatgtttctgtgctaaaaaagaaactgaagatgcttgagagaatccctgaggcttctcccaaatataagctgttgtatgaagatgtgagccgagaaaatgactgccttcaggaagagctgagaatgatggagacacgctacgatgaggcactagaaaataacaaagaactcactgcagaggttttcaggttgcaggatgagctgaagaaaatggaggaagtcactgaaacattcctcagcctggaaaagagttacgatgaggtcaaaatagaaaatgaggggctgaatgttctggttttgagacttcaaggcaagattgagaagcttcaggaaagcgtggtccagcggtgtgactgctgcttatgggaagccagtttagagaacctggaaatcgaacctgatggaaatatactccagctcaatcagacactggaagagtgtgtgcccagggttaggagtgtacatcatgtcatagaggaatgtaagcaagaaaaccagtaccttgaggggaacacacagctcttggaaaaagtaaaagcacatgaaattgcctggttacatggaacaattcagacacatcaagaaaggccaagagtacagaatcaagttatactggaggaaaacactactctcctaggctttcaagacaaacattttcagcatcaggccaccatagcagagttagaactggagaaaacaaagttacaggagctgactaggaagttgaaggagagagtcactattttagttaagcaaaaagatgtactttctcacggagaaaaggaggaagagctgaaggcaatgatgcatgacttgcagatcacgtgcagtgagatgcagcaaaaagttgaacttctgagatatgaatctgaaaagcttcaacaggaaaattctattttgagaaatgaaattactactttaaatgaagaagatagcatttctaacctgaaattagggacattaaatggatctcaggaagaaatgtggcaaaaaacggaaactgtaaaacaagaaaatgctgcagttcagaagatggttgaaaatttaaagaaacagatttcagaattaaaaatcaaaaaccaacaattggatttggaaaatacagaacttagccaaaagaactctcaaaaccaggaaaaactgcaagaacttaatcaacgtctaacagaaatgctatgccagaaggaaaaagagccaggaaacagtgcattggaggaacgggaacaagagaagtttaatctgaaagaagaactggaacgttgtaaagtgcagtcctccactttagtgtcttctctggaggcggagctctctgaagttaaaatacagacccatattgtgcaacaggaaaaccaccttctcaaagatgaactggagaaaatgaaacagctgcacagatgtcccgatctctctgacttccagcaaaaaatctctagtgttctaagctacaacgaaaaactgctgaaagaaaaggaagctctgagtgaggaattaaatagctgtgtcgataagttggcaaaatcaagtcttttagagcatagaattgcgacgatgaagcaggaacagaaatcctgggaacatcagagtgcgagcttaaagtcacagctggtggcttctcaggaaaaggttcagaatttagaagacaccgtgcagaatgtaaacctgcaaatgtcccggatgaaatctgacctacgagtgactcagcaggaaaaggaggctttaaaacaagaagtgatgtctttacataagcaacttcagaatgctggtggcaagagctgggccccagagatagctactcatccatcagggctccataaccagcagaaaaggctgtcctgggacaagttggatcatctgatgaatgaggaacagcagctgctttggcaagagaatgagaggctccagaccatggtacagaacaccaaagccgaactcacgcactcccgggagaaggtccgtcagttggaatccaatcttcttcccaagcaccaaaaacatctaaacccatcaggtaccatgaatcccacagagcaagaaaaattgagcttaaagagagagtgtgatcagtttcagaaagaacaatctcctgctaacaggaaggtcagtcagatgaattcccttgaacaagaattagaaacaattcatttggaaaatgaaggcctgaaaaagaaacaagtaaaactggatgagcagctcatggagatgcagcacctgaggtccactgcgacgcctagcccgtcccctcatgcttgggatttgcagctgctccagcagcaagcctgtccgatggtgcccagggagcagtttctgcagcttcaacgccagctgctgcaggcagaaaggataaaccagcacctgcaggaggaacttgaaaacaggacctccgaaaccaacacaccacagggaaaccaggaacaactggtaactgtcatggaggaacgaatgatagaagttgaacagaaactgaaactagtgaaaaggcttcttcaagagaaagtgaatcagctcaaagaacaagtgagcctacccggtcatctctgttcacccacctcacattccagctttaactccagttttacatccctttattgccattaactcgttaacttatgttgtctaataaaggcaaa

SEQ ID NO: 2157 - DNA, 4216 bp, Homo sapiens
gagagaccgacagaaggtgagcactgtgggctatgggatggatgaggtggagcaggaccagcatgaggcccgactcaaggagctgtttgacagttttgacacgacgggcacagggtccctggggcaggaggaactcaccgacctttgccacatgttgagcttggaggaggtggccccagtgctgcagcagacattacttcaggacaacctcttgggcagggtacattttgaccaatttaaagaagcattaatactcatcttgtccagaactctgtcaaatgaagaacactttcaagaaccagactgctcactagaagctcagcccaaatatgttagaggtgggaagcgttacggacgaaggtccttgcccgagttccaagagtccgtggaggagtttcctgaagtgacggtgattgagccactggatgaagaagcgcggccttcacacatcccagccggtgactgcagtgagcactggaagacgcaacgcagtgaggagtatgaagcggaaggccagttaaggttttggaacccagatgacttgaatgcttcacagagtggatcttcccctccccaagactggatagaagagaaactgcaagaagtttgtgaagatttggggatcacccgtgatggtcacctgaaccggaagaagctggtctccatctgtgagcagtatggtttacagaatgtggatggagagatgctcgaggaagtattccataatcttgatcctgacggtacaatgagtgtagaagattttttctatggtttgtttaaaaatggaaaatctcttacaccatcagcatctactccatatagacaactaaaaaggcacctttccatgcagtctttcgatgagagtggacgacgtaccacaacctcatcagcaatgacaagtaccattggctttcgggtcttctcctgcctggatgatgggatgggccatgcatctgtggagagaatactggacacctggcaggaagagggcattgagaacagccaggagatcctgaaggccttggatttcagcctcgatggaaacatcaatttgacagaattaacactggcccttgaaaatgaacttttggttaccaagaacagcattcaccaggcggctctggccagctttaaggctgaaatccggcatttgttggaacgagttgatcaggtggtcagagaaaaagagaagctacggtcagatctggacaaggccgagaagctcaagtctttaatggcctcggaggtggatgatcaccatgcggccatagagcggcggaatgagtacaacctcaggaaactggatgaagagtacaaggagcgaatagcagccttaaaaaatgaactccgaaaagagagagagcagatcctgcagcaggcaggcaagcagcgtttagaacttgaacaggaaattgaaaaggcaaaaacagaagagaactatatccgggaccgccttgccctctctttaaaggaaaacagtcgtctggaaaatgagcttctagaaaatgcagagaagttggcagaatatgagaatctgacaaacaaacttcagagaaatttggaaaatgtgttagcagaaaagtttggtgacctcgatcctagcagtgctgagttcttcctgcaagaagagagactgacacagatgagaaatgaatatgagcggcagtgcagggtactacaagaccaagtagatgaactccagtctgagctggaagaatatcgtgcacaaggcagagtgctcaggcttccgttgaagaactcaccgtcagaagaagttgaggctaacagcggtggcattgagcccgaacacgggctcggttctgaagaatgcaatccattgaatatgagcattgaggcagagctggtcattgaacagatgaaagaacaacatcacagggacatatgttgcctcagactggagctcgaagataaagtgcgccattatgaaaagcagctggacgaaaccgtggtcagctgcaagaaggcacaggagaacatgaagcaaaggcatgagaacgaaacgcacaccttagaaaaacaaataagtgaccttaaaaatgaaattgctgaacttcaggggcaagcagcagtgctcaaggaggcacatcatgaggccacttgcaggcatgaggaggagaaaaaacaactgcaagtgaagcttgaggaggaaaagactcacctgcaggagaagctgaggctgcaacatgagatggagctcaaggctagactgacacaggctcaagcaagctttgagcgggagagggaaggccttcagagtagcgcctggacagaagagaaggtgagaggcttgactcaggaactagagcagtttcaccaggagcagctgacaagcctggtggagaaacacactcttgagaaagaggagttaagaaaagagctcttggaaaagcaccaaagggagcttcaggagggaagatatgaatctgaaaagcttcaacaggaaaattctattttgagaaatgaaattactactttaaatgaagaagatagcatttctaacctgaaattagggacattaaatggatctcaggaagaaatgtggcaaaaaacggaaactgtaaaacaagaaaatgctgcagttcagaagatggttgaaaatttaaagaaacagatttcagaattaaaaatcaaaaaccaacaattggatttggaaaatacagaacttagccaaaagaactctcaaaaccaggaaaaactgcaagaacttaatcaacgtctaacagaaatgctatgccagaaggaaaaagagccaggaaacagtgcattggaggaacgggaacaagagaagtttaatctgaaagaagaactggaacgttgtaaagtgcagtcctccactttagtgtcttctctggaggcggagctctctgaagttaaaatacagacccatattgtgcaacaggaaaaccaccttctcaaagatgaactggagaaaatgaaacagctgcacagatgtcccgatctctctgacttccagcaaaaaatctctagtgttctaagctacaacgaaaaactgctgaaagaaaaggaagctctgagtgaggaattaaatagctgtgtcgataagttggcaaaatcaagtcttttagagcatagaattgcgacgatgaagcaggaacagaaatcctgggaacatcagagtgcgagcttaaagtcacagctggtggcttctcaggaaaaggttcagaatttagaagacaccgtgcagaatgtaaacctgcaaatgtcccggatgaaatctgacctacgagtgactcagcaggaaaaggaggctttaaaacaagaagtgatgtctttacataagcaacttcagaatgctggtggcaagagctgggccccagagatagctactcatccatcagggctccataaccagcagaaaaggctgtcctgggacaagttggatcatctgatgaatgaggaacagcagctgctttggcaagagaatgagaggctccagaccatggtacagaacaccaaagccgaactcacgcactcccgggagaaggtccgtcagttggaatccaatcttcttcccaagcaccaaaaacatctaaacccatcaggtaccatgaatcccacagagcaagaaaaattgagcttaaagagagagtgtgatcagtttcagaaagaacaatctcctgctaacaggaaggtcagtcagatgaattcccttgaacaagaattagaaacaattcatttggaaaatgaaggcctgaaaaagaaacaagtaaaactggatgagcagctcatggagatgcagcacctgaggtccactgcgacgcctagcccgtcccctcatgcttgggatttgcagctgctccagcagcaagcctgtccgatggtgcccagggagcagtttctgcagcttcaacgccagctgctgcaggcagaaaggataaaccagcacctgcaggaggaacttgaaaacaggacctccgaaaccaacacaccacagggaaaccaggaacaactggtaactgtcatggaggaacgaatgatagaagttgaacagaaactgaaactagtgaaaaggcttcttcaagagaaagtgaatcagctcaaagaacaagtgagcctacccggtcatctctgttcacccacctcacattccagctttaactccagttttacatccctttattgccattaactcgttaacttatgttgtctaataaaggcaaattctattataaat

SEQ ID NO: 2158 - DNA, 3317 bp, Homo sapiens
gttctccgctgaggaggagcggggcagaggagggaggcagcgggtgagagttcagagttcagcagcagcagcccgagcccatgattcccatatgccctgtagtttctttcacctatgtgcccagccggctgggggaagatgccaaaatggcgaccggcaactactttggattcacccacagcggggcggcggcggcggcggctgcggcccaatatagccagcagccagcttcgggtgtagcctattctcatccaactacagttgctagctacactgtccatcaggctccagtagctgctcacacagttactgctgcctatgcaccagcagccgccacagttgcagttgccaggcctgctccagtagctgttgcagctgctgcaacagctgctgcttatggaggctaccccactgcacacacagcaactgactatggttatactcagaggcaacaagaagcaccaccaccaccacccccagctactacacaaaactaccaggattcatactcatatgtaaggtccacagctcctgctgtagcttatgatagtaagcaatactaccaacaaccaacagcaactgctgctgctgtagctgccgctgcccaacctcagccttctgttgctgaaacttactatcagacagcccccaaagcaggttacagccaaggtgcaactcagtatactcaagcccagcaaactcgacaagtgacagccataaaaccagccacaccaagtccagctaccactactttctccatctatcctgtatcctccaccgtacagccagtagcagctgcggctactgtggtgccatcctatactcagagtgctacttacagtaccacagcagttacatattctggtacgtcttattcaggttatgaagcagcagtgtattcagctgcatcttcctactatcaacagcagcagcagcaacagaagcaggcagcagcagcagctgctgctgctgctgcaacagctgcctggacagggaccacctttactaaaaaagcaccattccaaaataaacaactgaaaccaaaacagcctcccaaaccaccacagattcactattgtgatgtttgtaagatcagctgtgctggaccacagacttataaagaacatttagaaggacagaaacataaaaaaaaagaagctgcattgaaagcctcacaaaataccagcagcagcaacagttctactcgtgggactcaaaatcagctacgttgtgagctctgcgatgtgtcttgtacaggagcagatgcgtatgctgcccacattcgtggtgctaagcatcagaaagtggttaagttacacacaaaacttggtaaacccattccatcaacagaaccaaatgttgttagccaagctacttcttcaacagctgtatctgcttcaaagccgactgcctctccttcaagcattgcagcaaacaattgtactgtgaatacgtcatcagttgcaacgtcttcaatgaagggtcttacgactacaggaaactcgtctcttaatagcacatctaacactaaagtatcagcagtgcctacaaatatggctgccaagaaaacatctacccccaaaataaattttgttggtggtaataagctgcagtcaacaggaaataaagcagaagacataaaaggaaccgaatgtgttaaaagtactcctgtcacttctgctgtgcagattcctgaagtaaagcaagacacagtgtcagaaccagtcacacctgcatctcttgctgctttacagagtgatgtgcagccagtgggccatgattatgtggaagaggtacgaaatgatgaaggaaaagtaattcggttccattgtaaattatgcgagtgcagctttaatgatcccaatgctaaggagatgcacttaaaagggcgaagacacagacttcaatataaaaaaaaagtaaatccagatttgcaagtagaagtaaagcctagtattcgagcaagaaagattcaagaagagaaaatgaggaagcaaatgcagaaggaggagtactggcgaagacgagaagaagaggagcgttggagaatggaaatgagacgttatgaagaggacatgtactggaggagaatggaggaagaacaacatcattgggatgatcgccgccgaatgccagatggaggttatcctcatggtcctccaggcccattaggccttctgggagtccgaccaggcatgcctcctcagcctcaggggcctgcacccttacgtcgtcctgactcatctgatgaccgttatgtaatgacaaaacatgccaccatttatccaactgaagaggagttacaggcagttcagaaaattgtttctattactgaacgtgctttaaaactcgtttcagacagtttgtctgaacatgagaagaacaagaacaaagagggagatgataagaaagagggaggtaaagacagagctttgaaaggagttttgcgagtgggagtattggcaaaaggattacttctccgaggagatagaaatgtcaaccttgttttgctgtgctcagagaaaccttcaaagacattattaagccgtattgcagaaaacctacccaaacagcttgctgttataagccctgagaagtatgacataaaatgtgctgtatctgaagcggcaataattttgaattcatgtgtggaacccaaaatgcaagtcactatcacactgacatctccaattattcgagaagagaacatgagggaaggagatgtaacctcgggtatggtgaaagacccaccggacgtcttggacaggcaaaaatgccttgacgctctggctgctctacgccacgctaagtggttccagcaagctagagctaatggtctgcagtcctgtgtgattatcatacgcattcttcgagacctctgtcagcgagttccaacttggtctgattttccaagctgggctatggagttactagtagagaaagcaatcagcagtgcttctagccctcagagccctggggatgcactgagaagagtttttgaatgcatttcttcagggattattcttaaaggtagtcctggacttctggatccttgtgaaaaggatccctttgataccttggcaacaatgactgaccagcagcgtgaagacatcacatccagtgcacagtttgcattgagactccttgcattccgccagatacacaaagttctaggcatggatccattaccgcaaatgagccaacgttttaacatccacaacaacaggaaacgaagaagagatagtgatggaatggatttgaagctgaggggaaaaaagacaaaaaagattatgataacttttaaaaagtgtctgtaa

SEQ ID NO: 2159 - DNA, 561 bp, Homo sapiens
cctccctctcacctgctcctctacctgctccaccctcaatccaccagaaccatgggctgctgtggctgctctggaggctgtggctccggctgtgggggctgtggctctggctgtgggggctgtgggtccagctgctgtgtgcccatctgctgctgcaagcccgtgtgctgctgtgtgccagcctgttcctgcaccagctgtggctcttgtgggggctccaaggggtgctgtggctcttgtgggggctccaaagggggctgtggctcttgtgggggctccaagggaggctgtggctcttgtggctgctcccagtgcagttgctgcaagccctgctactgttcctcaggctgtgggtcatcctgctgccagtccagctgctgcaagccctgctgttcccaggccagctgctgtgtccccatttgctgccagtgcaaaatctgaggctctgactttggacctcaggtgagtccagcatatccacaccacccaagaagtgaccagtgctgcatttcagttctggctgtcccacagctccaggagttgtgtcccctgaattttgca

SEQ ID NO: 2160 - DNA, 1958 bp, Homo sapiens
gttttggcacgacagttatgaaaaagaaagacacttgagggattccgggttttcactttggaattggagataagggatcgtgggcccgtgtagtctcggaagaggttgtgtagtttaggatcaaagagctggccgtgatgagggcagggatgcaggcgcagcccgtctgactccaaactgccttgctcttaacccgactgcaagaccctcaagaacacgggccccatggttttcctcttatgtttctatcatctctaaaatacaacagcctggtgggcagggcctcctgcactggccatgcccatgcccacggagggcaccccgccacctctgagtggcacccccatcccagtcccagcctacttccgccacgcagaacctggattctccctcaagaggcccagggggctcagccggagcctcccacctccgccccctgccaagggcagcattcccatcagccgcctcttccctcctcggaccccaggctggcaccagctgcagccccggcgggtgtcattccggggcgaggcctcagagactctgcagagccctgggtatgacccaagccggccagagtccttcttccagcagagcttccagaggctcagccgcctgggccatggctcctacggagaggtcttcaaggtgcgctccaaggaggacggccggctctatgcggtaaagcgttccatgtcaccattccggggccccaaggaccgggcccgcaagttggccgaggtgggcagccacgagaaggtggggcagcacccatgctgcgtgcggctggagcaggcctgggaggagggcggcatcctgtacctgcagacggagctgtgcgggcccagcctgcagcaacactgtgaggcctggggtgccagcctgcctgaggcccaggtctggggctacctgcgggacacgctgcttgccctggcccatctgcacagccagggcctggtgcaccttgatgtcaagcctgccaacatcttcctggggccccggggccgctgcaagctgggtgacttcggactgctggtggagctgggtacagcaggagctggtgaggtccaggagggagacccccgctacatggcccccgagctgctgcagggctcctatgggacagcagcggatgtgttcagtctgggcctcaccatcctggaagtggcatgcaacatggagctgccccacggtggggagggctggcagcagctgcgccagggctacctgccccctgagttcactgccggtctgtcttccgagctgcgttctgtccttgtcatgatgctggagccagaccccaagctgcgggccacggccgaggccctgctggcactgcctgtgttgaggcagccgcgggcctggggtgtgctgtggtgcatggcagcggaggccctgagccgagggtgggccctgtggcaggccctgcttgccctgctctgctggctctggcatgggctggctcaccctgccagctggctacagcccctgggcccgccagccaccccgcctggctcaccaccctgcagtttgctcctggacagcagcctctccagcaactgggatgacgacagcctaggtccatgtgttctgaaaaggacagagggggccttggagtgcagccagatggaaggactttgaaggctgtccaagtgctgctttcagagtgcaccaagtttttattgtccctgactgtggctccctgcctgtttgtcaggcgggagcctggagcctgcacagggacagagctggtttcatccggcactccctagccctggacaccctccttgtctcgcctgccctcctgcaggccttcactctcccctgaggctgtcctggcccggactgtggggagcacctccaccccccggagcaggtgcacacccagggatgccctggacctaagtgacatcaactcagagcctcctcggggctccttcccctcctttgagcctcgg

SEQ ID NO: 2161 - DNA, 3759 bp, Homo sapiens
cacgcgccccgatacccggcacaggagccacctcccagagccccgcagtccatgcctcagtcggcctgcgctcctcagcctggcggttctacctccgagggttcgcccgcccttggttttccttacaccttagcctttggctcctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttactctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagatcaccatttcaggtcactgctggatatcagttgcctgtatataattatcaggcatttcctgcttatccaaattcaccatttcaagtcgccactggatatcagttccctgtatacaattatcagccatttcctgcttatccaagttcaccatttcaggtcactgctggatatcagttgcctgtatataattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaaattcaccagttcaggtcaccactggatatcagttgcctgtatacaattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaaattcagcagttcaggtcaccactggatatcagttccatgtatacaattaccagatgccaccgcagtgccctgttggggagcaaaggagaaatctgtggaccgaagcatacaaatggtggtatcttgtctgtttaatccagagaagagactgataaattccgttgttactcaagatgactgcttcaagggtaaaagagtgcatcgctttagaagaagtttggcagtatttaaatctgttggatcctctcagctatctagtttcatgggaagttgctggttttgaatattaagctaaaagttttccactattacagaaattctgaattttggtaaatcacactgaaactttctgtataacttgtattattagactctctagttttatcttaacactgaaactgttcttcattagatgtttatttagaacctggttctgtgtttaatatatagtttaaagtaacaaataatcgagactgaaagaatgttaagatttatctgcaaggatttttaaaaaattgaaacttgcattttaagtgtttaaaagcaaatactgactttcaaaaaagtttttaaaacctgatttgaaagctaacaattttgatagtctgaacacaagcatttcacttctccaagaagtacctgtgaacagtacaatatttcagtattgagctttgcatttatgatttatctagaaatttacctcaaaagcagaatttttaaaactgcatttttaatcagtggaactcaatgtatagttagctttattgaagtcttatccaaacccagtaaaacagattctaagcaaacagtccaatcagtgagtcataatgtttattcaaagtattttatcttttatctagaatccacatatgtatgtccaatttgattgggatagtagttaggataactaaaattctgggcctaattttttaaagaatccaagacaaactaaactttactgggtatataaccttctcaatgagttaccattcttttttataaaaaaaattgttccttgaaatgctaaacttaatggctgtatgtgaaatttgcaaaatactggtattaaagaacgctgcagcttttttatgtcactcaaaggttaatcggagtatctgaaaggaattgtttttataaaaacattgaagtattagttacttgctataaatagatttttatttttgttttttagcctgttatatttccttctgtaaaataaaatatgtccagaagaggcatgttgtttctagattaggtagtgtcctcattttatattgtgaccacacagctagagcaccagagcccttttgctatactcacagtcttgttttcccagcctcttttactagtctttcaggaggtttgctcttagaactggtgatgtaaagaatggaagtagctgtatgagcagttcaaaggccaagccgtggaatggtagcaatgggatataatacctttctaagggaaacatttgtatcagtatcatttgatctgccatggacatgtgtttaaagtggctttctggcccttctttcaatggcttcttccctaaaacgtggagactctaagttaatgtcgttactatgggccatattactaatgcccactggggtctatgatttctcaaaattttcattcggaatccgaaggatacagtctttaaactttagaattcccaagaaggctttattacacctcagaaattgaaagcaccatgactttgtccattaaaaaattatccatagtttttttagtgcttttaacattccgacatacatcattctgtgattaaatctccagatttctgtaaatgatacctacattctaaagagttaattctaattattccgatatgaccttaaggaaaagtaaaggaataaatttttgtctttgttgaagtatttaatagagtaaggtaaagaagatattaagtccctttcaaaatggaaaattaattctaaactgagaaaaatgttcctactacctattgctgatactgtctttgcataaatgaataaaaataaactttttttcttcaaa

SEQ ID NO: 2162 - DNA, 1392 bp, Homo sapiens
tcagtcggcctgcgctcctcagcctggcggttctacctccgagggttcgcccgcccttggttttccttacaccttagcctttggctcctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttactctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagatcaccatttcaggtcactgctggatatcagttgcctgtatataattatcaggcatttcctgcttatccaaattcaccatttcaagtcgccactggatatcagttccctgtatacaattatcagccatttcctgcttatccaagttcaccatttcaggtcactgctggatatcagttgcctgtatataattatcaggcatttcctgcttatccaaattcaccagttcaggtcaccactggatatcagttgcctgtatacaattatcaggcatttcctgcttatccaagttcaccatttcaggtcaccactggatatcagttgcctgtatataattatcaggcatttcctgcttatccaaattcagcagttcaggtcaccactggatatcagttccatgtatacaattaccagatgccaccgcagtgccctgttggggagcaaaggagaaatctgtggaccgaagcatacaaatggtggtatcttgtctgtttaatccagagaagagactgataaattccg

SEQ ID NO: 2163 - DNA, 3273 bp, Homo sapiens
tcagtcggcctgcgctcctcagcctggcggttctacctccgagggttcgcccgcccttggttttccttacaccttagcctttggctcctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttactctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagatcaccatttcaggtcactgctggatatcagttgcctgtatataattatcaggcatttcctgcttatccaaattcaccatttcaagtcgccactggatatcagttccctgtatacaattatcagccatttcctgcttatccaagttcaccatttcaggtcactgctggatatcagttgcctgtatataattatcaggcatttcctgcttatccaaattcaccagttcaggtcaccactggatatcagttgcctgtatacaattatcaggcatttcctgcttatccaagttcaccatttcaggtcaccactggatatcagttgcctgtatataattatcaggcatttcctgcttatccaaattcagcagttcaggtcaccactggatatcagttccatgtatacaattaccagatgccaccgcagtgccctgttggggagcaaaggagaaatctgtggaccgaagcatacaaatggtggtatcttgtctgtttaatccagagaagagactgataaattccgttgttactcaagatgactgcttcaagggtaaaagagtgcatcgctttagaagaagtttggcagtatttaaatctgttggatcctctcagctatctagtttcatgggaagttgctggttttgaatattaagctaaaagttttccactattacagaaattctgaattttggtaaatcacactgaaactttctgtataacttgtattattagactctctagttttatcttaacactgaaactgttcttcattagatgtttatttagaacctggttctgtgtttaatatatagtttaaagtaacaaataatcgagactgaaagaatgttaagatttatctgcaaggatttttaaaaaattgaaacttgcattttaagtgtttaaaagcaaatactgactttcaaaaaagtttttaaaacctgatttgaaagctaacaattttgatagtctgaacacaagcatttcacttctccaagaagtacctgtgaacagtacaatatttcagtattgagctttgcatttatgatttatctagaaatttacctcaaaagcagaatttttaaaactgcatttttaatcagtggaactcaatgtatagttagctttattgaagtcttatccaaacccagtaaaacagattctaagcaaacagtccaatcagtgagtcataatgtttattcaaagtattttatcttttatctagaatccacatatgtatgtccaatttgattgggatagtagttaggataactaaaattctgggcctaattttttaaagaatccaagacaaactaaactttactgggtatataaccttctcaatgagttaccattcttttttataaaaaaaattgttccttgaaatgctaaacttaatggctgtatgtgaaatttgcaaaatactggtattaaagaacgctgcagcttttttatgtcactcaaaggttaatcggagtatctgaaaggaattgtttttataaaaacattgaagtattagttacttgctataaatagatttttatttttgttttttagcctgttatatttccttctgtaaaataaaatatgtccagaagaggcatgttgtttctagattaggtagtgtcctcattttatattgtgaccacacagctagagcaccagagcccttttgctatactcacagtcttgttttcccagcctcttttactagtctttcaggaggtttgctcttagaactggtgatgtaaagaatggaagtagctgtatgagcagttcaaaggccaagccgtggaatggtagcaatgggatataatacctttctaagggaaacatttgtatcagtatcatttgatctgccatggacatgtgtttaaagtggctttctggcccttctttcaatggcttcttccctaaaacgtggagactctaagttaatgtcgttactatgggccatattactaatgcccactggggtctatgatttctcaaaattttcattcggaatccgaaggatacagtctttaaactttagaattcccaagaaggctttattacacctcagaaattgaaagcaccatgactttgtccattaaaaaattatccatagtttttttagtgcttttaacattccgacatacatcattctgtgattaaatctccagatttctgtaaatgatacctacattctaaagagttaattctaattattccgatatgaccttaaggaaaagtaaaggaataaatttttgtctttgttgaagtatttaatagagtaaggtaaagaagatattaagtccctttcaaaatggaaaattaattctaaactgagaaaaatgttcctactacctattgctgatactgtctttgcataaatgaataaaaataaactttttttcttcaaatg

SEQ ID NO: 2164 - DNA, 3287 bp, Homo sapiens
gctgccacccattggctcaggccgataccacgcgccccgatacccggcacaggagccacctcccagagccccgcagtccatgcctcagtcggcctgcgctcctcagcctggcggttctacctccgagggttcgcccgcccttggttttccttacaccttagcctttggctcctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttactctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagatcaccatttcaggtcactgctggatatcagttgcctgtatataattatcaggcatttcctgcttatccaaattcaccatttcaagtcgccactggatatcagttccctgtatacaattatcagccatttcctgcttatccaagttcaccatttcaggtcactgctggatatcagttgcctgtatataattatcaggcatttcctgcttatccaaattcaccagttcaggtcaccactggatatcagttgcctgtatacaattatcaggcatttcctgcttatccaaattcagcagttcaggtcaccactggatatcagttccatgtatacaattaccagatgccaccgcagtgccctgttggggagcaaaggagaaatctgtggaccgaagcatacaaatggtggtatcttgtctgtttaatccagagaagagactgataaattccgttgttactcaagatgactgcttcaagggtaaaagagtgcatcgctttagaagaagtttggcagtatttaaatctgttggatcctctcagctatctagtttcatgggaagttgctggttttgaatattaagctaaaagttttccactattacagaaattctgaattttggtaaatcacactgaaactttctgtataacttgtattattagactctctagttttatcttaacactgaaactgttcttcattagatgtttatttagaacctggttctgtgtttaatatatagtttaaagtaacaaataatcgagactgaaagaatgttaagatttatctgcaaggatttttaaaaaattgaaacttgcattttaagtgtttaaaagcaaatactgactttcaaaaaagtttttaaaacctgatttgaaagctaacaattttgatagtctgaacacaagcatttcacttctccaagaagtacctgtgaacagtacaatatttcagtattgagctttgcatttatgatttatctagaaatttacctcaaaagcagaatttttaaaactgcatttttaatcagtggaactcaatgtatagttagctttattgaagtcttatccaaacccagtaaaacagattctaagcaaacagtccaatcagtgagtcataatgtttattcaaagtattttatcttttatctagaatccacatatgtatgtccaatttgattgggatagtagttaggataactaaaattctgggcctaattttttaaagaatccaagacaaactaaactttactgggtatataaccttctcaatgagttaccattcttttttataaaaaaaattgttccttgaaatgctaaacttaatggctgtatgtgaaatttgcaaaatactggtattaaagaacgctgcagcttttttatgtcactcaaaggttaatcggagtatctgaaaggaattgtttttataaaaacattgaagtattagttacttgctataaatagatttttatttttgttttttagcctgttatatttccttctgtaaaataaaatatgtccagaagaggcatgttgtttctagattaggtagtgtcctcattttatattgtgaccacacagctagagcaccagagcccttttgctatactcacagtcttgttttcccagcctcttttactagtctttcaggaggtttgctcttagaactggtgatgtaaagaatggaagtagctgtatgagcagttcaaaggccaagccgtggaatggtagcaatgggatataatacctttctaagggaaacatttgtatcagtatcatttgatctgccatggacatgtgtttaaagtggctttctggcccttctttcaatggcttcttccctaaaacgtggagactctaagttaatgtcgttactatgggccatattactaatgcccactggggtctatgatttctcaaaattttcattcggaatccgaaggatacagtctttaaactttagaattcccaagaaggctttattacacctcagaaattgaaagcaccatgactttgtccattaaaaaattatccatagtttttttagtgcttttaacattccgacatacatcattctgtgattaaatctccagatttctgtaaatgatacctacattctaaagagttaattctaattattccgatatgaccttaaggaaaagtaaaggaataaatttttgtctttgttgaagtatttaatagagtaaggtaaagaagatattaagtccctttcaaaatggaaaattaattctaaactgagaaaaatgttcctactacctattgctgatactgtctttgcataaatgaataaaaataaactttttttcttcaaatgtg

SEQ ID NO: 2165 - DNA, 3831 bp, Homo sapiens
cacgcgccccgatacccggcacaggagccacctcccagagccccgcagtccatgcctcagtcggcctgcgctcctcagcctggcggttctacctccgagggttcgcccgcccttggttttccttacaccttagcctttggctcctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttactctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagatcaccatttcaggtcactgctggatatcagttgcctgtatataattatcaggcatttcctgcttatccaaattcaccatttcaagtcgccactggatatcagttccctgtatacaattatcagccatttcctgcttatccaagttcaccatttcaggtcactgctggatatcagttgcctgtatataattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaaattcagcagttcaggtcaccactggatatcagttccatgtatacaattaccagatgccaccgcagtgccctgttggggagcaaaggagaaatctgtggaccgaagcatacaaatggtggtatcttgtctgtttaatccagagaagagactgataaattccgttgttactcaagatgactgcttcaagggtaaaagagtgcatcgctttagaagaagtttggcagtatttaaatctgttggatcctctcagctatctagtttcatgggaagttgctggttttgaatattaagctaaaagttttccactattacagaaattctgaattttggtaaatcacactgaaactttctgtataacttgtattattagactctctagttttatcttaacactgaaactgttcttcattagatgtttatttagaacctggttctgtgtttaatatatagtttaaagtaacaaataatcgagactgaaagaatgttaagatttatctgcaaggatttttaaaaaattgaaacttgcattttaagtgtttaaaagcaaatactgactttcaaaaaagtttttaaaacctgatttgaaagctaacaattttgatagtctgaacacaagcatttcacttctccaagaagtacctgtgaacagtacaatatttcagtattgagctttgcatttatgatttatctagaaatttacctcaaaagcagaatttttaaaactgcatttttaatcagtggaactcaatgtatagttagctttattgaagtcttatccaaacccagtaaaacagattctaagcaaacagtccaatcagtgagtcataatgtttattcaaagtattttatcttttatctagaatccacatatgtatgtccaatttgattgggatagtagttaggataactaaaattctgggcctaattttttaaagaatccaagacaaactaaactttactgggtatataaccttctcaatgagttaccattcttttttataaaaaaaattgttccttgaaatgctaaacttaatggctgtatgtgaaatttgcaaaatactggtattaaagaacgctgcagcttttttatgtcactcaaaggttaatcggagtatctgaaaggaattgtttttataaaaacattgaagtattagttacttgctataaatagatttttatttttgttttttagcctgttatatttccttctgtaaaataaaatatgtccagaagaggcatgttgtttctagattaggtagtgtcctcattttatattgtgaccacacagctagagcaccagagcccttttgctatactcacagtcttgttttcccagcctcttttactagtctttcaggaggtttgctcttagaactggtgatgtaaagaatggaagtagctgtatgagcagttcaaaggccaagccgtggaatggtagcaatgggatataatacctttctaagggaaacatttgtatcagtatcatttgatctgccatggacatgtgtttaaagtggctttctggcccttctttcaatggcttcttccctaaaacgtggagactctaagttaatgtcgttactatgggccatattactaatgcccactggggtctatgatttctcaaaattttcattcggaatccgaaggatacagtctttaaactttagaattcccaagaaggctttattacacctcagaaattgaaagcaccatgactttgtccattaaaaaattatccatagtttttttagtgcttttaacattccgacatacatcattctgtgattaaatctccagatttctgtaaatgatacctacattctaaagagttaattctaattattccgatatgaccttaaggaaaagtaaaggaataaatttttgtctttgttgaagtatttaatagagtaaggtaaagaagatattaagtccctttcaaaatggaaaattaattctaaactgagaaaaatgttcctactacctattgctgatactgtctttgcataaatgaataaaaataaactttttttcttcaaa

SEQ ID NO: 2166 - DNA, 2382 bp, Homo sapiens
ctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcagtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcagtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttactctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagatcaccatttcaggtcactgctggatatcagttgcctgtatataattatcaggcatttcctgcttatccaaattcaccatttcaagtcgccactggatatcagttccctgtatgtgaaatttgcaaaatactggtattaaagaacgctgcagcttttttatgtcactcaaaggttaatcggagtatctgaaaggaattgtttttataaaaacattgaagtattagttacttgctataaatagatttttatttttgttttttagcctgttatatttccttctgtaaaataaaatatgtccagaagaggcatgttgtttctagattaggtagtgtcctcattttatattgtgaccacacagctagagcaccagagcccttttgctatactcacagtcttgttttcccagcctcttttactagtctttcaggaggtttgctcttagaactggtgatgtaaagaatggaagtagctgtatgagcagttcaaaggccaagccgtggaatggtagcaatgggatataatacctttctaagggaaacatttgtatcagtatcatttgatctgccatggacatgtgtttaaagtggctttctggcccttctttca

SEQ ID NO: 2167 - DNA, 1584 bp, Homo sapiens
ttcgccgttactctgcgcgtaagtcgcttgtccgtggcttctctgagaagaaaagttgaaaaagggtaaaagttttcaggaatattcgggctctctattgctaagcatagcgagtgtcggttttctctctccaacagacatcgctattgcggttccgaggcagtgggaagagatgcggcccctggacatcgtcgagctggcggaaccggaggaagtggaggtgctggagcccgaggaggatttcgagcagtttctgctcccggtcatcaacgagatgcgcgaggacatcgcgtcgctgacgcgcgagcacgggcgggcgtacctgcggaaccggagcaagctgtgggagatggacaatatgctcatccagatcaaaacgcaggtggaggcctcggaggagagcgccctcaaccacctccagaacccgggcgacgcggccgagggccgggcggccaagaggtgcgagaaggccgaggagaaggccaaggagattgcgaagatggcagagatgctggtggagctggtccggcggatagagaagagcgagtcgtcgtgagcgcggtcggcggtttccagccaatggattctggtcaactggtggagattggctgacaccctggagaagccgaaaccagagagccttttgttttctcttttttcctgtctatgctctgtctcacttaacactacgttttctgctatggtctgtggttgatgacctcaatatgagtttcgattgttaacgtgtttttgtttgggaagtaattttgtttgaaaatgctctcacatacaggaattagggcctagattgtaagctcttgcagcagtcacatttgttcccgggctttggtggttatttctaaatttttgaggtgctttgctatttcttgtgtgacctgatagctccctggaactttgggtctgtgtgtgacacatgagactcacagttggagttctccagctctggaggtgctgaaggagctgcattaattctggaagacgactccatgcagcaactactgaagaaaggaccagacttcaacggggagtgtggatgggccgacctggctgggactcgtgaatctggagaagagctggagaatggatagtattgtctgtatttggagactttaatttctgtgtgagaccaaaggaggagagatgtgttttgttcaaaatttaaatttgttgtggtacactatcttatgtaacctgtctggtgagtttgtttggacaacctaactcagctttatttgacatggaacctaaaatagaagataagatcttgatattctgtacaagttgatgtaataccctgatgcgttttagaggacttggcataaaatgaaagattggcaaaggcccttgaggggcttggggatgacagtatggaactgtctgcattggaccctaaactggactagaagaggcatcttcaaggttcatacgttgtccagctgtaagttcatttgagtagcagacctaacaaatatttgaggtcagaaccctaccatgttaaaacaaacaaaaacttaccatgttaataaaagtattcatttgcttgaaaagacgaaagacctaaaa

SEQ ID NO: 2168 - DNA, 936 bp, Homo sapiens
agctgcacagggccgcactaaagtcatactcacactaccctgggggactggtttctggacaaggtgttgagaaagggagaaaactcttccttttaggatggtgaggaaggaaagccggtctgaactggatgatgagggccatgaagcccccaggaggagaatcgagcaatctttttggaagtccagaagaagctactccttccagcaggcctaataggatggcatctaatatttttggaccaacagaagaacctcagaacatacccaagaggacaaatcccccagggggtaaaggaagtggtatctttgacgaatcaacccccgtgcagactcgacagcacctgaacccacctggagggaagaccagcgacatttttgggtctccggtcactgccacttcacgcttggcacacccaaacaaacccaaggatcatgttttcttatgtgaaggagaagaaccaaaatcggatcttaaagctgcaaggagcatcccggctggagcagagccaggtgagaaaggcagcgccagaaaagcaggccccgccaaggagcaggagcccatgcccacagtcgacagccatgagccccggctggggccgcggcctcgctctcacaacaaggtcctgaacccaccgggaggcaaatccagcatctccttctactaagagaagccactgctccacccggagccagaccagaaactcaagagatagggtagccatgttttcatttccttttgcccaaatgagcggggtgggaagagggttagtcttatgtgagcctggctgctcagcgtctcctggccgtcatgacagctgcttggagacccgtgccttccagatggctgggagatgcctctgtggggatgaaatggggcacccctggccatcactcatgtgtagtccaggtttgagaggaactggaaggggggtgagg

SEQ ID NO: 2169 - DNA, 965 bp, Homo sapiens
acggcgcgcggcgagctgagggtggcggcggtcgacatgttccaggtcccggatagcgagggcggccgcgccggctccaggaaatggcaactgctgacaggaagtttggcatccacctcccccagcctcctgagtggacaggggccctgggcaccacttcagagggccatgaagcccccaggaggagaatcgagcaatctttttggaagtccagaagaagctactccttccagcaggcctaataggatggcatctaatatttttggaccaacagaagaacctcagaacatacccaagaggacaaatcccccagggggtaaaggaagtggtatctttgacgaatcaacccccgtgcagactcgacagcacctgaacccacctggagggaagaccagcgacatttttgggtctccggtcactgccacttcacgcttggcacacccaaacaaacccaaggatcatgttttcttatgtgaaggagaagaaccaaaatcggatcttaaagctgcaaggagcatcccggctggagcagagccaggtgagaaaggcagcgccagaaaagcaggccccgccaaggagcaggagcccatgcccacagtcgacagccatgagccccggctggggccgcggcctcgctctcacaacaaggtcctgaacccaccgggaggcaaatccagcatctccttctactaagagaagccactgctccacccggagccagaccagaaactcaagagatagggtagccatgttttcatttccttttgcccaaatgagcggggtgggaagagggttagtcttatgtgagcctggctgctcagcgtctcctggccgtcatgacagctgcttggagacccgtgccttccagatggctgggagatgcctctgtggggatgaaatggggcacccctggccatcactcatgtgtagtccaggtttgagaggaactggaaggggggtgaggg

SEQ ID NO: 2170 - DNA, 5428 bp, Homo sapiens
ggcccaccgccgcccaggcaaggccgccctgccttgggcgcagcgctgccatggctgggggccgtggggcccccgggcgcggccgggacgagcctccggagagctacccgcaacgacaggaccacgagctacaggccctggaggccatttacggcgcggacttccaagacctgcggccggacgcttgcggaccggtcaaagagccccctgaaatcaatttagttttgtaccctcaaggcctaactggtgaagaagtatatgtaaaagtggatttgagggttaaatgcccacctacctatccagatgtagttcctgaaatagagttaaaaaatgccaaaggtctatcaaatgaaagtgtcaatttgttaaaatctcgcctagaagaactggccaagaaacactgtggggaggtgatgatctttgaactggcttaccacgtgcagtcatttctcagcgagcataacaagccccctcccaagtcttttcatgaagaaatgctggaaaggcgggctcaggaggagcagcagaggctgttggaggccaagcggaaagaagagcaggagcaacgtgaaatcctgcatgagattcagagaaggaaagaagagataaaagaagagaaaaaaaggaaagaaatggctaagcaggaacgtttggaaattgctagtttgtcaaaccaagatcatacctctaagaaggacccaggaggacacagaacggctgccattctacatggaggctctcctgactttgtaggaaatggtaaacatcgggcaaactcctcaggaaggtctaggcgagaacgtcagtattctgtatgtaatagtgaagattctcctggctcttgtgaaattctgtatttcaatatggggagtcctgatcagctcatggtgcacaaagggaaatgtattggcagtgatgaacaacttggaaaattagtctacaatgctttggaaacagccactggtggctttgtcttgttgtatgagtgggtccttcagtggcagaaaaaaatgggtccattccttaccagtcaagaaaaagagaagattgataagtgcaaaaagcagattcaaggaacagaaacagaattcaactcactggtaaaattgagccatccaaatgtagtacgctaccttgcaatgaatctcaaagagcaagacgactccatcgtggtggacattttagtggagcacattagtggggtctctcttgctgcacacctgagccactcaggccccatccctgtgcatcagcttcgcaggtacacagctcagctcctgtcaggccttgattatctgcacagcaattctgtggtgcataaggtcctgagtgcatctaatgtcttggtggatgcagaaggcaccgtcaagattacggactatagcatttctaagcgcctcgcagacatttgcaaggaggatgtgtttgagcaaacccgagttcgttttagtgacaatgctctgccttataaaacggggaagaaaggagatgtttggcgtcttggccttctgctgctgtccctcagccaaggacaggaatgtggagagtaccctgtgaccatccctagtgacttaccagctgactttcaagattttctaaagaaatgtgtgtgcttggatgacaaggaaagatggagtccccagcagttgttgaaacacagctttataaatccccagccaaaaatgcctctagtggaacaaagtcctgaagattctgaaggacaagattatgttgagactgttattcctagcaaccggctacccagtgctgccttctttagtgagacacagagacagttttcccgatacttcattgagtttgaagaattacaacttcttggtaaaggagcttttggagctgtcatcaaggtgcagaacaagttggacggctgctgctacgcagtgaagcgcatccccatcaacccggccagccggcagttccgcaggatcaagggcgaagtgacactgctgtcacggctgcaccatgagaacattgtgcgctactacaacgcctggatcgagcggcacgagcggccggcgggaccggggacgccgcccccggactccgggcccctggccaaggatgaccgagctgcacgcgggcagccggcgagcgacacagacggcctggacagcgtagaggccgccgcgccgccacccatcctcagcagctcggtggagtggagcacttcgggcgagcgctcggccagtgcccgtttccccgccaccggcccgggctccagcgatgacgaggacgacgacgaggacgagcacggtggcgtcttctcccagtccttcctgcctgcttcagattctgaaagtgatattatctttgacaatgaagatgagaacagtaaaagtcagaatcagatggagtactgtgagaagagcactttacgagacaccattgaccagggactgtatcgagacaccgtcagactctggaggctttttcgagagattctggatggattagcttatatccatgagaaaggaatgattcaccgggatttgaagcctgtcaacatttttttggattctgatgaccatgtgaaaataggtgattttggtttggcgacagaccatctagccttttctgctgacagcaaacaagacgatcagacaggagacttgattaagtcagacccttcaggtcacttaactgggatggttggcactgctctctatgtaagcccagaggtccaaggaagcaccaaatctgcatacaaccagaaagtggatctcttcagcctgggaattatcttctttgagatgtcctatcaccccatggtcacggcttcagaaaggatctttgttctcaaccaactcagagatcccacttcgcctaagtttccagaagactttgacgatggagagcatgcaaagcagaaatcagtcatctcctggctgttgaaccacgatccagcaaaacggcccacagccacagaactgctcaagagtgagctgctgcccccaccccagatggaggagtcagagctgcatgaagtgctgcaccacacgctgaccaacgtggatgggaaggcctaccgcaccatgatggcccagatcttctcgcagcgcatctcccctgccatcgattacacctatgacagcgacatactgaagggcaacttctcaatccgtacagccaagatgcagcagcatgtgtgtgaaaccatcatccgcatctttaaaagacatggagctgttcagttgtgtactccactactgcttccccgaaacagacaaatatatgagcacaacgaagctgccctattcatggaccacagcgggatgctggtgatgcttccttttgacctgcggatcccttttgcaagatatgtggcaagaaataatatattgaatttaaaacgatactgcatagaacgtgtgttcaggccgcgcaagttagatcgatttcatcccaaagaacttctggagtgtgcatttgatattgtcacttctaccaccaacagctttctgcccactgctgaaattatctacactatctatgaaatcatccaagagtttccagcacttcaggaaagaaattacagtatttatttgaaccataccatgttattgaaagcaatactcttacactgtgggatcccagaagataaactcagtcaagtctacattattctgtatgatgctgtgacagagaagctgacgaggagagaagtggaagctaaattttgtaatctgtctttgtcttctaatagtctgtgtcgactctacaagtttattgaacagaagggagatttgcaagatcttatgccaacaataaattcattaataaaacagaaaacaggtattgcacagttggtgaagtatggcttaaaagacctagaggaggttgttggactgttgaagaaactcggcatcaagttacaggtcttgatcaatttgggcttggtttacaaggtgcagcagcacaatggaatcatcttccagtttgtggctttcatcaaacgaaggcaaagggctgtacctgaaatcctcgcagctggaggcagatatgacctgctgattccccagtttagagggccacaagctctggggccagttcccactgccattggggtcagcatagctatagacaagatatctgctgctgtcctcaacatggaggaatctgttacaataagctcttgtgacctcctggttgtaagtgttggccagatgtctatgtccagggccatcaacctaacccagaaactctggacagcaggcatcacagcagaaatcatgtacgactggtcacagtcccaagaggaattacaagagtactgcagacatcatgaaatcacctatgtggcccttgtctcggataaagaaggaagccatgtcaaggttaagtctttcgagaaggaaaggcagacagagaagcgtgtgctggagactgaacttgtggaccatgtactgcagaaactgaggactaaagtcactgatgaaaggaatggcagagaagcttccgataatcttgcagtgcaaaatctgaaggggtcattttctaatgcttcaggtttgtttgaaatccatggagcaacagtggttcccattgtgagtgtgctagccccggagaagctgtcagccagcactaggaggcgctatgaaactcaggtacaaactcgacttcagacctcccttgccaacttacatcagaaaagcagtgaaattgaaattctggctgtggatctacccaaagaaacaatattacagtttttatcattagagtgggatgctgatgaacaggcatttaacacaactgtgaagcagctgctgtcacgcctgccaaagcaaagatacctcaaattagtctgtgatgaaatttataacatcaaagtagaaaaaaaggtgtctgtgctatttctgtacagctatagagatgactactacagaatcttattttaaccctaaagaactgtcgttaacctcattcaaacagacagaggcttatactggaataatggaatgttgtacattcatcataatttaaaattaaattctaagaagaggctgggtgcagtggctcacacctttaatcccagcactttgggaagccaaggcaggaagactgcttgaaaccaggagtttgagaccagcctgagcaacaaagcaagaccccatctctataaaaactaaaaaaattagttgggcatggtggcacatgcctgtagtcccagctactccagaggctgagatggatcatctgagcctcaggaggttgaggctgcagtgagctgtgactgcgccactgcactccagtctgggacaacagagcaagaccctgtcttaaaaaaaaaaagaaaaaaaaaatttttttctaagaagctgtcctacaaagttgagctttgttagtttttcatgtgtaatatattataaatttatcttttgggatataataaatgctttcatatacctgc

SEQ ID NO: 2171 - DNA, 3931 bp, Homo sapiens
aaataaaacggacaccttaagcgctacaatcaaggtgcgcacggggtgctacagaacaatacgcagacaggaggaggtggggggaaaggtgagacttcccaggcaggtgtcatcccagaataacttttacacagggtgactaagcgagttagtgactgcgcggaaaacgggcttccaaggttcacaaggctcgtgctgcggctccgggagttatgtcacagtaagcttactatcatcctttgggcatctgctttacggatgagttcatcaggatttaaaggatcttggttccatatccttccccttcctcacagaggccgccagcccggagcccctctaggccctcctccctcctgcatctactggccgcgagcctttccctccccgcccccttcacacaggccgcccccagcctcccaaccccccggttccgttccacgggaggccccggcctccctgccctctcctccaccgttctacccgcatcgcccggcttcccgcaagccgctggcaccgtcccctcaacaccctccgcccaccgccactcccttccactgagggggaccgggctgccttctctctgacccgccgttctccgcccccacccacttccccaggcctcccgcaccacccccttcccgccgcgctctctcccgcccccgcgcttccggccccgcccgcccccgcgcggaggactgtgggagcggcttccttggattccgcgcttggcaacggctcggcgtcgcgctttggccaaccgctgcgtcgtccctgggcccgaataactgtcgcccgcttccctcagcgtgaggtgaagcacttcaaattgcctgatgaaagttgaatcaggaatgaagataaaagtacacaacaatgcagaaagcggtacttagcctcacaaagatggaaacattccaaaaacgtgaagtactgttgtcccaagattctttctaagcctaaaattacacttttactagtccgattttctggttgtgagttttttttgtttgttttttttttttcgagaaactgcagtaggcttcttggaagtagaccaagggtgtccaatctttggcttccctgggccacatcggaagaagaattgtcttgggccacacatgaaattcacaaacactaaggtacaaatgatgcaaaatgtgcacctggctccagagacagatgaagatgatctttattccggctataatgactacaatccaatctatgatatcgaggaattggagaatgatgcagcttttcagcaagctgtgaggactagtcatggcagaagacctccaataactgctaaaatatcaagcacggcagttactagacctatagctactggatatgggtccaagacatctctggcatcatcaataggaagaccaatgacaggggctattcaggatggagttactagacccatgacagcagtgagagcagctggttttaccaaagcagctttgagaggctctgcatttgacccccttagtcagtcaaggggccctgcttcccctttggaagccaagaaaaaagatagcccagaggaaaaaataaagcaattagagaaggaagtaaatgagttggtagaagaaagctgtattgccaatagttgtggagacttaaaattggccttagaaaaggcaaaagatgcaggaagaaaagagagagtcctggtgagacagcgagaacaagttacaactccagaaaatatcaatttggatttaacttactcagttcttttcaatttggccagtcagtattcagttaatgaaatgtatgccgaagcacttaacacttatcaagttatagtcaaaaataagatgtttagcaatgcaggaatattgaaaatgaatatgggaaatatctatttaaagcaaagaaattattccaaagccattaaattctaccgaatggcattagaccaagttccaagtgtcaataagcaaatgaggattaaaataatgcagaatattggagttacatttattcaggctggtcagtattcagatgctattaattcatatgagcacataatgagcatggcaccaaatctgaaggcaggctacaacctaactatctgttattttgctattggagaccgagaaaaaatgaagaaggcattccaaaaattgattactgttccattagaaattgatgaagataaatatatttcaccaagtgatgatcctcatactaacttagtaactgaagctataaaaaatgatcacctcaggcaaatggaacgtgaaaggaaagccatggcagaaaaatatattatgacatctgcaaaactcattgctcctgtaattgaaacatcttttgctgcaggttatgattggtgcgtggaagtggtgaaagcttctcaatatgtagagctagccaatgatctggaaataaacaaagcagttacatacttgagacaaaaagactataaccaagctgtagagatcttaaaagtgttggaaaaaaaggacagtagagtgaaaagtgcagctgcaaccaatctctcagccctgtattatatgggaaaggattttgcacaagccagcagctatgcagatatagctgtgaactctgatagatataatccagcagctcttactaataaagggaatacagtttttgcaaatggtgattatgagaaggccgctgaattctataaagaggctctaagaaatgattcttcttgtactgaagcactttataatattggccttacctatgagaaactaaatcggctagatgaggctttggactgtttcctgaaacttcacgcaatcctacgaaacagtgccgaagttctttaccagatagcaaatatatatgaattaatggaaaatcccagtcaagctattgaatggctaatgcaggtggtcagtgttattccaaccgatcctcaagttttatctaagctaggagaattatatgatcgtgaaggagataaatctcaagcatttcaatattactatgagtcatataggtattttccttgtaatattgaagtcattgagtggcttggagcctattacattgacacccaattttgggaaaaagctattcagtactttgaaagagcttctcttatacagcctacacaagtgaaatggcagctgatggtagctagttgtttcagaagaagtggtaactaccaaaaagcattagatacttacaaagatactcacagaaaatttccagaaaatgtcgaatgttctggcagcgtgaggacaggacacatggagagagaccctttaaacctccttccaaggaagtcagttctccctggtccagagattgcaaagtgtaattatttttcaggagaaaaatactatttgtctgcgtttcttagttcgtctctgcacagatcttggattaaaagatgctcaagaatatgccagaaaactgaagaggttggaaaaaatgaaagaaataagggaacagcgcataaagtcaggcagagatggcagtgggggctcccgtggcaaaagagaaggaagtgctagcggtgatagtggccagaactatagtgccagtagtaaaggtgaacgactaagtgccagactcagagctttacctgggacaaatgaaccttatgaaagtagcagtaacaaagaaatagatgcctcctatgtggacccacttggccctcaaatagaacgaccaaaaactgcagccaagaaaaggatcgatgaggatgattttgctgatgaagaattaggagatgatttgcttccagaataatattcactttaatatttattaaaggaaagaaattgccttatgagatcatcctcatgttaaaccttggattaaatatctaacctgtaattattttttttcactgtcaaaacttaagtaagtgtattctattctgtatgtatgcatttaagttgtttttttcttttaaggaataaaaacaggtaaaact

SEQ ID NO: 2172 - DNA, 318 bp, Homo sapiens
ttgacctccaaacacatctacagttgctgaaccatgagctactacagaagctattatggaggcctgggctatggctatggaggctttggtggctggggctatggctatggctgcggctatggcagcttccgcaggttgggctatggctgtggctacggaggctatggattcagctgttgccgaccattatactacggaggatatggattctctgccttctactgaagagtgaactcattctttggatcactagaatctgtctatcatcctgacttaattctcctttcaggtctttttaccccctctgtgaattgcgca

SEQ ID NO: 2173 - DNA, 273 bp, Homo sapiens
ggctagagacttaaatcctgacacaatgagctactatggcaactactacggaggactgggctatggctatgactgtaaatatagttatacctctggctttggtgcctttagaatcctggactgtggctacagatgtggctgtggtggggtatggatttgactgctgccaccaatatgattatgctacatgcttattatcaggcactgactgaataatatctacaattgggtccattttcttatgagacaggggtgctgttctactacactttt

SEQ ID NO: 2174 - DNA, 224 bp, Homo sapiens
tccacaactgaaacatccacttctgaacaccatgtcctactacagccatctttctggtggcctgggctgcggcttggctgtggctgtgactatgggaaggactgtggctgtggctgagtatggcaggtgcagacatggctgccactcatcttactctgccaggtaatgacaccatggattccactgaggaacacctagagcagttcagtctactgcactcctcc

SEQ ID NO: 2175 - DNA, 293 bp, Homo sapiens
attgaactccatcttctgacaccatgtgctactaccacaactattatggtagcctggactatggttgcagctatggctctgaatatggtaactctggatatgcctgcaactttccgtgctcctatggaagattcctattggctcctagaaagaaattctgattgctgatcactttgagccattttcttgtgatgcactaattgcatcaacagggttatttatggattcgttattgtctctccaattttaactaactctaattattgattaccacaggtcatatttgcattgga

SEQ ID NO: 2176 - DNA, 682 bp, Homo sapiens
gaccatctttaaggatttttagcaatatgcctcatagccactgccattcactcaggagcttccacaatgccccaccactctctgccatcacacatggcactaatcctataacctttgaagacagattgtgtttgcccagcagcttccatagcagaacctgtttcctggacaactttcaagaaacctgcaatgaaaccaccagctgccaaatgaccaattgtgaacaggacttattcacagacgatagctgtgtgcaaagtaactgcttccccggagttgtccaaactacttactccaattccaggccctgcgaaaggacagcgtgccaatcagaaagttcttcagcagggctggcttgtgtttctcagccttgccaatcagaaagcactcagcagatgggttttgtagcccagagctgccaacctgcaagcctcaagggaaacagttgcccacccaagacttctaagtctaaaaatttcgaaactctggaacgtgcatctagccaatgtcagtgtcagtctcagaaccctgaatccagttcctgtagacctctggtcaatgttgcacctgagccacaactcctggaatcttctccaggagttgaaccaacttgctgtgttactggtggttctcaattgcctagtaagtgaagatctgtaggggagatggcttatattctcat

SEQ ID NO: 2177 - DNA, 1390 bp, Homo sapiens
agcatttgaagctgcagtcctgaaaaccatgcaggccggaagagtagataaagaaatatttatttgagatggcacatgtttcttcagaaactcaagatgtttcccccaaagatgaattaactgcttcagaagcctccactaggtctccattgtgtgaacacaccttccctggggactcagacttacggtcaatgattgaagaacatgcttttcaggttttgtcacaaggatccttgttagaaagtccaagttacacagtttgtgtctctgagccagataaagatgatgattttctttctctgaactttcccaggaaactttggaaaatagtggaaagtgaccaattcaagtctatttcatgggatgagaatggaacttgcatagtgattaatgaagaactcttcaagaaagaaattttggaaacaaaggctccttacagaatatttcaaactgatgctatcaaaagttttgttcgacagctcaacctttatggatttagtaaaattcaacagaattttcaaagatctgcctttctagccacctttctgtcagaagagaaagaatcgtctgtcttaagcaagcttcatgtctttgtgtttcaccacagtctatttggagcaacattcggagaacatcactttcagccatgccctttaccatctggtaacaaggctcccatttctacttggagtggagattcctggttgctgtgatgaaatgggatacactggggatccagctgcacaacttttcggaagcagcattcactgtggatttggtatattatgcagcttttggtgtcacaggctaaggtctgacaagattcaccatgcagttttctgggatagcagaaaatgaacatggatttggacagccagattcctcaggatggaaacctagtggtgccatctaaccatatacgtatatttccaagttgtgcataagtagaaaaagtttagaatccatcatctaaaaagggaatcctgatttcctttcctggcagaccatgacagaaagacaaaggtcatttcacctatatccacatgctattaactttttagttctcaaactgggttttcagaaggtagtgtgatagacatggttaaatggttaacaggaagaatgtttaaaaaaaaaattccggctggggtggtggctcaggcctgtaatcacagcattttgggaggccaagctgagtcaggagaatcgcttgaacccaggaggcggaggttgcagtaagctgagatcctgcttttgcgctccagcctgggtgacagagtaagacttcatcttaaagaaatccacaacaataaaaaggctaatgccagacacaataaaaaatgaaaagaataacttgggtgaacagcaaggcaagaaagaaaaaaggaaa

SEQ ID NO: 2178 - DNA, 1374 bp, Homo sapiens
agcatttgaagctgcagtcctgaaaaccatgcaggccggaagagtagataaagaaatatttatttgagatggcacatgtttcttcagaaactcaagatgtttcccccaaagatgaattaactgcttcagaagcctccactaggtctccattgtgtgaacacaccttccctggggactcagacttacggtcaatgattgaagaacatgcttttcaggttttgtcacaaggatccttgttagaaagtccaagttacacagtttgtgtctctgagccagataaagatgatgattttctttctctgaactttcccaggaaactttggaaaatagtggaaagtgaccaattcaagtctatttcatgggatgagaatggaacttgcatagtgattaatgaagaactcttcaagaaagaaattttggaaacaaaggctccttacagaatatttcaaactgatgctatcaaaagttttgttcgacagctcaacctttatggatttagtaaaattcaacagaattttcaaagatctgcctttctagccacctttctgtcagaagagaaagaatcgtctgtcttaagcaagcttcatgtctttgtgtttcaccacagtctatttggagcaacattcggagaacatcactttcagccatgccctttaccatctggtaacaaggctcccatttctacttggagtggagattcctggttgctgtgatgaaatgggatacactggggatccagctgcacaacttttcggaagcagcattcactgtggatttggtatattatgcagcttttggtgtcacaggctaaggtctgacaagattcaccatgcagttttctgggatagcagaaaatgaacatggatttggacagccagattcctcaggatggaaacctagtggtgccatctaaccatatacgtatatttccaagttgtgcataagtagaaaaagtttagaatccatcatctaaaaagggaatcctgatttcctttcctggcagaccatgacagaaagacaaaggtcatttcacctatatccacatgctattaactttttagttctcaaactgggttttcagaaggtagtgtgatagacatggttaaatggttaacaggaagaatgtttaaaaaaaaaattccggctggggtggtggctcaggcctgtaatcacagcattttgggaggccaagctgagtcaggagaatcgcttgaacccaggaggcggaggttgcagtaagctgagatcctgcttttgcgctccagcctgggtgacagagtaagacttcatcttaaagaaatccacaacaataaaaaggctaatgccagacacaataaaaaatgaaaagaataacttgggtgaacagcaaggcaa

SEQ ID NO: 2179 - DNA, 1586 bp, Homo sapiens
gtttccggttcgcctccggagccatggcggcggcactgaagtgtctactgacattaggaagatggtgccccggccttggagtggctccccaggcccgggcgctcgccgccttagtacccggagtgacccaggtagataacaagtccggtttcctgcagaagaggcctcatcgccagcaccctggcatcctaaagctgccgcacgtgcggctgccacaggcactggctaacggtgcccagttattgctacttgggagcgctgggcccactatggagaatcaggtgcaaacactgaccagttatctctggagcagacatttgcctgtagagccagaggagttgcaaagacgggctaggcatcttgagaaaaaattcctggaaaacccagacttatctcagacagaggagaaacttcgtggagcagtgctacacgcactacgtaaaactacctaccattggcaagaactgagctacactgagggactgagcctggtgtatatggcagcaagactggatggtggctttgcagcagtctccagagcattccatgagatccgggctcgaaatccagcatttcagccacaaactttgatggactttggctcaggtactggttctgtcacctgggctgctcacagtatttggggccagagcctacgtgaatatatgtgtgtggacagatcagctgccatgttggttttggcagaaaaactactgaaaggtggttcagaatctggggagccttatattccaggtgtctttttcagacagtttctacctgtatcacccaaggtgcagtttgatgtagtagtgtcagctttttccttaagtgaactgcccagcaaggctgaccgcactgaggtagttcaaaccttatggcgtaagacaggtcatttcctggtactggtggagaatggaacaaaagctgggcacagccttctcatggatgccagggatctggtccttaagggaaaagagaagtcacctttggaccctcgacctggttttgtctttgccccgtgtccccatgaactcccttgtccccagttgaccaacctggcctgtagcttctcacaggcgtaccatcccatccccttcagctggaacaagaaaccaaaggaagaaaagttctctatggtgatccttgctcgggggtctccagaggaggctcatcgctggccccgtatcactcagcctgtccttaaacggcctcgccatgtgcattgtcacttgtgctgtccagatgggcacatgcagcatgctgtgctcacagcccgccggcacggcaggtatggggggtgtgaccaaaatcagtgggatgtggcaggaagctgcagcccacgccagcatctgtttccacagggatttgtatcgttgtgcccgtgtcagctcctggggagatcttttacctgtgcttactccgtctgcgtttcctccatctacggctcaggatccctctgagagttgatgaggatgtgtaacaagtattttcttctatcgtgcctgccagggctgaagctgcctggtatccaggaggggaatgctggtatccccatatgtctgtgtttgtttgagatttttaataat

SEQ ID NO: 2180 - DNA, 1717 bp, Homo sapiens
gtgcggtgtggggcaccgggcggggccgcgggaaccggcgccccacggagctgctgctgtcagaccaaccccgggcccccatcatcactgcgccgcgctttcaggcgccgagaactaccgttcccggcatgccatgaaattggcctcggcgctgaggcggggtccggccctccacccgctcccgccgcgcgcgaatcgcggtcgcgagccatggaggaggaggcatcgtccccggggctgggctgcagcaagccgcacctggagaagctgaccctgggcatcacgcgcatcctagaatcttccccaggtgtgactgaggtgaccatcatagaaaagcctcctgctgaacgtcatatgatttcttcctgggaacaaaagaataactgtgtgatgcctgaagatgtgaagaacttttacctgatgaccaatggcttccacatgacatggagtgtgaagctggatgccagtgatgatcagccagagaagcctcactttgactctcgcagtgtgatatttgagctggattcatgcaatggcagtgggaaagtttgccttgtctacaaaagtgggaaaccagcattagcagaagacactgagatctggttcctggacagagcgttatactggcattttctcacagacacctttactgcctattaccgcctgctcatcacccacctgggcctgccccagtggcaatatgccttcaccagctatggcattagcccacaggccaagcaatggttcagcatgtataaacctatcacctacaacacaaacctgctcacagaagagaccgactcctttgtgaataagctagatcccagcaaagtgtttaagagcaagaacaagatcgtaatcccaaaaaagaaagggcctgtgcagcctgcaggtggccagaaagggccctcaggaccctccggtccctccacttcctccacttctaaatcctcctctggctctggaaaccccacccggaagtgagcacccctccctccaactccctaccagctccagagtggtggtttccatgcacagatggccctaggggtgacctccagttttgcgtgtggaccgtaggcctctttctagttgaatgaccaaaattgtaaggcttttagtcccaccgacattagccaggctcgtagtgaggcctccagagcaggttgtgctgtcccctgcctctggaagcaatggggaatttggaatcttgtgtaagtgcccaaataagtctgagtgctttcctcttcttcaacactcaaccctcaatcccttagcactgattgattagagaggtcccccaaagaaaccactggttttgacccatgaagcattagaactgcattgttcattcaggagccactagtcacatatgactatttaaatttaaagtaaattgtatgaaaaattcatttcttcaattgcattagccacattttgagtattcatgtggctggtagattctgtattagcacaaagatatggaacatttccatcaccacagaaagttctgttggacagcactgcattagaatattttcatactgctcttcctcaattaatttttgttgttaatgttgatgtcttcattggatgggtcataatgttccatgaaacctctcaagtacacaattgtatgttctttgtatcccttaccacaaatatctcgctctgctcatttcttttgcagcttcctataaagtttgtcttcctcatc

SEQ ID NO: 2181 - DNA, 2133 bp, Homo sapiens
ggctttcctggcaggcctggcgggggggccaggttgccatgacgaccgcggctaggtcgcggcagactcgagccatgggcagcaggaagaaggaaattgccctgcaggctggaatgcagcggcatgatctcatctcagtgcaacctccacctctcacgttcaagcagttctcatgtctcagcctcccgagtagctggtaaaacaggtcaacatcagcacccaagagctttgggaggaaatgctcagttccaaaggactaactgttgttgatgtctatcaaggctggtgtggcccctgcaaacctgtggtgagcctcttccagaagatgaggatcgaggtcggcctggaccttctgcactttgcattagcagaggcagatcgtcttgatgtcctcgaaaagtacagagggaagtgcgagccaacctttctgttttatgcaattaaagatgaggctctttctgatgaagatgaatgtgtttcccatggaaagaataatggtgaagatgaggacatggtttcatcagagaggacctgtaccttggccatcattaaaccagatgcagtggcccatggaaagactgatgagattatcatgaagattcaggaagctgggtttgaaattctaacaaatgaagagagaaccatgacagaggcagaagtgcgacttttctaccaacacaaagctggagaggaggcatttgagaagctggtacatcacatgtgcagtggaccaagccacctcctgatcctcaccaggactgagggcttcgaggacgtggtcactacctggcgaaccgtcatgggcccccgtgaccccaatgtggccaggagggagcagccagaaagtctccgagctcagtacggcacagaaatgcccttcaatgccgtccatggaagccgggacagagaagatgctgacagagaactggcattgctcttccccagtttgaaattttcagacaaagatacagaagcccctcagggtgagtccagtacacagccaaggttgaagatcactgacctagactaaaatgagaggattcagaagtctgaccttagaacatgagagagtggaaaacctcaggatgtttcagccaaacaagaagagaagaaaatattgttgaaattaacaatgatcagggaaaatatcatctattaagaacagggaaccacattttagctgtagattaggaatggtaatttttatctggtgttttagtttccaaaacatttacatattgatctactcctcgccctagaccaaacctaattccattcttactgatatgcacaatcactctctgtcctcattgtcacctctagcccctaaattcctccctttctcagtctacctactctttgtgactccctcatatcttttccccctggcatggatgtcctgctcagacactccacttagaagacagtttccctttttcactgtcctcccaccattcattactcctcctccagataccaactgctgatgttgctctagaaaaaccaccaaacatgactgttctttccgtgtaagctatcccacctcagcggcaccctcactgctggtgaccagccttgtaaccccctggagatgcccatgttccttatggtagctacctcttacttcaaattcttctgcctccctcatgctcgcagccactctgtgcccacctcatcttcgtagggaccttgattttggggacacacattgcaacttcccacttctgacgaaaggtctccatgcttttgctgttttctttactcttgtcaaggttgggtacttcaagctcaaagcctatctaccttgatccaaaaactacctttccataatgttctcacatctttactctgtcctacctctcattttcaatcctgtttaaaagacgtttaagtgtccaaactttaacctcttgaagctagtcctctccccactttccatctttaaatgggcatatatacaataaaggctctgtccatctccatctcttatatataacaatactgtgacttaaaaaccaactcagtattggaaattttctaaagttctgtcctagagttctttcctgacctctagctccatacttctgattgcctaataaatatgacatggatgttcagtggaacttcccatct

SEQ ID NO: 2182 - DNA, 521 bp, Homo sapiens; identical to SEQ ID NO: 1926

SEQ ID NO: 2183 - DNA, 2028 bp, Homo sapiens
gttcatttgctcgcgtgcaggggaagtctggagaaggcattgtttcaattattaaaagtgtgggggcagtgggcggaacaaacgcgccgactacagaggctggacgtaagcttagcggtggcgcgcgtgcgcagcgccggcccgagttgccaaaacaaaggggatttggtgatggaggctttgttagaaggaatacaaaatcgagggcatggtgggggatttttgacatcttgtgaagcagaactacaggagctcatgaaacagattgacataatggtggctcataaaaaatctgaatgggaaggacgtacacatgctctagaaacttgcttgaaaatccgtgaacaggaacttaagagtcttaggagtcagttggatgtgacacataaggaggttggaatgttgcatcagcaggtagaagaacatgaaaaaatcaagcaagagatgaccatggaatataagcaggagttgaagaaactacatgaagaattatgcatactgaagagaagctatgaaaagcttcagaaaaagcaaatgagggaattcagaggaaataccaaaaatcacagggaagatcggtctgaaattgagaggttaactgcaaaaatagaggaattccgtcagaaatcgctggactgggagaagcaacgcttgatttatcagcaacaggtatcttcactggaggcacaaaggaaggctctggctgaacaatcagagataattcaggctcagcttgtcaatcggaaacagaaattagagtctgtggaactttctagccaatcagaaattcaacacttaagcagtaaactggagcgggctaatgacactatctgtgccaatgagttggaaatagagcgcctcaccatgagggtcaatgacttggttggaaccagtatgactgtcctacaggagcagcagcaaaaagaagaaaaattgagggaatctgaaaaactattagaggctctgcaggaagaaaagagagaattgaaggcagctcttcagtctcaagaaaatctcatacatgaggccagaatacaaaaggagaagttacaagaaaaagtaaaggcaactaacactcaacatgctgtagaagctataaggccacgggaagaatctctggcagaaaagaagtacacctctcaagggcagggggacttagacagtgtgctctcccagttgaattttacccatactagtgaggaccttctgcaggcagaggtgacttgtcttgaaggcagtttggaatctgtgagtgcaacgtgtaaacagctgagccaagaactaatggaaaaatatgaagaactgaagaggatggaagcacataacaatgaatacaaagcagagattaagaagttgaaagaacagattttacagggtgaacaaagttacagttctgcactagaaggaatgaagatggaaatctcccatctaactcaggagttacatcagcgagatatcactattgcttccaccaaaggttcttcctcagacatggaaaagcgactcagagcagagatgcaaaaggcagaagacaaagcagtagagcataaggagattttggatcagctggagtcactcaaattagaaaatcgtcatctttctgaaatggtgatgaaattggaattgggtttacatgagtgttccttgcctgtatctccccttggttcaatagctaccagatttttggaagaggaggaactgaggtctcatcacattctagagcgcttggatgcccatattgaagaactaaaaagagagagtgaaaagacagtgagacaattcacagccttaaagtagcctcttaaaaaaatcactatcttggaaataaaaataaacaccaaagagttactgtcatctgaagtagcagctctttaaaaacatgaagagataaaattataaaaatgatacatctaaagcagtggtgaagaaagctgaaaaactgatacttttgataggcattttctctgcactggtttgtttaaaggacttcttccagcaataagttgaaagaataaaccactttgctag

SEQ ID NO: 2184 - DNA, 1476 bp, Homo sapiens; identical to SEQ ID NO: 1945

SEQ ID NO: 2185 - DNA, 1456 bp, Homo sapiens; identical to SEQ ID NO: 1946

SEQ ID NO: 2186 - DNA, 4073 bp, Homo sapiens
gccagctgctgcgcatgcgccggccggggccccgcccccatgcgccgcgcggctccagggccacgttccagggtcgggtttggtggattcctcagtccctgccgccgcggggcgccctgggatagcggcggggcctcctggtgagcgcgcgccggggcggcctccgggaagtgggagacgctgcgggtcctgggcccaggccttgggatgggcgggaaggcctggccgcgccgggctgtgggcactgcaggaggcccctgtgcaggtggagatcgccgcggccctggcgggactctttgctggctcttgggcgcgctgatgcccatcatctccctgagtttctgagccctatctctcatgtgtcagtggtcaccgccgaatccagacactccggccctgttccggaagagccctgatatccgtggctccatggcgctgtctgtcgataccatgcactctagctctcaaggaggaaaggttttgtggaagggaatagagacttggaataacagacctgtgctaattagagacgggaaagatggaacaaggggagtgacccttctccacccccatatcctaatgtgctctctctctatccagaacagatctcggcccctttccaaacactcctgatgcctcatttgcctctcgcttcttttcgaccaccattttgggggctgaggcactcacggggcctccccaggtttcactccgtttctacacagtcggagccccatggatctcccatctcccggaggaaccgtgaagccaaacagaagcgcctgcgagagaagcaggctactctggaggctgagatagcaggggagagcaagtcacctgcagaatccattaaggcctggaggcctaaggagttagtattgtatgaaatccctacgaaacccggtgaaaagaaagatgtctctgggcccctgcctcctgcatacagcccccgatatgttgaggctgcctggtacccgtggtgggtacgagagggcttcttcaaaccagaatatcaggcccggctgccccaagctacaggggagaccttttccatgtgtatcccacctcccaatgtcactggctccctgcacattggccacgcactcacggtggccatacaggatgccctcgtgcgctggcaccggatgcgtggggatcaagtgctgtgggtccctggttcagatcatgcaggaattgctacacaagctgtggtggagaaacaactgtggaaggaacggggagtgaggagacatgagctgagccgggaggccttccttagggaggtgtggcagtggaaggaggcgaaaggtggagagatctgtgagcagctgcgagctctgggtgcctccctggactgggatcgagagtgttttaccatggatgttggctcctcagtggctgtgactgaagcttttgtgcggctctacaaggcggggttgctgtaccggaaccatcagcttgtcaactggtcatgtgctttaagatcagccatctcggacattgaggtggagaaccggcccctgcctggccacacacagcttcgactgcctggctgccccacccccgtgtcttttggcctcctattttctgttgccttccccgtggatggagagcctgatgcagaggttgtggtaggaaccacaaggccagagacgctgcctggagatgtggctgtggccgttcatccagacgactcgcgatacacacatctacacgggcgacagcttcgtcaccccttgatggggcagcctcttcccctcatcacagactatgctgttcagccacatgtgggcacgggggcagtgaaggtgactccagctcacagtcctgccgatgctgagatgggggcccgacatggcttgagccccttgaatgtcattgcggaggatgggaccatgacctccctctgcggggactggttgcagggtcttcaccggtttgtggcccgggaaaagataatgtctgtgctgagtgaacggggcctattccggggcctccagaaccaccccatggtactgcccatctgcagccgttctggggatgtgatagaatacctgctgaagaaccagtggtttgtccgctgccaggaaatgggggcccgagctgccaaggctgtggagtcgggggccctggagctcagtccctccttccaccagaagaactggcagcactggttttcccatattggggactggtgtgtctcccggcagctgtggtggggccatcagattccagcctacctggttgtagaggaccatgcgcagggagaagaggactgttgggtggttgggcggtcagaggctgaggccagagaggtagcagcggaactgacagggaggccaggggcagagctgaccctggagagggatcctgatgtcctagacacatggttttcttctgccctgttccccttttctgccctgggctggccccaagagaccccagaccttgctcgtttctaccccctgtcacttttggaaacgggcagcgaccttctgctgttctgggtgggccgcatggtcatgttggggacccagctcacagggcagctgcccttcagcaaggtgcttcttcatcccatggttcgggacaggcagggccggaagatgagcaagtccctggggaatgtgctggacccaagagacatcatcagtggggtggagatgcagttgctgcaggaaaagctgagaagcggaaatttggaccctgcagagctggccattgtggctgcagcacagaaaaaggactttcctcacgggatccctgagtgtgggacagatgccctgagattcacactctgctcccatggagttcaggcgggcgacttgcacctgtcagtctctgaggtccagagctgccgacatttctgcaacaagatctggaatgctcttcgctttatcctcaatgctttaggggagaaatttgtgccacagcctgctgaggagctgtctccctcctccccgatggatgcctggatcctgagccgccttgccctggctgcccaggagtgtgagcggggcttcctcacccgagagctctcgctcgtcactcatgccctgcaccacttctggcttcacaacctctgtgacgtctacctggaggctgtgaagcccgtgctgtggcactcgccccgccccctggggccccctcaggtcctgttctcctgcgctgacctcggcctccgcctcctggccccactgatgcccttcctggctgaagagctctggcagaggctgccccccaggcctggttgcccccctgcccccagcatctcggttgccccctaccctagcgcctgcagcttggagcactggcgccagccagagctggagcggcgcttctcccgggtccaagaggtcgtgcaggtgctaagggctctccgagccacgtaccagctcaccaaagcccggccccgagtgctgctgcagagctcagagcctggggaccagggcctcttcgaggccttcttggagcccctgggcaccctgggctactgtggggctgtgggcctgttacccccaggcacagcagctccctccggctgggcccaggctccactcagtgacacggctcaagtctacatggagctgcagggcctggtggacccgcagatccagctacctctgttagccgcccgaaggtacaagttgcagaagcagcttgatagcctcacagccaggaccccatcagaaggggaggcagggactcagaggcaacaaaagctttcttccctccagctggaattgtcaaaactggacaaggcagcctctcacctccggcagctgatggatgagcctccagccccagggagcccggagctctaactcatcatccccatcagttttcctccctctcagacctgtctttgaggacaaacagatttgtcagctgtcagggtgcagtgggacgtcagagactatgtggtccatcgccttcattgtgtaaatgaggacacagactggcttggtcgcagtgactgtggtgtccttgagatgctcacattactgcccggcctgcctcccacctggaagtctgggaatgaggagattgagataaacttttgaaatcccaaa

SEQ ID NO: 2187 - DNA, 3247 bp, Homo sapiens
tcaggaatggagagaagggtaatggttttacctcttattgtggaaacctgttgagatcacagagaatatactgacggcataaaagggcagaaccatagcagggtgcgcgctgctgtagttgccttccatggatctataggagagcaagtcctccaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagggacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggacacgagagacttcctaaacaggtatccacggaagaagttctgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctaggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccccagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttccctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccgggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttctaagagactgttccaacggctctgggcctcagtggtcacttgaccaccattgtctcagagctgcccactttgtgtgtgtcacatgctgcctgagtcacatgtacatcttatttctgcctctagttttgtaagctcctggagggcggataacatcttatactactcttgtattctcatggcacctagtgcagtgctgggcacagagtaggtgctcaataaagacttgttgaatgaa

SEQ ID NO: 2188 - DNA, 2018 bp, Homo sapiens
ggcgggagtcgccggggctccttcctgtggtgcagcttcgggtctcggagtttggcccctactctgaccccaccccagctccgctccgccttgggttccggcagaacccgccttgcggtagccatggcagcaggctccgaggcgaccactcctgtgatcgttgcggctggggctggaggggaggaaggtgaacatgtcaaaccttttaagccagagaaagcaaaagaaattatcatgtctttacaacaacctgcaatcttctgtaacatggtgtttgattggccagcacgacactggaatgctaaatacctttcgcaggtccttcatggcaagcagatacgattcagaatggggatgaaaagcatgagcacagttcctcagtttgaaactacatgtaattacgtagaagctacactcgaagagtttctgacctggaactgtgaccagtctagtatttctggaccatttagagattatgaccattccaagttctgggcttatgctgactataaatattttgtcagtctatttgaagacaagacagatcttttccaggatgtgaaatggtctgacttcgggtttcctggaagaaatggacaggaaagtacattgtggattggctccttgggagcccacacaccctgtcatctggactcctatggttgtaacttggtattccaggtacaaggaaggctggagtgcaatggcatgatcatagctcctggacctcaagccatcctcctgccgcagcctctcaagtatctaggactacaggaaacgatggcatctctttcctcctgaagatactcctttcctttatccaactagaatcccttatgaagaatctagtgtgttcagtaaaatcaatgttgtcaatcctgatttaaagcgttttcctcagttccggaaagctcaaagacatgcggttacactgagcccaggacaggttctctttgttcccagacactggtggcattacgtagaatccattgatcctgtcactgtcagtataaactcatggattgaactggaagaggatcacctagcccgggtagaagaggcaatcacccgtatgcttgtgtgtgccctgaaaactgcagagaatccacaaaataccagagcctggttaaaccccactgaggttgaggaaacgtcccatgcagtcaactgttgctacttaaatgcagctgtttctgcattttttgatcgctgcagaacatctgaggtagtagaaatccaagcactgagaacagatggagagcacatgaaaaaggaagaattaaatgtgtgcaaccacatggaggtgggccaaacaggtagccagaacttgaccacaggaacagacaaaccggaggcagcaagtccctttggccctgatctggtccctgtagcacagaggtccgaagaaccgccttcagaaagaggaggcatatttggaagtgatgggaaagactttgtggacaaggatggagaacactttggaaaattgcattgtgccaagagacaacaaataatgagcaacagtgaaaatgcaattgaggaacagattgcctcaaatactactacgactcctcaaacattcatttctacggatgacttgctggactgcttggtgaatccacaagtaaccaggatagtggcacaacttttgatacaaggaagaagtttatgattcaagtggaagatgacttttaaaataatattttttaaatatatatttttaagtagtatgactaaaataaagatgaaccagcaaaaggtcagtttgcacatttgtaaatgtatttatccttaccgaattacatgtcagtctgttgccaccttctttcatgcacattcctctttggccaaactggctgctctttgtttgtaagcttttgttcctctctcatcccatacttttagcctgtgtcaaatgtaagtcccaagtatttccagcaggaagtaatgtcttcctcagcctcaaccagggaccaaccggctgcttacttttgcaaataaaattttactagaacacg

SEQ ID NO: 2189 - DNA, 2787 bp, Homo sapiens
ttgtacaggtagccaggtgtcggtctccagcctgagaactctggctgttgttccttgtgtcgtcccatattcctgcctggcctgcgatggacatcagcaagggcctcccaggcatgcagggaggcctccacatatggatctctgagaaccggaagatggtgccggtacccgagggggcttacgggaacttttttgaggaacactgctatgtcatcctccacgtcccccagagcccgaaggccacgcagggggcgtccagcgacctgcactactgggtcgggaagcaggcgggtgcggaagcgcagggcgctgcggaggccttccagcagcgcctacaggacgagctggggggccagaccgtgctgcaccgcgaggcgcagggccacgagtccgactgcttctgcagctacttccgcccgggaatcatctacaggaagggaggcctagcatctgacctcaagcatgtggagaccaacttgttcaacatccagcgactgctgcacatcaaagggaggaagcacgtgtctgccactgaggtggagctctcctggaacagctttaataagggtgacatcttcctgctggacctaggcaagatgatgattcagtggaatgggcccaagaccagcatttctgagaaggctcgggggctggctttgacctacagcctccgggacagggaacgtggtggtggtcgtgcacagattggtgtggtggatgatgaggccaaagccccggacctcatgcagatcatggaggctgtgctgggccgcagggtgggcagcctgcgtgccgccacgcccagcaaggatatcaaccagctgcagaaggccaatgttcgcctgtaccatgtctatgagaagggcaaagacctggtggtcctggagttggcgacccccccactgacccaggacctgctgcaggaggaggacttctacatcctggaccagggtggcttcaagatctatgtgtggcagggacgcatgtctagcctccaggagagaaaggctgccttcagccgggctgtgggcttcatccaggccaagggctacccgacctacaccaacgtggaggtggtgaacgacggcgccgagtcggccgcgttcaagcagctcttccggacttggtctgagaagcggcgcaggaaccagaagctcggcgggagggataaatcgattcatgtaaagctggacgtgggcaagctgcacacccagcctaagttagcggcccagctcaggatggtggacgacggctctgggaaggtggaggtgtggtgcatccaggacttacacaggcagcccgtggaccccaagcgtcatggacagctgtgtgcaggcaactgctaccttgtgctctacacataccagaggctgggccgtgtccagtacatcctgtacctatggcagggccaccaggccactgcggatgagattgaggccctgaacagcaacgctgaggaactagatgtcatgtatggtggcgtcctagtacaggagcatgtgaccatgggcagcgagcccccccacttcctcgccatcttccagggccagctggtgatcttccaggagagagctgggcaccatggaaaggggcagtcagcatccaccacaaggcttttccaagtgcaaggcactgacagccacaacaccaggaccatggaggtgccagcccgtgcctcatccctcaactccagtgacatcttcttgctggtcacagccagcgtctgctacctctggtttgggaagggctgtaatggtgatcagcgtgagatggcacgggtggtggtcactgtcatttccaggaagaatgaggaaacggtgctggagggtcaggagcctccccacttctgggaggccctgggaggccgggccccctaccccagcaacaagaggctccctgaggaggtccccagcttccagccacgactgtttgagtgctccagccacatgggctgcctggtcctcgcagaagtggggttcttcagccaggaggacctggacaagtatgacatcatgttactggacacctggcaggagatcttcctgtggcttggggaagctgcaagtgagtggaaggaggcggtggcctggggccaggagtacctgaagactcacccagcagggaggagcccggccacacccatcgtgctggtcaagcagggccatgagcctcccaccttcattggatggttcttcacttgggacccctacaagtggactagccacccgtcccacaaggaagtggtggatggcagcccggcagcagcatcaaccatctctgagataacagcagaagtcaacaacttgcggctatccagatggccgggcaatggcagggcaggtgccgtggccctgcaggccctcaagggctcccaggacagctcagagaatgatctggtgcgaagccccaagtcggctggcagcagaaccagcagctccgtcagcagcaccagcgccacgatcaacgggggcctgcgccgggaacaactgatgcaccaggctgttgaggacctgccagagggcgtggaccctgcccgcagggagttctatctctcagactctgacttccaagatatctttgggaaatccaaggaggaattctacagcatggccacgtggaggcagcggcaggagaaaaagcagctgggcttcttctgaacccaagccctctcgactgcccctatcccctggaccccaacatacctacaatgctggggaggccctgcttccactcccctcagaggcttttggtcatcctctgcgtgtcagtaaaagcaggcagcccata

SEQ ID NO: 2190 - DNA, 3138 bp, Homo sapiens
gctctctcctcctcctcctcctcttcctctctggtctcctccctcctccgggctgggttgcaaatggcttcgttccccgagaccgatttccagatctgcttgctgtgcaaggagatgtgcggctcgccggcgccgctctcctccaactcgtccgcgtcgtcgtcctcctcgcagacgtccacgtcgtcggggggcggcggcgggggccctggggcggcggcgcgccgcctacacgtcctgccctgcctgcacgccttctgccgcccctgcctcgaggcgcaccggctgccggcggcgggcggcggcgcggcgggagagccgctcaagctgcgctgccccgtgtgcgaccagaaagtagtgctagccgaggcggcgggtatggacgcgctgccttcgtccgccttcctgcttagcaacctgctcgacgcggtggtggccactgccgacgagccgccgcccaagaacgggcgcgccggcgctccggcgggagcgggcggccacagcaaccaccggcaccacgctcaccacgcgcacccgcgcgcgtccgcctccgcgccgccactcccgcaggcgccgcagccgcccgcgccttcccgctcggcacccggcggccctgccgcttccccgtcggcgctgctgctccgccgtcctcacggctgcagctcgtgcgatgagggcaacgcagcttcttcgcgctgcctcgactgccaggagcacctgtgcgacaactgcgtccgagcgcaccagcgcgtgcgcctcaccaaggaccactacatcgagcgcggcccgccgggtcccggtgccgcagcagcggcgcagcagctcgggctcgggccgccctttcccggcccgcccttctccatcctctcagtgtttcccgagcgcctcggcttctgccagcaccacgacgacgaggtgctgcacctgtactgtgacacttgctctgtacccatctgtcgtgagtgcacaatgggccggcatgggggccacagcttcatctacctccaggaggcactgcaggactcacgggcactcaccatccagctgctggcagatgcccagcagggacgacaggcaatccagctgagcatcgagcaggcccagacggtggcggaacaggtggagatgaaggcgaaggttgtgcagtcggaggtcaaagccgtgacggcgaggcataagaaagccctggaggaacgcgagtgtgagctgctgtggaaggtagaaaagatccgccaggtgaaagccaagtctctgtacctgcaggtggagaagctgcggcaaaacctcaacaagcttgagagcaccatcagtgccgtgcagcaggtcctggaggagggtagagcgctagacatcctactggcccgagaccggatgctggcccaggtgcaggagctgaagaccgtgcggagcctcctgcagccccaggaagacgaccgagtcatgttcacaccccccgatcaggcactgtaccttgccatcaagtcttttggctttgttagcagcggggcctttgccccactcaccaaggccacaggcgatggcctcaagcgtgccctccagggtaaggtggcctccttcacagtcattggttatgaccacgatggtgagccccgcctctcaggaggcgacctgatgtcggctgtggtcctgggccctgatggcaacctgtttggtgcagaggtgagtgatcagcagaatgggacatacgtggtgagttaccgaccccagctggagggtgagcacctggtatctgtgacactgtgcaaccagcacattgagaacagccctttcaaggtggtggtcaagtcaggccgcagctacgtgggcattgggctcccgggcctgagcttcggcagtgagggtgacagcgatggcaagctctgccgcccttggggtgtgagtgtagacaaggagggctacatcattgtcgccgaccgcagcaacaaccgcatccaggtgttcaagccctgcggcgccttccaccacaaattcggcaccctgggctcccggcctgggcagttcgaccgaccagccggcgtggcctgtgacgcctcacgcaggatcgtggtggctgacaaggacaatcatcgcatccagatcttcacgttcgagggccagttcctcctcaagtttggtgagaaaggaaccaagaatgggcagttcaactacccttgggatgtggcggtgaattctgagggcaagatcctggtctcagacacgaggaaccaccggatccagctgtttgggcctgatggtgtcttcctaaacaagtatggcttcgagggggctctctggaagcactttgactccccacggggtgtggccttcaaccatgagggccacttggtggtcactgacttcaacaaccaccggctcctggttattcaccccgactgccagtcggcacgctttctgggctcggagggcacaggcaatgggcagttcctgcgcccacaaggggtagctgtggaccaggaagggcgcatcattgtggcggattccaggaaccatcgggtacagatgtttgaatccaacggcagcttcctgtgcaagtttggtgctcaaggcagcggctttgggcagatggaccgcccttccggcatcgccatcacccccgacggaatgatcgttgtggtggactttggcaacaatcgaatcctcgtcttctaattgcatttcctaggtttctgtgtttggggtgtgtgtgcgtgtctctctctctctctctctctttctctttctctctctttttgaatttcaaagaagaaacagtctcagggaaatttcttttttcttttttttttttaaagagaacaagaaaagtacaacattgcttaagtcctacctcatctttatttttttacagatgaatgtacttatcttttctgcagggattgagcctgtgaagtgataatttctatctacctcataaatctttacatttccttctgcaacaggccctcttcccctcctcagtggagtttgcatttccctcttcccctgcgtggggcatgatatgcacaagcctggcatctgtatggctgggagggcactggatgtgtgtggtggggtgtattctgtagattgagccaaggaaacacaaaaaaaaactactaagtaaaaaaacaaaaaactata

SEQ ID NO: 2191 - DNA, 1479 bp, Homo sapiens
gtccgagacctggagcagccaccgccgcaatcatgacttcggggacctggtttttagagagtctagaatctgatgagagaacctgtgcttacttggtgtgtacctcttgaactgctttgcagccatcctcttccactgtctgcctttctgaaatcacaagtcaaactttatacctacagggcttgtgctggaaaagatgaaatggggaaaatggtgtcagtaattaacactgtggatacctcccatgaggacatgattcacgacgcccagatggactactatggcacccgcctggcaacctgctcatcagacaggtccgtcaaaatctttgatgtgcgcaatggagggcagatccttatcgccgacctcaggggtcatgagggtcctgtgtggcaagtggcctgggctcaccccatgtacggcaacatcctggcatcgtgctcctatgaccggaaagtcattatctggagagaggaaaacggcacctgggagaagagccacgagcatgcgggacacgactcctcagtgaactcggtgtgctgggccccccatgactacggcctgatcctggcctgtgggagctcggatggggccatctccctgctgacttacaccggggaaggccaatgggaagtaaagaagatcaacaacgctcacaccattggctgcaatgccgtcagctgggcccctgctgttgtacctggaagcctcatagaccacccatcggggcagaaacccaattacatcaagaggtttgcatcaggtggctgtgacaacctcatcaagctgtggaaggaggaggaggacggccagtggaaggaggagcagaagctagaagcgcacagtgactgggttcgagatgtggcctgggccccctccatcggcctgcccaccagcaccatcgccagctgctcccaggatggtcgtgtgttcatttggacctgtgatgatgcctcaagcaatacgtggtcccctaaattgttgcacaagttcaacgatgtggtgtggcatgtgagctggtccatcacagccaacatcctggctgtctctggtggagacaataaggtgaccctgtggaaggagtcagttgatgggcagtgggtgtgcatcagtgatgtcaacaagggccagggctccgtatcagcatcagtgacagagggccagcagaacgagcagtgacaagacaggtggggcctggctccccacccgccagctccaggactgccccttcctgggccaactaaccagacaactgggaagagcccccaactccaacaggattattttcccaggaggagttacagatgcagccacagattgatcatctgccttaacgtgatcggagatgctttgtaatctactgtccagctgaaagcactcatgttacgaggaagaaactacaagtgatgttcaaatctattttgggtcatttttatgtacctttgggttcaggcattatttggggggttttgtttccaa

SEQ ID NO: 2192 - DNA, 4834 bp, Homo sapiens
ttcttttttttttttgagacggagtctcgctctgtcacccaggctggggtgcagtggcgcgatcttggctcactgcaagctccgcctcccaggttcccgccattctcctgcctcagcctcccgagtagctgggactacaggcgcccgccatcacgcctggctaattttttgtatttttagtagagacggggtttcactgtgttagccaggatggtctcgatctcctgacctcatgatccatccacctcagcctcccaaagtgctgggattacaggcgtcagccaccgtgaccagcctgaaacaggagcaagttctaaactcaggctctagagtcagaaaaggtagagtcaggttctggatccaaaatggggcaagtcatgatcaggttctggaaccagaacaggcctcaagcctaggggctgagcagggtatcccctggcctgggagcagaggacttctggctgactgctgcccgcaacgttctcaagctggtggtgaagtctgagtggaagtcataccctattcaggcagtagaggaagaggcctcaggtaagtactgtggttacctccactctcccacccatttatcctccacccatccgcccttccacctatctgcccttctacctatctattcatccacgcacctactggttcatccacacatctgtgtatgattcacatctacccatctatccatccatccaccagccatccatccactcatccacccacgtattcacccactctctgatctaccgattcacccacccacccttccactcatccttccatcctcccacctgtcacccattgttaatctcgtcattcatctacctgatgtcagctccatactccccatccatctatccactccctgcctacctatccttccacagatccacctacccatctatctacctgctattccattctcccatctactacctatctgttcttcaggccatccactcatccattcttctgtcccaggtacttagacacttgtcttcccatccgtttgttagttgatccactcctcattcagccctcccatgggcctggcatgtagccgagcaccctggagagggcagactaagaagacatggtccgtccctgcctgtgaggagttcaggtctctgaggaggaggaagcagtgaaactgggctttacacatggcctgagaacagcttaggcctgaacataaggaacagcttggagtggaggggacacagaggaaccctcactatcatgcatgccaacccaaccactgcctgccctttcccttctggatttagctcgtgtctccaggctcctagtcctgtaatccagggacccatcagcgagggattcagggaagcagaggcagctctccaggaaggaggaaaatccctgcctcttccagagagactcccccattgctgtctcttgtgtgtgtcatgcacaaggaaggcttggttgtgtgccaggataaggggcacaagggcctcgggtgtggccagagaccccatgcttaagcttttatggtataggtcaggctgcaggggtttgagggcctcagttgtatatcagaatcttcagagcactgcgatgttcaggggtgagtcaggtctgtagatgtgcacggggtcttctgaagggtcagtttctgtaatcactttcaggtgtgtcagggccttgtgcagtaacagtgcacacagaagttagtgtttctgtgggctaagggttgtagctctgtatcaggattctgggagtgggtctggatttctggtgtgtggacttaagaagctgtgtcagacttgggggaggggcgttcatgtataactgggttcacataggccaagactcccaggtgcattttaggcagagcctcaggtgtgttagaggtcccaggggcagagaggctataggtgctgtcagaggccttggggacatttagggcagagcctcgagtgacaggtcctgggacagtgggagccaagggcaagtgctagagttgcagtgaatttagagcaaagcctcagctaagtgacacatcccagggcagtaggggatctatctaggttcgtgctgggcctcaggtaagtgacaggccttaggacaatgggggctgtggcatgcgtcaggttacctgccttgatatgggatcgtgacaggcccctccctatgtgcaggagacaagcagcccaagaaacaggagaaaaacccagtgttggtgtccccagagtttgtggatgaagctctgtgtgcgtgcgaggagtaccttagcaacttggcccacatggacatcgacaaggacctggaggccccgctgtacctcacccccgagggctggtccctcttcctccagcgctactaccaagtggtccacgaaggggcagaactcaggcacctcgacactcaggtccagcgctgtgaggacatcctgcagcagctgcaggccgtggtaccccagatagacatggaaggggatcgcaacatctggatcgtgaagccaggagccaagtcccgcggacgaggcatcatgtgcatggaccacctggaggagatgctgaagctggtgaacggcaaccccgtggtgatgaaggacggcaagtgggtggtgcagaagtatattgagcggcccctcctcatctttggcaccaagtttgacctcagacagtggttcctggtaactgactggaacccacttaccgtgtggttctaccgcgacagctatatccgcttttccacgcagcccttctccctgaagaacctggacaactcagtgcacctgtgcaacaactccatccagaagcacctggagaactcatgccatcggcatccactgcttccgccagacaacatgtggtctagccagaggttccaggcccacctgcaggagatgggtgccccaaatgcttggtccaccatcatcgtgcctggcatgaaggatgctgtgatccacgcacttcagacctcccaggacaccgtgcagtgtcggaaggccagctttgagctctatggcgctgacttcgtgttcggggaggacttccagccctggctgattgagatcaacgccagccccacgatggcaccctccacagcagtcactgcccggctctgtgctggcgtgcaagctgacaccctgcgcgtggtcattgaccggatgctggaccgcaactgtgacacaggagcctttgagctcatctataagcagcccgtcaccacttccccagcctccacaccaaggcccagctgccttctccccatgtactccgacaccagggccaggtcctcagacgacagcacagcaagctggtgggcactaaggccctgtcgaccacaggcaaggccttgaggactctacccacggctaaggtcttcatttccctcccaccgaaccttgatttcaaggtggcacccagcatcctgaagccaagaaaggtgggcctcgacctgtgactcacacccagtggacagtgctgagcacggggtcagggctggagggcacaggcagagggcagctcccaggctggctggcaccccaagggaagagctggtctccctcagaagccccttcctccacagacttctgatcatctccctcttctcccctcctttcacaccgaggctcctgctctcctgtgcctccgaggcccccagctggaagtgccttgttgcctctgccctttgaagtcggaacaattcctagcacctgtcggaaggtcaaggccaaaggcaaattcaaggccagactgtgacaaacccagggctgaggcctgccccatgaagaggctgagccccctgaaacccctgccccttgttggtacattccagaggcgcaggggcctgggggatatgaagctagggaagcccctgcttcgattccccactgcccttgtcctggatccaacaccaaataaaaagaaacaagtgaagtatttggggcttgactccattgctgttggagggtcaagagtggatggggcgaggccgtgtaccccagggtccacagcaagagcctgaggccatcagcagctcctccgtgcagcgaggcccagaattcccacctaaggacagacatggggcttcctatttagggactcccccagcatctccgatccaggggtggggagcgtgagccttcactttacagatgaagaaactgagtctgaaagaggaggcatggcttacccaagatcacgtggcagtgagtcgacgcagggacatattgccagaactgccgagcactgggagccccccaaccccagagaacaagccaagctagcagaatgacacctaccgggcataggaacgttaatgccatgagacaggggaaggaattggccttgcctaaacctcagcccttctgcagagggcatgggtctatcccttcttcagcaaggggccaaggtcacctaaaaatgaaacatccaataagccacacccacctgaagaaaagtgtggcactgcttagttgtagtgggttgaactgtggtcccctgaaaagagatgtctacttggaccctgtgaatgtgaccttatgtgggaaaagagtctttgtagctgggtatggtggctcacacctgttatcccagcactttgagaggccaaggcaggagatcgcttgagcccgcaagttcaagaccagtctgggcaacatggtgaaaccgtttctacagaaaattagctgggtgtggtggcacacacctgtagtcctagctactcgggaggcctaggtgggaggattacctgagcctgggaagatcaaaactgtggtgagctgtgatcacgccactgcgctctgagcctgggagacagagtgaaaccctaaatcaaaaaaaaaaaaaaa

SEQ ID NO: 2193 - DNA, 2335 bp, Homo sapiens
caagattcgagcctgagcggcctgggcgtctcgagaggtgagagagttggcggcgaggtctcggcggctaagcgagcgtcggcgactgtctctccgcgagaggaggcaagttggggtccaggctccaaagccggtggccgcgtaccgcggtggagccgctgtctttgaggtctgaggagagaacagagtctagctctttcacccaggctggagtgaagtggtgcaatctcagctcagtgcaacctccgccccctgggttcaagtgattctcctgcctcagcctccccagtagctgggattacagtgatatcctgagagaagatgggaaagggctgcaaggttgtggtttgtggattgttatctgtggggaaaactgcaattttggagcagctcctttatggaaatcatactattggaatggaagattgcgaaacaatggaagatgtatacatggcttcagtagaaacagaccgaggagtaaaagaacagttacatctttatgacaccagaggtctacaggaaggcgtggagctgccaaagcattatttttcatttgctgatggcttcgttcttgtgtacagtgtgaataaccttgaatcctttcaaagagtggagcttctgaagaaagaaatcgataagttcaaagacaaaaaagaggtagcaattgtggtattaggaaacaaaatcgacctttctgagcagagacaagtggacgctgaagtggcacagcagtgggcaaaaagtgagaaagtaagactgtgggaggtgactgttacagatcggaaaactctgattgaaccattcactttattagccagtaaactttctcaaccccagagcaaatcaagctttcctttgcctgggaggaaaaacaaagggaactctaattctgagaactaaaaatcagtaatttccacaattgtatgttgaatagtgattgcctttaagtgtctgtgaacatggagtaatattactatttaaaataggccatttgtatctacctttggtccttaggaaaattcctaaggaagtcaattaatgcactttagatgttaaaagtatttgggctaaggttattattgcctgatatgaaataatatattcttattctcattgtttgaaacctgtctttgaaattagcacctttgttatttatgttgtacttgtgaaaacagtaaaatagtttggatagttatgcaaatgcacctatgtgtaacttccccccaaccccaagctgtttcggaagatatcataatcattctgtgtaacattatgcaaacttctaagcccaaacatgactttgtttttaaaaagttcattaatctaatgtctaggattataaaacatttttttgtgtctaaattggacccaaaacattgaacagtttggggtagtaagctaaatttcatcttgtggagattttgctaaacagactaagacccatgatttagctttgctcaaattagaatgtttagcatgagttgaggtaccaggtagtgttaagtaggttcatcacgctctaaggccgttttttccttagccagacccctgttgatagaccagatacttgagggcaaactgtttgctcctcctcttgaaaatgattaggcacttaaggacagtaaagctgtattttctggaaggaagactgtatcttctggaatagttttctagaaaactagtcatatacaataaaagtatcaaaaatattgggctctaatttgatctgacttagatgtctgagtttgtgttgtttctctaaagattttggcaagactcaagcaatgtggctgactgtaactttattaatttaaaaggtaggaagtaagctacttagtggtttcacctgtgaaataactattttgactgaaatgtaaaataagctattcaacaaagaacatattaaaacatcaagtaatttgtaacatcttaaatggaatacttttttcatgagctctagtgaagaactactacatataaaagacgatacttacaaatcagctattgctgctacagtataattcttcaaaatttctcatcataaattcattttttggtaaaaaaaaattaccagacactaactcacccccttacccttttcccccggttattgaatattaatctagcttcccacccatgcatgttacatagatggacaaatgctttcataatgatttttaaataagtaccttccagtttgctttgtttcctactaatgcaacttagtctatattagtacaaacagttaccaattctttttaaattctgtaatgaatgtatgtgtatccagataagtttctctgaaagagacatacagaaacagaactgctgggtc

SEQ ID NO: 2194 - DNA, 2397 bp, Homo sapiens
ctatgagcagacgtgtggttcggcaaagcaagttccgccatgtgtttgggcaggcagcaaaggccgaccaggcctacgaggacatccgtgtgtccaaggtcacatgggacagctccttctgtgccgtcaaccccaaattcctggccattattgtggaggctggaggcgggggtgccttcatcgtcctgcctctggccaagacagggcgagtggataagaactacccactggtcactgggcacactgcccctgtgctggatattgactggtgtccacacaatgacaacgttatcgccagtgcctcagacgacaccaccatcatggtgtggcagattccagactatacccccatgcgcaacattacggaacctatcatcacacttgagggccactccaagcgtgtgggcatcctctcctggcaccctactgccaggaatgtcctgctcagtgcaggtggtgacaatgtgatcatcatctggaatgtgggcaccggggaggtgctgctgagcctggatgatatgcacccagacgtcatccacagtgtgtgctggaacagcaacggtagcctgctagccaccacctgcaaggacaagaccttgcgcatcattgaccccagaaaaggccaagtggtggcggagaggtttgcggcccacgaggggatgaggcccatgcgggccgtcttcacgcgccagggccatatcttcaccacgggcttcacccgcatgagccagcgagagctgggcctgtgggacccgaacaacttcgaggagccagtggcactgcaggagatggacacaagcaacggggtcctattgcccttttacgatcccgactccagcatcgtctacctgtgtggcaagggcgacagcagcattcggtactttgagattaccgacgagccgcctttcgtgcactacctgaacacgttcagcagcaaagagccgcagcggggcatgggtttcatgcccaaaaggggactggatgtcagcaagtgtgagatcgcccggttctacaagctacacgaaagaaagtgtgaacctatcatcatgactgtgccccgcaagtcagacctcttccaggacgatctgtacccggatacgccaggcccggagccggccctagaagcggacgaatggctatccggccaggacgccgaacccgtgctcatttcgctgagggacggctatgtgccccccaagcaccgcgagctccgggtcacgaagcgcaacatcctggacgtgcgcccgccctccggcccccgccgcagccagtcggccagcgacgcccccttgtcgcagcagcacaccctggagacgctgctggaagagatcaaggccctccgcgagcgggtgcaggcccaggagcagcgcatcacggctctggagaacatgctgtgcgagctggtggacggcacggactagccccgcgcgccaggcaggcggagcggggcggggcgcacaagctcggccccgccccggcttttagtcccgaactccggaccccgccttcttgggctgggcccgggggcgggactggggagggaactccgcccctcgcgggagaccagaactcttggagcttaggggagacccacgtcgctccagcggaggctggactgcgagcctcgtctgggactcggctggagctggcctagggaggcctggggtaacctggggggctcagcaatggtgctgcacggcgaggtggtgtccccctttgtcctccgcccagggcagggaaagtgcttagtattagcgtgatgcttggggttattggagcctgagcttgacctcaaacgggtggcgatttgatgggtacccccaggctggggaaaatgacagcgcttctcctaatcagctcactggattccatcaccctgagcggtaaaccagatgggcgtcaccccagttctgcagacacatacacaacccgtttgctgcagagccggacccagtggctacacccacagcggtctgtggtagagaactctcttccttctttccaccgacaggggcgagggctgcttcctcgcggcagcccccgcgaagaaatctcgagagaactggcatgaggagttaggttcatcacaaatacacacacactgcccccaaccctctgccgttgcctctctcagaaaaacaagacgtactgaatgaaatattttactaagcgttcagtctgtgcctcctgcatgggtgggagtgaggggaacgagacccccagcctctgcaaatgctacccccaggctcctgggagacctggcgatgcactcctgggctcagggtccatcaggcagcctcttaccctagagctctctccactctgaggttcagaaggaccccaacccacaccgtaggcgttccccccaagtaaagttaggtagcaaaagcctccggt

SEQ ID NO: 2195 - DNA, 2963 bp, Homo sapiens
gggtgacgcaggcgcagcgcgggctgcgcgcgctactgcccatccccggttgtcccacttttgttcgcctctcttcggccctctactcaagagctccgtctccgtctcgccctcctcgaagtcctcgtcgcgcgcccgcgacccaggtcgccctgaaatctagcccgtccgagcgcgagtccaacgccgcggccgcaccaaggccccctcagaccgtgccatgggtgacagtgatgacgagtacgatcgaaggcgcagggacaagttcagaagagagcgcagcgactacgaccgttcccgcgagagagatgaaagacgtcgaggggacgattggaatgacagagagtgggaccgtggccgtgagcgccgtagtcggggtgaatatcgggactatgaccggaatcggcgagagcgcttctcgccacctcgccacgaactcagcccgccacagaagcgcatgaggagagactgggatgagcacagctctgacccataccacagtggctatgagatgccctatgctggggggggtgggggcccaacttatggcccccctcagccctggggccaccctgacgtccacatcatgcagcaccatgtcctgcctatccaggccaggctgggcagcattgcagagattgacctgggtgtgccgccgcccgtgatgaagaccttcaaggagtttctcctctccctggatgactcggtggatgagacggaggccgtcaagcgctataatgactacaagctggatttccggaggcaacagatgcaggatttcttcctggcgcacaaagatgaggagtggtttcggtctaagtaccacccagatgaggtggggaagcgtcggcaggaggcccggggggccctgcaaaaccgactgagggtcttcctgtccctcatggagactggctggtttgataaccttctcctggacatagacaaagctgatgccattgtcaagatgctggatgcagccgtgattaagatggaaggaggcacggagaatgatcttcgcatcctggagcaggaggaggaggaggagcaggcaggaaagcctggggagcccagcaagaaagaagaaggacgggctggagcaggcctaggggacggggagcgcaaaaccaacgacaaggatgagaagaaggaagacggcaagcaggctgagaatgacagttctaatgatgacaaaacaaagaagtcggagggtgatggggacaaggaagagaagaaagaagactccgagaaggaagccaaaaagagtagcaagaagcggaaccggaagcacagtggtgacgacagctttgacgagggcagcgtgtcagagtctgagtcggagtcagagagcggccaggctgaggaggagaaggaggaggccgaagcgctcaaggagaaggagaagcccaaggaagaagaatgggagaagcccaaggacgccgcggggctggagtgcaagccgcggccgctgcataagacctgctccctcttcatgcgcaacatcgcgcccaacatctcccgggccgagatcatctccctttgtaaaaggtacccaggctttatgcgggtggcgctctcagagccccagccagagaggaggtttttccgtcgtggctgggtgaccttcgaccgcagtgttaacattaaagagatctgttggaacctgcagaacatccgtctccgggagtgtgagctgagccctggtgtgaacagggacctgacccggcgcgttcgcaacatcaacggcatcacccagcacaagcagattgtgcgcaacgacatcaagctggcggccaagctgatccacacgctggatgacaggacacagctttgggcctcagaaccagggacgcctcccctgcccacgagcctgccctcgcaaaacccgatcttgaagaatatcaccgactacctgatcgaggaagtaagcgccgaggaggaggagctgctggggagcagcgggggcgctcctcctgaggagcctcctaaggaagggaacccggcagagatcaacgtggagcgggatgagaagttgattaaggtcttggacaagctcctcctttacctgcgcatcgtgcattccttggattattacaacacctgtgagtaccccaacgaggacgagatgcccaatcgctgtgggatcatccacgttcgggggcccatgccacccaaccgcatcagtcacggggaagtgctggagtggcagaagacttttgaggagaagctcacgccgttgctgagtgtgcgggagtcactctcagaggaagaggcccagaagatggggcgcaaagacccagagcaggaagtggagaagttcgtcacctccaacacgcaggaactgggcaaggataagtggctgtgtcctctcagtggcaagaaattcaagggtcctgagtttgtgcgcaaacatatcttcaacaagcatgcagagaaaattgaggaagtgaaaaaggaagtcgcgttttttaacaacttcctcactgatgctaagcgcccagctctgcctgagatcaagccagcccagccacctggccccgcccagatactccccccaggtttgaccccaggactcccctacccacaccagactccccagggcctgatgccctatggtcagccccggcccccgatcttgggctatggagctggtgctgtccgccctgcagtccccacaggaggccctccatacccccatgccccgtatggtgctggtcgagggaactatgatgccttccgaggccagggaggttatcctgggaaacctcgcaacaggatggttcgtggagacccaagggccattgtggaatatcgggacctggatgccccagacgatgttgatttcttttgagccgtcccccgttcctcagtcctgtatcatccatacttgtactaccttgtcctatgaagctctgagaattttttgtacgatcagccttactgctaataaaagcacttccacaggg

SEQ ID NO: 2196 - DNA, 826 bp, Homo sapiens
ctcagcgaagatggcggcagtggagaagcggcggcaagcggtaccaccgccggccggtttcacggacagcggccgccagtcggtatcccgggcggcgggggcggccgagagcgaggaggacttcctgcggcaggtcggcgtgacggaaatgctacgtgcggccctgctgaaggtgctggaggcgcggcccgaggagccgatcgccttcctggctcactacttcgagaacatgggcctgcgctcgcctgtaaacggcggcgccggggagcccccgggccagctcctgctgcagcagcagcgcctgggccgcgcgctatggcaccttcgcctggcccaccactcccagagggccgccttcaacaacaacgtgagcgtggcctacgagtgcctgagcgccggcgggcgcaggaagaggccggggctggacgggcgcacctacagcgagctgctcaggcgcatctgccgggacggccaagcccccgaggaggtggtggcgccgctgctgcgcaaggtgcagtgccgtgaccacgaggcggtgccgctgagcgtcttccgcgcgggcacactcacctgcttcgtgctgctggagttcgtggcgcgcgccggcgcgctcttccagctgctggaggactcggccgccgccgtggccgaccgccgcgtgggccaggccgtgctggacaccctggagggcgcgctgcaggccagcgacgccgccgcgcccgcgcgcttcctggaggccggctcgcgcttggcgcccatgacccgcgaggagtttctggagagggccgccgcgctcttcatcgcgaaggtcaagccggtgggctga

SEQ ID NO: 2197 - DNA, 2429 bp, Homo sapiens
gctgattgcccgcctgcccgtgggtcatggcctgccagcagtcgcggtaccacagcttctcgtccgcgtcgaggtaggcgctggcagggatgagggcagagatgagggtttgagtacttctagagagggaaatggcacttgatccggacctctgcacctcctgctggcctctgaccattgatctagggctccagcaccacagagtcaatggttagaatcgggctgatttagcccagtgaagacgttacgtgctagcaaaacgattacagccacggccttcaggagtgaccatagacgaatcctttctcacagaagacaagagcacccagaatcgcaagcttcttcagaaacgaaggacgctgactggtcagttctccatgggtgggcacctgtccccatggcccacatacaccagtggccagaccattttgcaaaatcgaaaaccctgttcagatgactaccggaagcgagtagggagctgccagcagcacccctttcgcactgccaagccccagtacttggaggaactggaaaactacctacgcaaggagctcctcctgctggacctgggcacagattccacccaggaactaaggctgcagccttacagagagatctttgagttcttcatagaggacttcaaaacgtacaagccattactatcctccatcaagaatgcgtatgaggggatgctggcccaccaaagggagaagattcgggctctggagcccctgaaggccaagcttgtcactgtgaatgaggactgcaatgagaggatcctggccatgagagctgaggagaaatatgaaatctccctgctcaagaaagagaagatgaacttgctaaaactcatcgacaaaaagaatgaggagaagatttcattgcagagcgaggtgaccaaactgaggaagaacttggctgaggagtacctgcactacctcagtgagcgagatgcctgtaagatcctcatcgcagacctgaatgagctgcggtaccagcgggaggacatgtcattagcccagtcgccaggcatctggggggaggaccctgtgaagttaaccctggctcttaagatgacccggcaagacctgacccgcacgcagatggaactcaacaacatgaaggccaactttggagatgtggtccccaggagggactttgaaatgcaggagaagaccaacaaggatcttcaggagcagctggacaccctgagagccagctacgaggaggttcgcaaggagcatgagatcctcatgcagctgcacatgagcacgctgaaggaacgggaccaattcttctctgagctgcaggagatccagcgcacttccacgccgcggcctgactggaccaagtgcaaagatgtggtggctgggggcccagagcgctggcagatgctggctgagggcaagaacagcgaccagctggtggacgtgctcctggaagagattggttcggggctgctgcgggagaaagacttcttccctggtctgggctatggggaagccatccctgcttttcttcggtttgatggcctcgtggagaacaagaagccaagcaagaaggacgtggtcaacctcctcaaggatgcctggaaggaacgtcttgctgaggagcagaaagagacgttcccagatttcttcttcaatttcctggagcatcgctttgggcccagtgatgccatggcctgggcttatactatttttgaaaatatcaagatcttccactccaacgaggttatgagtcagttctatgcagtcttgatgggaaagcggagtgagaatgtgtatgtcacccagaaggagacagtagcccagctgctgaaggagatgacaaatgctgacagtcagaacgaggggctactaaccatggagcagttcaacactgtcctcaagagtaccttccctctcaagacagaagagcaaatccaggagctgatggaggcagggggctggcatcccagcagcagcaatgcagacttgctcaactaccgctcactgtttatggaggatgaggagggccagagtgagccctttgtgcaaaaactctgggaacaatacatggatgagaaggacgagtacttacagcagctaaagcaggagcttggcatagaactccatgaggaagtgactctgcccaagctgcgagggggcctgatgaccatcgaccccagcctggacaagcagacagtgaacacctacatgagccaggccttccagctccctgagtcggaaatgccagaggagggtgacgagaaggaagaagccgtggtggaaatcctccagactgccctggagcggcttcaggtgattgacatcaggcgtgtgggacctcgagagccagagcctgcaagctaggaacttgtgggcagcctgcgtactccagtcctgctaacccctagcttttaatataaaagtgtttgtctgaatcca

SEQ ID NO: 2198 - DNA, 1287 bp, Homo sapiens
atggagccgctgaaggtggaaaagttcgcaaccgccaagaggggaaacgggctgcgcgccgtgaccccgctgcgccccggagagctactcttccgctcggatcccttggcgtacacggtgtgcaaggggagtcgtggcgtcgtctgcgaccgctgccttctcgggaaggaaaagctgatgcgatgctctcagtgccgcgtcgccaaatactgtagtgctaagtgtcagaaaaaagcttggccagaccacaagcgggaatgcaaatgccttaaaagctgcaaacccagatatcctccagactccgttcgacttcttggcagagttgtcttcaaacttatggatggagcaccttcagaatcagagaagctttactcattttatgatctggagtcaaatattaacaaactgactgaagataagaaagagggcctcaggcaactcgtaatgacatttcaacatttcatgagagaagaaatacaggatgcctctcagctgccacctgcctttgacctttttgaagcctttgcaaaagtgatctgcaactctttcaccatctgtaatgcggagatgcaggaagttggtgttggcctatatcccagtatctctttgctcaatcacagctgtgaccccaactgttcgattgtgttcaatgggccccacctcttactgcgagcagtccgagacatcgaggtgggagaggagctcaccatctgctacctggatatgctgatgaccagtgaggagcgccggaagcagctgagggaccagtactgctttgaatgtgactgtttccgttgccaaacccaggacaaggatgctgatatgctaactggtgatgagcaagtatggaaggaagttcaagaatccctgaaaaaaattgaagaactgaaggcacactggaagtgggagcaggttctggccatgtgccaggcaatcataagcagcaattctgaacggcttcccgatatcaacatctaccagctgaaggtgctcgactgcgccatggatgcctgcatcaacctcggcctgttggaggaagccttgttctatggtactcggaccatggagccatacaggatttttttcccaggaagccatcccgtcagaggggttcaagtgatgaaagttggcaaactgcagctacatcaaggcatgtttccccaagcaatgaagaatctgagactggcttttgatattatgagagtgacacatggcagagaacacagcctgattgaagatttgattctacttttagaagaatgcgacgccaacatcagagcatcctaa

SEQ ID NO: 2199 - DNA, 1235 bp, Homo sapiens
gcgggcgctgcggcccctgctctacctcctagcgccggtgcgcggccgaggccgcactacctgtctgcgggaaagcgggatccaccccaggacgtcgggtcgctgccgacataatgtcaagtggaaactatcagcagtcagaggctcttagcaaacccactttcagtgaggaacaagcctctgcgttagtggagtcagtgtttgggttgaaagtttccaaggtccggccacttcctagctatgatgaccaaaactttcatgtctacgtttcaaaaaccaaagatggcccaactgaatatgtcctcaaaataagcaacaccaaggctagcaaaaatccagacctgattgaagtgcagaatcacatcatcatgtttctgaaagccgctggatttccaacagcctctgtgtgtcacactaaaggagacaacacagcttctctcgtgtctgtagatagtggctctgaaatcaaaagctacttggtgaggctgctgacttacctcccaggaagacccatcgctgagcttcccgtcagcccccagctattgtatgaaattggaaaactagctgccaaattggataagacactgcagagattccatcacccaaagttaagtagtcttcatcgggagaacttcatctggaatctgaaaaatgttcctcttctggagaaatacctgtatgccctgggccagaatcgaaaccgagagattgttgagcatgtcattcatctgttcaaggaggaagtaatgaccaaattaagtcattttcgagaatgtatcaatcacggagatcttaatgaccataatattttaatagagtccagcaagtcagcctctggaaatgctgaatatcaagtgtctgggattttagactttggtgacatgagctatggctactatgtgtttgaagtggcaattaccatcatgtacatgatgattgagagcaagagtcctatacaagtaggaggccatgtccttgcagggtttgaaagcatcaccccactgacagctgtagagaagggtgctttgtttttacttgtatgcagtcgtttttgtcagtcacttgtcatggctgcatactcttgccagctatacccagagaacaaagactatctcatggttactgcaaaaaccgggtggaaacacttacagcaaatgtttgacatgggtcagaaagctgtagaagaaatctggtttgaaactgccaaatcctatgaatctgggatctccatgtga

SEQ ID NO: 2200 - DNA, 2766 bp, Homo sapiens
atggctttgctgtgtggccttgggcaagtcactctgcgtatctgggtttcacttccttcccaatccgaaaacgggattgggagcggcggcatggaggctctcaccactcagctggggccggggcgcgagggcagttcctcgcccaactccaagcaggagctgcagccgtactcgggctccagcgctctcaaacccaaccaggtgggcgagacgtcgctgtacggggtgcccattgtgtcgctggtcatcgacggccaggagcgcctatgcctggcgcagatctccaacaccctcctcaagaactacagctataatgagatccacaaccgccgcgtggccctgggcatcacgtgcgtgcagtgcacgccggtacagctggagattctgcgtcgggccggggccatgcccatctcgtcgcgccgctgcggcatgatcactaagcgagaggccgaacgcctgtgcaagtcgttcctgggcgagcacaaaccacccaagctgcccgagaacttcgccttcgatgtggtgcacgagtgcgcgtggggctcgcgtggtagcttcatccctgcgcgttacaacagctctcgtgccaagtgcatcaagtgcggctactgcagcatgtacttctcgcccaacaagttcatcttccactcgcaccgaacacccgacgccaagtacacgcagcccgatgccgccaacttcaactcctggcgtcgtcacctcaaactcagtgacaagtcggccacagacgaactgagccatgcttgggaggacgtcaaggccatgtttaatggcggcacgcggtgcggtgcagagatggccccaggcccgccgccccacaaaagcctgcgctgtggcgaagatgaggctgccgggcctccggggccacctccaccccacccgcagcgcggacttggcctggcgactggagctagtggcccggcgggcccaggagggcccggtggcggcgccggcgtacgaagctacccggtgatcccggtgcccagcaaaggctttgggctcctgcaaaagctgcccccaccacttttcccccatccttacggcttccctacggccttcggcctatgccccaaaaaggacgacccggttttaggcgcgggcgagccaaagggcggtcctggcactgggagcggcggcggcggcgcggggacaggcgggggtgcggggggcccgggagccagccacttgcccccgggggcaggggcgggcccgggcggcggcgccatgttctgggggcatcaaccctccggggcagccaaggacgcagcggcagtggctgcagcggccgccgccgccactgtgtacccgacgtttcccatgttctggccagcagcaggcagcctcccggtaccgtcctaccccgctgctcagagccaagccaaggccgtggcggcagccgtggcggcggcagcggcggcggcagcggcagctgctggcagcggtgccccagagcccctggacggtgccgagccagccaaagagagtggcctcggcgcggaggagcgctgcccgagcgctctgtcccgcgggcccctggacgaagacggcacggacgaggcgctgccaccgcccctggccccgttgcccccgccgcccccgccgcccgcacgcaaaggctcctacgtgtcggccttccggccggtggtcaaggacaccgagagcatcgctaagctctacgggagcgcccgggaggcgtacggcgcggggcctgctcgggggccgggacccggcgctgggagcggcggctacgtgagcccggactttctgagcgagggcagctccagctacaattccgcctcgcccgacgtggacaccgcggacgagcccgaggtggacgtggaatccaaccgcttccccgacgacgaggacgcccaagaggagaccgagcccagcgcacccagcgcagggggcggcccagacggtgaacagcccactggacccccttccgccacctcctctggcgcggacggtcccgcaaactctcccgacggcggcagcccccgcccccggcgccgcctcgggccacccccagctggccggcccgcatttggggacttggcagccgaagacttggtgcggagacctgagaggagcccgccaagcggcggcggcggctacgagctgcgagagccttgcgggcccctaggaggccccgcgccggccaaggtgttcgcgcccgagagggatgagcacgtgaagagcgcggcggtggcgctggggcccgcggcctcctacgtctgcacccccgaggcccacgagccagataaggaagacaatcactcgcccgccgatgatttggaaacgaggaaatcctatccagaccaaaggagtatctcccagccaagtcctgcaaatacagacagaggcgaagatgggcttaccttggatgtcacaggaactcatttggtggagaaagatatcgagaacctggccagagaggaattgcaaaaactgctcctggaacaaatggagctccgcaagaagctggaacgggaatttcagagtctcaaagataattttcaggatcaaatgaagagggaattggcttatcgagaagaaatggtgcaacagctgcaaattgtcagagataccctgtgtaacgaactcgaccaggagcggaaggcgcgctatgccatccagcagaaattgaaagaagcccacgacgccctgcaccatttctcctgcaagatgctgacgccccgccactgcactggcaactgctccttcaagccaccgctgttgccctag

SEQ ID NO: 2201 - DNA, 5068 bp, Homo sapiens
gagagttcagggaggccgccctgagattccggcgaggccgcgggtcccacctcccgggggcggggcgagggcggagcggggagaagggagctgacgggcgcccggccggctgcggtccgtgcggaggctgagccggccgcgggcgcgaccggaggcagtttccgttactatggcaatgacggcagggactacaacaacctttcctatgagcaaccatacccgggaaagagtgactgtagccaagctcacattggagaatttttatagcaacctaattttacagcatgaagagagagaaaccaggcagaagaaattagaagtggccatggaagaagaaggattagcagatgaagagaaaaagttacgtcgatcacaacacgctcgcaaagaaacagagttcttacggctcaaaaggaccagacttggcttggatgactttgagtctctgaaagttataggaagaggagcttttggagaggtgcggttggtccagaagaaagatacaggccatatctatgcaatgaagatattgagaaagtctgatatgcttgaaaaagagcaggtggcccatatccgagcagaaagagatattttggtagaagcagatggtgcctgggtggtgaagatgttttacagttttcaggataagaggaatctttatctaatcatggaatttctccctggaggtgacatgatgacattgctaatgaagaaagacaccttgacagaagaggaaacacagttctacatttcagagactgttctggcaatagatgcgatccaccagttgggtttcatccatcgggatattaagccagacaaccttttattggatgccaagggtcatgtaaaattatctgattttggtttatgtacgggattaaagaaagctcacaggactgaattttatagaaatctcacacacaacccaccaagtgacttctcatttcagaacatgaactcaaagaggaaagcagaaacttggaagaagaacaggagacaactggcatattccacagttgggacaccagattacattgctccagaagtattcatgcagactggttacaacaaattgtgtgactggtggtctttgggagtgattatgtatgaaatgctaataggatatccacctttctgctctgaaacacctcaagaaacgtacagaaaagtgatgaactggaaagaaactctggtatttcctccagaggtacctatatctgagaaagccaaggacttaattctcagattttgtattgattctgaaaacagaattggaaatagtggagtagaagaaataaaaggtcatcccttttttgaaggtgtcgactgggagcacataagggaaaggccagcagcaatccctatagaaatcaaaagcattgatgatacttcaaattttgatgacttccctgaatctgatattttacaaccagtgccaaataccacagaaccggactacaaatccaaagactgggtttttctcaattatacctataaaaggtttgaagggttgactcaacgtggctctatccccacctacatgaaagctgggaagttatgaatgaagataacattcacccataaccaagagaactcaggtagctgcatcaccaggcttgcttggcgtagataacaatacactgaaatactcctgaagatggtggtgcttattgactacaagaggaaattctacaggattaggatttctaagactactataggaattggttggcagtgccagctggctcttttttttaatattttattatttttgttaactttattatatgaaggtactggaataaaaggaacagacatccctttctaactgcactgcctacatgcgtattaaggtccattctgcctgtgtgtgctgtggctttgaactgtaacacctctaatcaattcaggagaaacacatatcatttaaagcaacataggctaacctgtaggtaacactgcagtattgatgttttactgcaaatcttatgggtctagataatcagtaaaagccatcttccatagttggtgttagaacattgccctattggtttggacatctgtagaatatatatgaagacaatttctgtaatggttttaagagatttaaaaagaaattcactggttctttacaaaatagaatttatcatcaagttattacacaaacttcacagtaaggagtgacaagtttataataaggaagacaaagtttaacaccttcactcaagcactccactaatatatttacgttgcattcagaaatactgatgaccttcatatacgtagtctgtatactcatagggagatgtactgtattatataacatgtaaagttgattttcttgtgacaagagaacttctttttttaacaagaggacatggcattattttaatttgattatggtgagttgaatttaagacatgaccatgaaggctgcttgtagaattagtgtatttttattaaactatttttttaaatgtcaaacttctatcatgtaaatggacttatagagaacaaaaagctatttactttggttttctagaaagttgttacatatcatggctggttaacttttatttcttttgatgaaaatttttcctttgatagtacttgtattattgtgccattattttcttatgctccaaatgtaccaaagatcttgaacagagtggatgttcacaactgagtagaattttcctttcctgtgggcatgctgtattcagacctgacagatctttgatagaggtcagcttattaaagggcaatattgttcttgtttagctacatcactgtggtgaatatagatggaattaaggaagtaaatgcaggccagggggttgtgatgagaggataggggagataatatcagcatcaaattctttgggtatctctctaagaattaaataatcttttctagcttaatattttaattctaattcaaacaactctgaggttttggtttcattagtaatagttgaggaataatatactagcaaagaatggcctaatgtttgtcataactgttaatggatgaaattttttaaagatacaaccatgataaccattataaatgatctatgatcaaaatctaaagtgatgaattatttgtaggaatgtcttcctaatggggaagaattgcataggagcattatgcaaatctacacaagcttttataaatgttgctgctgggtagctccacagtgtttcataaggccatcctgtttcccccaactcccccatttttggtttgtttctttttaaatatttgttgagtacttacgtgtttatctaacagttcacttccatttttctagtctggattttttgagtatttaggaaagagagctattaaaaactggggatttctcaatgtgactaactctaatttttctaattataactgcctttaattaacataatattaacttttgctgaggtttatgagattttctcaccccacatcgctcccctttttttaaaaaggactgttttgctagtgtgataatgaataggtaagatatgagataattgcaacattgtctagttctagtatggtaactattcttgaaatggtattgaaaaataccgttaattcaaattgacagagattgataaaaagaaactgatttacctaagtttactttttaattgcataatagagcattttttgttttgagttccctcattcttattaccagaaagagcttgcaaatagttttactttcttggcactggaagggtagttctggaaagctactttgttgagagtctcattcttccctggagttaatagagtgattcacaatctttggggttttctcctcatcaaaagcatttcttaagtgcctatctaaaagcaattaaagactgtgtctgccctttagaagctaagaatttgattcatgatgcaaattaactagataatttgcaaagtacccttgagattgaattttctctattatatatttcccatatttcaggtgaataatttaatttaaatgacaaaaccctatctagtcaactgggcataatgacattttctttaaattagactctattttgaattaaaagagttttattataaaccgtgtgtttttggtttttctaagtatatagaaagcttgtataattcagatttatcaatttcctgatttaatgtagactttgacttttttattaaaaacctttgtattaaagcaagttatgttatttttcttttatgcatttattactaacatagctttaaatctttaaatgtattgaagcattgtgctgtctgaaaataaggaattgcttataaaccagccacttctgaatacaatatgtagctgatttaataagctagttagtgaatggaaaataagtgtggagtattaaaaatgttctttggttggtaaggcctaagatagggtttcatttatttctatactttttctgttttttaaacacctgcatatttttatgtaaatctctaaatttaaaatattttaagtacatttatttttggtgttttattgtataaaaccttagacaatcaatcagtcagtctttactgacaggagcagcagctatctgtcttttgctgatctacaaataaatgaattgagaatttagtccatagaggtccctggctaccaaacacattctcctttgaattgttaaaattcagaacattcaaaataactgttttgctacaacccatgattattttcctgttgtgtttatttaaatttactttctctttagaagtgcacttatttctgaaaaatcttaatgaaacaaacgcttagaacaaatataaatatgagacacttgggactactagagatattttagatttttatgaaaaaaatgtgaggggatattgctgctttaaaaaggaataaagtaataaaaatatatctcagctatttttttaaagcaatataattcagcaattgtctagaaaagtaatcatgaggctactgagtttggtgttcagttactgagtttcaaaaatgttttggtggcatgaggacaaaatttcattgaaggtaagataagaataaaaactatgtttacaaaa

SEQ ID NO: 2202 - DNA, 4057 bp, Homo sapiens
cctgaacggacgccgtagccaagaggttgggcggatgttgtgagccgggtcgctgcggccgaggctccggcccccaggaccactggctgcccatgagagatgaaggatggcatccaagggggccggcatgtctttctcccgcaagagctataggctgacctcagatgctgagaaatccagggtcacaggcattgtgcaggagaagctgctgaatgactacctgaaccgcatcttttcctcttctgaacatgcacccccagcagccaccagcaggaaacccctgaacttccagaacctgccagaacatttggaccagttgctacaggtggacaatgaggaggaggaaagccagggacaggttgaagggcggcttggcccatccactgtggtcctggaccacacaggcggctttgaggggcttctcctggtggatgatgacctgctgggggtgattggacacagcaactttggcaccatccgctctaccacatgcgtgtacaaagggaaatggctctacgaggtcctcatctcctcccaggggctcatgcagatcggctggtgcaccatcagctgccgcttcaaccaggaggagggggttggagatacacacaactcctatgcctatgatggcaaccgcgtgcgcaagtggaatgtgaccacaacgaattatggcaaggcgtgggcagcgggggacatcgtgagctgcctgattgacctggatgatggcactctgtccttctgcctgaacggtgtatcactgggcactgcctttgagaacctgtccaggggcctgggtatggcctacttcccagccatcagcctctctttcaaggagtccgtggccttcaactttggcagccgtcctctgcgctacccagtggcaggctaccggcccctgcaggacccaccgagtgctgacctggtgcgggcacagaggttgctgggctgcttccgggcagtgctgagtgtggagctggaccctgtggaggggcggctgttggacaaggagagctccaagtggcggttgcggggccagcccaccgtcctcctcacactggcccacatcttccatcactttgcaccgcttctgcgcaaggtgtatctggtggaggctgtgctcatgagcttcttgctgggcatcgtggagaagggcacacccacacaggcacagtccgtggtgcaccaggtcctggacctcttgtggctcttcatggaggactacgaggtacaagattgcctcaagcagttgatgatgtctctgcttcggctgtaccgattctcacccattgtcccagacctgggcctacagatccattacctgcggctcactatcgccatcctgaggcatgagaagtcccgcaagtttctgcttagcaatgtcctcttcgacgtgctccgctccgtcgtcttcttttacatcaagagccccctgcgtgtggaggaggccggcctgcaggagctcattcccaccacctggtggccccactgctccagtagggagggcaaagagagcacggagatgaaggaggagaccgcagaggagcggctgcggcggcgagcctacgaacggggctgtcagcggctcaggaagcgcatcgaagtggtggaagaactacaggtccagatcctgaagctgctgctggacaataaagatgacaatgggggtgaagcttctaggtatatcttcctgaccaagtttcgcaagtttctgcaggagaacgccagtggccgggggaacatgcccatgctctgcccccctgagtacatggtctgcttcttacaccggctgatctctgccctgcgctactattgggatgaatacaaggcttccaatcctcatgcttccttcagtgaggaggcctacatcccgccccaggtcttctataatggcaaggtggactactttgacctgcagcgcctggggggcctcctctcgcacctgcggaagaccctcaaagatgaccttgcttccaaagccaacattgtgatcgacccactggagctccagtcaaccgccatggatgacctagatgaggatgaggagccagccccagctatggcccagcgccccatgcaggccctggctgttggggggccactgcccctgccccggcccggctggctcagttctccaactttgggccgagccaaccgcttcctcagcacagcggctgtgagcctcatgaccccacggcggcctctgagcacctcggagaaagtgaaggtccgcacgctgagcgtggagcagaggacccgtgaggacattgaaggcagccactggaatgagggcttgctgctggggcggccccccgaggagcctgagcagcccctcaccgagaactcgctgctggaagtcctggatggggcggtcatgatgtacaacctcagcgtacaccagcagctgggcaagatggtgggtgtctccgatgatgtcaatgaatacgctatggctctgagggacacagaggacaagctccgccggtgccccaagaggaggaaggacatccttgcagagttgaccaagagccagaaggttttctcagaaaagctggaccacctgagccgccgtcttgcctgggtccatgccactgtctactcccaggagaagatgctggacatctactggctgctgcgcgtctgcctgcggaccattgagcacggtgatcgcacagggtctctctttgccttcatgcccgagttctacctgagcgtggccatcaacagctacagtgctctcaagaattactttggtcccgtgcacagcatggaggagctcccaggctatgaagagaccctgacccgcctggctgccattctcgccaaacactttgccgacgcacgcattgtgggcactgacatccgagactcactgatgcaggccctggccagctacgtgtgctacccacactccctgcgggctgtggagcgaatccccgaggagcagcgtatcgccatggtgaggaacctcctggcgccctatgagcagcggccctgggcccagaccaactggatcctggtgcggctctggaggggctgtggcttcgggtaccgctatacacggctgccacatctgctgaaaaccaaacttgaggacgccaatttgcccagcctccagaagccctgcccttccaccctgctgcagcagcacatggcggacctcctacagcagggtcctgatgtggcacccagcttcctcaacagcgtcctcaatcagctcaactgggccttctctgaattcattggcatgatccaagagatccagcaggctgctgagcgcctggagcggaactttgtggacagccggcagctcaaggtatgtgccacctgctttgacctctcggtcagcctgctgcgtgtcttggagatgactatcacactggtgcctgagatattccttgactggacccggcctacctctgagatgctgctgcggcgtcttgcacagctgctaaaccaggtgctgaaccgggtgacagctgagaggaacctgtttgatcgtgtggtcaccctacggctgcctggcctagagagcgtggaccactatcccattctggtggcagtgacgggcatcctggtgcagctcctggtgcgtggcccagcctcagagagagagcaagccacatcagtgctcctggcagatccctgcttccagctacgctcaatatgctatctcctgggacagccagagcccccagcacctggcactgctctgccagcccctgaccggaagcgcttctccctgcagagctatgcggattatatcagtgccgatgagctggcccaagtggaacagatgctggcgcacctgacctctgcatctgcccaggcagcagctgcctccctgcccaccagtgaggaggacctctgccccatctgctatgcccaccccatctctgctgtgttccagccctgtggccacaagtcctgcaaagcctgtatcaaccagcacctgatgaacaacaaggactgcttcttctgcaaaaccaccacatccaacctccttgcctgcctgtatcctcattggtgggagcccagccatggccctaattgtgcctga

SEQ ID NO: 2203 - DNA, 5078 bp, Homo sapiens
atgccgtcggtttcgaaagcggcggcagcggcgctgagcgggtcccccccgcagactgagaagccgacccactacaggtacctgaaggagttcaggacggagcagtgccccctgttttcacagcacaagtgcgcgcagcaccggccgttcacctgcttccactggcacttcctcaaccagcggcgccgcaggcccctccgcaggcgcgacggcaccttcaactacagccccgacgtgtactgctccaagtacaacgaagccaccggcgtgtgccccgacggcgacgagtgtccctacctgcaccggacgacgggggacacagaacgcaagtaccacctgcgttactacaaaacaggaacctgcatccacgagacagacgcacgtggccactgcgtgaagaatgggctgcactgtgccttcgcgcacggccccctggacctgcggccgcccgtgtgtgacgtcagggagctgcaggcccaggaagccttgcagaacggccagctgggcggcggggaaggggtcccggatctgcagcctggggtcttggccagccaggccatgattgagaagatcctgagcgaggacccccggtggcaagatgccaacttcgtgctgggcagctacaagacggagcagtgcccgaagccgccacgcctgtgccgccagggctatgcgtgcccacactaccacaatagccgggacaggcggcgcaacccccggcggttccagtacaggtccacgccctgccccagtgtgaagcacggggatgagtggggggaaccctcacgctgcgatggcggcgacggctgccagtattgccactcccgcacggagcagcagttccatcccgagtctacaaaatgcaacgacatgcgccaaaccgggtactgcccgcgcggccccttctgtgcctttgcacacgttgagaagagcctggggatggtgaatgaatggggctgtcacgacctccacctcacgagtccttcctccacgggcagcggccagccgggaaatgccaagcggagagactcgccggccgagggtggccctaggggcagcgagcaagacagcaagcagaaccacctggccgtgtttgcagcggtccacccgccggcccccagcgtgagctccagcgtggcgtccagcctggcgtccagcgccggctccggcagctcctcccccactgcgctgcccgcgccccccgcccgtgccctcccgctcggccccgccagcagcactgtggaggccgtcctcggttctgcgttagacctgcatcttagcaatgtgaatattgcatccctagagaaggacctggaagagcaagacggccacgacctgggagcagcaggtcccaggtcgctggccggctctgcacctgtcgccatccccggctccctgcccagagcaccatcgctacactcgccatcctctgcgtccacctcgccgctcggttcgctgtcccagcccctcccagggccggtgggctcctcagccatgacgcctccccagcagccgccacccctgcgttcagagccgggcacactgggctctgcagcctcatcctacagccccctaggtttgaacggtgtccccgggagcatctgggactttgtttccggcagcttctcccccagcccctcccccatcctgagtgccggccccccatcctcttcgagtgcaagtccaaacggagctgagctggcccgggtcaggcggcagctggacgaggccaagaggaagatccggcagtgggaggagtcctggcagcaggtgaagcaggtctgcgatgcctggcagcgagaggcgcaggaggccaaggagcgtgcccgtgtggccgatagcgaccggcagctggcgctgcagaagaaggaggaggtggaggcacaggtgatcttccagctccgcgccaagcagtgtgtggcctgccgggagcgggcccacggtgctgtcctgcggccctgtcagcaccacatcctctgtgagccgtgtgcggccaccgcacctgagtgcccctactgcaagggccagcccctgcagtggtgacctcagcggggacagccacctcctgctgggcaccctggctccagcgctcctcctgaccacggacatgtcgtcactcgcttctggtgccaccgacgtgaggaccgaggctgggagcccttcctgttacacgttatcatgaggctgggagccccgcctgcgcttggcctgacagcctttcctgtcacacgttgtcacctatctagtcctaccgacggtttcaaggtattttcctcaaaaaccttaaatgcaaacccacagaacccgcctgcctgtccctgaggggcctggtgcctccgggatccacgcggcgctgtgatcacagcagtttgtggtcctgacactactgtgactaggccactgggagctggggtctttcaaagcactttgtaaaccgaggaatttagttagaggttataaattgctctaagctgctttctgtttttttttaatatgcgataatatgaagctttatatgtgtactgtgaacttaaatatttcatatcagtttattgtcaattcatagtatgctaaatatattagatttcatattctgaaactagtacttatgaaatgagtgtttatctagtagtaagacctaggatttttacattttccaattaagtgcaaatagtatttataagcagagtgattatggattgagatgtttttaacttgatggaaggagctagttttcctgagcctgtgtgtgcaccaggcactggggctgatgttccagcctcgtggcgtgggagcaggagagctccgtcctgcatttctgtggtccgtggccgctgtttctgtgcgcctgcgcctcggagagcaagtgaaggagcatcatgggttttgttttctcccttaaccctctgaaagacagtttgatactaacaaaaaacgcagcagaggggatccgacgtcagagcttttagaattacttttttaagcagctgtcttctggctgggtgcggtggctcatgcctgtgatcccagcactttgggaggcgggtggatcacctaaggtcaggagttcaagaccagcctggccaacatggtgcaaccccgtcttagtaaaaatacaaaaattggcctggcgtgagagcgggcacctgtagtcccagctactcgggaggctgaggcaggagaatcgcttgaacctgggaggcagaggttgcagtgagccgagatcgcgccaccgcactccagcccgggtgacagagcgagactctggctcaaaaaaaaaaaaaaaaagctgttttctgattactcagagctgtcctaggcaatggtgctttgtagctccttggagatgtcgctgggcgtcctggcaggggtcaggcagtgaactgggagagtggttgcctccccagcacccgtgaccaccctggtcctgctcgtgtgggagatgctcgggccgtgtgtgcgccagggtccggggtgccgggtgtatgtggcagtcacctgacccgcgctgccagttatcatcggagctcatccatgtggccagtgaggtcacaggagaggacccggccacagcctctcagtggcctggagcacacgggggaagcgaccccccccaggtcccggctctgctgtggtcccctgtcccgtctgcccctggagcgacagtgtggtttcggccgcagcagaaacgtgactgagaacgcatccccgcgatgacctgacccttctgctcagggctgggactgtccctaggagttgagcaggaacaggcatctgtggtttacggcgacctggctctccgcgggccacgtgggtggtgagggcacacgagtgggaagcggcaccgacgtgtttctccccgaccgtggctttgccaaagacttttaatagcattttttaagtgcaaaacgtctaggtaaaaatctttatcatcagtgaccaaattagaatgtatttaatatagtaggtggtttaagaactgttttaacgtaagacaaactgatagcaacattctgttgttttaaaggaagtgggtccgtgacattctgcagctagtccactactccaaggtaactatcgacttggtttcagtgaatctattttgtttttaactacagtgatttattagctcagtatctagaaattacgtatattttgtgctactgtcatcgatgtgtaaactctgtttttatttgtatttatgcacttggttcccatttggagcctctggtcttttctgggataagtggtgtctgccgagacatctcccggttgtcagtggtcaggagcagctgagctctagtctgccagctgctctgctctttctgggaaggaggtggcgcccgcccctcagggtgtctccagggctcagcttccggggtggtagagctggggagccccaggggtggggggacagctgggagatggaggtggcacctgctcccctagatcagtactggctctgaggacaggtgagcagtgggaagaccaaagaatggctggcagcgctgccagggttggaaatgggggcaagatcctggggctgtgtgccctggggcctccctcacctgtcttggtggccatggcctcagggatggctcctaggtggctgaggcacagcagtggctggaaggtgccccgtggaggctgaggtggaggcgcgcccagcagctcccccctgtggccatggcgggcacggggcgtaggagctggctggcggccggctctgcatgttcttgttgcctgtcgtctgtaactctagtgttcgacattcgccgtgatacagtggtgtcacgacgtgtgtaactgtggtcagcagaccttgttccgcgtggacgcctcaagtggattaatttctggaagcctcaatctgtatgtttgagtatttacatgagaatgttatttgaatggaattttcttaacccagaaggtagtatttataatcatttacttgtagcgaactgtttaaagttaacacttgtttaaatttttttacactatagcatttatgcaatggtttacagaattcatggagttatttttatcagtatgggaattaattaaaaccttgaatcttt

SEQ ID NO: 2204 - DNA, 1510 bp, Homo sapiens
acaagatggcggcgctgcgggacggctagcggccctgcgtgggagttcctgacagctggattctagaagtagaactatgagctcacctttggcctcccttagcaagacccgaaaagtgcccctgccctcggagcctatgaatcctgggaggcgaggaatccgcatctatggagatgtccctgcatcccatgactcggagctgatggccttcatgacgaggaagttgtgggacctggagcagcaggtgaaggcccagactgatgagatactgtccaaggatcagaagatagcggccctagaggacctggtgcagaccctccggccacacccagccgaggcaaccctgcagcggcaggaggaactggagacgatgtgtgtgcagctgcagcggcaggtcagggagatggagcggttcctcagtgactatggcctgcagtgggtgggcgagcccatggaccaggaggactcagagagcaagacagtctcagagcatggcgagagggactggatgacagccaagaagttctggaagccaggggactcattggcgccccctgaggtggactttgacaggctgctggccagcctgcaggatcttagtgagctggtggtagagggtgacacccaagtgacaccagtgcccggcggggcacggctgcgtaccctcgagcccatcccgctgaagctctaccggaatggcatcatgatgttcgacgggcccttccagcccttctacgatccctccacacagcgctgcctccgagacatattggatggcttctttccctcagagctccagcgactgtaccccaatggggtcccctttaaggtgagtgacttgcgcaatcaggtctacctggaggatggactggaccccttcccaggcgagggccgtgtggtgggcaggcagctgatgcacaaggccttggacagggtggaggagcacccaggctccaggatgactgctgagaaatttctgaacaggctccccaagtttgtgatccggcaaggcgaggtgattgacatccggggccccatcagggacaccttgcagaactgctgcccattgcctgcccggatccaggagattgtggtggagacgcccaccttggccgctgagcgagagaggagccaggagtcacccaacacgccggcacccccgctctccatgctgcgcatcaagtctgagaatggggaacaggccttcctactgatgatgcagcctgacaacaccattggggacgtgcgagctctgctagcgcaggccagggtcatggatgcctctgcctttgagatcttcagcacattcccgcccaccctctaccaggacgatacactcacgctgcaggctgcaggccttgtgcccaaagcagcactgctgctgcgggcacgccgagccccgaagtccagcctgaaattcagtcctggtccctgtccccccggtcccggtcccggccccagtccctgtcctggacccagtcccagcccccaataaagcacccgccccctc

SEQ ID NO: 2205 - DNA, 2382 bp, Homo sapiens
atgggccagtgctataatttggaggatgatgacttggaaacagacgtgaacaagctgagttccaaacctggtcttgaccgacctgaagaggaactgatgcaatatgaggtgatgtgtcttgagctctcctatagctttgaggaactgcagtccaaacttggagatgatttgaactctgaaaagactcagtatgccaatcaccaccacattccagccgctgcctcctcaaaacagcattgctacagcaaggaccaaagctcctgtgggcaagaaagagaatatgctgtccagacttcccttctgtgcagggtgaagacgggaaggtccactgtgcatctaggctccaaaaaaaatcctggagtgaacctgtaccaaaatgtgcaatccaatagtctcaggagagattcttctgaaagtgaaatccctgacattcaggcttccccgaaagcagatgcctgggacgtagatgcaattttctgcccaaggatgagtgcctccttttctaattccactaggactagagaagttgtcaaagtaatagataagcttctgcagacacatctgaagcgtgtccctttccacgatccctatctttatatggccaaagccagaagaaccagctctgtggtggacttcaagatgatggcatttcctgatgtctggggacactgtccccctcccaccacccagcctatgttggaacgaaaatgtggagtccaaaggatcaggatatttgaggatattcggaggctcatccagccaagtgatgttataaataaagttgtcttcagtttagatgagccttggcctttgcaagacaatgcttccaattgtttacggttcttctccaaatttgagtcaggaaatcttcgcaaagccatccaagtgcgtgagttcgagtatgacttgctggtcaacgcagatgtgaatagcacccagcaccagcagtggttctatttcaaagtgagcggtatgcaggcggccatcccttaccacttcaacatcatcaactgtgagaagcccaacagccagtttaattatgggatgcagcccaccctatattctgtgaaggaggctcttcttggcaaacccacctggataaggacaggccatgaaatatgttattacaaaaatcattatcgccagagtacagctgttgcaggcggagcatctgggaagtgctactataccctcacctttgctgtcaccttcccacacagtgaggatgtctgctacctggcctaccactatccctatacctacacagccctcatgactcatcttgacatcctggaaaagagtgtcaacctcaaagaggtctacttccggcaagatgttctctgccagacgctgggagggaatccgtgtcccttggtgaccatcacggccatgcctgagtccaacagtgatgagcatctagagcagttccgacatcgtccatatcaggtgatcactgctcgagttcatccaggagagagcaatgccagttgggtgatgaagggtaccttggagttcctggtcagcagtgaccctgtggctaggctcttgagggaaaacttcatcttcaagatcatacccatgctcaacccagatggtgtcatcaacggcaaccacagatgctcactgagcggggaagatttgaacagacaatggctttctcccagtgctcatctgcagccaaccatttaccatgccaaaggcctcctctaccacctgagcagcattggccgaagtcccgtggttttctgtgacttccatggccactcccaaaagaagaatgtgttcctttatggctgtagcatcaaggaaaccttgtggcaagcagcatgcactgtgggcacatctactatcctagaggaggtcaactacaggactcttcccaaaatccttgataagctagcaccagcattcacaatgagcagctgcagctttctcgtggagaaatctcgagcttccacggcccgggtggtggtgtggagagagatgggggtgtccagaagctacaccatggaaagcagctactgtggctgcaaccagggcccttatcagtgtacacagaggctgttggagaggacaaagaatgaaagggctcacccagtggatggccttcagggtctacagtttggtaccagagaactggaggagatgggagccatgttctgtttgggcctcctcatcctggagctcaaatctgccagctgcagccatcagctcctggctcaagctgcaactctgctgagtgctgaggaggacgctctggaccagcacctccaacgattaaaatcatccaatttcctgccaaagcatatttggtttgcttaccacttttttgccattacaaactttttcaagatgaaccttcttctgcatgtctccccgtga

SEQ ID NO: 2206 - DNA, 575 bp, Homo sapiens
cgcgcttggcaacggctcggcgtcgcgctttggccaaccgctgcgtcgtccctgggcccgaataactgtcgcccgcttccctcagcgtgaggtgaagcacttcaaattgcctgatgaaagttgaatcaggaatgaagataaaagtacacaacaatgcagaaagcggtacttagcctcacaaagatggaaacattccaaaaacgtgaagtactgttgtcccaagattctttctaagcctaaaattacacttttactagtccgattttctggttgtgagttttttttgtttgttttttttttttcgagaaactgcagtaggcttcttggaagtagaccaagggtgtccaatctttggcttccctgggccacatcggaagaagaattgtcttgggccacacatgaaattcacaaacactaaggtacaaatgatgcaaaatgtgcacctggctccagagacagatgaagatgatctttattccggctataatgactacaatccaatctatgatatcgaggaattggagaatgatgcagcttttcagcaagctgtgaggactagtcatggcagaagacct

SEQ ID NO: 2207 - DNA, 3054 bp, Homo sapiens
cgcaccacccccttcccgccgcgctctctcccgcccccgcgcttccggccccgcccgcccccgcgcggaggactgtgggagcggcttccttggattccgcgcttggcaacggctcggcgtcgcgctttggccaaccgctgcgtcgtccctgggcccgaataactgtcgcccgcttccctcagcgtgaggtgaagcacttcaaattgcctgatgaaagttgaatcaggaatgaagataaaagtacacaacaatgcagaaagcggtacttagcctcacaaagatggaaacattccaaaaacgtgaaaaactgcagtaggcttcttggaagtagaccaagggtgtccaatctttggcttccctgggccacatcggaagaagaattgtcttgggccacacatgaaattcacaaacactaaggtacaaatgatgcaaaatgtgcacctggctccagagacagatgaagatgatctttattccggctataatgactacaatccaatctatgatatcgaggaattggagaatgatgcagcttttcagcaagctgtgaggactagtcatggcagaagacctccaataactgctaaaatatcaagcacggcagttactagacctatagctactggatatgggtccaagacatctctggcatcatcaataggaagaccaatgacaggggctattcaggatggagttactagacccatgacagcagtgagagcagctggttttaccaaagcagctttgagaggctctgcatttgacccccttagtcagtcaaggggccctgcttcccctttggaagccaagaaaaaagatagcccagaggaaaaaataaagcaattagagaaggaagtaaatgagttggtagaagaaagctgtattgccaatagttgtggagacttaaaattggccttagaaaaggcaaaagatgcaggaagaaaagagagagtcctggtgagacagcgagaacaagttacaactccagaaaatatcaatttggatttaacttactcagttcttttcaatttggccagtcagtattcagttaatgaaatgtatgccgaagcacttaacacttatcaagttatagtcaaaaataagatgtttagcaatgcaggaatattgaaaatgaatatgggaaatatctatttaaagcaaagaaattattccaaagccattaaattctaccgaatggcattagaccaagttccaagtgtcaataagcaaatgaggattaaaataatgcagaatattggagttacatttattcaggctgaccgagaaaaaatgaagaaggcattccaaaaattgattactgttccattagaaattgatgaagataaatatatttcaccaagtgatgatcctcatactaacttagtaactgaagctataaaaaatgatcacctcaggcaaatggaacgtgaaaggaaagccatggcagaaaaatatattatgacatctgcaaaactcattgctcctgtaattgaaacatcttttgctgcaggttatgattggtgcgtggaagtggtgaaagcttctcaatatgtagagctagccaatgatctggaaataaacaaagcagttacatacttgagacaaaaagactataaccaagctgtagagatcttaaaagtgttggaaaaaaaggacagtagagtgaaaagtgcagctgcaaccaatctctcagccctgtattatatgggaaaggattttgcacaagccagcagctatgcagatatagctgtgaactctgatagatataatccagcagctcttactaataaagggaatacagtttttgcaaatggtgattatgagaaggccgctgaattctataaagaggctctaagaaatgattcttcttgtactgaagcactttataatattggccttacctatgagaaactaaatcggctagatgaggctttggactgtttcctgaaacttcacgcaatcctacgaaacagtgccgaagttctttaccagatagcaaatatatatgaattaatggaaaatcccagtcaagctattgaatggctaatgcaggtggtcagtgttattccaaccgatcctcaagttttatctaagctaggagaattatatgatcgtgaaggagataaatctcaagcatttcaatattactatgagtcatataggtattttccttgtaatattgaagtcattgagtggcttggagcctattacattgacacccaattttgggaaaaagctattcagtactttgaaagagcttctcttatacagcctacacaagtgaaatggcagctgatggtagctagttgtttcagaagaagtggtaactaccaaaaagcattagatacttacaaagatactcacagaaaatttccagaaaatgtcgaatgtctgcgtttcttagttcgtctctgcacagatcttggattaaaagatgctcaagaatatgccagaaaactgaagaggttggaaaaaatgaaagaaataagggaacagcgcataaagtcaggcagagatggcagtgggggctcccgtggcaaaagagaaggaagtgctagcggtgatagtggccagaactatagtgccagtagtaaaggtgaacgactaagtgccagactcagagctttacctgggacaaatgaaccttatgaaagtagcagtaacaaagaaatagatgcctcctatgtggacccacttggccctcaaatagaacgaccaaaaactgcagccaagaaaaggatcgatgaggatgattttgctgatgaagaattaggagatgatttgcttccagaataatattcactttaatatttattaaaggaaagaaattgccttatgagatcatcctcatgttaaaccttggattaaatatctaacctgtaattattttttttcactgtcaaaacttaagtaagtgtattctattctgtatgtatgcatttaagttgtttttttcttttaaggaataaaaacaggtaaaactaatactttaggccagtgacttccttagctttttgaaaacattgacacacaggaagaaataaatttcataac

SEQ ID NO: 2208 - DNA, 3270 bp, Homo sapiens
caatggcggcggccgcggcggagcagcaacagttctacctgctcctgggaaacctgctcagccccgacaatgtggtccggaaacaggcagaggctagacaaatggccgccgttctcctaagacgtctcttgtcctctgcatttgatgaagtctatccagcacttccctctgatgttcagactgccatcaagagtgagctactcatgattattcagatggaaacacaatctagcatgaggaaaaaagtttgtgatattgcggcagaactggccaggaatttaatagatgaggatggcaataaccagtggcccgaaggtttgaagttcctttttgattcagtcagctctcaaaatgtgggactgcgggaagctgcccttcacattttctggaactttcctggaatttttgggaaccagcaacaacactatttagatgtcatcaaacgaatgttagttcagtgtatgcaagatcaggaacacccgtcgatcaggacgttatctgctagagctacagctgcatttatacttgcaaatgagcataatgttgctctgttcaaacattttgcagacttgctaccgggattcctacaggcggtaaatgactcgtgctaccagaatgatgattctgtcctaaaatccctcgttgagattgcagatactgttccaaagtatttgcgtcctcacttggaagcaactctacagctaagtctaaagttgtgtggagacactagcctcaacaatatgcaacgccagcttgcccttgaagtgatcgtcaccctctctgagactgcagctgctatgttaagaaaacataccaatattgttgcacagactattcctcagatgttagcaatgatggttgatttggaagaagatgaggactgggcaaatgcagatgaactagaagatgatgattttgacagcaatgcagttgcaggcgagagtgctctagatcgaatggcttgcggacttggtggaaagctcgttctgccgatgatcaaggaacacattatgcaaatgcttcaaaatcctgactggaaataccggcatgcaggattgatggccttatctgccattggtgaagggtgccaccagcaaatggaaggaattctaaatgagatcgtaaattttgttttactttttctccaggatcctcatccaagagtaaggtatgcagcctgtaatgccgtgggacagatggctacagattttgcacctggtttccaaaagaaatttcatgagaaggtgattgcagctctgctgcagaccatggaagaccaaggcaatcaacgtgtgcaggcccatgcagctgctgccctcattaactttactgaagactgtcccaagtcactacttattccatacttggataatttggtgaaacatctgcattccattatggtactgaagcttcaagagctgattcagaaaggcaccaagttagttttggaacaagttgtgacatccattgcatcagttgccgatactgcagaagaaaaatttgtcccctactatgatttatttatgccatcactgaagcacatcgttgagaatgcggttcaaaaagaactgagacttctgagaggaaaaactattgaatgcattagcctcattggtctggctgttgggaaggaaaaattcatgcaggatgcatcagatgtgatgcagcttttgttaaagacccagacagacttcaatgatatggaagatgatgatcctcagatctcttacatgatctcagcatgggccagaatgtgcaaaatccttggaaaagaatttcagcaataccttccagtggttatggggcctttaatgaagacggcttcaattaagcccgaagtagcccttttagatacccaagacatggagaatatgagtgatgatgatggttgggaatttgtgaaccttggagatcagcaaagctttggtattaaaactgcaggactagaagaaaaatcaactgcttgccagatgttggtttgctatgctaaggagttaaaggaaggctttgtggagtacaccgaacaggttgtcaaactgatggtccctttactgaaattttatttccacgatggtgttcgagtggcagcagcggaatccatgcctcttctcctggagtgtgcaagagtccgtggtcctgagtatctcacacagatgtggcattttatgtgtgatgctctaattaaggccattggtacagaaccagattcagacgtcctctcagaaataatgcattcttttgcaaagtgcattgaagtaatgggagatggatgccttaataatgaacactttgaagaactgggaggtatattgaaagcaaagcttgaagaacattttaaaaatcaagaattacgacaagttaaaagacaagatgaagactatgatgaacaggtcgaagagtcactacaagatgaggatgataatgatgtttatattctgaccaaagtgtcagatattttacactcaatattcagtagctacaaagaaaaggtgttaccatggtttgaacagctgcttccattaattgtcaacctcatttgtccacatagaccatggccagacagacaatggggattatgcatctttgatgatgtcatagaacactgtagtccagcctcatttaaatacgcagaatatttcttaagaccaatgctccaatatgtatgtgacaacagcccagaagtcaggcaagcagctgcatatggcctgggagtcatggcacagtacggtggagataattatcgccctttttgtacagaagcacttcccctgctggtaagagttattcagtctgcggattctaagaccaaagaaaatgtcaatgctacagagaactgcatctcagcagtagggaaaatcatgaagttcaagcctgactgtgtaaacgttgaagaggtccttccacactggttgtcttggcttccactacatgaagataaagaagaagctgttcagactttcaattatctgtgtgacctgattgaaagtaatcatccaattgttcttggcccaaacaataccaatctgcccaaaatatttagtataattgcggaaggagaaatgcacgaggcaattaaacatgaagatccttgtgccaaacgtctggccaatgtcgttcgccaagtacagacttctggaggactgtggactgagtgcatagcacagctcagtcctgagcagcaggccgccattcaggagctcctgaactctgcgtgaagggccttaatgtcacccaccagaaaactaactccaaataaacgcttaccctttc

SEQ ID NO: 2209 - DNA, 2949 bp, Homo sapiens
ggccgggatagaagccgcagcccaggcggcggtccctcccgctgtcgccgcccgggtgtagcgcatcacccggagcccaccggccgcaggtgcctcctccggccccagggggccccgggagccctgaagggcgaagcggcagggacgcctctcttgggcgaagaggcggcctcaccgccccggatgcggccggagggcgcgggaatggagctcggaggcggcgaggagcgcctgcctgaggagagcaggagggagcactggcagttgctgggtaatttgaagacgacggtggagggtttggtatcaaccaacagccccaacgtctggtctaagtatggtggcttggagcggctttgcagggacatgcagagcatcctctatcacgggcttatccgtgaccaggcgtgccgccgccagacggattactggcagttcgtgaaagacatccggtggctcagtccccactcagcccttcacgtggagaagttcatcagcgtgcacgagaacgaccagagcagtgctgatggtgccagtgaacgtgctgttgccgagctgtggctgcagcacagcctgcagtaccactgcctctcagcccagctccggcccctgctcggggatagacagtatatcagaaaattctacacagatgctgccttcctgctaagtgacgctcatgtcacggccatgctgcagtgcctggaagcagtggaacagaacaacccccgcctcctggctcagatcgatgcgtccatgtttgccagaaagcacgagagcccgctcctggtgacaaagagccagagcctgacagccctgcccagttccacatacacccctccaaacagctatgctcagcattcctactttgggtccttctctagcctccaccaatccgtgcccaacaatggctcagagagaagatctacttcctttccactctctggccctccccggaaacctcaagaaagcagagggcacgtctcaccagcagaggatcaaaccatccaagcccccccagtttcagtctctgcactagccagggattcccctttgaccccaaatgaaatgagctccagtactctgaccagccccatagaggcatcctgggtcagcagccagaatgattccccaggtgatgccagtgaggggcctgagtacctggccattggcaacttggacccccgaggccggactgccagctgtcagagtcacagcagcaatgccgagagcagcagttccaatttgttctcctccagcagctcccagaagccagattctgctgcctcttccttaggggaccaggaaggaggtggggagagccagctgtccagtgtcctccgcaggtccagcttctcagaggggcagacactcactgtcaccagtggggcaaagaaaagccacattcgctcccattcggataccagcattgcctccaggggagctccagaatcctgcaatgataaggcgaagttgagaggccctttgccctactctggtcaaagcagtgaagtcagcacacccagctctctgtacatggaatatgaaggtggtcggtacctgtgctcaggggaaggcatgttccgaagaccatcagaaggacagtccctcatcagctacctctctgagcaagacttcggcagctgtgccgacctggaaaaggagaatgcccacttcagcatctcagagtccttaattgctgccatcgagctaatgaagtgcaacatgatgagccagtgcctagaggaggaggaagtggaagaggaagacagtgatagagagatccaggagctgaagcagaagatccgccttcggcgccagcaaatccgcaccaagaacctgctccccatgtaccaggaggctgagcacggaagctttcgggtcacctccagcagctcccagttcagctcacgtgattcggcacagctctctgactctggctctgctgatgaggttgatgaatttgaaatccaagatggtagcgaaggatctaacctgactcacatatcaaagaacggactgtcagtgtcactggcctcgatgttctcagatgctgacatcagaaggaacacagcctcaagcagcaaatccttcgtttcctcccagtccttctcccactgcttcctgcactccacgtctgctgaggcggtggccatggggctcctgaagcagtttgaggggatgcagcttccagccgcctcggagctggagtggcttgtcccggagcatgatgcccctcagaagctcctgcccattcctgactcactgcccatctcaccggatgacgggcagcacgctgacatctacaagctgcggattcgtgttcgtggcaacttggagtgggccccgccccggcctcagataatttttaatgttcatccagccccaacgaggaaaattgccgtggccaagcagaattaccgctgtgcaggatgtggcatccggactgaccctgattacatcaagcgactgcggtactgtgagtacctgggcaagtacttctgccagtgctgccacgagaatgcccagatggccatccccagccgggttctgcgcaagtgggacttcagcaagtactacgtcagcaacttctccaaggacctgctcattaagatctggaatgatcctctcttcaacgtgcaggacataaacagtgccctctataggaaggtcaagctgctcaatcaagtccggctgctgcgggtccagctgtgtcacatgaagaacatgttcaagacttgccgactggccaaggagcttctggattcctttgacacagtcccaggccacctgacagaggacctccacctgtactcactgaatgacctgactgcgaccaggaagggggagctggggccccggcttgctgagctcaccagggcaggggctacccatgtggagagatgcatggtgagaaagtctcactgtagcatgcagctgagcccttgcttttag

SEQ ID NO: 2210 - DNA, 2714 bp, Homo sapiens
acctgctgggagctggaggaggcgcggagcgaagccggccctgccagccacgcggagaagcagaggcaggtgagcgcgatgcagccggcgccgggtctggggctcggggactcctccctgcaccgctacctggacggcgacttctggagcctcaagaacgagctgcgcggactcctcggcggcgcccgctcttccggcaaaggtatgatttaagcttggatgaaatgagagctttgacagttcagagagtgaagtttgccatggacctgcctctgttaaaacgtgcaggtcaggatctggcagagaaaacaaagaattttgtcagccgaagccttgtcataggagaagtcctctccatggcggacatggccacaggagtgaagtgcggaataatttattggctatttggtggtgctatcaggaatctcggaagccctgaacatgttactaagtggtttcagccactccaggagcagaaatacactgggatgtttgcaatgaccgagaggggccatgggagcaacgcgagagggatccagaccgaagccacctttgacctctctgcccaggagtttgtaattgacacgccgtgtgaaaatgcggagaagatgtatattggaaatgccatgtacgggaattatgcagctgtctttgcccagctcatcatagatggaagatctcaagggccccactgtttcatcgttcctgtccgggatgaaaacggaagcttgtacccaggagtcacagctattgatatgatgtacaaggagggtctgcatggtgtggacaatgggatattaatatttgacaaggttcggatacccagggagaacctgctggataagtttggttccgtggctccagatggacagtaccattcgcctattaggaacaagagtgcaagattcaatgccatgctggcagcactgaccccttcgagattagctgtggctttccaagctatgggtgccatgaagcttgggttgacgatagccattcgctatagccacagccggaggcagtttgggcccaaaaccaaggaagaggtgaagatcattgagcaccaaacacagaccctgcggctgatgccccacctggccacagccttggccctgaccttcgtcagcaggtatgctggggccctcctggatgaggatgtcttccagggaaaggagctggtcaacagtcgctcgctgcaggctctggtggcggggctgaaggcctacagcacctgggagaacatccgctgcctgcaggactgccgcgagtgcactggaggcatgggttacatgatggaaaatcgaatctcaggcttaaagtgtgacacagatgtgtttgccacttttgaaggtgacgatgttgttatgcttcaggttgtggggcgggaactgctggcccaatacaccaaacagtatgaagaaaaaccactctttggcctgctccaaaactgggctgaatctgtgggggacaagctgagaaccagtttcctggcatttaacatggacacagttgatgatctcgcctttctgttgaaagcagtgaaatttcgtgaaagggttcttcagcggggtttggtggccagaatttattataaggtaaagaccaagaaggaggattttttccatgcctggaactcgtgtctgcaccacgtggcttctctgtccctggcacacactcaccgagttaccttagagcagttctccctagcagtgaagagctgtcctgaccaagaggaccagactttgttaatgaagttttgtctgttgtatggaaccaagctggtgtttcaggagcgggcctggtatttagaacataaatacttgactcccatggccagcacgaggatcaggaatcaggagagatgctgaaacacaaacaggtataagactcagtctccacatgaagggagctcatatccaaggacacaaaaccactttaaaaacataaatactggccaggtgcagtggctcatgcctgtaatcccagcactatgggaggctgaggcgggcagatctcctgagctcaggagttcgacaccatcttgggcaacatggtgaaaccctgtctactaaaatacaaaaaaattagctgggcgtggtggcatgtggctgtagtcccagctactcgggaggctgaggcacgagaatcgcttgagccctggagttggaggttgcagtgagcagagattgcgccactgtactccagtttggactacagagtgagactccatctcaaaacaaaacaaaacaacaacagcaaaaaacaacaaaacaaaacacaaatactctcacagggcatggaggttttcgaatgaacttggccataagaataaattcagagttgacagaacagacgtcttaggaataaatgccattcttatgctagaccttgaagagtagaaaattaagagatggtggcccaattgagaggggaaaatgcagttgaaacttcagacagggttgataaagtgaggacgatcatagacatggagtacttagacatattaataaacaataaagactttacctgtctaatggaaaacctggagaagtcgtcaggaaccagactacagtggaccctggagaaccttgaagaacatttttccttttcaggaaaacggaggttacagagaaaagtatatgtaatgatgctacagtaatgtatttctgtataacaaatgactccaaacttacgacttaaaacaaccaccactt

SEQ ID NO: 2211 - DNA, 7474 bp, Homo sapiens
tgctcgctgcggagccgttttgtgccgcggcgcgggggaacggggacgcggggcggggggcgcggagccggcgggcgcagcctcagcatggacgtgacagtctcggagctcctggagctcttcctgcagagcccgctggtgacctgggtgaaaacttttggcccgtttggaagcggcagccaggacaacctgactatgtacatggatttagtggacggcatctttttgaaccaaattatgctgcaaatagatcccaggcccacaaatcaacgcatcaataagcacgtcaacaatgatgtgaaccttcgcattcagaatttgaccatcttggtgagaaacattaagacctactaccaggaagttctccagcagctgattgtaatgaatttgcccaatgttttgatgattggcagagacccactgtctgggaagagcatggaggaaatcaagaaggtgctgctgctggtgctgggctgtgctgtccagtgtgagaggaaagaggagttcattgaaagaatcaaacagctggacattgagacccaggctggcatcgtggcccatatccaggaggtgactcacaaccaagagaacgtgtttgacctgcagtggctggagctgcccgacgtggctccggaggagctggaggccctgtcgaggagcatggtgctccacctgcggaggctcatcgaccagcgggacgagtgcaccgagctgatcgtggacctcactcaggaacgggactacctgcaggcacagcatccacccagccccatcaagtcctccagcgccgactccactcccagccccaccagcagcctctctagcgaagacaagcagcacctggccgtagagctggccgacaccaaggccaggctgcggcgcgtcaggcaggagctggaggataagacagagcagcttgtggacaccagacatgaggtggaccagctggtgctggaactgcagaaagttaagcaggagaacatccagctagcggcagacgcccggtctgctcgtgcctatcgagacgagctggattccctgcgggagaaggcgaaccgcgtggagaggctggagctggagctgacccgctgcaaggagaagctgcacgacgtggacttctacaaggcccgcatggaggagctgagagaagataatatcattttaattgaaaccaaggccatgctggaggaacagctgactgctgctcgggcccggggcgataaagtccatgagctggaaaaggagaacctgcagctgaaatccaagcttcacgacctggaattggaccgggacacagataagaaacgaattgaggagctgctggaagaaaacatggtccttgagattgcacagaagcagagcatgaacgaatctgcccaccttggctgggagctggagcagctgtccaagaacgcagacttgtcagacgcctccaggaagtcgtttgtgtttgagctgaacgaatgtgcgtccagccgcatcctgaagctggagaaggagaatcagagcctccagagcaccatccaggggctgcgggacgcgtccctggtgttggaggagagcggcctcaagtgcggggagctggagaaggagaaccaccagctcagcaagaagattgaaaagttacaaacccagctggagagagaaaagcagagcaaccaagatctggagaccctcagtgaggagctgatcagagagaaggagcagctgcagagtgacatggagaccctgaaggctgacaaagccaggcagatcaaggaccttgagcaggaaaaggaccacctcaaccgagccatgtggtcgctgcgggagaggtcgcaggtcagcagtgaggcccgcatgaaagacgtggagaaggagaacaaagccctccaccagacggtgacggaggccaatggcaagctcagccagttggagtttgagaagcggcagctgcacagggacttggagcaggccaaggagaagggggagcgggcagagaagctggagagggagctacagcgactccaggaggagaacgggaggctggccaggaaggtgacctccctggagacagccaccgagaaagtcgaggccctggagcatgagagccagggcctgcagctggagaaccggactctgaggaagtctctggacaccttgcagaacgtgtccctgcagcttgagggcctggagcgtgacaacaagcagctggacgcagagaacctggagctgcgcaggctggtggagaccatgcgcttcaccagcaccaagctggcacagatggagagggagaaccagcagctggagcgtgagaaggaggagctgaggaagaacgtggatctgctcaaggcgctgggcaagaagtcagagcgcctggagctcagctaccagagcgtgagcgctgagaacctccggctgcagcagagcctggagagcagcagccacaagacgcagaccttggagagtgagctgggcgagctggaggctgagcgccaggcgctgcggcgggacctggaggccctccggctggccaatgcacagttggagggggccgagaaggacaggaaggccctggagcaggaggtggcccagctcgagaaggataagaagctgctggagaaggaggccaagcggctgtggcagcaggtggagctcaaggatgcagtcttggacgatagcactgccaaactgtccgccgttgagaaggagagccgcgcgctggacaaggagctggcccgctgcagggacgcagccggcaagctgaaggagctggagaaggacaaccgggacctcaccaagcaagtcaccgtgcatgcaaggacactgacaactctgagggaggacctggtgctcgagaagctgaagagccagcagctcagcagtgagctggacaagctgagccaggaactggagaaggtcggcctcaacagggagctgctgttgcaggaggacgacagcggcagtgacacaaaatacaagattttggagggcagaaatgaatcagcattaaaaacaacactagccatgaaagaagaaaagattgtgctcttagaagcacagatggaagagaaagcgagcctaaatcgccagttagagagtgagctgcagatgctaaagaaggagtgtgagaccctcaggcagaaccagggagaggggcagcacttgcagaactctttcaagcaccctgcggggaagacagccgccagtcaccaggggaaggaggcctgggggcccggccataaggaagccaccatggagcttctccgagtgaaggaccgggccatcgagctggagcggaataatgcagctctgcaggctgagaagcagctgctaaaggaacagctgcagcacctggagacccagaacgtgaccttcagcagccagatcttgacactgcagaaacagagcgccttcctgcaggagcacaacaccacactgcagacccagaccgccaagctgcaggtggagaactccacgctgagttcccagagcgcagcgctcaccgcgcagtacacgctgctgcagaaccaccacacggccaaggagacggagaacgaaagcctgcagaggcagcaggagcaacttacagcggcctacgaggccctgctgcaggaccacgagcacctgggcacgctgcacgagcggcaatcggccgagtacgaggccctcatccgccagcacagctgcctaaagacactgcatcggaatctggagctggagcacaaggagctcggggagaggcacggtgacatgctgaagcgcaaggcggagctggaggagcgggagaaggtcttgaccactgagcgagaggcgctgcagcaggagcagaggacaaacgccctcgccatgggcgagaaccagaggctgcggggcgagctggacagggtcaatttcctgcaccaccagctgaagggggagtacgaggagctgcacgcccacaccaaggagctgaaaacctcactgaacaacgcgcagctggagctcaaccgctggcaggcccgcttcgacgagctgaaggagcagcaccagaccatggacatctcgctgaccaagctggacaaccactgtgagctgctctcccgtctcaaggggaacttggaggaagaaaatcatcacctcctgagccagatccagctgttgagccagcagaaccagatgcttctggagcagaacatggagaacaaggagcagtaccatgaggagcagaagcagtacatagacaaattaaatgccttacgaagacataaggaaaagctggaagaaaaaatcatggatcaatacaagttctatgatcctcctccaaagaagaagaaccactggattggagccaaagccttagtcaaactcatcaaaccaaagaaagagggttcgagggaacgcttaaaatccaccgtggacagccctccctggcagctggagtcctcagaccccgcctcgccggcggcctctcagccgctcagatcacaggccgagaaccccgacacccccgcactgggctccaactgtgcagaagagcgcgacgcccacaacgggtctgtggggaaaggccctggggatctaaaaccaaagcgaggctccccacacagaggcagccttgaccgcacagatgcctccaccgatctggccatgaggtcctggccctcggagctgggctcccggacttgctcaacttcagccaccactacagccccttccaactccacccccatcgcccggcacccaggccgcaccaaaggctataactcagatgacaacctctgtgagccatccctggagtttgaggtccccaaccacaggcagtacgtgtcgcggccaagtagcttagagagcagtagaaacacatccagcaacagctcacctcttaacctaaaaggctcctccgagcagctccatggccggtctgagagcttcagcagcgaagacctgatccccagcagggacctggccactttgccccgggaagccagcacaccgggacgcaacgccctcggccgccacgagtaccccttgcctcggaacgggcctctcccacaggagggtgcccagaagaggggcacagcccctccctacgtcggagtgcggccctgctcggcctcccccagcagtgagatggtcaccttggaggagttcctggaggagagcaaccgcagctcccccacccatgacactcccagttgccgggatgacctgctgagtgactacttccgaaaggccagcgatcccccagccatcggaggccaaccaggaccacctgccaagaaagaaggggccaagatgcccaccaactttgtggcccccaccgtcaaaatggccgcccccacctcggaggggaggccgctgaagcccgggcagtacgtaaagccaaacttcagactgactgaggccgaggccccacccagcgtggccccgagacaggcccagcctccccagagcctgtctctgggcagaccccggcaggctccggtgcccccagcttcccatgcacctgccagccgcagtgcctccttgagccgggccttcagcctggcctcagctgaccttctccgggccagcgggccagaggcctgcaaacaggagtcccctcagaagctgggggctcctgaggccttagggggcagagagacaggcagccacaccctgcaaagccccgcaccccccagctcccatagcctggcccgggagcggaccccacttgtgggaaaggctggcagctcctgtcagggcccaggtccccgcagccggccgctggacacgaggcgcttctccctggctcccccaaaggaggagaggctggcccccctgcatcagtctgccacagcccccgccattgccactgcaggtgctggtgctgctgctgctggcagtggcagcaactcccagctcctgcacttctcacctgctgcagccccggctgccaggaccaagcccaaggcgcccccacgctcaggggaggtggccaccatcacccctgtccgggcagggctcagcctctcagagggagacggggtcccggggcagggctgcagtgaggggcttccggccaagagcccaggtcggtctcccgatttggctccccacctcggccgggccctggaggactgcagtcgagggagcgtctcaaagagcagtccggcctccccggagcccggcggggatccgcagaccgtgtggtatgagtacggctgtgtgtgactgtctcgtggttgagctcgcaaacctgaaaactactgacgcgccttccgactctcacggccttttctcttgcttgcctgcggtgccaggagagggtttggaatgaggaaaggggttcccacgcatttctgctgtttgttctgtgaatggaaacactgtgccaagccccaagaggattacgcttccaggtgtgtaacgtgttttctgtgtctgccgcttccagcagctgatatctttggaacaaataatccacgtcagcatggggaccaattaggatgcaatgacaaactgacttcccccaaagcagacactactccagtatgtcccagtagaacactcatttgcaatgtgttgagctccgttaagcacacacacactcacacaacaggcttacgaggctcaggcctggcgggtcagaaagcccactccctctcccaaggccactggatcccaggagaagcccagactggcgatactacaaaggtctccagggcctggcagaccccagagtcaggcctgctgttaaaaagtgagagtgctgctgttccattcctggggtcccaagcacttccctttaccccaggacccagggcagcctgcagggcagctggcggtggccttggccatttgcccccagcctccagctggctcctgagctctgcaccagggggtttggggaccacacaggcacctgccttcctagatttccctggctcacttttctgcaaacactggatctgccaggcctggggattggggggcaggaaagaggcccccatccagccccctccaggccagtgtgcacagtgcaccgaggggtcatccgcacagagcgaggtgcaagctcgatgtgtaacctggctgcggcacccgacatccccggtctcggggtgttgatttatttctgaataactttttgggtatagaaaccaattttttttaatatatgacatgtatatgtacacactcatgtgaaatatgtatactttggggggatctatttatgttccagtgggagtcactctcttctgtcgggaatcttatctgctgctttgtgtctttggtcagattcctgacaatttagtttcctgttgtaaaggtgcttttcctggggtgaactaaacctattgattttttttttttaagatttttttttccttttgatttaatatactgagaaagaaatgggagacttttgaatgttaacaagatccattttaggagtgtttggggttgtgtattaaatagccattcattctggaactcaaggacaggactgtaataaaatggaatggaaccg

SEQ ID NO: 2212 - DNA, 8215 bp, Homo sapiens
ccgagccgggagccgagcgcgctgggcgcggccgtcccgctgccgccgccaagcccggagtgcgccagcggccatggttcccgcggcggcgccgggcgcctgagccccgggacgcaagcgctggaggcgggctgccggctgtgcgggcgctccggagagaccgacagaaggtgagcactgtgggctatgggatggatgaggtggagcaggaccagcatgaggcccgactcaaggagctgtttgacagttttgacacgacgggcacagggtccctggggcaggaggaactcaccgacctttgccacatgttgagcttggaggaggtggccccagtgctgcagcagacattacttcaggacaacctcttgggcagggtacattttgaccaatttaaagaagcattaatactcatcttgtccagaactctgtcaaatgaagaacactttcaagaaccagactgctcactagaagctcagcccaaatatgttagaggtgggaagcgttacggacgaaggtccttgcccgagttccaagagtccgtggaggagtttcctgaagtgacggtgattgagccactggatgaagaagcgcggccttcacacatcccagccggtgactgcagtgagcactggaagacgcaacgcagtgaggagtatgaagcggaaggccagttaaggttttggaacccagatgacttgaatgcttcacagagtggatcttcccctccccaagactggatagaagagaaactgcaagaagtttgtgaagatttggggatcacccgtgatggtcacctgaaccggaagaagctggtctccatctgtgagcagtatggtttacagaatgtggatggagagatgctcgaggaagtattccataatcttgatcctgacggtacaatgagtgtagaagattttttctatggtttgtttaaaaatggaaaatctcttacaccatcagcatctactccatatagacaactaaaaaggcacctttccatgcagtctttcgatgagagtggacgacgtaccacaacctcatcagcaatgacaagtaccattggctttcgggtcttctcctgcctggatgatgggatgggccatgcatctgtggagagaatactggacacctggcaggaagagggcattgagaacagccaggagatcctgaaggccttggatttcagcctcgatggaaacatcaatttgacagaattaacactggcccttgaaaatgaacttttggttaccaagaacagcattcaccaggcggctctggccagctttaaggctgaaatccggcatttgttggaacgagttgatcaggtggtcagagaaaaagagaagctacggtcagatctggacaaggccgagaagctcaagtctttaatggcctcggaggtggatgatcaccatgcggccatagagcggcggaatgagtacaacctcaggaaactggatgaagagtacaaggagcgaatagcagccttaaaaaatgaactccgaaaagagagagagcagatcctgcagcaggcaggcaagcagcgtttagaacttgaacaggaaattgaaaaggcaaaaacagaagagaactatatccgggaccgccttgccctctctttaaaggaaaacagtcgtctggaaaatgagcttctagaaaatgcagagaagttggcagaatatgagaatctgacaaacaaacttcagagaaatttggaaaatgtgttagcagaaaagtttggtgacctcgatcctagcagtgctgagttcttcctgcaagaagagagactgacacagatgagaaatgaatatgagcggcagtgcagggtactacaagaccaagtagatgaactccagtctgagctggaagaatatcgtgcacaaggcagagtgctcaggcttccgttgaagaactcaccgtcagaagaagttgaggctaacagcggtggcattgagcccgaacacgggctcggttctgaagaatgcaatccattgaatatgagcattgaggcagagctggtcattgaacagatgaaagaacaacatcacagggacatatgttgcctcagactggagctcgaagataaagtgcgccattatgaaaagcagctggacgaaaccgtggtcagctgcaagaaggcacaggagaacatgaagcaaaggcatgagaacgaaacgcacaccttagaaaaacaaataagtgaccttaaaaatgaaattgctgaacttcaggggcaagcagcagtgctcaaggaggcacatcatgaggccacttgcaggcatgaggaggagaaaaaacaactgcaagtgaagcttgaggaggaaaagactcacctgcaggagaagctgaggctgcaacatgagatggagctcaaggctagactgacacaggctcaagcaagctttgagcgggagagggaaggccttcagagtagcgcctggacagaagagaaggtgagaggcttgactcaggaactagagcagtttcaccaggagcagctgacaagcctggtggagaaacacactcttgagaaagaggagttaagaaaagagctcttggaaaagcaccaaagggagcttcaggagggaagatatgaatctgaaaagcttcaacaggaaaattctattttgagaaatgaaattactactttaaatgaagaagatagcatttctaacctgaaattagggacattaaatggatctcaggaagaaatgtggcaaaaaacggaaactgtaaaacaagaaaatgctgcagttcagaagatggttgaaaatttaaagaaacagatttcagaattaaaaatcaaaaaccaacaattggatttggaaaatacagaacttagccaaaagaactctcaaaaccaggaaaaactgcaagaacttaatcaacgtctaacagaaatgctatgccagaaggaaaaagagccaggaaacagtgcattggaggaacgggaacaagagaagtttaatctgaaagaagaactggaacgttgtaaagtgcagtcctccactttagtgtcttctctggaggcggagctctctgaagttaaaatacagacccatattgtgcaacaggaaaaccaccttctcaaagatgaactggagaaaatgaaacagctgcacagatgtcccgatctctctgacttccagcaaaaaatctctagtgttctaagctacaacgaaaaactgctgaaagaaaaggaagctctgagtgaggaattaaatagctgtgtcgataagttggcaaaatcaagtcttttagagcatagaattgcgacgatgaagcaggaacagaaatcctgggaacatcagagtgcgagcttaaagtcacagctggtggcttctcaggaaaaggttcagaatttagaagacaccgtgcagaatgtaaacctgcaaatgtcccggatgaaatctgacctacgagtgactcagcaggaaaaggaggctttaaaacaagaagtgatgtctttacataagcaacttcagaatgctggtggcaagagctgggccccagagatagctactcatccatcagggctccataaccagcagaaaaggctgtcctgggacaagttggatcatctgatgaatgaggaacagcagctgctttggcaagagaatgagaggctccagaccatggtacagaacaccaaagccgaactcacgcactcccgggagaaggtccgtcagttggaatccaatcttcttcccaagcaccaaaaacatctaaacccatcaggtaccatgaatcccacagagcaagaaaaattgagcttaaagagagagtgtgatcagtttcagaaagaacaatctcctgctaacaggaaggtcagtcagatgaattcccttgaacaagaattagaaacaattcatttggaaaatgaaggcctgaaaaagaaacaagtaaaactggatgagcagctcatggagaactcagtggttggaagtagcagagaagggtgcagttctctgcctgagatagtgtgtgaagatgcagcacctgaggtccactgcgacgcctagcccgtcccctcatgcttgggatttgcagctgctccagcagcaagcctgtccgatggtgcccagggagcagtttctgcagcttcaacgccagctgctgcaggcagaaaggataaaccagcacctgcaggaggaacttgaaaacaggacctccgaaaccaacacaccacagggaaaccaggaacaactggtaactgtcatggaggaacgaatgatagaagttgaacagaaactgaaactagtgaaaaggcttcttcaagagaaagtgaatcagctcaaagaacaactctgcaagaacactaaggcagacgcaatggtgaaggacttgtatgttgaaaatgcccagttgttgaaagctctggaagtgactgaacagcgacagaaaacagcagagaagaaaaattacctcctggaggagaagattgccagcctcagtaatatagttaggaatctgacaccagcgccattgacttctacacctcctttgaggtcatagccaaaccaaagggtacactcatatttgtgcactttactgaaatagatgaacatttcagtaggttctcaacttaaaattaagcctaacctaaaactgccagcaacacaactggagtttccatttatcataattagtttttctaaatagacccttatgggagtttgaaaataaatactcacatatttcactacttaaattattcccaagatttgaatttattttaaaattttaatagccaccaagaatgtggacatatgaaaattcaagaacctaaaaaataccagttttgaatgagtttttgtggttttggttttttttttaattattacaaatctatgtgtaaaatctagatatttgaagtttgagatctgatgagaatggttgttataaactttattttaaaaccaaatttaggtgttcttacatatttaaatactggaaagtcattataatagttttggttctttgaattggtagacaattagtagagtataattggttaggaggcagggcttattaagtggttattaaccgctgacatcagacaaacccaaatctgtagaattctaaccttctaacacctgtgacagtattaccactcttcttgtattatagatttagaactgatttactcaattgcactcttaactaatgttaaaagcttacttgctttaaacagccttttcttctttctcttaaaagtttcatttggggagctggtcttctaagaaacggataaagccacataattaaagcagttgaactatagggaaagcactgaacaaaccactttggagtaaatagctactcttagaaaagagggataagcagaccatgtaggttttctgtctctcaaatcttagagttcataaatttacttgaggttgcctcaagaactcagggaacaatactgtaaactgtcttcctgaactactgtagggcctctctaagaatttgaaatgtataaaccatgtgacctcatttatttgtcttatatatttacagccatactagaatttttatttctacgtttttagtaaatttaatattctgggggaaaaaaggccttgattttagggttaaaaacctgacttatagaagagtttatttaatataggtcaaaattttctgtgtttcttattccttctatacctcaaatctgattctaagaatttcttactgtgataatcattggcatgccacctgaggtcaaggagtgccaaataggactttccactcatgctcaagatcaaaactttatagaacagtcaacattttagattcggtaaccttttttttcttccaattataatctctgctagccacttccgccagcagttggtggaagacttactaggtgcagggcactttccaagttcatcacaacaacctgcttgttttcatgagacaataatccgaaaagttcgctttgatatattcctggagggccaagcccatctatttacaaaaggtgaacagcaaaatcaagcactgctttatgggcaggaacacaagagaaagcaaactgcccaagaagtcatcatgtcagaaactcaatctcaacaaaataatttccatcagggaacttcagggtttcttgggggcttatgagtctcaccggtcaacccaggaggcctcactacaagagccttgacaaggcactgttttttgtgggactgggagttcacactgatgaagcaaacctttgaatttttgcacagctcttgtcagaaagccctgagttccccctggataaagagttaattttaatccttccctataattatacttcaaaatatttgacatctgctattatgccttctttagatctttcttctgtggtgcagacatttctagtaagtgtttgactacttgtatggcattagctttcacagaaaattgtttcacttaaaactgtggattggcctaggctaaggacaaaaataaactaagtacctgtagtgtatttatgtgatatgtgtcaagttactcaaagttattgctgttggaactgaacaataatatttcccagatagctggccttagcatgtgatcacggttgttgtatttttaatttttgtcttttacagtatgagaggtgtaggttaatttgtttatttcctataaatttgtatttatgtgtatataaaatgtacaatgaatgtaaatatgactttctggaaagtttagactacatttagaatctctattcaaaatcaaaatgctgctcaaatgaatttaaccaacatctaggtgcttaatttctcattttatcccacttatgagattgggaaaaagatcaatatgagaaataccatacagataccttaaatgtatgcatttgtgcaacaatttttgagaaggtgagtggcaatttataatttagttggcaatttataatagaacttatagcttttaaaagaccttttaaagacattaaatgtaaacttaaaaatgtttagatcttgtttcaaactttacaatagcattcttcaaaatattaagttatatattttataggcatttagttgcttattaaaagcactgattttcaaactttttgatttaagaacaattatttaagatcgtctcagaagatgggatcttcgtttcaagaaaagggaatcaagtttgcctttgagataatacgttacactaagaaaaggaaaatgtggatagtaaaacccacctctctcatcctattgtactctcttctgctttttagaagcctgcacttaagcttagatttgtgaagggagagtagaaggggagaagtagaaccacagtgttttatttatttttctaaaactcttactaaatccagattttttaaactgttttaaatgtgaattcttcccagaaatttcaatgcattgcatatttagccttcggcatatttttcatgaatagatcatgaagtcataggcttccaaggcataggaagagatcttgcaggtctagtattttaataatgcactattacccagggcagatattatgagaaactgtttcttctctaagggtttatggcagactttgcttttttaacatgtgagaaatgaattttttattttgtgatttatgtgatttcttttgctgagtgaaggaaaggagaaattgttgctattgtcagcatcttaaaggtatttccagtcaaggcaaggctaagtgctttgtgatagtattaagcaagtcatgttttgaatggattacctgtagtgactcattggaatgatataattatacaagtaatgccaaaaaccaagtcaaagcctaattaaccaaagcactcatttaaaaatcatcatgtttggacctatctggacctctcagcactgtaaaatagttttggttttgtggcatatgaatagctgtttaacaaatcaaagttagctttttgcttctcagcttttttgggcaatacaagttaagttcttaatggggagacattatcatggcatgacttaagggaacattggtttgtgaaggaaaaacagattatctaaagccatctctatgtttctgttcagataaagattaatgagttctgtgtttatatcagctttgtatatttcatcttagccattctatcctagaaagattttaatgtgagcttaagatgtaaataaataattttgcaaacatgccttttgttttctatataccctgaccttttaataaagtttcagtgtatttatca

SEQ ID NO: 2213 - DNA, 3643 bp, Homo sapiens
gcgttgttggtttcgggttgtcaggcagcgcgcgaggcggcgggcagctagcagctggcggacgcgacccggaggcggtgggggtgcggctgagccatgcccggtggcgcggcctgagcccctccacctgctgcaatcatgaaggacagcggggactccaaggaccagcaactcatggtggcgcttcgggtccggcccatcagcgtggcagagctggaggaaggagctaccctcatcgcccataaagtggatgagcagatggtggttctcatggacccaatggaggatcccgacgacatcctgcgggcgcatcgctcccgggagaagtcctacctgttcgacgtggcctttgacttcaccgccacccaggagatggtgtatcaggccaccaccaagagcctcatcgagggcgtcatctcaggctacaatgccactgtctttgcctatggccccacaggctgtgggaaaacctacaccatgctgggcacagaccaggagcctggcatctatgttcagaccctcaacgacctcttccgtgccatcgaggagaccagcaatgacatggagtatgaggtctccatgtcctacctggagatctacaatgagatgatccgggacctgctgaacccctccctgggctacctggagctgcgggaggactctaagggggtgatccaggtggccggcatcaccgaagtctccaccatcaatgccaaggagatcatgcagctgctgatgaaggggaaccggcagaggacccaggagcccacggccgccaaccagacgtcctcccgctcccacgcggtactgcaggtgaccgtgcgccagcgcagccgggtcaagaacatcttgcaggaggtgcggcagggccgcctgttcatgatcgacctggctggctcagagcgcgcctcgcagacacagaatcgtgggcagcgtatgaaggagggggcccacatcaaccgctcactgctggcactgggcaactgcatcaacgccctgagcgacaagggtagcaacaagtacatcaactatcgcgacagcaagctcacccggctcctgaaggactctctgggaggaaacagccgcacagtgatgatcgctcacatcagtcctgcgagcagtgccttcgaggagtcccggaacaccctgacctacgccggccgggccaagaacattaagactagggtgaagcagaacctcctgaacgtctcctaccacatcgcccagtacaccagcatcatcgctgacctgcggggcgagatccagcgactcaagcgcaagattgatgagcagactgggcggggccaggcccggggccggcaggatcggggtgacatccgccacatccaagctgaggtccagctgcacagcgggcagggtgagaaggctggcatgggacagcttcgggagcagctcgccagcgccttccaggagcagatggatgtgcggaggcgcctgctggagctggagaaccgcgccatggaggtccagattgacacctcccgacacctgctcaccatcgccggctggaagcatgagaagtcccgccgggccctcaaatggcgggaggagcagcgaaaggagtgctacgctaaggacgacagcgagaaggactcagacacaggtgatgaccaaccagacatcctggagccacccgaggtggccgcagcccgggagagcattgcagccctggtggacgagcagaagcaactgcgcaagcagaagctggcgctggagcagcgctgccgggagctgcgcgcgcggggccggcgcctggaggagacgctgccgcggcgcatcggctccgaggagcagcgcgaggtgctcagcctgctgtgccgcgtgcacgagctcgaggtggagaacaccgagatgcagtcgcacgcgctgctccgcgacggtgcgctccgccaccgccacgaggccgtgcgccgcctggagcagcaccgcagtctctgcgacgagattatccagggccagcggcagatcatcgacgactacaacctggccgtcccgcagcgcctggaagagctctacgaagtgtacctgcgggagctggaggagggcagcctggagcaggccaccatcatggaccaagtggcctccagggccctgcaggacagctccttgcccaaaattaccccagcaggaacctcactgaccccagattctgacctggagagtgtgaagacattgagctctgatgcccagcacctgcagaacagcgccctccctcccctcagcacagagagtgaaggccaccacgtgttcaaggctggtactggggcctggcaggcaaaaagctcctctgtgcccaccccacctcccatccagctcggcagcctggtgacgcaggaggccccggctcaggacagcctgggcagctggatcaactcttcccctgacagcagtgagaacctgtcggagatccccttgtcccacaaagagaggaaggagatcctgactggcaccaagtgcatctgggtgaaggccgcccggcggcgctcgcgggccctgggaaccgaggggcgacacctgctggcacccgcgacagagcgcagcagcctgtccctgcactcactgagcgagggcgacgatgcgcggccaccaggcccactggcctgcaagcggccgcccagccccacactacagcatgctgccagtgaggacaacctgtccagcagcacgggcgaggccccgtcccgggcagtcggacatcatggggacggccccaggccctggctgcgtggccagaagaaaagcctgggcaagaaaagggaggagtcgctggaggcaaagagaaggaagcggaggtcccgatccttcgaggtcaccgggcaagggctctcccaccccaagacacacctcctggggccccatcaggcggagcgcatctcggaccacaggatgccagtgtgcaggcacccagcccctggtatccggcatctgggaaaggtcacgctacctttggccaaagtcaaactccctccaagccagaacacgggcccgggggactcctcacccctggctgttccccccaacccaggtggtggttctcgacgggctacccgtgggccccgcctgccccacggcacaagcacccatggcaaagatggatgctcccggcataactgaggggccctgcctggaactggctctctcacctcccaagactgaatggggtctagcagggcatgggaggtggaggctgggcagatggagatgaccaggaagtaagctcaggatctcagcaggccagggctcctgagacccaggaactggggtctctgcccaaccctcccatgctttcagtgccactggggaaaagaggtgaggccaggggacatggccaggacggctgggctccctggcttcccagccctggacagaatgctgttgccaaaacctgcacagccctgaggccagcctcggccttggtaacggaggaaagcagctgacagtgagacggggctcctggcccacgtgtggggcacgggcatcctggatggttggggaggcgccgacaggcacttcacgtattacaattggggatgtgggtgagggagggaatctggttttgttacttggcagtggttttttctcacccttcctttttaacaataaaatcccatttgggtcttga

SEQ ID NO: 2214 - DNA, 1777 bp, Homo sapiens
ctactccgccgagcctacgtgacacgacgtcaagtggcaatggcggcggacgagggctgtgcccccggcccgccccgttaggagccgcgagtaaggcgagtgtccaacgccgagctggctgacagagcccggccgcggcctccgcgggcccaggggcctccaggccccgtgaccaccggaccgagcaccctggaacggccccagcttggcctcgggacagtccgcgcgctcaccgactccctggtgaacgccgcttggccgccgccgccgccgcaggacccacgagaagcggaaaccggcgcaaggacccggtccccccggcgccgaatgtagtaagaaaacaaaaactgatgaccaagagaatgtgtcagccgatgcaccgagtccagcccaggaaaatggagagaagggagaattccacaagttggctgatgccaagatatttttgagcgactgcctggcatgtgacagctgtatgactgcagaggaaggagtccaactttcccagcaaaatgccaaggacttcttccgcgttctgaaccttaacaagaaatgtgatacctcaaagcacaaagtgctggtagtgtctgtgtgtcctcaatctttgccttattttgctgctaaattcaacctcagtgtaactgatgcatccagaagactctgtggtttcctcaaaagtcttggggtgcactatgtatttgatacgacgatagctgcggattttagtatcctggagagtcaaaaagaattcgtgcgtcgctatcgccagcacagtgaggaggaacgcaccctgcccatgctgacctctgcctgtcctggctgggtccgatacgccgagcgggtgctgggtcgccccatcactgcccacctctgcaccgccaagtccccccagcaggtcatgggctctttggtgaaggattatttcgccagacagcagaacctgtctccagagaagattttccacgtcattgtggccccttgttatgacaagaagctggaggctcttcaggaaagccttccccctgctttgcatggctcccggggcgctgactgcgtgttaacatcaggtgaaattgctcaaataatggagcaaggtgacctctcagtgagagatgctgccgtcgacactctgtttggagacttgaaggaggacaaagtgacgcgtcatgatggagccagctcagacgggcacctggcacacatcttcagacatgcggccaaggagctgttcaacgaggatgtggaggaggtcacttaccgagccctgagaaacaaagacttccaagaggtcacccttgagaagaacggagaggtggtgttacgctttgctgcagcctatggctttcgaaacatccagaacatgatcctgaagcttaagaagggcaagttcccattccactttgtggaggtcctcgcctgtgctggaggatgcttaaatggcagaggccaagcccagactccagacggacatgcggataaggccctgctgcggcagatggaaggcatttacgctgacatccctgtgcggcgtccggagtccagtgcacacgtgcaggagctgtaccaggagtggctggaggggatcaactcccccaaggcccgagaggtgctgcataccacgtaccagagccaggagcgtggcacacacagcctggacatcaagtggtgaagtcaggccagggccttccagctgctcttggggccagagccaagagcctctcagtagagggaggggctgccctgagtggagtattaaagacacttaagaaaaccgctc

SEQ ID NO: 2215 - DNA, 3888 bp, Homo sapiens
atgaaggttgcaggaggacttgaacttggagctgctgctctgctctcagcatcaccacgtgctcttgtcactctttccacaggtcctacttgctctatattaccaaagaatccacttttcccccaaaacctgagctctcagccttgtatcaagatggaaggagacaaatcgctcaccttttccagctacgggctgcaatggtgtctctatgagctagacaaggaagaatttcagacattcaaggaattactaaagaagaaatcttcagaatcgaccacatgctctattccacagtttgaaatcgagaatgccaacgtggaatgtctggcactcctcttgcatgagtattatggagcatcgctggcctgggctacgtccattagcatctttgaaaacatgaacctgcgaaccctctcggagaaggcacgggatgacatgaaaagacattcaccagaagatcctgaagcaacgatgactgaccaaggaccaagcaaggaaaaagtgccaggaatttcacaagctgtgcaacaagatagtgccacagctgcagagacaaaagaacaagaaatttcacaagctatggaacaagaaggtgccacagcagcagagacagaagaacaagaaatttcacaagctatggaacaagaaggtgccacagcagcagagacagaagaacaaggacatggaggtgacacatgggactacaagagtcacgtgatgaccaaattcgctgaggaggaggatgtacgtcgtagttttgaaaacactgctgctgactggccggaaatgcaaacgttggctggtgcttttgattcagaccggtggggcttccggcctcgcacggtggttctgcacggaaagtcaggaattgggaaatcggctctagccagaaggatcgtgctgtgctgggcgcaaggtggactctaccagggaatgttctcctacgtcttcttcctccccgttagagagatgcagcggaagaaggagagcagtgtcacagagttcatctccagggagtggccagactcccaggctccggtgacggagatcatgtcccgaccagaaaggctgttgttcatcattgacggtttcgatgacctgggctctgtcctcaacaatgacacaaagctctgcaaagactgggctgagaagcagcctccgttcaccctcatacgcagtctgctgaggaaggtcctgctccctgagtccttcctgatcgtcaccgtcagagacgtgggcacagagaagctcaagtcagaggtcgtgtctccccgttacctgttagttagaggaatctccggggaacaaagaatccacttgctccttgagcgcgggattggtgagcatcagaagacacaagggttgcgtgcgatcatgaacaaccgtgagctgctcgaccagtgccaggtgcccgccgtgggctctctcatctgcgtggccctgcagctgcaggacgtggtgggggagagcgtcgcccccttcaaccaaacgctcacaggcctgcacgccgcttttgtgtttcatcagctcacccctcgaggcgtggtccggcgctgtctcaatctggaggaaagagttgtcctgaagcgcttctgccgtatggctgtggagggagtgtggaataggaagtcagtgtttgacggtgacgacctcatggttcaaggactcggggagtctgagctccgtgctctgtttcacatgaacatccttctcccagacagccactgtgaggagtactacaccttcttccacctcagtctccaggacttctgtgccgccttgtactacgtgttagagggcctggaaatcgagccagctctctgccctctgtacgttgagaagacaaagaggtccatggagcttaaacaggcaggcttccatatccactcgctttggatgaagcgtttcttgtttggcctcgtgagcgaagacgtaaggaggccactggaggtcctgctgggctgtcccgttcccctgggggtgaagcagaagcttctgcactgggtctctctgttgggtcagcagcctaatgccaccaccccaggagacaccctggacgccttccactgtcttttcgagactcaagacaaagagtttgttcgcttggcattaaacagcttccaagaagtgtggcttccgattaaccagaacctggacttgatagcatcttccttctgcctccagcactgtccgtatttgcggaaaattcgggtggatgtcaaagggatcttcccaagagatgagtccgctgaggcatgtcctgtggtccctctatggatgcgggataagaccctcattgaggagcagtgggaagatttctgctccatgcttggcacccacccacacctgcggcagctggacctgggcagcagcatcctgacagagcgggccatgaagaccctgtgtgccaagctgaggcatcccacctgcaagatacagaccctgatgtttagaaatgcacagattacccctggtgtgcagcacctctggagaatcgtcatggccaaccgtaacctaagatccctcaacttgggaggcacccacctgaaggaagaggatgtaaggatggcgtgtgaagccttaaaacacccaaaatgtttgttggagtctttgaggctggattgctgtggattgacccatgcctgttacctgaagatctcccaaatccttacgacctcccccagcctgaaatctctgagcctggcaggaaacaaggtgacagaccagggagtaatgcctctcagtgatgccttgagagtctcccagtgcgccctgcagaagctgatactggaggactgtggcatcacagccacgggttgccagagtctggcctcagccctcgtcagcaaccggagcttgacacacctgtgcctatccaacaacagcctggggaacgaaggtgtaaatctactgtgtcgatccatgaggcttccccactgtagtctgcagaggctgatgctgaatcagtgccacctggacacggctggctgtggttttcttgcacttgcgcttatgggtaactcatggctgacgcacctgagccttagcatgaaccctgtggaagacaatggcgtgaagcttctgtgcgaggtcatgagagaaccatcttgtcatctccaggacctggagttggtaaagtgtcatctcaccgccgcgtgctgtgagagtctgtcctgtgtgatctcgaggagcagacacctgaagagcctggatctcacggacaatgccctgggtgacggtggggttgctgcgctgtgcgagggactgaagcaaaagaacagtgttctggcgagactcgggttgaaggcatgtggactgacttctgattgctgtgaggcactctccttggccctttcctgcaaccggcatctgaccagtctaaacctggtgcagaataacttcagtcccaaaggaatgatgaagctgtgttcggcctttgcctgtcccacgtctaacttacagataattgggctgtggaaatggcagtaccctgtgcaaataaggaagctgctggaggaagtgcagctactcaagccccgagtcgtaattgacggtagttggcattcttttgatgaagatgaccggtactggtggaaaaactgaagatacggaaacctgccccactcacacccatctgatggaggaactttaaacgctgttttctcagagcaagctatgcacctgggagttccttctcaaagatggagaatgatttctgattctcacaaagccctcaatggtagtgattcttctgtgttcactctacgttggttactggatttgaaggctagagaccttcaagtcataggactcagtatctgtgaaatgtccgtcatatctcagagcatatagagggaattaaataaacacaaagcatttggaaaagtt

SEQ ID NO: 2216 - DNA, 3608 bp, Homo sapiens
ggttccgctgaggcgtggtaggaagtggctgccgtcaatcactcggggagactccaaacagtgagcctagagctggagactagcgttaaccggcggggcggccggttttatgaatgaagctatggctacagattccccaagaagacccagtcgttgtactggtggagttgtggttcgcccccaggctgtcacagagcagtcctacatggaaagtgttgtgacttttctgcaggatgttgtgccacaggcttacagtggaacacctctaacagaagaaaaggagaaaatagtctgggtcagatttgaaaatgcagatttaaatgatacatcaagaaatctggaatttcatgaaatacatagtactgggaatgaaccgcctttgttgattatgattggctacagtgatggaatgcaggtctggagcatccctatcagtggtgaagcacaagagctcttctctgttcgacatggcccaattcgagcggctagaatcttgcctgctccacagtttggtgctcaaaaatgtgataactttgctgaaaaaagacccctccttggtgtttgtaagagcattggatcttctggcacaagcccaccgtactgttgtgtggatctgtattcacttcgtactggggagatggtcaagtccattcaatttaagacacctatttatgatctccattgcaataaacggatccttgtcgtagtcttgcaggagaaaattgctgcctttgatagctgtactttcacgaagaaattctttgttacaagctgctatccatgtccagggccaaacatgaatcctattgctcttgggagccgctggcttgcttatgcagaaaacaagttgattcgatgtcatcagtcccgtggtggagcctgtggagacaacattcagtcttatactgccacagtcattagtgctgctaaaacattgaaaagtggcctgacaatggtagggaaagtggtgactcagctgacaggcacactgccttcaggtgtgacagaagatgatgttgccatccacagtaattcacggcggagtcctttggtcccaggcatcatcacagttattgacaccgaaaccgttggagagggccaggtgcttgtgagtgaggattctgacagtgatggcattgtggcccacttccctgcccatgagaagccagtgtgctgcatggcttttaatacaagtggaatgcttctagtcacaacagacacccttggccatgactttcatgtcttccaaattctgactcatccttggtcctcatcacaatgtgctgtccaccatctgtatactcttcacaggggagaaactgaagccaaagtacaggacatctgcttcagccatgactgtcgctgggttgtggtcagtactctccggggtacttcccacgttttccccatcaacccttatggtggccagccttgtgttcgtacacatatgtcaccacgagtagtgaatcgcatgagccgtttccagaaaagtgctggactggaagagattgaacaagaactgacgtctaagcaaggaggtcgctgtagccctgttccaggtctatcaagcagcccttctgggtcacccttgcatgggaaactgaacagccaagactcctataacaattttaccaacaacaaccctggcaaccctcggctctctcctcttcccagcttgatggtagtgatgcctcttgcacaaatcaagcagccaatgacattggggaccatcaccaaacgaaccgggccttatctctttggagcggggtgtttttccataaaagccccatgcaaagttaaacctcctccacaaatttcacccagcaaatcgatgggcggagaattttgtgtggctgctatcttcggaacatccaggtcatggtttgcaaataatgcaggtctgaaaagagaaaaagatcagtccaaacaagttgtagttgagtccctgtacattatcagttgctatggcaccttagtggaacacatgatggagccgcgacccctcagcactgcacccaagattagtgacgacacaccactggaaatgatgacatcgcctcgagccagctggactctggttagaacccctcaatggaatgaattgcagccaccgtttaatgcaaaccaccctctgctcctcgctgcagatgcagtacagtattatcagttcctgcttgctggcctggttccccctggaagtcctgggcccattactcgacatgggtcttacgacagtttagcttctgaccatagtggacaggaagatgaagaatggctttcccaggttgaaattgtaacacacactggaccccatagacgtctgtggatgggtccacagttccagttcaaaaccatccatccctcaggccaaaccacagttatctcatccagttcatctgtgttgcagtctcatggtccgagtgacacgccacagcctcttttggattttgatacagatgatcttgatctcaacagtctcaggatccagccagtccgctctgaccccgtcagcatgccagggtcatcccgtccagtctctgatcgaaggggagtttccacagtgattgatgctgcctcaggtacctttgacaggagcgtgaccctgctggaggtgtgcgggagctggcctgagggcttcgggctgcggcacatgtcctccatggagcacacggaggagggcctccgggagcgacttgccgacgccatggccgagtcacctagccgggacgtcgtgggatccggaacagaacttcagcgagagggaagcatcgagactctgagtaacagctcaggctccaccagcggcagcataccaagaaactttgatggctaccgatctccgctgcccaccaatgagagccagcccctcagcctcttcccgactggcttcccgtaggtaccagcaacctgcttctgactggccagccccctcccctgctggaggaggggagaagccccgctctggtcctacccttcagtctctgctcttccttcatcaaccaccttccccaagcttagtgacagcagccgcccatcctacctggatggagaagagacccttctccaagcacctcagcgcacttgccctctgccacacctgtcggtggaggctgtggccaggagagactgtagaagctcggtccctgtgtatgtttgcatatgacatcctgcattggatccgcttttgtattttttaaccatacccacggtggggcgggtggggggagcctggaacagtgaccagatctgggggcctgagtggggacagagttgatcgtccacctggccattttgaccctgagtggacagtcacagcctcagctcatgtctggctgtgacacacactgcccccagcttcccttggtcagccccactccagcacggggtgaacggaggcccagagtactagggaaggaggaagggaggacatgcctcttcttcctcctttctttccccatctgttcatgggaagagtttgtctttcttatctttaagcccctttaccctggtcctgtactgatcagtgaaggaaaccgtggttactgaggccctgttgaaaagtgcacgtcttgtccaataaatcacgctgcagttggtgtccatccctg

SEQ ID NO: 2217 - DNA, 1074 bp, Homo sapiens
cttcctggaaacccacccagaacctccaccctctgacaccatggtcaactcctgttgtggctctgtgtgctctgaccagggctgtggcctagagaactgctgccgtcccagctactgccagaccacctgctgcaggaccacctgctgccgccccagctgctgtgtgtccagctgctgcagaccccagtgctgccagaccacctgctgcaggaccacctgctgccaccccagctgctgtgtgtccagctgctgcagaccccagtgctgccagtctgtgtgctgccagcccacctgctgcagaccccaatgctgccagactacctgctgtaggaccacctgctgccgccccagctgctgcaggccccagtgctgccagtctgtgtgctgccagcccacctgctgctgccccagctactgtgtgtccagctgctgcagaccccagtgctgccagaccacctgctgcagaaccacctgctgccgccccagctgctgtgtgtccaggtgctacaggccccattgtggccagtctctatgctgctagcccatctgctggcaaaccacctgctacaggaccacctgctgccaccccagctattgcatttccagctgctgccagccttcctgcagtatctctagcagcagtagctcctcctgctgtggcttcagctgctgcaggctctcctgctgcatctccagttgctgccgccccaactgctgccagaccatgtgctgccgcccaacctgctctagtgcttcttgctgctgaggctgtcatctggactcaccagattctcatcaaccagcattcttgatgtagctcatctatgagctgagttatgggaagctagttggaaaacttcagttccaaccaattcttagattgaatctggcctccaaatatatgctccccccacattttacctctctaccaaatgaacataagttgtaatttgctctgaaatctgtcaactatcttaattgaaatatttgctctctgccataatttctcatatggagctattccattttaaacaaatatttatctaaataaatcttaaataaattttcaggcat

SEQ ID NO: 2218 - DNA, 2478 bp, Homo sapiens
ttcactcgctgaagtcatctgggagacagtgccaaatgttccactccagagtcttggcctctaggaggcaggaacagcaggcctggccagcccaaaggactctctatccaggatgtaaatgagcacactgctggcccatgcgcctcggggctgtagagggcagcctcagaggcactgggcattcctggcaccatggatgacgctgctgtcctcaagcgacgaggctacctcctggggataaatttaggagagggctcctatgcaaaagtaaaatctgcttactctgagcgcctgaagttcaatgtggcgatcaagatcatcgaccgcaagaaggcccccgcagacttcttggagaaattccttccccgggaaattgagattctggccatgttaaaccactgctccatcattaagacctacgagatctttgagacatcacatggcaaggtctacatcgtcatggagctcgcggtccagggcgacctcctcgagttaatcaaaacccggggagccctgcatgaggacgaagctcgcaagaagttccaccagctttccttggccatcaagtactgccacgacctggacgtcgtccaccgggacctcaagtgtgacaaccttctccttgacaaggacttcaacatcaagctgtccgacttcagcttctccaagcgctgcctgcgggatgacagtggtcgaatggcattaagcaagaccttctgtgggtcaccagcgtatgcggccccagaggtgctgcagggcattccctaccagcccaaggtgtacgacatctggagcctaggcgtgatcctctacatcatggtctgcggctccatgccctacgacgactccaacatcaagaagatgctgcgtatccagaaggagcaccgcgtcaacttcccacgctccaagcacctgacaggcgagtgcaaggacctcatctaccacatgctgcagcccgacgtcaaccggcggctccacatcgacgagatcctcagccactgctggatgcagcccaaggcacggggatctccctctgtggccatcaacaaggagggggagagttcccggggaactgaacccttgtggacccccgaacctggctctgacaagaagtctgccaccaagctggagcctgagggagaggcacagccccaggcacagcctgagacaaaacccgaggggacagcaatgcaaatgtccaggcagtcggagatcctgggtttccccagcaagccgtcgactatggagacagaggaagggcccccccaacagcctccagagacgcgggcccagtgagcttcttgcggcccagggaatgagatggagctcacggcttaaagcccaagctctgaagaagtcaagggtggagccagagaaggaaggcagtcccagatgagcctctattttcatcagcttcttctctctccccttgaacttggtaacccacatggttctcccgtggcccctaggtggatgaggccaaagtcaaatccaaggctgagacagtcgtgcgactcctactcccccagagcgtgacccggagcaggtgctggacacagagcctgtctcagcagagggtccccactggccgcaacggctcagtgacagcaagagcaggaagagcagcaggaaggcaccgctgtccaccttgggcaccatttatcctcctttcatcgtccccggggcagttgcgtgaccctgctgggaggccagaccgggccagactgagggtcaggggaccaggctgggttgggggttgggtggggctggacggggacgaggcgcggagaggcggcgggaaagagcttcggctgggccacgggctcgcgggcactctcggcggcagcctcgggggctccgactccagctctgggcaagatccataaacttttaaagaagcctcaaaacatacttttaaagcattaagctttaaagtgctagaaatcttgtgccccatatgtgcttctttcagtattatcctagatcctcaggagtagcatggcaactggagaaaatgggaggaaagacaagaagaaatagaagctgatttaacatcaagtttattcagttttgatttttcttatctctactggctttctcctgttcaaaccttgcagcgataatatttggaaaagagcacttggaaattatattcctgtttttaactctttatatttaatcattctccttgtaattgattttgtagctaatttactccccagcacccccagaagaaaattttacaaaggaaaatgttttatttttattttttccttatcaactttttatttaaatgctaatatccaattaatggacaaacgaatcagctaatactggaaacaatgtaacaatagtgaaaagcatgaacttttgatttctatagaccgaatttgactctgctactaaatgatcttgggcaagttggttaatctatatgtctcagtttctttatctataaaatgagaataatacaacttc

SEQ ID NO: 2219 - DNA, 646 bp, Homo sapiens
acaaaccaactcaccactcctgacaccatgagtcactacggcagctactacggaggcctgggctacagctgtggaggcttcggtggcctgggctatggctatggctgtggatgtggcagcttctgcagacggggttctggctgtggctatggaggctacggatatggctctggctttggaagctacggatatggctctggctttggaggctacggatatggctctggctttggaggctatggatatggctgctgccgcccatcgtacaatggaggatacggattctctggcttttattaaatgaattgctgaaattggaagcagaggagaaacctccaaatgtgtttggtcctgtcccgtgctttcattccaaaaatccattctattgccttcagcatcaatggagagatatttagctatgttaaatctttaaaatagatttaagctgcttctgtgaatatttgttgtctttttactttcggagtccgtcacctgaaatcatattcatgtataactactctaggttgttcttctaaatttgctttatttttcttaccaccattaccttgatgttatctatcaagatcctagcaaaaacttgtattttgcttttatctaataaatgaagtaaagtataaatatttta

SEQ ID NO: 2220 - DNA, 704 bp, Homo sapiens
ttaaaactcagaatcttcccaggtacactcagctgaactcacatcttcccgtcaacatgtcctacaactgttgctctagaaacttctcctcctgctcccacgggggttacttgcactacccaggctcctcctgtggctcttcctaccccagcaacctggtctacagcactgacctctgctctcccagcacctgccagctgggttcctctctctataggggctgtcaggagacctgctggaggcccaacagctgtcagacattgtgtgttgagtccagcccctgccacacctcctgctactaccccaggactcacatgctctgcaattcttgcctgactatgcatgttgggtctcggggttttggatccaatagctgctgctccctgagctgtggatccaggagctgctcctcactgggctgtggatccaatggcttcagatatctgaattatagaatccatacctccccttcccagagttatagatccagattctgccatccaatctattttccacctagaaggtggttccattcatcttgttatcagccattctgtagatctggtttctactgactaatgtggtgactggtaaaactcatttgagaaatgcatattctttagtaaggtcatctgttaatttcttcctttgagaagtattctaatattattgatcaccaggtcttccttactttccagccctca

SEQ ID NO: 2221 - DNA, 1554 bp, Homo sapiens
atgtctggcagttgctcttctaggaaatgcttctccgtgccagccacctctctctgctccactgaggtgagctgtggaggccccatctgcctgcccagttcctgccagagccagacatggcagctggtgacttgtcaagacagctgtggatcatccagctgtgggccacagtgccgtcagccctcctgtcctgtgagtagctgtgcccaacccctgtgctgtgatcctgtcatttgtgagccttcttgctccgtgagcagcggctgccaacccgtgtgctgtgaggccaccacctgtgagccttcttgctctgtgagcaactgctaccaacctgtgtgcttcgaggccaccatctgtgagccttcttgctcagtgagcaactgctgccaacctgtgtgctttgaggccaccgtttgtgagccttcttgttccgtgagcagctgtgctcaacctgtgtgctgtgagcctgctatttgtgagccttcttgctccgtgagcagctgctgccagcctgtaggctctgaagccacttcctgccaaccagtcctctgtgtgcccacttcctgccagcctgtcctctgcaaatccagctgctgccagccagttgtctgtgagcccagctgctgttcagctgtctgcaccctgcctagttcctgccaacctgtggtctgtgagccttcctgctgtcagccggtgtgcccgacacctacctgctctgtgaccagtagctgccaggctgtctgctgtgaccccagcccttgtgagccaagttgctcagagtctagcatctgccagccagctacgtgtgtggctctggtctgtgagccagtttgcctccgccctgtctgctgtgttcagagctcgtgcgagccaccttctgtccccagcacttgccaagagccttcttgttgtgtctccagtatctgccaacccatctgctctgagcccagcccctgctcaccagctgtctgtgtgtccagtccatgccaacctacttgctatgtagtcaagcgctgtccttctgtctgccctgagccagtttcctgcccatctacctcctgccgacctctttcctgcagtccagggtcttctgcatctgccatctgccgaccaacttgtcctaggactttctacatacccagttccagcaaacggccttgcagtgctacgatttcctaccgcccggtctcccgtccgatctgccgcccaatctgctctggactcctcacctataggcagccatacatgacatccatctcctaccgtcctgcctgctatcgcccatgctactccatcctgcgccgcccagcctgtgtcacttcctactcttgccgcccagtctacttccgcccatcttgcactgagtctgactcttgcaaacgggattgcaaaaaatccacttccagccaactggattgtgttgacacaaccccctgcaaggtggatgtctcagaagaggctccctgccagcccactgaagccaaacccatcagcccaaccacccgtgaggccgcagcagctcagcctgctgccagcaagcctgccaactgctaa

SEQ ID NO: 2222 - DNA, 1026 bp, Homo sapiens
atggcagacggctgttgtcctggaaacaccacagccattccagctgtgcccaccatcaccacatacccagttaaaggtggatttcgacatgctctctgtttgcctagttcctgccacagcagaatgtggcaactggtcacatgccaagaaagctgtcagccatccattggtgccccaagtggctgtgatcctgcttcgtgtcaacctacccgccttccagcaacgtcttgtgtgggttttgtttgccaacctatgtgctcccacgcagcctgctatcagtctggcactggtcagtctccttgtctggttagctcatgtcagccatcctgctcggaatctacttgttgtcaggaaaagtgctgcgatgccagtccctgccagcaaagctcctgccaggaatctgtctgcatgtctggatcatgtcaggcagcttgtggccaatcagtctgctgtgatgctggatcctgccagccatcctgctctgaagtgacctcctgtccggaaacttcttgcctaccaaccatctgtacagctagtccatgccaaccaacttggtgccaaggaagttcatgtcaacccgtcagtggtgaaggccagccctgtaaatcaacttattatcaacccatctgctatattttcaagccttgccaatcagccctctacatgcctgttccctgccagccatcgacttgtgtgttcagttcttgcaatactacttgctgtgtgccttcccattgccagccacctcactgccaactggttccttccacatgcttcatctaccagccagtggctaactgccaggccccttgttccacaaagaactgttgcaaaccagcttcttgtgacactgtgatttctggccaaccaacttgtgatggacccccttcctataaccagagtggctgcaaatcagcttgctgtgtgactggtttaggcacatcacccagtagtggctccaattgcttgccgacttcatgccaacccagctgtgagtccagcttctgcaaggcaacactttgttaa

SEQ ID NO: 2223 - DNA, 941 bp, Homo sapiens
atggtcagctcctgctgtggctctgtctgctctgaccagagctgtggtcaaggtctcggccaggagagctgctgccgccccagctgctgccagaccacctgctgcaggaccacctgctgccgccccagctgctgcatttccagttgctgcaggccttcctgctgtatctccagctgctgcaaacccagctgctgcaggaccacctgctgccgccccagctgctgcatttccagttgctgcaggccttcctgctgtatctccagctgctgcaaacccagctgctgcaggaccacctgctgccgccccagctgctgcatttctagttgctgcaggccttcctgctgtatctctagctgttgcaaacccagctgctgccagaccacctgctgccgccccagctgctgtatctccagctgctacaggccccagtgctgccagccctcctgctgccgcccggcttgctgcatttctagttgctgtcatcccagctgctgtgtgtccagctgccgctgccctttcagctgcccgaccacctgctgtagaacaacctgcttccaccccatctgctgcggcagttcttgctgctgagtgaagctgctctggatttgtgcaccttcttgctctcaaccttcagttcaggcacagagtatctattcagagaacatgtggacttcctgatgtcgtgaaaacagaggcatggactgatttggaaaatattttattagtatgtattctcttttatagaagtttttattcctattgaatctgaatttacagtcaaattccacatcacatgttttagaattctttattctaattcaatatacataaatcttcaaatggtatccttctagatgtttcttcctaatgttttctgtggtatcaattttcatgtggaattgtttgatgttcctcaataaaacttcatagtgttcaaaagc

SEQ ID NO: 2224 - DNA, 1174 bp, Homo sapiens
ctcctagaaacccaactagatccttcaccctctgacaccatggtaaactcctgttgtggctccgtgtgctctcaccaaggctgtggccgagacctctgccaggagacctgctgccgccccagctgctgtgagaccacctgctgcaggaccacctactgtcgccccagctgctgtgtgtccagctgctgcaggccccagtgctgccagtctgtgtgctgccagcccacctgctgccgccccagatgctgcatctccagctgctgtcgccccagctgctgtgtgtccagctgctgcaagccccagtgctgccagtctatgtgctgccagcccacttgctgccgccccagatgctgcatctccagctgctgtcgccccagctgctgtgtgtccagctgctgcagaccccagtgctgccagtctgtgtgctgccagcccacctgctgccaccccagctgcagcatctccagctgctgccgcccctcttgctgtgaatccagctgctgccgcccctgctgctgcctgcgtccagtctgtggccgagtctcctgccacaccacttgctatcgcccaacctgtgtcatctccagctgcccccgccccttgtgctgtgcctcctcttgctgctgagcccactgccctggctcatctctcccttcactgcaggcccacagttgtagaccattcttctgtgctgactattaggacacatggagtgggattgatgtcattcagcagggtggacttcatgtttccaatgagcccatcaccatcccactgactctgtgagaacattctggttcattttaaactccctcccttgctttctttctcttccagtcatggcaccaaatatgaaataatttgtaatccactagctaagaaattattccaatcctctaaattcctcattttttaaatcgttttgagcctacagaatatccttcccagtgaggtacacattatctccatttcaaacatattatttgtctgtcagcctttcagtcattcttttctcttggaaaggtaggaggctgcccctcccatgctctcctgctttctccctgttctctctttgtctctgtttgttcaagtttgccagaatttttctattttattggttctttatctttattgtgttcacaaaatatattgtattaaacttttcatttagaaa

SEQ ID NO: 2225 - DNA, 1157 bp, Homo sapiens
aaacccaagaacttcactctcttggaagcccacccagatcctccccgttctgacaccatggtcagctcctgttgtggctccgtgtgctctgaccagggctgcggccaagacctctgtcaggagacctgctgccgccccagctgctgtgagaccacctgctgcaggaccacctgctgccgccccagctgttgtgtatccagctgctgcaggccccagtgctgccagtctgtgtgctgccaacccacttgttcccgccccagctgctgtcagaccacctgttgcaggaccacctgctaccgccccagctgttgtgtgtccagctgctgcaggccccagtgctgccagcctgcgtgctgccaacccacttgctgtcgccccagctgctgtgagacgacctgctgccaccctaggtgctgcatctccagctgctgtcgccccagctgctgtgtgtccagctgctgcaagccccagtgctgccagtctgtgtgctgccagcccaactgctgccgccccagctgcagcatctccagctgctgccgcccctcttgctgtgaatccagctgctgccgcccctgctgctgcgtgcgtccagtctgtggccgagtctcctgccacaccacttgctatcgcccaacctgtgtcatctccagctgcccccgccccttgtgctgtgcctcctcttgctgctgagcccactgccctggcttatctcccccttcaccactggcccacagatgtagacccttctactgtgctgaccattaggatacaggaagtggggttgatgtcattcaatagaatggaactcatgtttccaatgagcccatcaccatttcactgactctttgagaacattctgattcattttaaactccctcccttgctttctttttcttccggtggtggcaccaaatgtgaattaatttgtaatccactagctagaaattattccaatcctctaatttcctcattttctttatcactttgaggtacagatcttcttctcagtgaggcagacattatctgcaggaccagttttgtcactgaggttgcaccctcagatccagccgcccagttatattctgtgtttctcctagtgtgaatttcttatgctttgttgcatctctgctttttaataaaatttctgtacataagaa

SEQ ID NO: 2226 - DNA, 850 bp, Homo sapiens
ctcctctcaacagcccaacccacaccagcctcagacaccaccatgaccggctcctgctgcggctccaccttgtcctccctgagctacgggggaggctgctgccagccctgctgctgccgcgacccctgctgctgccgccccgtgacctgccagaccaccgtgtgccgccccgtgacctgcgtgccccgctgcacgcgccccatctgcgagccctgccgccgcccggtgtgctgcgacccctgctccctgcaggaaggctgctgccgccccatcacctgctgcccctcgtcgtgcacggctgtggtgtgcaggccctgctgctgggccaccacctgctgccagcctgtgtctgtgcagtccccctgctgccggcctccctgcggccagccgaccccttgcagcaccacctgcaggacctcctcctgctgagaccccacctctcctctcaacgcacgaaacattcccaggtgcacagaagcttgtgcagactcttctaccccttctggatcagatgagagactccacctttgcagcctagctgatcctcaagcacgaattcaacaataacatcctatctatttccccacataattatgcagctaatcctggccctctctgacaatcttgagaaaaattccagctttcatcattcgaattcctggcttgaaaaaaaaaacgagtaaataaaaatcaaagctcctcttgaatagaactctgtcccactgactcatcacccttttttctactgtttcaaggttctcagatgagatttttttcttccaggataatactatttgtatgctgtatttttgcactgtaaaaaaaaataaaattatatttctggggaagc

SEQ ID NO: 2227 - DNA, 776 bp, Homo sapiens
catccagctcctctccacagcccaacccacaccagcctcagacaccaccatgaccggctcctgctgcggctccaccttctcctccctgagctacgggggaggctgctgccagccctgctgctgccgcgacccctgctgctgccgccccgtgacctgccagaccaccgtgtgccgccccgtgacctgcgtgccccgctgcacgcgccccatctgcgagccctgccgccgcccggtgtgctgcgacccctgctccctgcaggaaggctgctgccgccccatcacctgctgcccctcgtcgtgcacggctgtggtgtgcaggccctgctgctgggccaccacctgctgccagcctgtgtctgtgcagtccccctgctgccggcccccctgcggccagccgaccccttgcagcaccacctgcaggacctcctcctgctgagccaccacctgctgccagcctgtgtctgtgcagtccccctgcggccagccgaccccttgcagcaccacctgcaggacctcctcctgctgagcagtgcactgactgcccggaacgcgtaactcaccttctgaaaaagtcacactcccatttctctactttaacaaacctcctgccctgagcccacaaaaccccacatcaaccaagcagggaaccgagcactgggctcatctattaagacctgggccattctgaagtctgtaaaagaagcaatttccttcttcttaagatttcgtggcatgtttattttctaataaatatctgttctttggccttgcaaaaa

SEQ ID NO: 2228 - DNA, 700 bp, Homo sapiens
caatcaaacccataaataccacagactctaatagccatggattgctgtgcctctcgaggctgcagtgtccccaccgggcctgccaccaccatctgctcctctgacaaatcctgccgctgtggagtctgcctgcccagcacctgcccacacacagtttggttactggagcccacctgctgtgacaactgtcccccaccctgccacattcctcagccctgcgtgcccacctgcttcctgctcaactcctgccagccaactccaggcctggagaccctcaacctcaccaccttcactcagccctgctgtgagccctgcctcccaagaggctgctaatggatggctactttgctcagtgcctgagattgaaaaagtcaacatagaagctttagcattcacctatctcagtacctacaactaatgtactctgctttagaaattggaacaaggatggtactaccacaatcaccccctgcaaaaaaaaagagaccaagaaactttcaatgaccattcagctataaccaactgcagtttgaatcagtggatgcctatagcttcctgaagctgttcgattccttcatattaaagtgtctctttctgtgggtggtttgggaattctgttttcagtcttgggtggtatctttctgaaaattaaggaagttcttcatgattatcctaataaattttacatctctggcatagc

SEQ ID NO: 2229 - DNA, 692 bp, Homo sapiens
aagaaactgaaagctaaccagacgcccattgccatggattgctgtgcctctcgcagctgcagtgtccccactgggcctgccaccaccatctgctcctccgacaaatcctgccgctgtggagtctgcctgcccagcacctgcccacacacagtttggttactggagcccatctgctgtgacaactgtcccccaccctgccacattcctcagccctgcgtgcccacctgcttcctgctcaactcctgccagccaactccgggcctggagaccctcaacctcaccaccttcactcagccctgctgtgagccctgcctcccaagaggctgctgatggatggctactttgctcagtgcccgacaacgaagaatccagaagctgtcccttcagtattcacttgcctcagtagtttgccagatgttaaggtagaccagatgacccagatatgaagaacttacctttggttttaatgggggaaaaaaagaaaagtattttttatggttatttagctgaaaaaccatttggttcctgtgggcaggtgaatgagttttattagcaaaatactgtttcaatctttaagacctcagattacatgttcttgatcatattgcttcctggctcttgtttcttgtactgggtattttcatagaagaaaatttcttggtgggttttccaataaactatatttctctggc

SEQ ID NO: 2230 - DNA, 591 bp, Homo sapiens
agacttctctcaactcaacaaaaacccacctcccattgccatgtattgctgtgctctccgctcctgcagcgtccccaccggccctgccaccaccttctgctcatttgataaaagctgccgctgtggagtctgcctacccagcacctgcccacatgagatcagcctccttcagcccatctgctgtgacacctgccccccaccctgctgcaagcctgatacctatgtgccaacttgctggctgctcaacaactgtcacccgactcccggactgagtgggatcaacctgaccacctatgttcagcctggctgtgagagtccctgtgagccccgctgttaaccagccgagtctgcacaggttccgtgaggtggctgcccaatgtcctctgcaccatctgggcttcagcactcactactgcctacatcaaggctaaggccatcccaatccccggggccaagtcttgatgaatcttcttaattatttgcacatttgggtaccattggagacctcccttctgtcttttaggctatttcatcactctttgagaaataaccattttgaccatttgttaataaactttattctggcttagc

SEQ ID NO: 2231 - DNA, 588 bp, Homo sapiens
cactgccctctgcctcgaccttatccagccacacgccaccatgtgccacaccagctgctcctcgggctgccagccagcctgctgcgcgcccagcccctgccaggcatcctgttacatccccgtgggctgccagtcctccgtgtgcgtgcccgtgagcttcaagccagccgtgtgtgtgcccgtgagatgccagtcctctgtgtgcgtgcccgtgagctgcaggcccgtcgtgtatgcggctccctcctgccagtcctctgggtgctgccagccttcctgcaccagcgtcctctgcagacccatctcctgcagcaccccttcctgctgctgagcatgaatctccagacccgctgctcccagtgcagatgaggccacacctgtacactccctggatgagtcctcagttggtcttctgcacatggtgcaggtgaaaagcatgctcagtgaaccctctgaattctggatcgagaatataatagaatgatctggagccctggctgaacttgcctatccccccagggaagtctggggtcccagagtcattctctgaccccatgagagtcaaataaaccagctttccccatgcaa

SEQ ID NO: 2232 - DNA, 447 bp, Homo sapiens
agaccagccctgtcctctgcgccccccacctgtccacactccatcatgtgccacaccagccactcttcgggctgcccaatggcctgccctggctccccgtgctgtgtccccagcacctgctacccacccgagggctatgggacctcctgctgctgctcagccccctgtgtggctctgctgtgccggcccctgtgtggggtatccacctgctgccagccagcctgctgtgtgcccagcccctgccaggtggcctgctgtgtgcctgtgagctgcaagcctgttttgtgtgtggcttccttctgcccaacctctgggtgctgccagcccttctgccccaccctggtctatagacctgtcacctggagcacccccactggctgctgagcaggtggcctcctatgaccctcgtaggtgcgaggtcagaagccagcaggctctctgaactcc

SEQ ID NO: 2233 - DNA, 971 bp, Homo sapiens
tcactcactcacgtctcccccagctcacctcctccccaccccagcatggccacgtctaccatgtccgtctgctccagcgcttactctgactcctggcaggtggacgcctgcccagagagctgctgtgagcccccctgctgcgccaccagctgctgcgccccggccccctgcctgaccctggtctgcaccccagtgagctgtgtgtccagcccctgctgccaggcggcctgtgagcccagcccctgccagtcaggctgcaccagctcctgcacgccctcgtgctgccagcagtctagctgccagccagcttgctgcacatcctccccctgccagcaggcctgctgcgtgcctgtctgctgcaagccagtctgctgtgtgcccgtctgctgcaagcctgtctgctgcaagcccatctgctgtgtgcccgtctgctctggggcttcctcttcatgctgccagcagtctagccgccagccggcttgctgcaccacctcctgctgcagaccctcctcctccgtgtccctcctctgccgccccgtgtgcaggtccacctgctgtgtgcccatcccctcctgctgtgcccctgcctccacctgccagcccagctgctgccgcccggcctcctgcgtgtccctcctctgccgccccacgtgctcccgcctctcttccgcgtgctgcggcctctcctcaggccagaagtccagctgctgacgggcaggtcccgtttctccagagttgttccagggccatctctgacttccgaaaatccttgcagccctgagccctgtctgagtctcctctgcccatagccactgcacctccagccagcaatgctgagctttcatgccgattccctccaggcatgcatctctcccacaccctcatctccatgctggccagccggtggtcactgtgtcctgccccatgtgagtgatcagtctgtcaacaaataaagtcaccaatgtgccctc

SEQ ID NO: 2234 - DNA, 1149 bp, Homo sapiens
tcactcactcacacacctcccccagctcacctcctccccactccagcatggccgcctccaccatgtccatctgctccagcgcctgcaccaactcctggcaggtggacgactgcccagagagctgctgtgagctcccctgcggcacccccagctgctgtgccccagccccctgcctgaccctggtctgcaccccagtgagctgtgtgtccagcccctgctgccaggcggcctgtgagcccagcgcctgccaatcaggctgcaccagctcctgcacgccctcgtgctgccagcagtctagctgccagccggcttgctgcacctcctccccctgccagcaggcctgctgcgtgcccgtctgctgcaagcctgtgtgctgtgtgcccgtctgctgtggggcttcttcatgctgccagcagtctagctgccagccagcttgctgtgcctcttcctcctgccagcagtcctgccgtgtgcctgtctgctgcaaagctgtgtgctgcgtgcccacctgctctgagtcatcctcttcatgctgccagcagtctagctgccagccggcttgctgcacctcctccccgtgtcagcagtcctgctgtgtgtccgtctgctgcaagcctgtctgctgcaagtccatctgctgtgtacctgtttgctctggggcttcctctccgtgctgccagcagtctagctgccagccagcttgctgcacctcctcctgctgcagaccctcctcctctgtgtccctcctctgccgccccgtgtgctcccgcccagcctcctgcagcttttcctcaggccaaaagtctagctgctgatggccatgtcccccagggccagccgggctcaggccccacctccctgccagtccttggacctcccagcccacccagcctcagcacagctcagcacagaaggagcagccccagccacagccgcccagccccggggtctcagatgctcactggctcctctctgacctcccgccgggcgggcgagccctggcttctcctcacggtgcttcctggctgcagaccacaaccctccgctggtcgctggtcgctggttggggatgggccctcctgacctgggtctcacccccaggagcgtcaccctctgcctctgagcaccaataaagcgtctgcggcccca

SEQ ID NO: 2235 - DNA, 636 bp, Homo sapiens
ccaaggatgacctcaacaaccaacaccatgtgtggcagctactacagaaactacaatggtggccatggctatgggtgctgtggctacggaggcctgggctgtggttatggcggctgtggctatgggtgctgtggctacggaggcctgggctttggctatggaggcctggactgtggctatggaggcctgggctgtggctatggctccttctgtggctgtggctacagaggcctggactgtggctatggctgtggctatggctatgtctcccactccttctgtggctgtggctataggtgcggctctggctatggctccagctttggctactactattgaggacaccatgggagactctcaccctctatcctgtgacattgcaattcaccaattctgaagcccacatgctctgagcctttcccttgattgatgatatcctgcagtggaagtctaatatgatctgttgttgatctaccatctaacccaaaaataccctgagtttccatcatgaagtgggataaggtgaagttcacctgtcacttctccttttatcaggatgatggtgtcacagtgactcctttgatgactttcatgctgtagtttgtttctctgctgacctaataaacacatttaatc

SEQ ID NO: 2236 - DNA, 3420 bp, Homo sapiens
caacctgcagccctcatctccgccggcgagtagggccaggtgttgggagctcccacgtgggacaagatggtgtcttcggcgcagatgggcttcaacctgcaggctctcctggagcagctcagccaggatgagttgagcaagttcaagtatctgatcacgaccttctccctggcacacgagctccagaagatcccccacaaggaggtagacaaggctgatgggaagcaactggtagaaatcctcaccacccattgtgacagctactgggtggagatggcgagcctccaggtctttgaaaagatgcaccgaatggatctgtctgagagagcaaaggatgaagtcagagaagcagctttgaaatcctttaataaaaggaagcctctatcattagcgtttacagaaacgaaaggaaatgtcatctgcctgggtaaagaagtctttaaaggaaaaaagccagacaaagacaataggtgcaggtatatattgaagacgaagttccgggagatgtggaagagctggcctggagatagcaaagaggtccaggttatggctgagagatacaagatgctgatcccattcagcaaccccagggtgcttcccgggcccttctcatacacggtggtgctgtatggtcctgcaggccttgggaaaaccacgctggcccagaaactaatgctagactgggcagaggacaacctcatccacaaattcaaatatgcgttctacctcagctgcagggagctcagccgcctgggcccgtgcagttttgcagagctggtcttcagggactggcctgaattgcaggatgacattccacacatcctagcccaagcacggaaaatcttgttcgtgattgacggctttgatgagctgggagccgcacctggggcgctgatcgaggacatctgcggggactgggagaagaagaagccggtgcccgtcctcctggggagtttgctgaacagggtgatgttacccaaggccgccctgctggtcaccacgcggcccagggccctgagggacctccggatcctggcggaggagccgatctacataagggtggagggcttcctggaggaggacaggagggcctatttcctgagacactttggagacgaggaccaagccatgcgtgcctttgagctaatgaggagcaacgcggccctgttccagctgggctcggcccccgcggtgtgctggatcgtgtgcacgactctgaagctgcagatggagaagggggaggacccggtccccacctgcctcacccgcacggggctgttcctgcgtttcctctgcagccggttcccgcagggcgcacagctgcggggcgcgctgcggacgctgagcctcctggccgcgcagggcctgtgggcgcagacgtccgtgcttcaccgagaggatctggaaaggctcggggtgcaggagtccgacctccgtctgttcctggacggagacatcctccgccaggacagagtctccaaaggctgctactccttcatccacctcagcttccagcagtttctcactgccctgttctacaccctggagaaggaggaggaagaggatagggacggccacacctgggacattggggacgtacagaagctgctttccggagtagaaagactcaggaaccccgacctgatccaagcaggctactactcctttggcctcgctaacgagaagagagccaaggagttggaggccacttttggctgccggatgtcaccggacatcaaacaggaattgctgcgatgcgacataagttgtaagggtggacattcaacggtgacagacctgcaggagctcctcggctgtctgtacgagtctcaggaggaggagctggtgaaggaggtgatggctcagttcaaagaaatatccctgcacttaaatgcagtagacgttgtgccatcttcattctgcgtcaagcactgtcgaaacctgcagaaaatgtcactgcaggtaataaaggagaatctcccggagaatgtcactgcgtctgaatcagacgccgaggttgagagatcccaggatgatcagcacatgcttcctttctggacggacctttgttccatatttggatcaaataaggatctgatgggtctagcaatcaatgatagctttctcagtgcctccctagtaaggatcctgtgtgaacaaatagcctctgacacctgtcatctccagagagtggtgttcaaaaacatttccccagctgatgctcatcggaacctctgcctagctcttcgaggtcacaagactgtaacgtatctgacccttcaaggcaatgaccaggatgatatgtttcccgcattgtgtgaggtcttgagacatccagaatgtaacctgcgatatctcgggttggtgtcttgttccgctaccactcagcagtgggctgatctctccttggcccttgaagtcaaccagtccctgacgtgcgtaaacctctccgacaatgagcttctggatgagggtgctaagttgctgtacacaactttgagacaccccaagtgctttctgcagaggttgtcgttggaaaactgtcaccttacagaagccaattgcaaggaccttgctgctgtgttggttgtcagccgggagctgacacacctgtgcttggccaagaaccccattgggaatacaggggtgaagtttctgtgtgagggcttgaggtaccccgagtgtaaactgcagaccttggtgctttggaactgcgacataactagcgatggctgctgcgatctcacaaagcttctccaagaaaaatcaagcctgttgtgtttggatctggggctgaatcacataggagttaagggaatgaagttcctgtgtgaggctttgaggaaaccactgtgcaacttgagatgtctgtggttgtggggatgttccatccctccgttcagttgtgaagacctctgctctgccctcagctgcaaccagagcctcgtcactctggacctgggtcagaatcccttggggtctagtggagtgaagatgctgtttgaaaccttgacatgttccagtggcaccctccggacactcaggttgaaaatcgatgactttaatgatgaactcaataagctgctggaagaaatagaagaaaaaaacccacaactgattattgatactgagaaacatcatccctgggcagaaaggccttcttctcatgacttcatgatctgaatccccccgagtcattcattctccatgaagtcatcgattttccaggtgttggtgaactgcctgtgactcctctcctccccggcccctacccctcagggataatgagttcattgctgggctagatgttttagccatgattctgcctctgttttatacctgcacacatccttatctttgttacatatgaaatatctgtatcacgggtatattgagagaaataaaggtgagagcattcac

SEQ ID NO: 2237 - DNA, 1205 bp, Homo sapiens
atttgaaacaacaactttattagcacctggcactaggcggagagaggcggtaagccgcgaggaggaaagggactcacgtcccgctgtggaccgatcctgctaagcagagaatcgctgtggccggacgacggggcgtcgagacaagaagaaagacgttggcaactcagaggactggttgcggcgttagacaagaaagcaaggcctttaagcagggattcggggtggacgtgggggtgggccgaagcgaagccggaaacaggaaactacaactcccacaaggcctagggccacgtcccgccgtcctcggctgctgagcctgatgggacaagtagttttgcgaacggcttaacctacagattgaagaggtcggaagctctgaggcccggggcttccggaggtcgcggagatggaattggagcagagagaagggaccatggcagccgtgggctttgaggagttctcagcgccgccaggctcagagttggcgttgcctcccctatttggtggccacatcctggagagcgagctggagacggaagtggagtttgtgtcaggtggtctgggcggctcagggctccgggagcgagatgaagaggaagaggcagcccggggtcggcggcggcgccagcgggaattaaatcgcagaaagtaccaggcactaggtcggcgctgccgggagatcgagcaggtgaacgagcgggtcctgaacaggctccatcaggtgcagaggataactcggaggctgcagcaggaacggaggttcctcatgagagtgctggactcctacggggatgactaccgggccagccagttcaccattgtgctggaggatgagggcagccagggcacggatgcccccaccccaggcaatgcggagaatgagcctccagagaaagagacactgtccccgcccagaaggactcctgcacccccagaacccggcagcccagcccccggtgaggggcccagtgggcggaagaggcggcgagtgccacgggatggacgccgagcaggaaatgcgctgactccagagctggccccggtgcagattaaggttgaggaagactttggctttgaagcagatgaggccctggattccagttgggtttctcggggtccagacaaactgctgccctacccgaccctggccagcccagcctctgactgacgcatgcccaataaactgaccccacactcaccccggc

SEQ ID NO: 2238 - DNA, 3205 bp, Homo sapiens
attggtgagtggggcagggcaggagggaactgaagagtgagaaagcattatttcagcaaaaggtctttcctcccttgctctctcctccaaccactggctcagcctctccgcccgctgcctgtgaatgatgcaatggaaggtgtgctggggtcgccctgtgtcccgtgcataggagcatctcagcctccaggtcctctcctttggggctcacggcacccccatgctacgaaccgcaggcagggacggcctctgtcgcctgtccacctacttggaagaactcgaggctgtggaactgaagaagttcaagttatacctggggaccgcgacagagctgggagaaggcaagatcccctggggaagcatggagaaggccggtcccctggaaatggcccagctgctcatcacccacttcgggccagaggaggcctggaggttggctctcagcacctttgagcggataaacaggaaggacctgtgggagagaggacagagagaggacctggtgagggataccccacctggtggcccgtcctcacttgggaaccagtcaacatgccttctggaagtctctcttgtcactccaagaaaagatccccaggaaacctacagggactatgtccgcaggaaattccggctcatggaagaccgcaatgcgcgcctaggggaatgtgtcaacctcagccaccggtacacccggctcctgctggtgaaggagcactcaaaccccatgcaggtccagcagcagcttctggacacaggccggggacacgcgaggaccgtgggacaccaggctagccccatcaagatagagaccctctttgagccagacgaggagcgccccgagccaccgcgcaccgtggtcatgcaaggcgcggcagggataggcaagtccatgctggcacacaaggtgatgctggactgggcggacgggaagctcttccaaggcagatttgattatctcttctacatcaactgcagggagatgaaccagagtgccacggaatgcagcatgcaagacctcatcttcagctgctggcctgagcccagcgcgcctctccaggagctcatccgagttcccgagcgcctccttttcatcatcgacggcttcgatgagctcaagccttctttccacgatcctcagggaccctggtgcctctgctgggaggagaaacggcccacggagctgcttcttaacagcttaattcggaagaagctgctccctgagctatctttgctcatcaccacacggcccacggctttggagaagctccaccgtctgctggagcaccccaggcatgtggagatcctgggcttctctgaggcagaaaggaaggaatacttctacaagtatttccacaatgcagagcaggcgggccaagtcttcaattacgtgagggacaacgagcctctcttcaccatgtgcttcgtccccctggtgtgctgggtggtgtgtacctgcctccagcagcagctggagggtggggggctgttgagacagacgtccaggaccaccactgcagtgtacatgctctacctgctgagtctgatgcaacccaagccgggggccccgcgcctccagcccccacccaaccagagagggttgtgctccttggcggcagatgggctctggaatcagaaaatcctatttgaggagcaggacctccggaagcacggcctagacggggaagacgtctctgccttcctcaacatgaacatcttccagaaggacatcaactgtgagaggtactacagcttcatccacttgagtttccaggaattctttgcagctatgtactatatcctggacgagggggagggcggggcaggcccagaccaggacgtgaccaggctgttgaccgagtacgcgttttctgaaaggagcttcctggcactcaccagccgcttcctgtttggactcctgaacgaggagaccaggagccacctggagaagagtctctgctggaaggtctcgccgcacatcaagatggacctgttgcagtggatccaaagcaaagctcagagcgacggctccaccctgcagcagggctccttggagttcttcagctgcttgtacgagatccaggaggaggagtttatccagcaggccctgagccacttccaggtgatcgtggtcagcaacattgcctccaagatggagcacatggtctcctcgttctgtctgaagcgctgcaggagcgcccaggtgctgcacttgtatggcgccacctacagcgcggacggggaagaccgcgcgaggtgctccgcaggagcgcacacgctgttggtgcagctcagaccagagaggaccgttctgctggacgcctacagtgaacatctggcagcggccctgtgcaccaatccaaacctgatagagctgtctctgtaccgaaatgccctgggcagccggggggtgaagctgctctgtcaaggactcagacaccccaactgcaaacttcagaacctgaggctgaagaggtgccgcatctccagctcagcctgcgaggacctctctgcagctctcatagccaataagaatttgacaaggatggatctcagtggcaacggcgttggattcccaggcatgatgctgctttgcgagggcctgcggcatccccagtgcaggctgcagatgattcagttgaggaagtgtcagctggagtccggggcttgtcaggagatggcttctgtgctcggcaccaacccacatctggttgagttggacctgacaggaaatgcactggaggatttgggcctgaggttactatgccagggactgaggcacccagtctgcagactacggactttgtggtggttatttgggatggacctgaataaaatgacccacagtaggttggcagcgcttcgagtaacaaaaccttatttggacattggctgctgaatggtcctatctgctggctctcccctgagatctggacagaggaagatgggagggtgctcatcacccccccagcataatgatcagcctccttcctagagacagactcatgcagattgagatcaaaagtccctctgcttgggatcaaattaatgtttgacagagctggccaggcgtggtggctcatgtatgtaatcctagcacttcgagaggccgaggcaggtggatcacgaggtcaggagtttgagattagcctggccaagatggtgaaaccctgtctctactaaaaataaaaaaaaattagccagg

SEQ ID NO: 2239 - DNA, 3715 bp, Homo sapiens
attggtgagtggggcagggcaggagggaactgaagagtgagaaagcattatttcagcaaaaggtctttcctcccttgctctctcctccaaccactggctcagcctctccgcccgctgcctgtgaatgatgcaatggaaggtgtgctggggtcgccctgtgtcccgtgcataggagcatctcagcctccaggtcctctcctttggggctcacggcacccccatgctacgaaccgcaggcagggacggcctctgtcgcctgtccacctacttggaagaactcgaggctgtggaactgaagaagttcaagttatacctggggaccgcgacagagctgggagaaggcaagatcccctggggaagcatggagaaggccggtcccctggaaatggcccagctgctcatcacccacttcgggccagaggaggcctggaggttggctctcagcacctttgagcggataaacaggaaggacctgtgggagagaggacagagagaggacctggtgagggataccccacctggtggcccgtcctcacttgggaaccagtcaacatgccttctggaagtctctcttgtcactccaagaaaagatccccaggaaacctacagggactatgtccgcaggaaattccggctcatggaagaccgcaatgcgcgcctaggggaatgtgtcaacctcagccaccggtacacccggctcctgctggtgaaggagcactcaaaccccatgcaggtccagcagcagcttctggacacaggccggggacacgcgaggaccgtgggacaccaggctagccccatcaagatagagaccctctttgagccagacgaggagcgccccgagccaccgcgcaccgtggtcatgcaaggcgcggcagggataggcaagtccatgctggcacacaaggtgatgctggactgggcggacgggaagctcttccaaggcagatttgattatctcttctacatcaactgcagggagatgaaccagagtgccacggaatgcagcatgcaagacctcatcttcagctgctggcctgagcccagcgcgcctctccaggagctcatccgagttcccgagcgcctccttttcatcatcgacggcttcgatgagctcaagccttctttccacgatcctcagggaccctggtgcctctgctgggaggagaaacggcccacggagctgcttcttaacagcttaattcggaagaagctgctccctgagctatctttgctcatcaccacacggcccacggctttggagaagctccaccgtctgctggagcaccccaggcatgtggagatcctgggcttctctgaggcagaaaggaaggaatacttctacaagtatttccacaatgcagagcaggcgggccaagtcttcaattacgtgagggacaacgagcctctcttcaccatgtgcttcgtccccctggtgtgctgggtggtgtgtacctgcctccagcagcagctggagggtggggggctgttgagacagacgtccaggaccaccactgcagtgtacatgctctacctgctgagtctgatgcaacccaagccgggggccccgcgcctccagcccccacccaaccagagagggttgtgctccttggcggcagatgggctctggaatcagaaaatcctatttgaggagcaggacctccggaagcacggcctagacggggaagacgtctctgccttcctcaacatgaacatcttccagaaggacatcaactgtgagaggtactacagcttcatccacttgagtttccaggaattctttgcagctatgtactatatcctggacgagggggagggcggggcaggcccagaccaggacgtgaccaggctgttgaccgagtacgcgttttctgaaaggagcttcctggcactcaccagccgcttcctgtttggactcctgaacgaggagaccaggagccacctggagaagagtctctgctggaaggtctcgccgcacatcaagatggacctgttgcagtggatccaaagcaaagctcagagcgacggctccaccctgcagcagggctccttggagttcttcagctgcttgtacgagatccaggaggaggagtttatccagcaggccctgagccacttccaggtgatcgtggtcagcaacattgcctccaagatggagcacatggtctcctcgttctgtctgaagcgctgcaggagcgcccaggtgctgcacttgtatggcgccacctacagcgcggacggggaagaccgcgcgaggtgctccgcaggagcgcacacgctgttggtgcagctcagaccagagaggaccgttctgctggacgcctacagtgaacatctggcagcggccctgtgcaccaatccaaacctgatagagctgtctctgtaccgaaatgccctgggcagccggggggtgaagctgctctgtcaaggactcagacaccccaactgcaaacttcagaacctgaggctgaagaggtgccgcatctccagctcagcctgcgaggacctctctgcagctctcatagccaataagaatttgacaaggatggatctcagtggcaacggcgttggattcccaggcatgatgctgctttgcgagggcctgcggcatccccagtgcaggctgcagatgattcagttgaggaagtgtcagctggagtccggggcttgtcaggagatggcttctgtgctcggcaccaacccacatctggttgagttggacctgacaggaaatgcactggaggatttgggcctgaggttactatgccagggactgaggcacccagtctgcagactacggactttgtggctgaagatctgccgcctcactgctgctgcctgtgacgagctggcctcaactctcagtgtgaaccagagcctgagagagctggacctgagcctgaatgagctgggggacctcggggtgctgctgctgtgtgagggcctcaggcatcccacgtgcaagctccagaccctgcggttgggcatctgccggctgggctctgccgcctgtgagggtctttctgtggtgctccaggccaaccacaacctccgggagctggacttgagtttcaacgacctgggagactggggcctgtggttgctggctgaggggctgcaacatcccgcctgcagactccagaaactgtggctggatagctgtggcctcacagccaaggcttgtgagaatctttacttcaccctggggatcaaccagaccttgaccgacctttacctgaccaacaacgccctaggggacacaggtgtccgactgctttgcaagcggctgagccatcctggctgcaaactccgagtcctctggttatttgggatggacctgaataaaatgacccacagtaggttggcagcgcttcgagtaacaaaaccttatttggacattggctgctgaatggtcctatctgctggctctcccctgagatctggacagaggaagatgggagggtgctcatcacccccccagcataatgatcagcctccttcctagagacagactcatgcagattgagatcaaaagtccctctgcttgggatcaaattaatgtttgacagagctggccaggcgtggtggctcatgtatgtaatcctagcacttcgagaggccgaggcaggtggatcacgaggtcaggagtttgagattagcctggccaagatggtgaaaccctgtctctactaaaaataaaaaaaaattagccagg

SEQ ID NO: 2240 - DNA, 3465 bp, Homo sapiens
ctctctcctccaaccactggctcagcctctccgcccgctgcctgtgaatgatgcaatggaaggtgtgctggggtcgccctgtgtcccgtgcataggagcatctcagcctccaggtcctctcctttggggctcacggcacccccatgctacgaaccgcaggcagggacggcctctgtcgcctgtccacctacttggaagaactcgaggctgtggaactgaagaagttcaagttatacctggggaccgcgacagagctgggagaaggcaagatcccctggggaagcatggagaaggccggtcccctggaaatggcccagctgctcatcacccacttcgggccagaggaggcctggaggttggctctcagcacctttgagcggataaacaggaaggacctgtgggagagaggacagagagaggacctggtgagggataccccacctggtggcccgtcctcacttgggaaccagtcaacatgccttctggaagtctctcttgtcactccaagaaaagatccccaggaaacctacagggactatgtccgcaggaaattccggctcatggaagaccgcaatgcgcgcctaggggaatgtgtcaacctcagccaccggtacacccggctcctgctggtgaaggagcactcaaaccccatgcaggtccagcagcagcttctggacacaggccggggacacgcgaggaccgtgggacaccaggctagccccatcaagatagagaccctctttgagccagacgaggagcgccccgagccaccgcgcaccgtggtcatgcaaggcgcggcagggataggcaagtccatgctggcacacaaggtgatgctggactgggcggacgggaagctcttccaaggcagatttgattatctcttctacatcaactgcagggagatgaaccagagtgccacggaatgcagcatgcaagacctcatcttcagctgctggcctgagcccagcgcgcctctccaggagctcatccgagttcccgagcgcctccttttcatcatcgacggcttcgatgagctcaagccttctttccacgatcctcagggaccctggtgcctctgctgggaggagaaacggcccacggagctgcttcttaacagcttaattcggaagaagctgctccctgagctatctttgctcatcaccacacggcccacggctttggagaagctccaccgtctgctggagcaccccaggcatgtggagatcctgggcttctctgaggcagaaaggaaggaatacttctacaagtatttccacaatgcagagcaggcgggccaagtcttcaattacgtgagggacaacgagcctctcttcaccatgtgcttcgtccccctggtgtgctgggtggtgtgtacctgcctccagcagcagctggagggtggggggctgttgagacagacgtccaggaccaccactgcagtgtacatgctctacctgctgagtctgatgcaacccaagccgggggccccgcgcctccagcccccacccaaccagagagggttgtgctccttggcggcagatgggctctggaatcagaaaatcctatttgaggagcaggacctccggaagcacggcctagacggggaagacgtctctgccttcctcaacatgaacatcttccagaaggacatcaactgtgagaggtactacagcttcatccacttgagtttccaggaattctttgcagctatgtactatatcctggacgagggggagggcggggcaggcccagaccaggacgtgaccaggctgttgaccgagtacgcgttttctgaaaggagcttcctggcactcaccagccgcttcctgtttggactcctgaacgaggagaccaggagccacctggagaagagtctctgctggaaggtctcgccgcacatcaagatggacctgttgcagtggatccaaagcaaagctcagagcgacggctccaccctgcagcagggctccttggagttcttcagctgcttgtacgagatccaggaggaggagtttatccagcaggccctgagccacttccaggtgatcgtggtcagcaacattgcctccaagatggagcacatggtctcctcgttctgtctgaagcgctgcaggagcgcccaggtgctgcacttgtatggcgccacctacagcgcggacggggaagaccgcgcgaggtgctccgcaggagcgcacacgctgttggtgcagctaccagagaggaccgttctgctggacgcctacagtgaacatctggcagcggccctgtgcaccaatccaaacctgatagagctgtctctgtaccgaaatgccctgggcagccggggggtgaagctgctctgtcaaggactcagacaccccaactgcaaacttcagaacctgaggctgaagaggtgccgcatctccagctcagcctgcgaggacctctctgcagctctcatagccaataagaatttgacaaggatggatctcagtggcaacggcgttggattcccaggcatgatgctgctttgcgagggcctgcggcatccccagtgcaggctgcagatgattcagttgaggaagtgtcagctggagtccggggcttgtcaggagatggcttctgtgctcggcaccaacccacatctggttgagttggacctgacaggaaatgcactggaggatttgggcctgaggttactatgccagggactgaggcacccagtctgcagactacggactttgtggctgaagatctgccgcctcactgctgctgcctgtgacgagctggcctcaactctcagtgtgaaccagagcctgagagagctggacctgagcctgaatgagctgggggacctcggggtgctgctgctgtgtgagggcctcaggcatcccacgtgcaagctccagaccctgcggctggatagctgtggcctcacagccaaggcttgtgagaatctttacttcaccctggggatcaaccagaccttgaccgacctttacctgaccaacaacgccctaggggacacaggtgtccgactgctttgcaagcggctgagccatcctggctgcaaactccgagtcctctggttatttgggatggacctgaataaaatgacccacagtaggttggcagcgcttcgagtaacaaaaccttatttggacattggctgctgaatggtcctatctgctggctctcccctgagatctggacagaggaagatgggagggtgctcatcacccccccagcataatgatcagcctccttcctagagacagactcatgcagattgagatcaaaagtccctctgcttgggatcaaattaatgtttgacagagctggccaggcgtggtggctcatgtatgtaatcctagcacttcgagaggccgaggcaggtggatcacgaggtcaggagtttgagattagcctggccaagatggtgaaaccctgtctctactaaaaataaaaaaaaattagccaggc

SEQ ID NO: 2241 - DNA, 623 bp, Homo sapiens
aaaccacattcccaaaactttccgttgcaaatttccaaactttcccagtttctaccctcagcctttcaaagtcccgcccctcattccagttcccacacccagccttcttcaggtcccactgctgaccgccagaccaaactcctacagctgccgcctgcatcccagaccgcctgcatcccgctcggagcgggtccgagccctgctccctcccagcgcaccttttccacgacacggatgacaccagcgatgagagagtctcggtcctgatacttcttagcgctggtgtgcagggcgcggatggcgtcggggcgccccgaggagctgtgggaggccgtggtgggggccgctgagcgcttccgggcccggactggcacggagctggtgctgctgaccgcggccccgccgccaccaccccgcccgggcccctgtgcctatgctgcccatggtcgaggagccctggcggaggcagcgcgccgttgcctccacgacatcgcactggcccacagggctgccactgctgctcggcctcctgcgcccccaccagcaccacagccacccagtcccacacccagcccaccccggcctaccctggccagagaggacaacgaggaggacgaggatga

SEQ ID NO: 2242 - DNA, 2025 bp, Homo sapiens
atttcctgttttcttcctagaccagtgggtcctccctggaccccgggcgaggttgggaggtctcggggcagctgagcgtggccccaggcgctcaccccatggctaccgcgttcatgctcaggttcctcacatcttggggtgtggggtactaaaatttcgacaggaggggtggttccacccctctcctccttagctcttttccctcctccctgcatccaaagaggacagccacatcgtgctccccctcctgtggggaacacgtctcactttcctctaatctctccctgatcttacacgaaactcgtctatcggggcgggttcttcctccatctctcagctccttggaggaaacaggacctcctctagaagctgaaggggcgcggatggcgtcggggcgccccgaggagctgtgggaggccgtggtgggggccgctgagcgcttccgggcccggactggcacggagctggtgctgctgaccgcggccccgccgccaccaccccgcccgggcccctgtgcctatgctgcccatggtcgaggagccctggcggaggcagcgcgccgttgcctccacgacatcgcactggcccacagggctgccactgctgctcggcctcctgcgcccccaccagcaccacagccacccagtcccacacccagcccaccccggcctaccctggccagagaggacaacgaggaggacgaggatgagcccacagagacagagacctccggggagcagctgggcattagtgataatggagggctctttgtgatggatgaggacgccaccctccaggaccttccccccttctgtgagtcagaccccgagagtacagatgatggcagcctgagcgaggagacccccgccggcccccccacctgctcagtgcccccagcctcagccctacccacacagcagtacgccaagtccctgcctgtgtctgtgcccgtctggggcttcaaggagaagaggacagaggcgcggtcatcagatgaggagaatgggccgccctcttcgcccgacctggaccgcatcgcggcgagcatgcgcgcgctggtgctgcgagaggccgaggacacccaggtcttcggggacctgccacggccgcggcttaacaccagcgacttccagaagctgaagcggaaatattgaagtccagggagggagcgccccgggccgcgtccgccccgtcccacactacgcccccgccccactcccggggcctgctaatctgaggccgatccgggaccggcctccttgcgtctcccattcccaagattgtcccgcctctgccaatccccgccgtccttccagcccacgacctgccgcgccgaggagcggcatctgtcccgtttcccgattgggtctgtcgtctctctccgcctagcgacagattccttctattaagggattggctcgctgagttctaagctctaaatgggtcaactcctttgttttccgcctagcgacaagggatttgctcgcacggcattggctccatcccctagtcgctggacagctctttttttgattggctcaaatcctgtaaagggcttgaccagtctctacatagtcaccgtccgcttttcctgagttctccctcccaattggctccagcttcctgggggcgtggccaagccctcctcttcccagaattggcccggggccttcaatttacgttctttacactacggggactggggtcgtctttgcccacgtcccgacaacttgttccctgaccccctcagggatggccccaaactgtccctgcctctggcaccccctttcattggttccatccatccccacaacagcctgccaatcgaagcccgtccctgcatccaggatggtaccagctcccgcccctcgccccccacctccacaggtgccttaaagggccctcgtccacccaaggtggggggcaggggccctcactctccggccctggtgtgggggagagagtgaggggttgggggatcggcagttgggaggggcgctctgagattaaagagttttacctctg

SEQ ID NO: 2243 - DNA, 1911 bp, Homo sapiens
gggcgcgacagctggaagagccgaacggataagagaagaggaggtgagaggagctgtacaccacaagaggcactgagggactcaggataacgggatgaagccgtcagtgcccccagaaacgaagcggccccggacgaatttctgagtcaccgtcgcgagaaagcgggctgagccgccattttgaagcctggcaaaccgaagcaagaaatgctgccgtgttggatctttgccagccttcgtgccgaatgggagcagggcgcggatggcgtcggggcgccccgaggagctgtgggaggccgtggtgggggccgctgagcgcttccgggcccggactggcacggagctggtgctgctgaccgcggccccgccgccaccaccccgcccgggcccctgtgcctatgctgcccatggtcgaggagccctggcggaggcagcgcgccgttgcctccacgacatcgcactggcccacagggctgccactgctgctcggcctcctgcgcccccaccagcaccacagccacccagtcccacacccagcccaccccggcctaccctggccagagaggacaacgaggaggacgaggatgagcccacagagacagagacctccggggagcagctgggcattagtgataatggagggctctttgtgatggatgaggacgccaccctccaggaccttccccccttctgtgagtcagaccccgagagtacagatgatggcagcctgagcgaggagacccccgccggcccccccacctgctcagtgcccccagcctcagccctacccacacagcagtacgccaagtccctgcctgtgtctgtgcccgtctggggcttcaaggagaagaggacagaggcgcggtcatcagatgaggagaatgggccgccctcttcgcccgacctggaccgcatcgcggcgagcatgcgcgcgctggtgctgcgagaggccgaggacacccaggtcttcggggacctgccacggccgcggcttaacaccagcgacttccagaagctgaagcggaaatattgaagtccagggagggagcgccccgggccgcgtccgccccgtcccacactacgcccccgccccactcccggggcctgctaatctgaggccgatccgggaccggcctccttgcgtctcccattcccaagattgtcccgcctctgccaatccccgccgtccttccagcccacgacctgccgcgccgaggagcggcatctgtcccgtttcccgattgggtctgtcgtctctctccgcctagcgacagattccttctattaagggattggctcgctgagttctaagctctaaatgggtcaactcctttgttttccgcctagcgacaagggatttgctcgcacggcattggctccatcccctagtcgctggacagctctttttttgattggctcaaatcctgtaaagggcttgaccagtctctacatagtcaccgtccgcttttcctgagttctccctcccaattggctccagcttcctgggggcgtggccaagccctcctcttcccagaattggcccggggccttcaatttacgttctttacactacggggactggggtcgtctttgcccacgtcccgacaacttgttccctgaccccctcagggatggccccaaactgtccctgcctctggcaccccctttcattggttccatccatccccacaacagcctgccaatcgaagcccgtccctgcatccaggatggtaccagctcccgcccctcgccccccacctccacaggtgccttaaagggccctcgtccacccaaggtggggggcaggggccctcactctccggccctggtgtgggggagagagtgaggggttgggggatcggcagttgggaggggcgctctgagattaaagagttttacctctgagataaa

SEQ ID NO: 2244 - DNA, 3640 bp, Homo sapiens
ctggattagaatatctgccctcctaaaggcaggcaggatggcggtcaggatttagaacaggccccggatctagactttctgagtccaggtcccagccctgcctcttccagttgtggcccttcaagatgctgactgcccctgggcctgagtttgcaactgtaaaatggggtgaactgtaactaaagctcctgtctcatagtgtaggtgaaagggtgggatgagaaggttgatcccatcttgggtccttgcgtggcttctgggaggtggtggataaacctcttccttcccttggggctttgaactccctgagtgagtcagataggtgagatgccaggtgtggaatcccagcactgaataggtgctcagcaaacaccaacatcaatgatcgtgagtcataaaaggcctgcaaatttcattcagactccagactccctgctcccttcaccctggtgggctggaccacagctgtgcctgaatccgtgcagtggcggtgtgcttactgcctcccggaagagcgtcttccgcagcccagcagctctggctcaaccacgctggttaatggggaagaaaatgaggcacagagagggccagtgagccatctaaggtcacacagcaggtttgagacagagtcagggcaaggacccagcccccctgccctcgctcttctcacccagtaaggagacgcaccctgcattgtctgcttagggccgacctgtcctgcaaacacaaatccctgaccttgggggaattcacagtctgatgcaggaggcagccaggttacagctgtcacaagctcaggtgacatgaatgctcatggaggaagcccagggcatcggatgggctcctgaagtcatctgatgcaccctgggggatcagggacaacagaggacctgccagaacagtcttgtaggaaaagccgtgtggatttcccagcacagagagcagcgccagcaccatttcagccccgactctctgaggcctcagtcatagaaccagccagttccctctggaaggaagtgtgctgggaaggtggccactcagacagtgtgggaccccctatggagcagactggctggatctatgggcgagggaaagtttcttccaccctaggatgagtgaaaggttggtggggaatggagcacaagtcatcaaggtcagggaccacgttttctgaaggcctcgggcctcagaggctctggaaggccgtggaggcaggatggcccaggagctggggatggccagaacacctagagcctccagggcctgccctgaggactatggcgaggagtagcatcagctccgggtgctgaaggaaccccctgggccttgtgcaggacactcttgacgggatggctgggcgacggagcagggtggcatcatccatcaaattcaacacaagccccacgtggaattctaaattttctagacaccatgttaaaagagtaaaaaaagcagatgaaattcctttttttttttttttttgcccaggctggcttcgaactcttgggctcggtgatccgcctgcctcggcctcccaaagtgctggggttgcaggcctgagccaccacgcccggctcgttcggctttattgtactcagtcttcagaacccagtgcaggttttattgttagaggcctctctgctaggactctctgctaggactccctgcctttccagtactccctgttcacatgtggctggcggctcccacagaggccagggcagggccaaaggggaaggagtacagtgacttggggcaggaggaatgggttggggcagaggacgtcgccagggtctgggcctgcgaggactggatggtgagaatcctggggagtagcaggtttggggaggacacacagcaccgctgggacaaggtgggtggagggtggtgagtgccatccaggggacgggcgggcactctgagtgggtggcgatgatgtaggccgccaagcctcagccccctctgtcctgctctggcccgcagggcgcggatggcgtcggggcgccccgaggagctgtgggaggccgtggtgggggccgctgagcgcttccgggcccggactggcacggagctggtgctgctgaccgcggccccgccgccaccaccccgcccgggcccctgtgcctatgctgcccatggtcgaggagccctggcggaggcagcgcgccgttgcctccacgacatcgcactggcccacagggctgccactgctgctcggcctcctgcgcccccaccagcaccacagccacccagtcccacacccagcccaccccggcctaccctggccagagaggacaacgaggaggacgaggatgagcccacagagacagagacctccggggagcagctgggcattagtgataatggagggctctttgtgatggatgaggacgccaccctccaggaccttccccccttctgtgagtcagaccccgagagtacagatgatggcagcctgagcgaggagacccccgccggcccccccacctgctcagtgcccccagcctcagccctacccacacagcagtacgccaagtccctgcctgtgtctgtgcccgtctggggcttcaaggagaagaggacagaggcgcggtcatcagatgaggagaatgggccgccctcttcgcccgacctggaccgcatcgcggcgagcatgcgcgcgctggtgctgcgagaggccgaggacacccaggtcttcggggacctgccacggccgcggcttaacaccagcgacttccagaagctgaagcggaaatattgaagtccagggagggagcgccccgggccgcgtccgccccgtcccacactacgcccccgccccactcccggggcctgctaatctgaggccgatccgggaccggcctccttgcgtctcccattcccaagattgtcccgcctctgccaatccccgccgtccttccagcccacgacctgccgcgccgaggagcggcatctgtcccgtttcccgattgggtctgtcgtctctctccgcctagcgacagattccttctattaagggattggctcgctgagttctaagctctaaatgggtcaactcctttgttttccgcctagcgacaagggatttgctcgcacggcattggctccatcccctagtcgctggacagctctttttttgattggctcaaatcctgtaaagggcttgaccagtctctacatagtcaccgtccgcttttcctgagttctccctcccaattggctccagcttcctgggggcgtggccaagccctcctcttcccagaattggcccggggccttcaatttacgttctttacactacggggactggggtcgtctttgcccacgtcccgacaacttgttccctgaccccctcagggatggccccaaactgtccctgcctctggcaccccctttcattggttccatccatccccacaacagcctgccaatcgaagcccgtccctgcatccaggatggtaccagctcccgcccctcgccccccacctccacaggtgccttaaagggccctcgtccacccaaggtggggggcaggggccctcactctccggccctggtgtgggggagagagtgaggggttgggggatcggcagttgggaggggcgctctgagattaaagagttttacctctgagataaat

SEQ ID NO: 2245 - DNA, 2370 bp, Homo sapiens
agctaaggccatgttaatacggggctgtcccatctctctgcggggcgcgacagctggaagagccgaacggataagagaagaggaggtgagaggagctgtacaccacaagaggcactgagggactcaggataacgggatgaagccgtcagtgcccccagaaacgaagcggccccggacgaatttctgagtcaccgtcgcgagaaagcgggctgagccgccattttgaagcctggcaaaccgaagcaagaaatgctgccgtgttggatctttgccagccttcgtgccgaatgggagcaggttggagggagggagagccaatatacactatgggctgattaagcccggttggctgccatgttgttaacgagcaccgatttcctctacttttgtcgaagaagtttattgtgggtcagggacgtcaggtcgcttgccttcgtttactgtggtcatgattgagcatatgaggacggccattattgttgggggcaaatggaaatgctctaggcggggccatttttcttaggggcaagctgtcgtcacccttgtcaactggttcggatgaagcccctgtggccgccatcttgatctcgggcggccccgataagggaggcggagtgtgcggagaggaggcggggcaactgcgcggacgtgacgcaaggcgccgccatgtcttttgagggcggtgacggcgccgggccggccatgctggctacgggcacggcgcggatggcgtcggggcgccccgaggagctgtgggaggccgtggtgggggccgctgagcgcttccgggcccggactggcacggagctggtgctgctgaccgcggccccgccgccaccaccccgcccgggcccctgtgcctatgctgcccatggtcgaggagccctggcggaggcagcgcgccgttgcctccacgacatcgcactggcccacagggctgccactgctgctcggcctcctgcgcccccaccagcaccacagccacccagtcccacacccagcccaccccggcctaccctggccagagaggacaacgaggaggacgaggatgagcccacagagacagagacctccggggagcagctgggcattagtgataatggagggctctttgtgatggatgaggacgccaccctccaggaccttccccccttctgtgagtcagaccccgagagtacagatgatggcagcctgagcgaggagacccccgccggcccccccacctgctcagtgcccccagcctcagccctacccacacagcagtacgccaagtccctgcctgtgtctgtgcccgtctggggcttcaaggagaagaggacagaggcgcggtcatcagatgaggagaatgggccgccctcttcgcccgacctggaccgcatcgcggcgagcatgcgcgcgctggtgctgcgagaggccgaggacacccaggtcttcggggacctgccacggccgcggcttaacaccagcgacttccagaagctgaagcggaaatattgaagtccagggagggagcgccccgggccgcgtccgccccgtcccacactacgcccccgccccactcccggggcctgctaatctgaggccgatccgggaccggcctccttgcgtctcccattcccaagattgtcccgcctctgccaatccccgccgtccttccagcccacgacctgccgcgccgaggagcggcatctgtcccgtttcccgattgggtctgtcgtctctctccgcctagcgacagattccttctattaagggattggctcgctgagttctaagctctaaatgggtcaactcctttgttttccgcctagcgacaagggatttgctcgcacggcattggctccatcccctagtcgctggacagctctttttttgattggctcaaatcctgtaaagggcttgaccagtctctacatagtcaccgtccgcttttcctgagttctccctcccaattggctccagcttcctgggggcgtggccaagccctcctcttcccagaattggcccggggccttcaatttacgttctttacactacggggactggggtcgtctttgcccacgtcccgacaacttgttccctgaccccctcagggatggccccaaactgtccctgcctctggcaccccctttcattggttccatccatccccacaacagcctgccaatcgaagcccgtccctgcatccaggatggtaccagctcccgcccctcgccccccacctccacaggtgccttaaagggccctcgtccacccaaggtggggggcaggggccctcactctccggccctggtgtgggggagagagtgaggggttgggggatcggcagttgggaggggcgctctgagattaaagagttttacctctgag

SEQ ID NO: 2246 - DNA, 3075 bp, Homo sapiens
attgccccgggaccaaggcggggagaatggtccagcccgcgttcggatgctgacgtgcgttccacagggggcagggctcaaggagtcgcctgagccgggggggcggggccatgggaggttcttccctggggcggtggacgggagggtgacggcgcgtttataagagatcggtgtttgccaaggccgtgccggattctcgagagccaaggcctgagagaagagctgatcactagacggggcgtttcgcatacactgaagcgagggaatgcgtcctcagtgcttaccctgtagccggctccttccatagtcgccgccgaaggccccactgccccgcctcctccttttcctagtcagcgtgttgtcacttccggagaaaacagttcccctccgggccggacagtggtagcggcccgacccgttctagagaaggagcgggtgaaaccatttttcagaagggggttattccactggaacctcgagggtggatcggagtcacgtggcgcagacgctgaaggtggatccggctacggagagtgcgcaggcgcagtgttcgccctctcgccacgaagtaaacaagtgggagggtctgagagctgcaccacctggggcaagcacgccttgaaacgcccacttccttctccatattgtatactggaattgaagccaaggaggtaccattttgctcgagggcatggcctaagccggtcagctaaggccatgttaatacggggctgtcccatctctctgcggggcgcgacagctggaagagccgaacggataagagaagaggaggtgagaggagctgtacaccacaagaggcactgagggactcaggataacgggatgaagccgtcagtgcccccagaaacgaagcggccccggacgaatttctgagtcaccgtcgcgagaaagcgggctgagccgccattttgaagcctggcaaaccgaagcaagaaatgctgccgtgttggatctttgccagccttcgtgccgaatgggagcaggttggagggagggagagccaatatacactatgggctgattaagcccggttggctgccatgttgttaacgagcaccgatttcctctacttttgtcgaagaagtttattgtgggtcagggacgtcaggtcgcttgccttcgtttactgtggtcatgattgagcatatgaggacggccattattgttgggggcaaatggaaatgctctaggcggggccatttttcttaggggcaagctgtcgtcacccttgtcaactggttcggatgaagcccctgtggccgccatcttgatctcgggcggccccgataagggaggcggagtgtgcggagaggaggcggggcaactgcgcggacgtgacgcaaggcgccgccatgtcttttgagggcggtgacggcgccgggccggccatgctggctacgggcacggcgcggatggcgtcggggcgccccgaggagctgtgggaggccgtggtgggggccgctgagcgcttccgggcccggactggcacggagctggtgctgctgaccgcggccccgccgccaccaccccgcccgggcccctgtgcctatgctgcccatggtcgaggagccctggcggaggcagcgcgccgttgcctccacgacatcgcactggcccacagggctgccactgctgctcggcctcctgcgcccccaccagcaccacagccacccagtcccacacccagcccaccccggcctaccctggccagagaggacaacgaggaggacgaggatgagcccacagagacagagacctccggggagcagctgggcattagtgataatggagggctctttgtgatggatgaggacgccaccctccaggaccttccccccttctgtgagtcagaccccgagagtacagatgatggcagcctgagcgaggagacccccgccggcccccccacctgctcagtgcccccagcctcagccctacccacacagcagtacgccaagtccctgcctgtgtctgtgcccgtctggggcttcaaggagaagaggacagaggcgcggtcatcagatgaggagaatgggccgccctcttcgcccgacctggaccgcatcgcggcgagcatgcgcgcgctggtgctgcgagaggccgaggacacccaggtcttcggggacctgccacggccgcggcttaacaccagcgacttccagaagctgaagcggaaatattgaagtccagggagggagcgccccgggccgcgtccgccccgtcccacactacgcccccgccccactcccggggcctgctaatctgaggccgatccgggaccggcctccttgcgtctcccattcccaagattgtcccgcctctgccaatccccgccgtccttccagcccacgacctgccgcgccgaggagcggcatctgtcccgtttcccgattgggtctgtcgtctctctccgcctagcgacagattccttctattaagggattggctcgctgagttctaagctctaaatgggtcaactcctttgttttccgcctagcgacaagggatttgctcgcacggcattggctccatcccctagtcgctggacagctctttttttgattggctcaaatcctgtaaagggcttgaccagtctctacatagtcaccgtccgcttttcctgagttctccctcccaattggctccagcttcctgggggcgtggccaagccctcctcttcccagaattggcccggggccttcaatttacgttctttacactacggggactggggtcgtctttgcccacgtcccgacaacttgttccctgaccccctcagggatggccccaaactgtccctgcctctggcaccccctttcattggttccatccatccccacaacagcctgccaatcgaagcccgtccctgcatccaggatggtaccagctcccgcccctcgccccccacctccacaggtgccttaaagggccctcgtccacccaaggtggggggcaggggccctcactctccggccctggtgtgggggagagagtgaggggttgggggatcggcagttgggaggggcgctctgagattaaagagttttacctctg

SEQ ID NO: 2247 - DNA, 1096 bp, Homo sapiens
aagcgaccgagggactgggagtcgttagtgagagtttcactcttgttgcctaggctggagtgcaatggtgcgatcttggctcatcacgaccttcgcctcccaggttcaagtgattgtcccatttcagcctcccgagtagctgggattacaggatgacgcggcatggcaagaactgcaccgcaggggccgtctacacctaccacgagaagaagaaggacacagcggcctcgggctatgggacccagaacattcgactgagccgggatgccgtgaaggacttcgactgctgttgtctctccctgcagccttgccacgatcctgttgtcaccccagatggctacctgtatgagcgtgaggccatcctggagtacattctgcaccagaagaaggagattgcccggcagatgaaggcctacgagaagcagcggggcacccggcgcgaggagcagaaggagcttcagcgggcggcctcgcaggaccatgtgcggggcttcctggagaaggagtcggctatcgtgagccggcccctcaaccctttcacagccaaggccctctcgggcaccagcccagatgatgtccaacctgggcccagtgtgggtcctccaagtaaggacaaggacaaagtgctgcccagcttctggatcccgtcgctgacgcccgaagccaaggccaccaagctggagaagccgtcccgcacggtgacctgccccatgtcagggaagcccctgcgcatgtcggacctgacgcccgtgcacttcacaccgctagacagctccgtggaccgcgtggggctcatcacccgcagcgagcgctacgtgtgtgccgtgacccgcgacagcctgagcaacgccaccccctgcgctgtgctgcggccctctggggctgtggtcaccctcgaatgcgtggagaagctgattcggaaggacatggtggaccctgtgactggagacaaactcacagaccgcgacatcatcgtgctgcagcggggcggtaccggcttcgcgggctccggagtgaagctgcaagcggagaaatcacggccggtgatgcaggcctgagtgtgtgcgggagaccaaataaaccggcttgggtgcgc

SEQ ID NO: 2248 - DNA, 1181 bp, Homo sapiens
cacttctgccgcccctgtttcaagggataagaaaccctgcgacaaaacctcctccttttccaagcggctgccgaagatggcggaggtgcaggtcctggtgcttgatggtcgaggccatctcctgggccgcctggcggccatcgtggctaaacaggtactgctgggccggaaggtggtggtcgtacgctgtgaaggcatcaacatttctggcaatttctacagaaacaagttgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccgtctcaaggtgtttgacggcatcccaccgccctacgacaagaaaaagcggatggtggttcctgctgccctcaaggtcgtgcgtctgaagcctacaagaaagtttgcctatctggggcgcctggctcacgaggttggctggaagtaccaggcagtgacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattcctcatgcgttgcctgcccttcctccattgttgccctggaatgtacgggacccaggggcagcagcagtccaggtgccacaggcagccctgggacataggaagctgggagcaaggaaagggtcttagtcactgcctcccgaagttgcttgaaagcactcggagaattgtgcaggtgtcatttatctatgaccaataggaagagcaaccagttactatgagtgaaagggagccagaagactgattggagggccctatcttgtgagtggggcatctgttggactttccacctggtcatatactctgcagctgttagaatgtgcaagcacttggggacagcatgagcttgctgttgtacacagggtatttctagaagcagaaatagactgggaagatgcacaaccaaggggttacaggcatcgcccatgctcctcacctgtattttgtaatcagaaataaattgcttttaaagaaa

SEQ ID NO: 2249 - DNA, 3725 bp, Homo sapiens
atgacctgctgctcacaggttcccccacgccgcagaccgagtctcgctctgtcgcccaggttggactgcaatggtttgaacggtgtccccgggagcatctgggactttgtttccggcagcttctcccccagcccctcccccatcctgagtgccggccccccatcctcttcgagtgcaagtccaaacggagctgagctggcccgggtcaggcggcagctggacgaggccaagaggaagatccggcagtgggaggagtcctggcagcaggtgaagcaggtctgcgatgcctggcagcgagaggcgcaggaggccaaggagcgtgcccgtgtggccgatagcgaccggcagctggcgctgcagaagaaggaggaggtggaggcacaggtgaagcagctgcaggaggagctggagggcctgggcgtagcctccacactgccggggctgcggggctgtggggacatcggcaccattcccctgccgaagctgcactcgctgcagagtcagctgcgcctggacctggaggcggtggacggcgtgatcttccagctccgcgccaagcagtgtgtggcctgccgggagcgggcccacggtgctgtcctgcggccctgtcagcaccacatcctctgtgagccgtgtgcggccaccgcacctgagtgcccctactgcaagggccagcccctgcagtggtgacctcagcggggacagccacctcctgctgggcaccctggctccagcgctcctcctgaccacggacatgtcgtcactcgcttctggtgccaccgacgtgaggaccgaggctgggagcccttcctgttacacgttatcatgaggctgggagccccgcctgcgcttggcctgacagcctttcctgtcacacgttgtcacctatctagtcctaccgacggtttcaaggtattttcctcaaaaaccttaaatgcaaacccacagaacccgcctgcctgtccctgaggggcctggtgcctccgggatccacgcggcgctgtgatcacagcagtttgtggtcctgacactactgtgactaggccactgggagctggggtctttcaaagcactttgtaaaccgaggaatttagttagaggttataaattgctctaagctgctttctgtttttttttaatatgcgataatatgaagctttatatgtgtactgtgaacttaaatatttcatatcagtttattgtcaattcatagtatgctaaatatattagatttcatattctgaaactagtacttatgaaatgagtgtttatctagtagtaagacctaggatttttacattttccaattaagtgcaaatagtatttataagcagagtgattatggattgagatgtttttaacttgatggaaggagctagttttcctgagcctgtgtgtgcaccaggcactggggctgatgttccagcctcgtggcgtgggagcaggagagctccgtcctgcatttctgtggtccgtggccgctgtttctgtgcgcctgcgcctcggagagcaagtgaaggagcatcatgggttttgttttctcccttaaccctctgaaagacagtttgatactaacaaaaaacgcagcagaggggatccgacgtcagagcttttagaattacttttttaagcagctgtcttctggctgggtgcggtggctcatgcctgtgatcccagcactttgggaggcgggtggatcacctaaggtcaggagttcaagaccagcctggccaacatggtgcaaccccgtcttagtaaaaatacaaaaattggcctggcgtgagagcgggcacctgtagtcccagctactcgggaggctgaggcaggagaatcgcttgaacctgggaggcagaggttgcagtgagccgagatcgcgccaccgcactccagcccgggtgacagagcgagactctggctcaaaaaaaaaaaaaaaaagctgttttctgattactcagagctgtcctaggcaatggtgctttgtagctccttggagatgtcgctgggcgtcctggcaggggtcaggcagtgaactgggagagtggttgcctccccagcacccgtgaccaccctggtcctgctcgtgtgggagatgctcgggccgtgtgtgcgccagggtccggggtgccgggtgtatgtggcagtcacctgacccgcgctgccagttatcatcggagctcatccatgtggccagtgaggtcacaggagaggacccggccacagcctctcagtggcctggagcacacgggggaagcgaccccccccaggtcccggctctgctgtggtcccctgtcccgtctgcccctggagcgacagtgtggtttcggccgcagcagaaacgtgactgagaacgcatccccgcgatgacctgacccttctgctcagggctgggactgtccctaggagttgagcaggaacaggcatctgtggtttacggcgacctggctctccgcgggccacgtgggtggtgagggcacacgagtgggaagcggcaccgacgtgtttctccccgaccgtggctttgccaaagacttttaatagcattttttaagtgcaaaacgtctaggtaaaaatctttatcatcagtgaccaaattagaatgtatttaatatagtaggtggtttaagaactgttttaacgtaagacaaactgatagcaacattctgttgttttaaaggaagtgggtccgtgacattctgcagctagtccactactccaaggtaactatcgacttggtttcagtgaatctattttgtttttaactacagtgatttattagctcagtatctagaaattacgtatattttgtgctactgtcatcgatgtgtaaactctgtttttatttgtatttatgcacttggttcccatttggagcctctggtcttttctgggataagtggtgtctgccgagacatctcccggttgtcagtggtcaggagcagctgagctctagtctgccagctgctctgctctttctgggaaggaggtggcgcccgcccctcagggtgtctccagggctcagcttccggggtggtagagctggggagccccaggggtggggggacagctgggagatggaggtggcacctgctcccctagatcagtactggctctgaggacaggtgagcagtgggaagaccaaagaatggctggcagcgctgccagggttggaaatgggggcaagatcctggggctgtgtgccctggggcctccctcacctgtcttggtggccatggcctcagggatggctcctaggtggctgaggcacagcagtggctggaaggtgccccgtggaggctgaggtggaggcgcgcccagcagctcccccctgtggccatggcgggcacggggcgtaggagctggctggcggccggctctgcatgttcttgttgcctgtcgtctgtaactctagtgttcgacattcgccgtgatacagtggtgtcacgacgtgtgtaactgtggtcagcagaccttgttccgcgtggacgcctcaagtggattaatttctggaagcctcaatctgtatgtttgagtatttacatgagaatgttatttgaatggaattttcttaacccagaaggtagtatttataatcatttacttgtagcgaactgtttaaagttaacacttgtttaaatttttttacactatagcatttatgcaatggtttacagaattcatggagttatttttatcagtatgggaattaattaaaaccttgaatcttt

SEQ ID NO: 2250 - DNA, 3208 bp, Homo sapiens
acagcgggcgcgcaggccggccccggggcctccatgatggaggagcgagcggccgccgcggtcgccgccgccgcctcctcctgccgtccgctcggctcaggcgcgggccctggccccactggggcggccccggtctccgcccctgcccccgggccgggcccggcaggtaagggaggcggcggcggaggcagccccgggcccacggcgggcccggagcccctgagcctgccggggatcctgcactttatccagcacgagtgggcgcgcttcgaagccgagaaagcccgctgggaggccgagcgcgccgagttacaggctcaggtggccttccttcagggagagaggaaagggcaggagaatctaaagacggacctggtgcggcggatcaagatgctagagtatgcgctgaagcaggaaagggccaaatatcataaactgaagtttgggacagacctgaaccagggggagaagaaagcagatgtgtcagaacaagtctccaatggccccgtggaatcggtcaccctggagaacagcccgttggtgtggaaggaggggcggcagcttctccgacagtacctggaagaggtgggctacacagacaccatcctcgacatgcggtccaagcgcgtccgttccctgctgggccgctcgctggagctcaacggggcagtggagccgagtgaaggggcccccagggctccaccaggccctgcagggctcagtggtggggagtcgctgctggtgaaacagatcgaggagcagataaagaggaacgcggcaggcaaagatggcaaagagcgcttgggcggctcagtgctggggcagatccccttcctgcagaactgcgaggacgaagacagcgacgaggacgatgagctggacagcgtgcagcacaagaagcagcgtgtgaagctcccatccaaggctctggtgcccgaaatggaagacgaggatgaggaagacgactctgaggatgctatcaatgagtttgatttcctgggctcaggagaggatggggaaggggctccagaccctcggcggtgcactgtggatgggagcccccatgagctggaaagccgtcgggtcaaactccaaggcattctggctgacctgcgggatgtggatgggctgcccccaaaagtgactggcccgcctcctggcacaccccagccccggccacatgaaggttcctttggcttctcctcagacgtcttcatcatggacactatcgggggcggggaggtgagcctgggggacttggcagatctcaccgtcaccaacgacaacgacctcagctgcgatctgtctgacagcaaagatgcttttaagaagacgtggaaccccaagttcaccctgcgctcgcactacgacggcattcgttccctggccttccaccacagccagtcggctctgctcaccgcctccgaggacggcacgctcaagctctggaacctgcagaaggcggtcacggccaagaagaatgcggcgctagatgtggaacctatacatgctttccgggctcacaggggcccagtgttggctgtggctatgggcagcaacagtgaatactgctacagtggcggggcagatgcctgcatccatagttggaagattccagacctcagcatggatccctatgatggctacgacccaagcgtgctgagccacgtcctggagggccacggggacgccgtgtggggcctggccttcagtcccacctcccagcgcctggcctcctgttctgctgatggcaccgtccgcatctgggaccccagcagcagcagcccggcctgcctctgcaccttccccacagccagcgagcacggggtccccacctcagtggccttcaccagcaccgagcctgcccacatcgtggcctccttccgctctggcgacaccgtcttgtatgacatggaggttggcagtgccctcctcacgctggagtcccggggcagcagcggtccaacccagatcaaccaagtggtgagtcatccaaaccagcctctcaccatcaccgcccacgacgacaggggcatccgcttcctggacaatcggacaggtaagccggtgcactccatggttgcacacctggacgcagtcacctgcctagccgtggaccccaacggcgcattcctgatgtcaggaagccatgactgctccctgcgtctctggagcctggacaacaaaacgtgcgtgcaggagatcacggcccaccgcaagaagcacgaggaggccatccacgctgttgcctgccaccccagcaaggccctcattgccagtgctggcgctgatgccctggccaaggtcttcgtatgatgcccacctggccctgccctggccgccacgctggctggggtgtagggccgggcaggtggggctgaggggactcccagcctcgctggaggtgcagaggcctggcctctgtctgtttgccatggagcctggtggtgctaacggccctttccccaggaatccctccccaacggctgccttccccaagcatccagcctggggatgggcccctttcaggaatcacccccgaggatggcctcggggtttccccctgtgccctgacagccgctcctggtatcagagctgctttccagagggcagcacagccagggccgggtgtctttagggatcagtttttccaagactccagaaggtgccaggttctccccttgagctcctgctcccccatcccccatcctcccagacctgggcaggagctgtgctgggagaaagggtggcagccgggagcctcagagctgagccccggcctggctgcccctcccctccggccctctccactgctttccagacactaaccaaggcttccaggccagggattgcccaacactcctagggcagccctcccagcgccccatggggtcgcccatgggtagagacggctttcttgtgcccctccctggggcatggagggtggagtgggcctcgggtccccctgaactccctgtatatctgtataaataacgggattttcatggcgccgccccacccgcattatcactgtgtgatggtctcagtcagtctcctccctgtctccactctttccctctatttatttcactctcttgtttggttctaccctgcaccctcggtccccttccaggttcctgtttataagccccaacccctctgtccccatcttgtatgtgaaaacttgtctcaataaaccctttggagt

SEQ ID NO: 2251 - DNA, 867 bp, Homo sapiens
gtaccattcttcaagaaacggtttgaatcagactgcctttccttttgtcttcattgtcataaacatctgcccccgtgtggttctgactggccgcgaacccctacccgaagcttttattccatcattgtgcaccgttggtggggaatgctgtggcaacaggccacgcctccacttactggttggctttgcgcaggcgccaacggaagtgggtcgcaggaagaggaagtcccgcctctctctcctcaggcagcagcaacgcggaggaaacgggagtgaacggagagcgtagtgaccatcatgttttagcacaaccccctcagaccactctgtggagaacagactgtcagggaacgtgggtggaggcagagagaccagaaagattccaggacagagatgacagaggcttaggccatggagcctcctcaacaagcccaagagtgagatgaccccagaggagctgcagaagcgagaggaggaggaatttaacaccggtccactctctgtgctcacacagtcagtcaagaacaatacccaagtgctcatcaactgccgcaacaataagaaactcctgggccgcgtgaaggccttcgataggcactgcaacatggtgctggagaacgtgaaggagatgtggactgaggtacccaagagtggcaagggcaagaagaagtccaagccagtcaacaaagaccgctacatctccaagatgttcctgcgcggggactcagtcatcgtggtcctgcggaacccgctcatcgccggcaagtaggggccgcctgtctgttgacagaactcactcctctgtcctatgaagaccgctgccattggtgttgagaataataaagctctgtgtttttttctagtggt

SEQ ID NO: 2252 - DNA, 2570 bp, Homo sapiens
tatcacagaagaaattcgtgtctatagcttttaaggacttgattacatcattttcaagcctgatagttttggaatcaccattagagcttaagacacacctgccttcatttcaaccacctgtcttcataccctgacgaagtgcaccttttaacactcctttgtccttggattacttaagagttcccagaaatacatttgccaccaacagagtagccaaatttataaggaaaaatgattcccaatggatatttgatgtttgaggatgaaaattttattgagtcttctgttgccaaattaaatgccctgaggaaaagtggccagttctgtgatgttcgacttcaggtctgtggccatgaaatgttagcacacagagcagtgctagcttgctgcagtccctatttatttgaaatctttaatagtgatagtgatcctcatggaatttctcacgttaaatttgatgatctcaatccagaagctgttgaagtcttgttgaattatgcctacactgctcagttgaaagcagataaggaattggtaaaagatgtttattctgcagcaaaaaagctgaagatggatcgagtaaagcaggtttgtggtgattatttactgtctagaatggatgttaccagctgcatctcttaccgaaattttgcaagttgtatgggagactcccgtttgttgaataaggttgatgcttatattcaggagcatttgttacaaatttctgaagaggaggagtttcttaagcttccaaggctaaagttggaggtaatgcttgaagataatgtttgcttgcccagcaatggcaaattatatacaaaggtaatcaactgggtgcagcgtagcatctgggagaatggagacagtctggaagagctgatggaagaggtttattaacaaaactaggatacccaagactgaagaaacaagaagaaacctcaagtgtattgacacgtaaagaagcagcagtcctgccccagttctcctaagaaaaatccgctgtgggcagagaacgatgatgatttaatggttcaaaccttgtactactcagctgatcacaagctgcttgatgggaacctactagatggacaggctgaggtgtttggcagtgatgatgaccacattcagtttgtgcagaaaaagccaccacgtgagaatggccataagcagataagtagcagttcaactggatgtctctcttctccaaatgctacagtacaaagccctaagcatgagtggaaaatcgttgcttcagaaaagacttcaaataacacttacttgtgcctggctgtgctggatggtatattctgtgtcatttttcttcatgggagaaacagcccacagagctcaccaacaagtactccaaaactaagtaagagtttaagctttgagatgcaacaagatgagctaatcgaaaagcccatgtctcctatgcagtacgcacgatctggtctgggaacagcagagatgaatggcaaactcatagctgcaggtggctataacagagaggaatgtcttcgaacagtcgaatgctataatccacatacagatcactggtcctttcttgctcccatgagaacaccaagagcccgatttcaaatggctgtactcatgggccagctctatgtggtaggtggatcaaatggccactcagatgacctgagttgtggagagatgtatgattcaaacatagatgactggattcctgttccagaattgagaactaaccgttgtaatgcaggagtgtgtgctctgaatggaaagttatacatcgttggtggctctgatccatatggtcaaaaaggactgaaaaattgtgatgtatttgatcctgtaacaaagttgtggacaagctgtgcccctcttaacattcggagacaccagtctgcagtctgtgagcttggtggttatttgtacataatcggaggtgcagaatcttggaattgtctgaacacagtagaacgatacaatcctgaaaataatacctggactttaattgcacccatgaatgtggctaggcgaggagctggagtggctgttcttaatggaaaactgtttgtatgtggtggctttgatggttctcatgccatcagttgtgtggaaatgtatgatccaactagaaatgaatggaagatgatgggaaatatgacttcaccaaggagcaatgctgggattgcaactgtagggaacaccatttatgcagtgggaggattcgatggcaatgaatttctgaatacggtggaagtctataaccttgagtcaaatgaatggagcccctatacaaagattttccagttttaacaaatttaagaccctctcaaactaacaggcttagtgatgtaattatggttagtagaggtacacttgtgaataaagagggtgggtgggtatagatgttgctaacagcaacacaaagcttttgcatattgcatactattaaacatgctgtacatactttttgggtttatttggaaaggaatgcaaagatgaaggtctgttttgtgtacttttaagactttggttattttactttttggaaaagaataaaccaagaattgattgggcacatc

SEQ ID NO: 2253 - DNA, 1654 bp, Homo sapiens
aaacgtcatcgcgggcgcgacgcctgagggacagtctggggtttggctgtccggacggtgcagcggcgaggccggccgcgaagatgccagtggcggtgatggcggaaagcgcctttagtttcaaaaagttgctggatcagtgcgagaaccaggagctcgaggacgcttgatgtaatgggcagaatcagaatgcttcaggaatctgtcgaatttgtttcttataatagcccctggaggaattgctacacccccagtgtatggtcagcttctagctttatatttgctccataatgacatgaataatgcaagatatctttggaaaagaataccacctgctataaaatctgcaaattctgaacttgggggaatttggtcagtaggacaaagaatctggcagagagatttccctgggatctatacaaccatcaacgctcaccagtggtctgagacggtccagccaattatggaagcacttagagatgcaacaaggagacgcgcctttgccctggtctctcaagcgtatacttcaatcatcgccgatgattttgcagcctttgttggacttcctgtagaagaggctgtgaaaggcatattagaacaaggatggcaagctgattccaccacaagaatggttctgcccagaaagccagttgcaggggccctggatgtttcctttaacaagtttattcccttatcagagcctgctccagttcccccaatacccaatgaacagcagttagccagactgacggattatgtggctttccttgaaaactgatttatcactctgagttcaagattcatcttcagaatcctgtatactgacaaacgtagaaatgtaaagtttgtattttcaatttattggatggcttaagcacctcagcattccttactatgtgataaaatacatatagaatataagatatactatatacattttgtccataaacgttatgctgaatagttgttgaaacagttctcattttgtagtatttaataatctggatggagcctgtcagtattacagttagttttctagtgactcataaaataagatttcctgtttcatgtagaatagtgtttgtcaactgtcttttctctgtcccagcacatgccgtactcttatatgtaccattggttgataattataatgattcatttggacttgaagaaagattgtccccaggcacagtatctgaatcactggggattatgattcaccctctttggagaacatgctctcttttcaccccccacctcctgagagccactaatgtaagatacagaaacatagctgaggaacaaatagaccatttccatactaaaccagtttgttaactttagattttttccaatagtgtgagtatatccattgctggcagtggagggcttgccatgaaaatgcaacttatttaagacatttatgagacatattaacttgtgctgtcgccttttagaaggagaaacttaagtgtggaatgcattatatgggcaaagaagctatgaagatacatgatacactttgtacaactatcctgcagcccattggttgcttatatttatcgcttggctcaagttctgccctttggagaaatactgagcaagtctttcattctctgtgtgacagccctctgaatatttgaagttgtttgtt

SEQ ID NO: 2254 - DNA, 6282 bp, Homo sapiens
agtctggtctggagctgggacagcagctgctgctgtggaaaggccagctggcaagatgatggaagaaatctccattatggtagcctatgacgcccatgttttcagccagctgcacgatgaagacttcctcactagtctggtggccatcagcaagcccaggtctatggtaccaaccaagaagctgaagaaatatgagaaagaatatcagacaatgcgagagagtcagctgcaacaggaagacccaatggatagatacaagagggagaaccgaagattacaggaggccagcatgaggttggaacaagagaatgatgaccttgcccatgaactagtaacaagcaaaattgctctacggaatgacttggatcaggcagaagacaaggcagatgtgttgaataaagagctccttttgaccaaacagaggctggtggagactgaagaggagaagaggaagcaagaggaagagactgcccagctaaaagaagtcttcaggaaacagctagagaaggcagaatatgaaataaagaagactacagctatcattgctgagtataaacagatctgttcgcagttgagtaccaggctggagaaacagcaagcagccagcaaggaggagctggaagtggtaaagggtaagatgatggcatgcaaacactgcagtgacattttcagcaaggagggtgctttgaaactagcagccacaggcagagaggaccagggaattgaaacagatgatgagaaggactcacttaagaagcagctgagagagatggaactggaactggcacaaaccaaactgcagttggtggaggccaagtgtaaaattcaggaacttgaacatcagagaggagcccttatgaatgaaatccaagctgcgaaaaactcttggtttagcaaaaccctgaactctatcaaaacggccacgggcacccagccattgcagccagcaccggtcacccagccacccaaggagagcacatagttccagccttacccaagcacaagagcacaatgttcaaaccaatggaaatctgggaggattcttcctggtgtccctttgaaggaaagtcaaggaggccagaaaacaagccagaatttttcagtagctctcactctttcttgtatgacacttttcaaagggatgctatttaaactgacctgttctatgttgaatacctattttccagcttctggaaggccatgttcagatccatcatagtattacacattattttgtttgcctgatgtttagttggaaataagtaattcagaactaaatgcttttttatttagaattattcataattatttttatcttacataaaaatggagacatctgttattccaaggttgaagtgataagaagatctttgtcacaggaaaaaaaaaattgaaacctaaacatcttaagttttcaggatttattcagataaagcacactgtggggccaggcatgaccactctcaggtttcctcctgagcctgattcccagggaagtgttaatcctgtccaaaggaaagaaccaatcagcgatcattggtttactttcattttctgttcggtacatctggaaatgaagtgccaggaatagacgggctgttcagattatacgctaggtaaaaggaactgaaattttaataagtgtaggtcaggatcatttgggctgtggtattctaacagatccttttaagaatgccacataggacttgtgagttcctaagtacaccaaagtatggacacagatgtgacttctggcaattataaagttaaaggtggatattgcaccttacagacttagggagcctttaccagagacgcctaaaaagccccaggttcagccattgtgctgaatagagtggaatatagaaccagggacagagtatttcatttaacgttgatatatacttgctaaggaaacactaacaatactgtaactttgttaaaggacatagtattgaaatgggaaatagaggtcaggctcacatcatcttagtttaatgctgggcaactttttctgatttctgtagttccctgaaaatgtgtccttcgtacccataaagagatacaaatgcatttgtaacatttttgattgaatataaaacctttacagaaatacttatctcatggaaaggtaaagctattgtttaaaaattagtggaaatattttttcaattatatttaacatgcctataaaaatagtccttgcaggaaattatttgataagagcaaaactatttttattttataaactattttggaggcctctgatcctttcaaaccaaccaaactactattagatatgtacaataacatttgttgatattaatcattggcctcattgttgaacatattatttgcaaagaatcttaaactctgtagtgccagaatgattctcatctgtgccatattttgcaattaaaagtaacacacccttagaagaatcaaataagagccatctacatcccaggaggatgcaccaagttgctcacagtggatcttttcctctaaaatgatcttttatgttctaaaaagtgaaatcccctttatctgtgtttatattctctacagcccataaaactgatgtgattgttatgttatactcatcagataatacttttcttacataaatctttcattgttgttctgacatctttcattacaaaatttattttcttaacaaaaaggaacataacccagcattccaagtgtctgtgttggctttaacattctctacatggtggtctagataagctaatttttttttttttttttttgtaaaatgtaatagctagaaaatgttatcttggcgcttgtttttgtaaatcatttagtataggctgttagctttactggtactttacgctttgattccaagaagccttgtgcagttgccttatcaaatggccagctaaattaaagatgctcttttgtgttgtgaatttcatagttctgtacagagcttgtttcaatttacaaaaataagtacattccacagaatgcctaaagtgtgtaattttctttaaataatagtaggtgagggagaaacataatggctctaggtcaatcccttatctaaagaccttgttcaacttcatagtccctttccttttaaagaggagaagagaaaaatcccccctggccaggcatggtggctcacatctgtaatcccagcactttgggaggctgaggtgggtggatcacctaaggtcaggagtttgagaccagcctggccaacatggtgaaaccctatctctactgcaaaatacaaaaattagccgggcttggtggcgggtgcctgtaatcccagctactcgggaggttgaggcaggagaatcacttgaacccaggaggcagaggttgcagtgggccaagattacggcattacattccatccagcctgggcgacaagagcaaaattccgtctcgaaaaatcaccaggtacatacctctcaagtttgataagtccatcttttgagttttcttttagctctttcaaaagattacgagggcaatacatattttttttttttttattctccagccccatatcatacttgggtatgcctgttggtaccataagcctaaactctccttcactgcaatgcctttgagtcagtagcaatagtaaagactagaaacaaagaaaattcagaatttggtatgtgatatgattgttcatacaatatgttataatagcaatattccaaacaatatgtccttcactgtctattgttggaaaactcatgcatcccagcatgaagtaactcctagttttaattttagttattttgagatatatttgagaattgcatctcttctcttgaatttcacttagaagagattaaccagccaaatatccaggaaagtttcaaaacattctagtgtttttcatcctttgctaggatgcactctgtacaaaacattcctctgaaaatctaatatttgcagtatctaagaattgatcatttctattttcattaaattctgtggaaaaaattaaatgaatgaaattcaacttcataattcagttcatcagcttttgtatcttgagaatctaaacacgtctttaaatctgaaagaaaccaagctggattttgcagtgcatatgtttgctagcttcccacatcctgaaccatgtcaaaatttggttttatttagttacatataatttaatgcaaagaaattctgttacttaatgttctgtttatttatgagtgcctatcaggaacactaataggaatgccattcaaccagtgtcttctgcccctctcccagctgttaaattagtacttcttcattggctttctgaaatgtcctgagtaaagtagaaaagcaacctttgtatggatgtggggatatttaatagtatgtatcttgtttcatttttttcctatgatgtattaatatttatttttctccaacccctgctccattttcttaaaatattttccagttaataactagttgctttatttcctagctgaagtgagaaaaccaacggaaaacaatacagatttgggcagaggagatagagttacatctttaaaggagtgagccagtcacccaggagaatcacatgtgtaactgatgtaggggtttaagtcttcatactttcactaaaatctgtctactaactctcccaccaacctttgcatcaaacacttaggtacctgcctgattaggggggcccctttaagggaaaaaacttttaaaaaattaaatgccttggttttgttttatcttctgggaaagaacacttttacttgattagcaagatgattatattatataacttgcccttaaaaacactccaaaatactgactccttttctccaattacaaatgagtgtgaagaaattctgttgtatgatttgaacactattaggtttgtatgtgtgtttaattggaagaattttatatagagtatctctgctgcttttgtttacctgggtaccacacaaccaaatacacattgagatttcaagaaatgatgatgaaagccagaaggccagaccacagctctgcagcctgtttcctacaaccagatataaaactctttctcgtcgccatgctgatagtcacactgaactagaactgtcccaacacattcttcctctctcataatggcttccatttaatacaggcaaagccctttaccttagcaaattctttatctttcaaaagtgaccaaaatgaggacttcaaccttggctgcacctcaataggagatgctgatcttgagttgtaatgagaaaagtgggcatataggagattttagtgactgcagtcagctgtctggcattcctttctcagtttgcatctaaaagactacatatgtcaagcttatctccacctgaatttgctgcctgctataaaaacatttcattaatatatcccattcttcctacctccatctctggtttgtcattagtggtattctgaaaagcttaagaaaaaagaatcattgagtagaaagtgaacattttaagttattttcctttttcattggcaattagttaacatgtaaaatcttttccattaaactgtataacttttaataactatatattatatatgggataaaatatatggactgaattgtgagaatataaatgcatcgaaagactctggtgtcatgaaagcacaagaataaggctggagatggtcccagatccaagatgtcccaaaagccttttgtatcagtttctctatttttggtattttgcataatgcatggatccttagttcaaatgagggacaaagtttctcagtcagccccacttcctttctttctaactcctacctttcccttgcagaggaggtagtagagattctggaattgtctatttttatgaattccattattttgtccatggcatctctaatgaaaacaggttctagaataaaggagttgattagtctgaacagtactaattaactacaaaataaacgttagtgatcagcctcttcctctataaacaatgaccaattagacgtttccgtaattccatgtattatgtatagtacactctataaatgtaaatgtaatgcttgtctaaaaagtgcaatttattgtacattgtcccaacaaatgtttacttttataatcgttatgaacttgaattggattagtatcttgtttttatgtgtgaatgaagccttgtgaaataaacaaatgcaactgagaaggtaacaaggtgactgtttttgtgagccagtgatgttttcaatgctttgtgttgcccctttggccccattaagcagtaataaacatttgttctg

SEQ ID NO: 2255 - DNA, 4967 bp, Homo sapiens
gcggtgtgtggcaggcggcagcggcgctggcggccgagtgcgcttgtcacgcgtggcggtgcgtggttgctaggggcgcctgaggctgccgggtagcccagcaggccgagggaggaagtagcgtggagccggtgccgagccggggcgaagctggatcccctagatagactgtcttcaagctcactgatattttcctctgcttgatccattgtgctgttgagagcctctagtaaatttttcagactgacagacttcaaggatgcagctgctactaccggaggtgtgtggcaccttacctcagcaaggccatgagaccgtgtggccatgatgtgggcccctcatggcctcagcaggaacacagcactatagtattggcctccgccagaaaaacagcttcaagcagagtggtccctcaggcacagtacctgccacgccacctgagaaaccctcggagggcagagtctggcctcaggcccatcagcaagtgaagccaatctggaagctggaaaagaagcaagtggagacactgtcagcagggttgggcccaggcctcttgggcgtcccaccccagccagcatatttcttttgccccagcactttatgtagctctgggaccacggctgtcattgcaggccacagcagttcctgttacctacactctctcccggacttgttcaacagcaccctgctataccgccgctccagctataggcaaaaaccgtaccagcaactggagtctttctgcttgcgttcgagcccgtcagaaaaaagccctttttctctccctcaaaagagcctccctgtcagtctcactgccaacaaggccacttcttccatggtcttctccatggcccagcccatggcctcctcatccacagaaccatacctctgcttggcagcggctggggaaaacccttcagggaagagcctggcctctgccatctcagggaagatcccatctccactctcttcctcctataagcccatgctgaataataattccttcatgtggccaaatagcacgccagtgcctttattgcagaccacacagggcctgaagccagtatcgccacccaagatccagcctgtctcctggcatcattcagggggtactggagactgtgcaccgcagcctgttgaccataaggtgcccaaaagcattggcactgtcccagctgatgccagtgcccatatcgccttgtctaccgctagctcccacgacacatccaccaccagtgttgcctcttcctggtataaccggaataacttagccatgagggcagagccactttcctgtgctctggatgacagctctgattcccaggatccaactaaggagattcggttcactgaggccgtgaggaaattgaccgcaagaggctttgagaagatgccgaggcaaggctgccagcttgaacagtctagtttcctgaaccccagcttccagtggaatgtcctcaacaggagcaggcggtggaaacctcctgcggtaaatcagcagtttcctcaggaggatgctggatcggtcaggcgggtcctccctggtgcctcagataccttggggttggacaatacagtcttctgtaccaagcgtatcagcattcacctccttgcctcacatgccagtgggctcaatcacaaccctgcctgtgaatctgtaattgactcctcagcatttggagaaggcaaagctccaggtcccccttttcctcaaactcttggcatagccaacgtggccacccgcctctcttccatccagctgggccagtctgagaaggagagacctgaggaggccagggagctggactcatctgatagggatattagttcagctactgacctccagccagatcaggctgagactgaagatacagaagaagaactagtagatggtttggaagactgttgtagccgtgatgagaatgaagaggaggagggagactcagagtgctcctcattaagtgctgtctcccccagcgaatcggtggccatgatctctagaagctgtatggaaattctgaccaaacccctttccaatcatgagaaagttgtccgaccagccctcatctacagtctctttcccaacgttccccctaccatctattttggcactcgggatgagagagtggagaaacttccctgggaacagaggaagttgctccgatggaagatgagcacagtgacccccaacattgtcaagcagaccattggacggtcccacttcaaaatcagcaaaagaaacgatgactggctgggctgctggggtcaccacatgaagtctcctagtttccgatccattcgagagcatcagaagctaaaccatttcccaggctcattccagattgggaggaaggaccggctatggcggaacctgtcacgtatgcagagccgctttggcaagaaggagttcagtttcttcccccagtcctttatcctgccccaggacgccaagctcctgcgcaaagcgtgggagagcagcagccgccaaaagtggattgtgaagccaccagcatcagctcgaggcattggcatccaggttattcacaagtggagtcagctccccaagcgaaggcccctcctggtacagaggtatctacacaaaccctacctcatcagcggcagcaagtttgacctgcggatctatgtttatgtcacttcctacgatcctctgcggatttacctcttttcagatggactggtccgctttgccagttgcaagtattcgccttccatgaagagccttggcaataagttcatgcacctgaccaactacagtgtcaataaaaagaatgccgagtaccaggccaatgcagatgaaatggcttgccagggccacaaatgggcactgaaggctttgtggaactacctgagccagaagggagtcaatagcgacgccatctgggagaagataaaggatgttgttgtcaaaactatcatctcgtcagagccctatgtgaccagcctgctcaagatgtatgtgcgacggccctatagctgccatgaactctttggttttgacatcatgctagacgaaaacctcaagccctgggtcctggaagtcaacatttccccaagcctccactccagctctccactggatatcagcatcaaaggccagatgattcgtgaccttctgaatctggcaggttttgtcctgcccaatgcagaggatatcatttccagccccagcagctgcagcagctccaccaccagcctgcccacctcccctggggacaaatgtcgaatggctccagagcatgtcactgcacagaagatgaagaaagcctattatctgacccagaaaattcctgatcaggacttctatgcatctgtgctggatgtcctgacaccagatgatgttcggattctggttgagatggaagatgagttttctcgccgtggtcagtttgaacgaatttttccttctcatatctcctctcgctatctccgcttttttgagcagccacgatatttcaacattctcaccacccaatgggaacagaaataccatggcaacaagcttaaaggagtagatctgctccggagttggtgctacaaagggttccacatgggagttgtctctgattctgctccagtgtggtctctcccgacatcacttctgactatctcaaaggatgacgtgatactcaatgccttcagcaaatcagagactagcaagctgggaaaacaaagctcctgtgaggttagcctactactctctgaagacgggaccacgcccaaatccaagaagactcaagctggcctttccccttatccccagaaacccagttcctcaaaggacagtgaggacaccagcaaagagcccagcctttctacccagacgttacctgtgatcaagtgctctgggcagacttcaagactttctgcttcctccactttccagtcaatcagtgactccctcctggctgtgagcccataactggcctctctccaaaagcctctgcccaggagcatgggcatcagctacctcacgggaaccagcctgctgttcagaccagtctgaccccctacccctttcaccctgtccctcctcagagtattttttgaagtggttgcattatagagatgggtatttgtagggccggagggatggtagtgatggggagaaggtgaggaagggtcaccctctgtcacctgtctgcctggctggcacctcatatctcagcagagaagccagtggtggccacgcagccttataaagcaggttttggtttctaccttaagtgagccatgtgtggtttgtctgggggccctggtgtggttgctgagttgtagctcaagaggagaaaacatacagaacatatttggaccggaaatcctttgttctgaatttgagggggtcttctgaggtccttacttccttaggtctttcctcacccctctcccaccgctgtcctgaggagaaacccttgaacttcctcagtagacaggcggagaggccacaacatgccgaacccatttcctgtcatcctagtcttgggtcttcaccgcctccttccaaatacccaccctgccagcagccctaggtcttcctgttctgaccccccatcactgctcgttcagccttctagatgtctctctcgtggacatctgttctttagctgttggctttctctgaggtgtgagagggtctatgaactttgtgaatttcccatggccccagtgaaggagcccagataatcccagtagctgttacctgtctccatgtatcaaaggacacagtccagggggagggtggaaggagatgtggtttctctatagtgcaacaaacatggtttctcaatgttctgctgtgcagcaagcagggtctggcggcttggtaggtgggtttcaggagcagtcactattgtaggatgggcttccaatcaaacctcagactaaactcttgtactgaactgattctacctccctcctctagactcagtaaacagtgactattcaataaa

SEQ ID NO: 2256 - DNA, 8073 bp, Homo sapiens
agaattcaagagcagttagaaagttcttttacaggtttgacagatgaaaaagtgaaggcatatctttctcttcacccccaggtattagatgaatttgtatctgaaagtgttagtgcagagacagtagagaaatggctgaagaggaagaacaacaaatcagaagatgaatcagctcctaaggaagtcagcaggtaccaagatacgaatatgcagggagttgtatatgaactaaacagctatatagaacaacggttggacacaggaggagacaaccagctactcctctatgaactgagcagcatcattaaaatagccacaaaagccgatggatttgcactgtatttccttggagagtgcaataatagcctgtgtatattcacgccacctgggataaaggaaggaaaaccccgcctcatccctgctgggcccatcactcagggcaccaccgtctctgcttatgtggccaagtccaggaaaacactgctagtagaagacatccttggagatgaacgatttccaagaggtactggactggaatcagggactcgtatccagtctgttctttgcttaccaattgtcactgcaattggtgacttgattggtattctcgagctgtatcggcactggggcaaagaagccttctgtcttagtcaccaggaggttgcaacagcaaatcttgcctgggcttcagtagcaatacatcaggtgcaggtatgcagaggccttgccaaacagacagaattgaatgacttcctactcgacgtatcaaaaacatattttgataacatagttgcaatagattctctacttgaacacataatgatatatgcaaaaaacctggtgaatgccgatcgttgtgcgcttttccaggtggaccataagaacaaggagttatattcagacctttttgatattggagaggaaaaggaaggaaaacctgtcttcaagaagaccaaagagataagattttcaattgagaaaggaattgctggccaagtagcaagaacaggggaagtcctgaacattccagatgcctatgcagacccacgctttaacagagaagtagacttgtacacaggctacaccacgcggaacatcctgtgcatgcccatcgtcagccgaggcagcgtgataggtgtggtgcagatggtcaacaaaatcagtggcagtgccttctctaaaacagatgaaaacaacttcaaaatgtttgccgtcttttgtgctttagccttacactgtgctaatatgtatcatagaattcgccactcagagtgcatttaccgggtaacgatggaaaagctgtcctaccatagcatttgtacttcagaagagtggcaaggtctcatgcaattcacccttcccgtgcgtctctgcaaagaaattgaattattccactttgacattggtccttttgaaaacatgtggcctggaatttttgtctacatggttcatcggtcctgtgggacatcctgctttgagcttgaaaagttgtgtcgttttattatgtctgtgaagaagaactatcggcgggttccttatcacaactggaagcatgcggtcactgtagcacactgcatgtatgccatacttcagaacaatcacacgcttttcacagaccttgagcgcaaaggactgctgattgcgtgtctgtgtcatgacctggaccacaggggcttcagtaacagctacctgcagaagttcgaccaccctctggccgctctctactccacttccaccatggagcagcaccacttctcccagactgtgtccatcctccagttggaagggcacaatatcttctccactctgagctccagtgaatatgagcaggtgcttgagatcatccgcaaagccatcattgccacagaccttgctttatactttggaaacaggaagcagttggaagagatgtaccagaccggatcactaaaccttaataatcaatcacatagagaccgtgtaattggtttgatgatgactgcctgtgacctttgttctgtgacaaaactgtggcccgttacaaaattgacggcaaatgatatatatgcagaattctgggctgagggtgatgaaatgaagaaattgggaatacagcctattcctatgatggacagagacaagaaggatgaagtcccccaaggccagcttgggttctacaatgccgtggccattccctgctatacaacccttacccagatcctccctcccacggagcctcttctgaaagcatgcagggataatctcagtcagtgggagaaggtgattcgaggggaggagactgcaacctggatttcatccccatccgtggctcagaaggcagctgcatctgaagattgagcactggtcaccctgacacgctgtcccacctacagatcctcatcttgcttctttgacattcttttcctttttttggggggggtggggggaacctgcacctggtaactggggtgcaaacctcttcaagaaggtaacatcaaataaataagtcaagcagaggacttcctgccaatctcttctgtgaggcatcatagacactgagcaaccaggaccacccccacgttcagaaatcagctggccaagtgactccatttgacttgcaaaccagccttttctaataggctaatattgctgaggccttaaaggaaatggacaaaaattatccagaaggggtacttttccattgtatctttctaataagggtttaaaatggtactattatggtattgtacttgggctttaacatcaatgttgctttgatgttgttggatataaataggaatttttacacattactattgtgaatggtgaatgttcatgtatgacctacttgtaattaacttgagttgtagtccacagcctcaggacaaatgtcgttgaggttacagagtaagaaatgatggcaaaacgtcaaactcttatttcagagcttcatgaatttagttagactaaacataattctttaagttcaacctaaagggctgagatcaataaatttaacactagacgaagtagacttcctgtctttttgagaagagatgaggtatatgttacaataaatctcagaacttcaagtagcagttcaaaagatgtcagtttttaaaattgtttttgttgttgtcttggcagttttactgaaccctttgcataaagaacaaaataaaagctcggcattgtaatttttttaatggacaagtcttatggatacgaagggtacatttttcataatgattcctttatattttcactttgtgtcattgcagaattttagactctcattcacaatgaaaagtttattttaaacattgtttaattaaaataccatacagttctcttttaaacatcaaaccataaaaagtgtattttgtaattttactctgacctgccgcagtcacctctcacttatctcttccacgtactgcacggtcgtatttcatgagctttctgtccatagcacagaaacagagcagaaagtagtacaatcatgttggaccttctttctgttctctttactcttctcacagatcagatcactccatagaagcctgtgggtttcgatggtttcttctatacacctttttggttgaccagtattactatacaatgtaagtgttttaaaaaatacgaaagtaatactctgcaccccttcctacaaagatgataaagcagtcacttctggcgcattttaataatttaaagatttttagtgcaatggcacggtaacctccaaacctgaattagacagagactcactcaggaagtgacaggcccatcatatcaaataacttattcacttttcatgtggcaggaaactggaatatcgcttttaataaaatggaaaaatatgcttctacatatttaccaccataggcgttttgttcatatgagcctggtttgtgcaaaattaaatcagaggcttctacaacatggtttatttatgttgtagcaaagttggctctacataaacattgttcttattttaaaattaacactatgtgttcagttttcttgtgggcttctgaaagttgccatcttccctccgtggagctccatttgctattttcattatacactatgaggtaaaatgtaataacaaaagagagagaagtaccactgtggctagatatatacacacacatatatatatggatggatgtaatatatgtagaacacacacatagatgtatataggatacacactcatgtatgtaaacgtatacatatgtgtatatatgatacatacacatacacacacacgagagacagaaggaaagagaggaagagagaagcaaacatgtaggaaaaaatataaatcagccccattctcccattctttaagaacaatgatttttcttgatggaaaatgcatatcacttgacagttgacaagaaagtgtcatttttgtgttagtgtatcatataattgaatttgaacaagatacatatttttctgcatacaaatttatgaagctggagtctaccaaacacagctttagtcacaaaagttagtttagttatctcatttcgcttggagatggaatttcaggaagggatatattatttaagattattgtttaattacaagaattttaaaagaatgtatgaattctgttttttaatatagaaaataattatggagttaggaatctcatggctacatttacatttttaggttattacagaaaattctcttaatttattatagtcaagtgtattatgtaatctctatttagaacagtttcccaaaggaatgtgattggatttactggttggttaatttcttgtgaaatattgtcataatagaagcacagcttgaacaaaagactgaattctgatataaactgtcaatattgcttttaccatgtgtaagatttacttagtaatcacagatttacctaaaataaaaggacccgggttgcagtgatatttagttaatgatttgttttggaaaacatgcagttaggagtatttttgtattttgtcagatgtttaggagacagactttcgggtcatgtttcttgtcttgttcccagatcttttcttaaaagaacagtgtgacaccagaagccaagagatggtttttactaacaacagctttgatgagttcctattaaggtcgtattgtgtattgtgccaaattttccacccagtataaatttagtaacccgctatgagcatatgtaggatattcaatttgcagatacttttgttggttatgttggtttataatagacaagttttatggtcatatgcaattattccattatctttttggacacagtgaatatgttttttagctaaaaatgtccttggaaacataaatgcctgccaataacatggaatattgaattcgggcaatgtgaattgattaattagaaaagggtcaaaagaaatacaatggatgtggaaactaattctaaaaaatagccctattaatagggcagagactctggtccatttcccagctgtacttctctctaagaggtgtatgaaaaacccatcttgcaaaagagaccaaaatattagacacaatcgttcccattcctgactcttcaatggaaaaggaaggtacagatgtttacagtggtgccccaggtgactcgttctcaccacaacaaaagcaactaattggaaactagatgtgttcaataatagatttcctcttttttggcatgctttttagattttttttcattttgtaaaatctcagttaatttttctttattggtatatttgtgtatgcgagacaaatcctgtattgtacaggatataaatagatgcataaatccttagatacctgggttttttaataggtttaggtttgggtattgtgtttctggtcttttaactcaaaattaaggtttgagctttaataggactaaattattcacctgccttggcctgtgcctttattttaaatactgcaattttacttcttcattcatgtatttattattttgcttttcttgcttaagtataattgaaaatatttgcaggaacgcacaattcattttatcaagttgaatgaataggaccattctctcctcatcagatttctgttctttatttgacttcattgacatataccctggtgactataaccagtgaactgttcagagtcagtcttttcggcaagaacttcagagaactgtgacactggttatgatgtgattttggggggtttcaggtacctaagcatgatttttaaaatcacttctctctttacatatttcgaacatatgtttgctttctacactttgcagattttatttaggatttaattctttaaagactatattcatttagtcactatagtggatctcttctactgcaagtattcatctgatttttaaattatgtaaaatgtaaatcagccaagtatgtcatccgttatagtttccccatgctttcagcgcatggccatgagatttttacatgtgcataagtatttagccaatacacattttgctgacttctttaaccatttatattgtttaaattagtaatatccaatgcagtgcacacttttttgtcttttttccaacggaatattttggttgtctgtagcgttggaagcattttatatgataaaaatagcaagaaaaaattaaaaagtgtcaacggtgtgctggttctaaattaagaagatagaacaaagagaaagacattaatgttacctaagaaacacatttaacatccgaagaagcaatgctgtcctcacttgatgtttctcttctcaacccagcaatggagagcagggcttgcaaagccgtacagagcctacgtgctctttcctgcaagtgggagaaaactaatcaatggcacacagggccaggtgtggccctgtgaggcaaaggataatgtcacctcaggaccaaggtggaaacttacagctgaatccagggcttactaagtagggaagtcagtttacatatttcagttttcctctgatgtttttgaggtactgtgtatttgcagaagtttaagcagaagggttttgtttctattgtaagttaggttctaaaagtgtataatctgatactctagcccaactgaaatattatatcttgggcgttacagcctttgtctttttctttagtcaccttaatacccagtcctatgctgtatctctgatagcctatataaatgacatataggaatattattttccatatgatctgttgtatggtgtatatgctatgtgttcatttcgtgtgcaagttcagagtgtaatagatttacccagagaaggtgtttctatacaatgcccctacctatttgaaattacatgcttgcccaacacactgtgaaatagttaccaaaatttgtacaaatgcagcatcttcattctttctgagaagacaagatggttttctttacatgaacaaatgaacaaaagagatcctagatccataacgtagctaaggcatctaagagtttgctgttgataatcttgctgaccaaaaactactggagagtaacacaggttatatgccatcacaaatacaatgctcatgaagaactgatttgtagagtcaatgaacctgtgtccagaattttaataggctctctattggaaggagaaagaatttcaagttaacagtatctaactttatcatagttgatgttagtaaattttaaaaaatgattttatatgtatgacaaaaatctttgtaaaatgcgcaagtgcaataatttaaagaggtcttaactttgcatttataaattataaatattgtacatgtgtgtaattttttcatgtattcatttgcagtctttgtatttaaaaaacatttactgttatgtttgtataatagaacagtaatcatttattataatctaggcaagttgtaaataaattcataattcaaacagccagtatatatgcatatatgagtgttatattgcaaaatctttgttttacttacatggttaaagcagcaagaattcttttgttgatatgtaattatacacataaaatatatatatgtatgatacatgaaatatatttagaaatgttcataattttaatggatatcctttggtgtgaataattgaatacagagtttttaaaata

SEQ ID NO: 2257 - DNA, 1767 bp, Homo sapiens
tccatcatgtggccactgacagcccttctgctcctggttccaagcagtgggcaagctgctactctggagaagcccatattgtctctacatccaccttggaccaccatcttcaaaggggagcgggtaactttgaagtgtgatggataccacccactgctcctggagctccagcccatcagcactctctggtatttgggccacctacttctgccctctcacaagaagagcattgaggtgcagacaccaggggtgtatcgatgccagacacggggagcacccgtcagtgaccccatccacctctctgtatccaatgattggctgattctgcaagtgccctatgcgccagtgttcgagggtgagccgctagtcctgcgctgccgcggctggtacgacaaggtggtctacaagcttcactactaccacgacggccaggccgtgcgctacttccactccagcgccaactacactgtgttacaggcgcgtgccagcgacagcgggcgctaccagtgctcgggcaccatgcgcatcccggtggagagcgcgcccatgttctccgctaaggtggctgtgacagtgcaagagctgttccgggcgccggtgctgagggtgatgggtccgcgggaggcccgcggcgcggcgctgggtggggtggtgctgcgctgcgacacgcgcctgcacccgcagaagcgcgacacgccgctgcagttcgcgttttacaagtacagccgcgcggtgcgccgcttcgactggggcgccgagtacacagtcccggagcccgaggtcgaggagctcgaatcgtactggtgcgaggcggctaccgccacccgcagtgtccggaaacgcagtccgtggctgcagctcccggggccgggttctcccctggacccggcctccaccaccgccccagctccatgggccgcagccttggctcctggtaataggccgctttccttcagaaagcccccggtgtccagatcggtcccgttggtcacctccgtccggaacaccacctccaccgggctgcagttcccggcgagcggcgccccgactgcggggccacccgcctgcgctccgccgacgcccttggaacaatcggctggagccctgaaacccgacgtggaccttctgctccgagaaatgcagctgctcaaaggccttctgagccgggtggtcctggaattaaaggagccacaggccctccgggagctcaggggaacgcccgagacccccacctctcactttgctgtgagcccgggaaccccagagaccactcctgtggagagctgagggggcggctaccgtcccctctgcaggctcattcctccttggtctcctgcttcccctcacgcgaatttctttcaaagccatctgtttgcatccttgtgttttgctgtggtttttaaaggagcgcccacgaagtgtagtggctgacgatttcaacctcacacagcagtttgtaaccgcaagcattctctttgaattctcacagaattcagcaagaagtagaaacctgttatttactacattgtgatttaactttggatgtgaatttagtcacccttagcccttcagataagcctagccagtacatatttcagcacaggcagtttttttggtatttaagtacattgaggtaactgagcacttgagaatattttagggtcaaagtgtaattattcataatgaatttactctgttgatattaaaaagacgttcagtcctattactgatgagtttacatcttcaaataaatcctgggttctattt

SEQ ID NO: 2258 - DNA, 2005 bp, Homo sapiens
acagttccatccattctagggatcagtgtctttcaatgatgtgactgtggacttcactcaggaggagtggcagcacctggatcatgctcagaagactctatatatggatgtgatgttggaaaactattgccacctcatctctgtggggtgtcacatgaccaaacctgatgtgatcctcaagttggaacgaggagaagagccatggacatcatttgcaggtcatacctgcttggaagaaaactggaaagctgaagactttttagtgaaattcaaggaacaccaagagaagtattctagatcagttgtaagcatcaaccacaaaaaactggtgaaggagaagagtaaaatatatgaaaagacatttactctaggcaaaaaccctgtgaattcaaaaaatctacctcctgaatatgatactcatggaaggattttgaaaaatgtttcagaattaatcatcagtaatctaaatcctgcaagaaagagacttagtgagtataatggatatgggaaatcactcctgagtactaaacaagagactactcatcctgaagtcaaatcccataatcaaagtgccagagctttcagtcataatgaagttcttatgcagtatcagaaaacggaaactccagcacagtcatttggatataatgactgtgagaaatcattccttcaaaggggaggcctgattacacatagtagaccttacaaaggagaaaacccatctgtatataataaaaaaagaagagcaaccaatattgaaaaaaaacatacatgcaatgaatgtgggaaatctttctgcaggaaatcagtattgattctgcatcagggaattcactcagaagaaaaaccctatcaatgtcatcaatgtggaaatgcatttagaaggaaatcatatctcattgatcatcagagaactcacacaggagagaaaccctttgtttgcaatgaatgtggtaagtccttccgcctcaagacagccctcactgatcatcagagaacacacacaggggagaaatcgtatgaatgtctgcaatgtaggaatgccttcagattgaagtcacacctcattcgtcatcagagaactcacacgggagagaaaccatatgagtgtaatgactgtgggaagtccttccgccagaagacaacactctctctacatcagagaatccatacaggtgagaaaccctacatttgtaaagaatgtgggaagtcctttcaccagaaggcaaatcttactgtacatcagagaactcatacaggggaaaagccctatatttgtaatgaatgtgggaaatccttctcccagaagacaacccttgctcttcatgagaaaactcataatgaggagaaaccctatatttgtagtgaatgtggaaagtccttccgccagaagacaacccttgtagcacatcagagaacacatacaggggagaaatcttatgaatgtcctcactgtgggaaggcctttagaatgaagtcatacctcattgatcatcaccgaactcacacaggagagaaaccatatgaatgtaatgaatgtggtaaatcattcagtcaaaagacaaatctcaatctacatcagagaattcatacaggggagaaaccctatgtttgtaatgaatgtgggaagtcctttcgccagaaagcaaccctcactgtacatcagaaaatacataccggccagaaatcctatgaatgtcctcagtgtgggaaagcctttagcaggaagtcatatctcattcatcatcaaagaactcatacgggagagaaaccatataaatgtagtgaatgtggaaagtgcttccgccagaagacaaatcttattgtacatcagagaactcacacaggtggagaggatggcctaactggatgtttatcctagcgtcaacccaccaaagatttggggaacatgtgagtcacattctctgggacattctactcccctttgattttgcatttccagacatttcagtggctaccacaaaaaataaaaagtatctgtggc

SEQ ID NO: 2259 - DNA, 725 bp, Homo sapiens
ggcgcggcaagatggaggtgacgggggtgtcggcacccacggtgaccgttttcatcagcagctccctcaacaccttccgctccgagaagcgatacagccgcagcctcaccatcgctgagttcaagtgtaaactggagttgctggtgggcagccctgcttcctgcatggaactggagctgtatggagttgacgacaagttctacagcaagctggatcaagaggatgcgctcctgggctcctaccctgtagatgacggctgccgcatccacgtcattgaccacagtggcgcccgccttggtgagtatgaggacgtgtcccgggtggagaagtacacgatctcacaagaagcctacgaccagaggcaagacacggtccgctctttcctgaagcgcagcaagctcggccggtacaacgaggaggagcgggctcagcaggaggccgaggccgcccagcgcctggccgaggagaaggcccaggccagctccatccccgtgggcagccgctgtgaggtgcgggcggcgggacaatcccctcgccggggcaccgtcatgtatgtaggtgcgtggctcgcgggcccggtcccgggctccagggctccaaggccgggaggaaatgttgggggcacagtggagcctcggagaccacgctctgcctaggggcgcggggttgggggggactcgaaacgatctcagtccctggaggtgacggaaccatctgccgacact

SEQ ID NO: 2260 - DNA, 588 bp, Homo sapiens
cagaatttggctgaggaggctggtctgaacatcactcacatttgcctccctccagatagcagtgaagccgagattatagatgaaatcttaaagatcaatgaagataccagagtacatggccttgcccttcagatctctgagaacttgtttagcaacaaagtcctcaatgccttgaaaccagaaaaagatgtggatggagtaacagacataaacctggggaagctggtgcgaggggatgcccatgaatgttttgtttcacctgttgccaaagctgtaattgaacttcttgaaaaatcagtaggtgtcaacctagatggaaagaagattttggtagtgggggcccatgggtctttggaagctgctctacaatgcctgttccagagaaaagggtccatgacaatgagcatccagtggaaaacacgccagcttcaaagcaagcttcacgaggctgacattgtggtcctaggctcacctaagccagaagagattccccttacttggatacaaccaggaactactgttctcaactgctcccatgacttcctgtcagaaagtttgattatcattagaagaatggccatcttttaa

SEQ ID NO: 2261 - DNA, 1943 bp, Homo sapiens
ctttggcctgccatctcccaagggcaaacctcacaactcaggcccaagtcacaggaatctgaatggtggggtgaccttctcctctagtttaatttcattgcaatactgagaaacttcaactgttttgtctttagaagggaaattcatgtttgtgccaggccagcctttgtaaaagcctttgattggattcactagaagtctgtcttcccgcagtacatatactgtgaattttctccttcggcatttcaaccacttggaatggccactaaagtggcttttgatctaaagtaaactctgattctgtgttgatggggaaccatttctctctaacatggtggtttctttaagatgtttgacttgggccacatgagaataacagatctttgggcagtccaagcaagagcctcctgatctagcagccaagactccccctgacctttggccatgtaccccaaccctctcatctactgcacctgctgggacccctggaacttgggaccacggaagctaatcaagacccctcaactaccacgcaagaactccacagggagttccaagctaactcctcttgtaccagctccaaaaaatcacaattacctccaaccaacaaaacctgttgtttccccaaaaatgaaaatccattcagcaaggcaagaagagactaataaatcattttatgaagtgatcaacgtgtcacctggctatcaacttgttcggaatcgggaacagatttctgtcaccttaggggatgagatgtttgataggaaaaagcggtgggaatcggagatcccggacaaaggcagattttccaggaccaacatcatttctgacctagaagagcaaatctcagagctgacagcaataattgaacaaatgaacagagaccaccagtctgcccagaaattgctctccagtgaaatggatctccgctgtgctgagatgaaacagaactttgaaaacaagaacagggagctcaaagaggcccatgaagcagaactcagtgagttggagaacaactacaaagcagccttgaaggcagagaagttggctgcccaagagaagctagaggagatgggaaaagaatacaagtatttgaagaatatgtttcgtacgtatcaggacagtatttatgatgaaatggaagagaagtggtcaaaacagaaggcgaaatggaagaaggatgagaagttcgagcgagaaaatatcctgctacagcaaaaaaaaaagatgaccaaaaaattcgaaatggagtcaggagaagaagataagaaaataaatgaatcctgcagtgctgtctttgagaacttcattcaagagaaggaggagctcttgaaacaacatcaaagtgacaccttgcaattagaagagctgagaaaaaccaaagaggtcatgcaggaagaattgcatgcacaagcccttatcctagagtcactgaacacaaacctctactatacccagttggaactccagaaagagaaagctatagtgggaaatctggagaaaatgcttcaaaccaagtttgctgaaactgaagaaaagtataagcacaccatacagatcctgacggaagagaacattcatctgaagcaaaagataatttctaagaatgaagaaatttgtgaaggatgttctgggagattggcctctattactgtttctaaggatgattctgacactgtgcaagatggtagcaagaaaggacaagaatcataaacaaaaagttgctctgcattgttgaagatggttggcacaccatttctgtaggcccaggaaactcctgggagggttttcttgagaaaatgcatataatgagtttagttcttgggttgctctgactctctgaatgtctgaaaatgtttgaattcgcatctgaatttcacagcttatcacggactcttcactgaaaaatgatgctctccatactgggagctgagctttctctg

SEQ ID NO: 2262 - DNA, 2540 bp, Homo sapiens
gcggccgccacgcgacgcctggctgggcccgcaccggagaggcgtctcggtacctggcaggcggcctgctactcggagcccgctgcggggcggcggcggcggggacatgcacgtgtgagatgcggcagcgggcggcgcggacgcgaacagcagcggcggcggcgggcgcggcctcctgggcgcggggcgcgcggtgcctgagggcgggcgcgcgggcgctgggcaactgccggccgcgccgcctgcgcaggcgctggttcaggactcacacgccgcgctgaggcccgcgggcccgtcatggaggcgcccaccgtggagacgccccccgacccctcgcccccttcggccccggcccctgccctggttccgttgcgcgccccggatgtggcgcggctgcgcgaggagcaggaaaaggtggtcactaactgccaagagagaatccagcattggaagaaggtagataatgactataatgcccttcgagaaagactcagcaccttgcctgataaattgtcttataatataatggtaccatttggcccttttgccttcatgccaggaaaacttgtccatactaatgaagtcactgttttactgggggacaactggtttgcaaagtgctcagcaaagcaggctgtaggtttagttgagcaccggaaagaacatgtaagaaaaacaatagatgacttaaaaaaagtgatgaaaaattttgaatccagagttgaattcacagaagatttgcagaaaatgagcgatgctgcaggtgatattgttgacatacgagaagaaattaaatgtgacttcgaatttaaagcaaaacaccgaattgctcataaaccgcattccaaaccaaaaacttcagatatttttgaagcagatattgcaaatgatgtgaaatccaaggatttgctagctgataaagaactgtgggctcgacttgaagaactagagagacaggaagaattgctgggtgaacttgatagtaagcctgatactgtgattgcaaatggagaagatacgacatcttctgaagaggaaaaggaagatcgtaacacaaatgtgaatgcgatgcatcaagtaacagactctcatactccttgtcataaggatgttgcaagttcagaaccattcagtggtcaagtgaatagtcagttgaactgttcagtgaatggttccagttcttaccacagtgatgatgatgatgatgatgatgatgacgacgacgacgacaacattgacgacgatgatggtgataacgaccatgaggctttaggggttggagataattctataccaacaatatatttttcacatactgttgagcctaagagggtccgaataaatactggaaagaataccactttaaaattcagtgaaaagaaagaagaagccaaacgtaaacgaaagaacagcactggcagtggccactctgcccaggagctgccgaccatcaggacgcctgcagacatttacagagcctttgttgatgttgtgaatggagaatatgtccctcgcaaatccatcctgaagtctcgaagtagagagaatagtgtgtgtagcgacactagtgaaagcagtgctgctgaatttgatgataggcggggagttttgaggagtatcagctgcgaagaagccacttgcagtgacaccagtgagagcattttggaagaggaaccacaagaaaatcaaaagaaacttttgcccttatcagtaacacctgaggctttttctggaactgttatagaaaaagaatttgtatcaccttccttaacaccacccccagccattgctcatcccgcactacccactattccagaacgaaaggaagttctgttggaagcatctgaagaaactggaaagagggtttcaaagtttaaagctgccagattgcaacagaaagactaggccctgtctaggaaatgggaatttacatcctaaaacctagttgttcatttgtttagagtatctatagcaaaataggttacatgtagtttgaaataaggtatcctgagttactttggcaacaagttcttttacccttacccgtggtatttgaaaaaaatcaaggtaactgtctgaatactttaatatcagcttgttttgtgaattctctgaatactgtcaacactcttatctaagtttgcctttatgatgcagtggcagcattttgaattacttttcaaagaatactgttcatatgcattgtttttgtgtttcaaactaaatacaggcagttttgtgccagctgtgatattgtgcataccatatggaccattttaaagaaaattttaaaatttcaaatagattcaacaattacattacttgctttcacattttaaaggcactttaaaaaaatctacttctcttgtaggttttgcggctagttggctattcaagaaacctcgcccctctgaatgtcatactgtaatctttaaggaagaaagctacatgaattaattgtactctatgggaaaatttctttggaaagatattttgtaaaacttttttttccaagtaaaaactttatgaaacttggtctc

SEQ ID NO: 2263 - DNA, 1180 bp, Homo sapiens
gtataaaagaccgagctgggggggcggcggcaggtctctgcgcagcccagcccgccggtccacgccgcgcaccgctccgagggccagcgccacccgctccgcagccggcaccatgcgcgagatcgtgcacatccaggcgggccagtgcggcaaccagatcggcgccaagttttgggaggtcatcagcgatgagcatgggatcgaccccacaggcagttaccatggagacagtgacttgcagctgctgacccactctctggggggcggcacggggtccgggatgggcaccctgctcatcagcaagatccgggaagagtacccagaccgcatcatgaacaccttcagcgtcatgccctcacccaaggtgtcagacacggtggtggagccctacaacgccaccctctctgtccaccagctggtggaaaacacagatgaaacctactccattgataacgaggccctgtatgacatctgcttccgcaccctgaagctgaccacccccacctacggggacctcaaccacctggtgtcggccaccatgagcggggtcaccacctgcctgcgcttcccgggccagctgaacgcagacctgcgcaagctggcggtgaacatggtgcccttccctcgcctgcacttcttcatgcccggcttcgcgcccctgaccagccggggcagccagcagtaccgggcgctcacggtgcccgagctcacccagcagatgttcgactccaagaacatgatggccgcctgcgacccgcgccacggccgctacctgacggtggctgccatcttccggggccgcatgtccatgaaggaggtggacgagcagatgctcaacgtgcagaacaagaacagcagctacttcgtggagtggatccccaacaacgtgaagacggccgtgtgcgacatcccgccccgcggcctgaagatgtcggccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgacgaacaaggggagttcgaggaggaggagggcgaggacgaggcttaa

SEQ ID NO: 2264 - DNA, 916 bp, Homo sapiens
gatcggccagggctgggggcgctgggggcgctacgggcgcggcgggtgcctgggagctgctgggagtccttgtttccgctcccgcccaggactgtgcgctcggctcgcggtggggtccggcgggcgcggcttcggcgggcggcagccgctgcagacgagctgcggagacggagtttcgtcatgttggccaggcccatttgagatctttgaagatatcctcaacgtgaggctctgctgccatgaaggtgaagattaagtgctggaacggcgtggccacttggctctgggtggccaacgatgagaactgtggcatctgcaggatggcatttaacggatgctgccctgactgcaaggtgcccggcgacgactgcccgctggtgtggggccagtgctcccactgcttccacatgcattgcatcctcaagtggctgcacgcacagcaggtgcagcagcactgccccatgtgccgccaggaatggaagttcaaggagtgaggcccgacctggctctcgctggaggggcatcctgagactccttcctcatgctggcgccgatggctgctggggacagcgcccctgagctgcaacaaggtggaaacaagggctggagctgcgtttgttttgccatcactatgttgacacttttatccaataagtgaaaactcattaaactactcaaatcttgctggaggcctctgggtgcctgtgttctcggcatatagatgtggtctcggtgtgttttgatatgaaaactctcatgaataaacatctccgtgaaacgccaaggccctcgtcaaaccctgagtcatgactgggaggagaaggagcaggatcagacggtagagcctggggcatgctcttcaggcatgctcttgcctgctggattgccggcggcggccctgggaccctccctcagg

SEQ ID NO: 2265 - DNA, 3528 bp, Homo sapiens
gatgtgatagctctatggaagtccaaactggagactgccatcgcatcccaccagcaggcgatggaagaactgaaggtatctttcagcaaagggcttggaacagagacggcagaatttgctgaactaaaaacacaaatagagaaaatgagactagattaccaacacgaaatagaaaatttgcagaatcaacaagactctgaacgggctgcccatgctaaagagatggaagccttgagggctaaactgatgaaagttattaaagaaaaggaaaacagtctggaagccatcaggtcgaaactggacaaagcagaagaccagcatctcgtagaaatggaagacacgttaaacaaattacaggaagctgaaataaagaaagaaaagtttgctgaagcttcagaggaggcagtctctgttcagagaagtatgcaagaaactgtaaataagttacaccaaaaggaggaacagtttaacatgctgtcttctgacttggagaagctgagagaaaacttagcagatatggaggcaaaatttagagagaaagatgagagagaagagcagctgataaaggcaaaggaaaaactggaaaatgacattgcagaaataatgaagatgtcaggagataactcttctcagctgacaaaaatgaacgatgaattacgtctgaaagaaagagatgtagaagaattacagctaaaacttacaaaggctaatgaaaatgcaagttttctgcaaaagtattgaggacatgactgtcaaagctgaacagagccagcaagaagcagctaaaaagcatgaggaagaaaagaaagaattggagaggaaattgtcggacctggaaaagaaaatggaaacaagccacaaccagtgtcaggagctgaaagccaggtatgagagagccacttctgagacaaaaaccaagcatgaagaaatcctacagaacctccagaagacgctgctggacacagaggacaagctgaagggcgcacgggaggagaacagtggcttgctgcaggagctggaggagctgagaaagcaagccgacaaagccaaagctgctcaaacagcggaagatgccatgcagataatggaacagatgaccaaagagaagactgagactctggcctccttggaggacaccaagcaaacaaatgcaaaactacagaatgaattggacacacttaaagaaaacaacttgaaaaatgtggaagagctgaacaaatcaaaagaactcctgactgtagagaatcaaaaaatggaagaatttaggaaagaaatagaaaccctaaagcaggcagcagctcagaagtcccagcagctttcagcgttgcaagaagagaacgttaaacttgctgaggagctggggagaagcagggacgaagtcacaagtcatcaaaagctggaagaagaaagatctgtgctcaataatcagttgttagaaatgaaaaaaagagaatccaagttcataaaagacgcagatgaagagaaagcttccttgcagaaatccatcagtataactagtgccttactcacagaaaaggatgccgagctggagaaactgagaaatgaggtcacagtgctcaggggagaaaacgcctctgccaagtccttgcattcagttgttcagactctagagtctgataaggtgaagctcgagctcaaggtaaagaacttggagcttcaactcaaagaaaacaagaggcagctcagcagctcctcaggtaatacagacactcaggcagacgaggatgaaagagcccaggagagtcaggtaatgattgatttcctaaattcagtaatagtggaccttcaaaggaagaatcaagacctcaagatgaaggtggagatgatgtcagaagcagccctgaatgggaacggggatgacctaaacaattatgacagtgatgatcaggagaaacagtccaagaagaaacctcgcctcttctgtgacatttgtgactgctttgatctccacgacacagaggattgtcctacccaggcacagatgtcagaggaccctccccattccacacaccatggcagtcggggtgaggaacgcccatactgtgaaatctgtgagatgtttggacactgggccaccaactgcaatgacgacgaaaccttctgatgaagcctccagtggagaactgggcttgctcagacgcactcgcattgacacaacgtaacaccagcattgtgtgtgcagacttcaggagaactcatgttattttttaaccccgtcaacaaatctaggaaaatattttgatcttcaacaaattgccctttagtctccccgtatgagttagaataataaatatttagtaggtgagttttcacctcgaattttgttttcttgatttttacgtttgaagacattgcaccagatgccattacatttattggccccccgaccttgtagaaaaacccctaccctcacaataccttatttaagtaactttaaattatgccgttacttttcatatttgcactaagatatttccaggctgcatttgtatatttagattttttggttaagctttgacactggaatgagttgaaaaaatgtgccattttgcattttcatctactcatttaaagtattttattcttattcaaagaaatatctgagctctttgcactacctgttatcagtagtgcctttacttcaggcttgataatacttaggtgtgattataaaatcatgaagcaggtaaagggaggggcaagcccccaaactgctgtggggacattttataatctatatgctgcacccacttaatctactgtggtgttttgtttattagttttgcataatttcagcttctatatattgtatgtatatattttttaaaaatctatattttgggaaaaaaacatacacaatgtgtctttctttttggacatttacctttttgaaaaagaaaacacttaaaatgatcattaggacataacagactaggccagacatagcatcttgtggctttgcaaccattttcatttgtttgttttccttttatttcttcaccagatttaaataactggaggaattttctccaatttttttttccttctctggcaggtatccccagcagtcaattaacaataagccagtataaaacacctaaataaccaatctacaatctcccttcacaagtttttttactgtttttagatgaatgtacgatgagaaattcaacgttaataattctggattttcttatcacaaaaaagaaaatgaaggacctcaaagcacctgaacagtttatcgaccagtttgaatctatttatcttcatttgaatgtcttctagaatatgtaaaaagtcataaaatgtatcttccatgctacatgtacaataagaacttctataattgtatatatgcctttgatgtattttcccctcaagattatcaactgtgtgttcgacagtgaatattcaatctggtaccagttgaaatttttggttataaatgtaatacgaattgtttcacaaacagaaaacatgtaaagcagtattaaaatttggccaaac

SEQ ID NO: 2266 - DNA, 2967 bp, Homo sapiens
gagcctggggaggtcgagggtgcagcgagccgtgatcgtgctactgcactccagcctgggcaacacagagagaccctgtctcaaaacaaacaaacaaacaaacaaacaaacaaacaaaaaaaacaaagaaaaaaaaatgggagtgggccgggcgcggtgactcacacctgtaatcccagcactttcggaggccaaggcgggtggatcacgaggtcaggaattcaagattagcctggacaacatggtgaaaccccatctctacgaaaaatacaaaaattagccaagtatggtggccggcgcctgtaatcccagctactcgggagactgaggcagagaactgcttgaacctgggaggcagaggttgcagtgatccgagatcgcgtcactgcactccagcgtgggcgacagagcgagactccgtttcagaaaagaaaaaaaaaaaaaaaaaaaagggagtcggggtggagctctcattggctcgttgcatgtgagtgtccctacggcctagaaatacaagagaagcacatcggaacgggctggaaatccacccagttaactagagggctttgaaccttttattaacttggaggttgactctcctgtcaactcgattcccttttggctgtttggcagggtcagtgagacatcccctgggtcgctcgaccccgtaggacggttcagggagccctccaggtcttcgtttctcctcttccccgcacagtgctgttatccagctgggggatccaacgcacacttaaggctccagcaaagtggctccgctgccggatgggagtgccccagtgtgctggatgaagctggcgcatgcaccatgtcatcatgtgtctctagccagcccagcagcaaccgggccgccccccaggatgagctggggggcaggggcagcagcagcagcgaaagccagaagccctgtgaggccctgcggggcctctcatccttgagcatccacctgggcatggagtccttcattgtggtcaccgagtgtgagccgggctgtgctgtggacctcggcttggcgcgggaccggcccctggaggccgatggccaagaggtcccccttgacacctccgggtcccaggcccggccccacctctccggtcgcaagctgtctctgcaagagcggtcccagggtgggctggcagccggtggcagcctggacatgaacggacgctgcatctgcccgtccctgccctactcacccgtcagctccccgcagtcctcgcctcggctgccccggcggccgacagtggagtctcaccacgtctccatcacgggtatgcaggactgtgtgcagctgaatcagtataccctgaaggatgaaattggaaagggctcctatggtgtcgtcaagttggcctacaatgaaaatgacaatacctactatgcaatgaaggtgctgtccaaaaagaagctgatccggcaggccggctttccacgtcgccctccaccccgaggcacccggccagctcctggaggctgcatccagcccaggggccccattgagcaggtgtaccaggaaattgccatcctcaagaagctggaccaccccaatgtggtgaagctggtggaggtcctggatgaccccaatgaggaccatctgtacatggtgttcgaactggtcaaccaagggcccgtgatggaagtgcccaccctcaaaccactctctgaagaccaggcccgtttctacttccaggatctgatcaaaggcatcgagtacttacactaccagaagatcatccaccgtgacatcaaaccttccaacctcctggtcggagaagatgggcacatcaagatcgctgactttggtgtgagcaatgaattcaagggcagtgacgcgctcctctccaacaccgtgggcacgcccgccttcatggcacccgagtcgctctctgagacccgcaagatcttctctgggaaggccttggatgtttgggccatgggtgtgacactatactgctttgtctttggccagtgcccattcatggacgagcggatcatgtgtttacacagtaagatcaagagtcaggccctggaatttccagaccagcccgacatagctgaggacttgaaggacctgatcacccgtatgctggacaagaaccccgagtcgaggatcgtggtgccggaaatcaagctgcacccctgggtcacgaggcatggggcggagccgttgccgtcggaggatgagaactgcacgctggtcgaagtgactgaagaggaggtcgagaactcagtcaaacacattcccagcttggcaaccgtgatcctggtgaagaccatgatacgtaaacgctcctttgggaacccattcgagggcagccggcgggaggaacgctcactgtcagcgcctggaaacttgctcaccaaaaaaccaaccagggaatgtgagtccctgtctgagctcaagacctagaaaataagtccccttcctgcctgttgcaaagtaacgtaagagttccctcacccgagtggatgcagaccttcttgctgtcagccacccttccttcatacacatagccagcccaggtgaccagaacctcccaggacagatgaggctttgtgtccttatgagactgggagaacctgctgggcacccctgctgcaggtgctgtggtgggtggggaccccactgcccttcccactgagcacatcatggctacctgacttggtgggagctccaggcagtcacttctgtttcttaaacatagctttactgaggtacaattcacataccatgtaattcacccacgggaagtgtatgattcagtggtttctaatacagacttctgcagccattaccaccgtcaactttacgacattttcatcagcccaagaagacaccctacactccttagctgtccccatccaactcccccaccccagtaaccactcagaataggtatggatttgcctattctggacgtttcgtataaatggcgtcatacacta

SEQ ID NO: 2267 - DNA, 4450 bp, Homo sapiens
gcaccatgtcatcatgtgtctctagccagcccagcagcaaccgggccgccccccaggatgagctggggggcaggggcagcagcagcagcgaaagccagaagccctgtgaggccctgcggggcctctcatccttgagcatccacctgggcatggagtccttcattgtggtcaccgagtgtgagccgggctgtgctgtggacctcggcttggcgcgggaccggcccctggaggccgatggccaagaggtcccccttgacacctccgggtcccaggcccggccccacctctccggtcgcaagctgtctctgcaagagcggtcccagggtgggctggcagccggtggcagcctggacatgaacggacgctgcatctgcccgtccctgccctactcacccgtcagctccccgcagtcctcgcctcggctgccccggcggccgacagtggagtctcaccacgtctccatcacgggtatgcaggactgtgtgcagctgaatcagtataccctgaaggatgaaattggaaagggctcctatggtgtcgtcaagttggcctacaatgaaaatgacaatacctactatgcaatgaaggtgctgtccaaaaagaagctgatccggcaggccggctttccacgtcgccctccaccccgaggcacccggccagctcctggaggctgcatccagcccaggggccccattgagcaggtgtaccaggaaattgccatcctcaagaagctggaccaccccaatgtggtgaagctggtggaggtcctggatgaccccaatgaggaccatctgtacatggtgttcgaactggtcaaccaagggcccgtgatggaagtgcccaccctcaaaccactctctgaagaccaggcccgtttctacttccaggatctgatcaaaggcatcgagtacttacactaccagaagatcatccaccgtgacatcaaaccttccaacctcctggtcggagaagatgggcacatcaagatcgctgactttggtgtgagcaatgaattcaagggcagtgacgcgctcctctccaacaccgtgggcacgcccgccttcatggcacccgagtcgctctctgagacccgcaagatcttctctgggaaggccttggatgtttgggccatgggtgtgacactatactgctttgtctttggccagtgcccattcatggacgagcggatcatgtgtttacacagtaagatcaagagtcaggccctggaatttccagaccagcccgacatagctgaggacttgaaggacctgatcacccgtatgctggacaagaaccccgagtcgaggatcgtggtgccggaaatcaagctgcacccctgggtcacgaggcatggggcggagccgttgccgtcggaggatgagaactgcacgctggtcgaagtgactgaagaggaggtcgagaactcagtcaaacacattcccagcttggcaaccgtgatcctggtgaagaccatgatacgtaaacgctcctttgggaacccattcgagggcagccggcgggaggaacgctcactgtcagcgcctggaaacttgctcaccaaaaaaccaaccagggaatgtgagtccctgtctgagctcaaggggacaaaaaaaaaaaaaggacttgactccatgacgtcgaccgtggccgctggctggctggacaggcgggtgtgaggagttgcagacccaaacccacgtgcattttgggacaattgctttttaaaacgtttttatgccaaaaatccttcattgtgattttcagaaccacgtcagatataccaagtgactgtgtgtggggtttgacaactgtggaaaggcgagcagaaaactccggcggtctgaggccatggaggtggttgctgcatttgagagggagtagggggctagatgtggctcctagtgcaaaccggaaaccatggcaccttccagagccgtggtctcaaggagtcagagcagggctggccctcagtagctgcagggagctttgatgcaacttatttgtaagaaggatttttaaattttttatgggtagaattgtagtcaggaaaacagaaagggcttgaaatttaataagtgctgctggaaggggattttccaagcctggaagggtattcagcagctgtggtggggaaacatttctcctgaaagactgaacgtgtttcttcatgacagctgctcaaagcaggtttctgagatagctgaccgagctctggtaaatctctttgtcaaattacgaaaacttcagggtgaaatcctatgcttccatgtacattacatggcttaagattaaacaaaaacatttttcaagtctctaactagagtgaactctagagcacagtagttcagaaactatttagagcttccaggatatatttcacagcttcaggcatgtgatcagttagagccgatgaaacctatgcccgcctgtatatatattagcagcttagctagttcataacctgtatattctaaagactgctaaggttttgttttcattttaaatcctagctgattgttgtggtcaatgaaatacccagtttctggagggccaggtgggaaatgctttcactggaccaacacacaaatgatcatcctgaggatctgagcttccctagactccacacaataaccttggggcacccttttagagaagactgttgaaacccacagcactcgttggggtatgaggaaaccagggcttggcacaggaagttcccctttgtagctaaaagtccagaaagaaagggttcatctttttgacttccaactgatattgggaagtttggttgaggttcaagtgtgactccttccagagccacaggtaggggagtgtgaagttgagggggaggaaagctggaaggactctgccttgggagattcccagctctgctttccagcgcttggtggaatctgggctggggaaagacggcaccgggaaactctgcttccccattgtttccatctgatcagctgtggtgtgaggacttctcagacaaaggcaaggcctcgtgcccctgcccagcccattcatggagccctgggccttcttggcttccatagatcctaagctcttgactgtagtttagccagacttgttttgctatcttataagcagttcagaattagggaatgctggttttgaagagcaaaggacaggtagtctagagagggtcgtctggcctgcttgctgggtctttgtaacccagcacttcctcttgccctcctggctttatgtttatggggagaggactcaatagctccaccccttctggcaccagatggggcttggttagtttgcaataagcaccttgcagaggttaaagccagcgggtccctagtcttaggcccagcctgcttgtgtgggctctggcctggcctggtggctggcccagggggcagcagtgcttagagcttctgcagggcttctcttgtttacacagctgcatcagacaatgccatttctccccaccacggaaccttccatctaagatttcttccagggaatgccagcaatcaggcagcacccagctgtgggggcagtggggtgggggagacccacattgatgactttttttttttcttttaatgaagaaacaccaaagaaagctgtggaaaggacctgccccacatgaaaaggataagccaagatggctgtaaacacagagcatttgagctgccactcttggagcacattgatttttcaaaagccagctctgtcaggaaaggaggtgctgttatgagcagctcttccagtgggcaaagaggacgcccataatttcttccattgctagctcatctgtgggaccaatttggtgtaagcaacctgtggcctgcacttgtggcctcgaaggaagcacaaaccctccatccacttcccatttcctctgcccttttccacctcccccttccatcccaccagctgccagtggctcccagaaagccttattgagccccttgttgacacttggggctgcggaggcctctccctactggtctggcctttcctgagaggcaggtcttccgtcctcagagcctttctggaacaaggagaatgcctgtgcaggtggacacacaggcctggcctgtcgctctcacttgtcttccagcggggagcttcacgttgccgagtggaagaaccatgacctccacttgcttccaaggtgctagggaagtttcagggtacgctggttcccctctccagctggaggccgagtttctggggactgcagatttttctactctgtgatcgattcaatgcccgatgcttctgtttcattcccgaccctttctactatgcattttccttttatcaggtgtataaagttaaatactgtgtatttatcactaaaaagtacatgaacttaagagacaactaagcctttcgtgtttttccacaggtgtttaagcttctctgtacagttgaaataaacagacagcaaaatggtgcc

SEQ ID NO: 2268 - DNA, 1165 bp, Homo sapiens
ccttggtgtgtgcataaggccacatgacctcaggtcaggaataaaagcttagggctgagcagctcactctttggttgagaatccagttggctcccctggagtgaagttctacacagaccctggaggaaccaccccatctgtttgttggagactgaaccgttgcaaggaacagacgaagatgcagtagccagtgctgacttctctagcatgctctctgaggaggaaaaggaagagttaaaagcagagttagttcagctagaagacgaaattacaacactacgacaagttttgtcagcgaaagaaaggcatctagttgagataaaacaaaaactcggcatgaacctgatgaatgaattaaaacagaacttcagcaaaagctggcatgacatgcagactaccactgcctacaagaaaacacatgaaaccctgagtcacgcagggcaaaaggcaactgcagctttcagcaacgttggaacggccatcagcaagaagttcggagacatgagacgaaagtaggcggtacgaaccctaatggaggcagttttgaggaggtcctcagctccacggcccatgccagtgcccagagcttggcaggaggctcccggcggaccaaggaggaggagctgcagtgctaagtccagccagcgtgcagctgcatccagaaaccggccactacccagcccatctctgcctgtgcttatccagataagaagaccaaaatcccgctgggaaaaacccaggccttgacattgttattcaaatggcccctccagaaagtttaatgatttccatttgtatttgtgttgatgatggaccacttgaccatcacatttcagtattcatagatgactgtcacattttaaaatgttcccacttgagcaggtacacaactggtcataattcctgtctgtgtaattcgatgtatatttttccaaacatgtagctattgtttgctttgatttttgcttggcctcctttatgatgtgcatgtccttgaaggctgaatgaacagtccctttcagttcagcagatcaacaggatggagctcttcatgactgtctccagcaataggatgatttactataaatttcatccaactacttgtgatctctctcacctacatcaattatgtatgttaatttcagcaattaaaagaattgatttt

SEQ ID NO: 2269 - DNA, 1149 bp, Homo sapiens
atggaagcagaacctaaaggtttgttggagactgaaccgttgcaaggaacagacgaagatgcagtagccagtgctgacttctctagcatgctctctgaggaggaaaaggaagagttaaaagcagagttagttcagctagaagacgaaattacaacactacgacaagttttgtcagcgaaagaaaggcatctagttgagataaaacaaaaactcggcatgaacctgatgaatgaattaaaacagaacttcagcaaaagctggcatgacatgcagactaccactgcctacaagaaaacacatgaaaccctgagtcacgcagggcaaaaggcaactgcagctttcagcaacgttggaacggccatcagcaagaagttcggagacatgagttactccattcgccattccataagtatgcctgctatgaggaattctcctactttcaaatcatttgaggagagggttgagacaactgtcacaagcctcaagacgaaagtaggcggtacgaaccctaatggaggcagttttgaggaggtcctcagctccacggcccatgccagtgcccagagcttggcaggaggctcccggcggaccaaggaggaggagctgcagtgctaagtccagccagcgtgcagctgcatccagaaaccggccactacccagcccatctctgcctgtgcttatccagataagaagaccaaaatcccgctgggaaaaacccaggccttgacattgttattcaaatggcccctccagaaagtttaatgatttccatttgtatttgtgttgatgatggaccacttgaccatcacatttcagtattcatagatgactgtcacattttaaaatgttcccacttgagcaggtacacaactggtcataattcctgtctgtgtaattcgatgtatatttttccaaacatgtagctattgtttgctttgatttttgcttggcctcctttatgatgtgcatgtccttgaaggctgaatgaacagtccctttcagttcagcagatcaacaggatggagctcttcatgactgtctccagcaataggatgatttactataaatttcatccaactacttgtgatctctctcacctacatcaattatgtatgttaatttcagcaattaaaagaattgattttaatg

SEQ ID NO: 2270 - DNA, 773 bp, Homo sapiens
gtatttggtagctttaggctgcattaaaccactttgtgatcttttgactgttatggactccaaaatagtccaagtggctttaaatggacttgaaaatattttacgtcttggagaacaagaatctaagcagaatggaataggcattaatccatactgtgctctcattgaagaagcatatggtctggataaaattgagtttttgcaaagccatgaaaatcaggaaatttaccagaaggcatttgatctgattgaacattactttggtgtagaagaagatgaccccagcattgtacctcaggtggatgaaaaccaacaacagtttatatttcagcagcaggaagcaccaatggatggatttcaactttaacttactggaggaaaaaaaatttatggctaaaaagggtagcttcagaaatgacagactttttcattgaatgatgaggacacagcagccatattatgccaagaggaaaaatatcatgatcatattgaaagatcaagcatgagcttccatggtgaagtcttctgtaccaatgcaccagagaatgcctaccatccaaaaaagcagtcagctgatggaaaagaagattattaaacctttgttctgggatttactgttaaaaaacaaacaaaaaacaacaaaaaagcggtgacaggaaacagttaaggaaatgatttaactgaagggaagcaagatttttttaaagcattgttcttaatccccatgactgtccttcagtcacaattccagaataaaagaatctactttgtgt

SEQ ID NO: 2271 - DNA, 2067 bp, Homo sapiens
cccctgaaagctggcgaggcgcgcgcgctcccgcggcacgccgcgcctccgccctccgcccgccaacccgctggtccagtccctcttcgcgcccgcttggctccgcccccttcccaattcgctcctcccccaacagactggcggcgcgcggaaaacgcgtcacgtgacgactggccccgcctcttcctctcggtcccatattgaactcgagttggaagaggcgagtccggtctcaaaatggaggtaaaaccgccgcccggtcgcccccagcccgactccggccgtcgccgtcgccgccggggggaggagggccatgatccaaaggaaccagagcagttgagaaaactgtttattggtggtctgagctttgaaactacagatgatagtttacgagaacattttgagaaatggggcacactcacagattgtgtggtaatgagagacccccaaacaaaacgttccaggggctttggttttgtgacttattcttgtgttgaagaggtggatgcagcaatgtgtgctcgaccacacaaggttgatgggcgtgtagtggaaccaaagagagctgtttctagagaggattctgtaaagcctggtgcccatctaacagtgaagaaaatttttgttggtggtattaaagaagatacagaagaatataatttgagagactactttgaaaagtatggcaagattgaaaccatagaagttatggaagacaggcagagtggaaaaaagagaggatttgcttttgtaacttttgatgatcatgatacagttgataaaattgttgttcagaaataccacactattaatgggcataattgtgaagtgaaaaaggccctttctaaacaagagatgcagtctgctggatcacagagaggtcgtggaggtggatctggcaattttatgggtcgcggagggaactttggaggtggtggaggtaattttggccgtggtggaaactttggtggaagaggaggctatggtggtggaggtggtggcagcagaggtagttatggaggaggtgatggtggatataatggatttggaggtgatggtggcaactatggcggtggtcctggttatagtagtagagggggctatggtggtggtggaccaggatatggaaaccaaggtggtggatatggtggaggtggaggatatgatggttacaatgaaggaggaaattttggcggtggtaactatggtggtggtgggaactataatgattttggaaattatagtggacaacagcaatcaaattatggacccatgaaagggggcagttttggtggaagaagctcgggcagtccctatggtggtggttatggatctggtggtggaagtggtggatatggtagcagaaggttctaaaaacagcagaaaagggctacagttcttagcaggagagagagcgaggagttgtcaggaaagctgcaggttactttgagacagtcgtcccaaatgcattagaggaactgtaaaaatctgccacagaaggaacgatgatccatagtcagaaaagttactgcagcttaaacaggaaacccttcttgttcaggactgtcatagccacagtttgcaaaaagtgcagctattgattaatgcaatgtagtgtcaattagatgtacattcctgaggtcttttatctgttgtagctttgtctttttctttttcttttcattacatcaggtatattgccctgtaaattgtggtagtggtaccaggaataaaaaattaaggaatttttaacttttcaatatttgtgtagttcagtttttctacattttagtacagaaactttaacaaaatgcagtttcgaaggtgtttccttgtgagttaacaagtaaagaagatcattgttaattactattttgtatgaattttgctaaagttaactgtaaagaaacacctgctgacttgcagtttaaggggaatctattctccccatttccaaaccatgatatgaatgggcgctgacatgtggagagaatagataatttgtgtgtttgcaatgtgtgttttagataaataggattgggtatttaaattagcatttgtgaattt

SEQ ID NO: 2272 - DNA, 3547 bp, Homo sapiens
ggaggtgagcaggaaggagacggccgcccagcagcccgtgggcaggcgcggcggagcgagcggggccggcggcgggcgccgagggacgccgaggcctcgggcgggggctggcccggggttccaggtctccagtgggggctgcagactaagcaaaatgaggcggttcctgaggccagggcatgaccctgtgcgggagaggctcaagcgggacctgttccagtttaacaagacggtggagcatggcttcccgcaccagcccagcgccctcggctacagcccgtccctgcgcatcctggccatcggcacccgttctggagccatcaagctctacggagccccaggcgtggagttcatggggctgcaccaggagaacaacgctgtgacgcagatccacctcctgcccggccagtgccagctggtcaccctgctggatgacaacagcctgcacctttggagcctgaaggtcaagggcggggcatcggagctgcaggaggatgagagcttcacactgcgtggacccccaggggctgcccccagtgccacacagatcaccgtggtcctgccacattcctcctgcgagctgctctacctgggcaccgagagtggcaacgtgtttgtggtgcagctgccagcttttcgtgcgctggaggaccggaccatcagctcggacgcggtgctgcagcggttgccagaggaggcccgccaccggcgtgtgttcgagatggtggaggcactgcaggagcaccctcgagaccccaaccagatcctgatcggctacagccgaggcctcgttgtcatctgggacctacagggcagccgcgtgctctaccacttcctcagcagccagcaactggagaacatctggtggcagcgggacggccgcctgctcgtcagctgtcactctgacggcagctactgccagtggcccgtgtccagcgaagcccagcaaccagagcccctccgcagcctcgtgccttacggtccctttccttgcaaagcgattaccagaatcctctggctgaccactaggcaggggttgcccttcaccatcttccagggtggcatgccacgggccagctacggggaccgccactgcatctcagtgatccacgatggccagcagacggccttcgacttcacctcccgtgtcatcggcttcactgtcctcacagaggcagaccctgcagccacctttgacgacccctatgccctggtggtgctggctgaggaggagctggtggtgattgacctgcagacagcaggctggccaccggtccagctgccctacctggcttctctgcactgttccgccatcacctgctctcaccacgtctccaacatcccgctgaagctgtgggagcggatcattgccgccggcagccggcagaacgcacacttctccaccatggagtggccaattgatggtggcaccagcctgaccccagccccaccccagagggacctgctgctcacagggcacgaggacggcacggtgcggttctgggatgcctcgggtgtctgcctgcggctgctctacaaactcagcactgtgcgcgtgttcctcaccgacacggaccccaacgagaacttcagtgcccagggcgaggacgagtggcccccactccgcaaggtgggctcctttgacccctacagtgatgacccccggctgggcatccagaagatcttcctctgcaagtacagcggctacctggctgtggcaggcacggcagggcaggtgctggtactggaactgaatgacgaggcagcggagcaggctgtggagcaggtggaggccgacctgctgcaggaccaagagggctaccgctggaaggggcacgagcgcctggcagcccgctcagggcccgtgcgctttgagcctggctttcagcccttcgtgttggtgcagtgtcagcccccggctgtggtcacctccttggccctgcactctgagtggcggctcgtggccttcggcaccagccatggctttggcctctttgaccaccagcagcggcggcaggtctttgttaagtgcacactgcaccccagtgaccagctggccttggagggcccactctcccgcgtcaagtccctcaagaagtccttgcgtcagtcattccgccggatgcgtcggagccgggtgtccagccggaagcggcacccggctggccccccaggagaggcacaggaggggagtgccaaggctgagcggccaggcctccagaacatggagctggcgcctgtgcagcgcaagatcgaggctcgctcggcagaggactccttcacaggcttcgtccggaccctgtactttgctgacacctacctgaaggacagctcccggcactgcccctcgctgtgggctggcaccaatgggggcaccatctatgccttctccctgcgtgtgcctcccgccgagcggagaatggatgagcctgtgcgggcagagcaggccaaggagatccagctgatgcaccgggcgccggtggtgggcatcctggtgctcgacggacacagcgtaccccttcccgagcccctcgaagtggcccatgatctgtcgaagagccctgacatgcagggaagccaccagctgctcgtcgtatcagaggagcagttcaaggtgttcacgctgcccaaggtgagtgccaagctgaagttgaagctgacggccctggagggctcaagagtgcggcgggtcagcgtggcccacttcggcagtcgtcgagccgaggactacggggagcaccacctggcagtccttaccaacctgggcgacatccaggtggtctcgctgcccctgctcaagccccaggtgcgctacagctgcatccgccgggaggacgtcagtggcatcgcctcctgcgtcttcaccaaatatggccaaggcttctacctgatctcaccctcggagtttgagcgcttctctctctccaccaagtggctggtggagccccggtgtctggtggattcagcagaaaccaagaaccaccgccctggtaacggtgcgggccccaagaaggccccgagccgagccaggaactcagggactcagagtgatggcgaggagaagcagcccggcctggtgatggagcgcgctctgctcagtgatgagagagtcctgaaggaaatccagagcacactggagggagaccgcgggagcggcaactggcgttcacatcgagccgccgtggggtgcagcctcagcaatggcggagcagagtgagtggctgagcgtccaggctgcgcgatgagcacacactactactgatggcctttcgggggtccctgccccaaccggagaggccggtgcacagggccccgccaggggctgggggcatcccggcttccacaatgcagctgctctgggcctcgggagaggagagaccccagtcccctgggctgcccttcccgggcctcgtctgtctgggtcctttggtcaatgttgcacagtttttattgctcccatccctttttgtagtgggctgggttttaagttataaatgttaactgcctctgggtgaaaaagtttttaataaacacctattacctcttg

SEQ ID NO: 2273 - DNA, 2176 bp, Homo sapiens
cgggcgggcgggcgggacggcgccccccgcggccgggcctggccgggctgcgctaggctgggctcgggcagggtcgcaggggcgggggtggcaggggagcgggtggcagccccgcgggtcacagcgccgccgccgcccatgctgctgcccctagcctgcctgcacggccgcgtcgctcagtgcctgacctccttgcttttgcttgcagagccgctcccgaggccccggcgcggcgcgagggcgcggggcgcggcgtccacaggcgccgaggctgcccccgccgccccgcccgcgaagatggcggcggaactctacgctcccgccagcgccgcggccgcggacctagccaacagcaacgccggcgccgccgtgggcaggaaggccgggccgcgcagcccgcccagcgcccccgcgccagcgccgccgccgcccgcgcccgcgccgcccacactcggcaacaaccaccaggagagccccggctggcggtgctgccgccccacgctgcgcgagaggaacgcgctcatgttcaacaacgagctcatggccgacgtgcacttcgtcgtggggcccccgggggcgaccaggacggtgcccgcccacaagtacgtcttggctgtcggcagctccgtcttctatgccatgttctacggagacctggcggaagtcaaatctgaaattcacattccagacgtggagcccgcagcctttctgatcctcttaaagtacatgtacagtgatgagatcgatctggaagccgacacggtgctggccactctgtacgctgctaagaagtacatcgtcccagcattggcaaaagcctgtgtcaactttctggagacaagtttggaagccaagaacgcctgcgtcctgctgtcccagagccggctgtttgaggagcccgagctgacgcagcgctgctgggaggtcattgacgcacaggccgagatggccctacggtccgaaggcttctgtgagatagaccggcagacgctggagatcattgtcactcgggaggccctcaacaccaaagaggcggtggtcttcgaggccgtcctgaactgggccgaggcggagtgcaagaggcaggggctgccaatcaccccacgaaacaagaggcatgttctggggcgagccctctatctggtccgaattccaaccatgaccctagaggagtttgccaacggcgctgcccagtcagacatcctgactctggaggagacccacagcatcttcctgtggtacacggccaccaacaagccccgcctggactttcccctgaccaagaggaagggcctcgccccgcagaggtgccaccgattccagtcttctgcctaccgcagcaaccagtggcggtaccgcgggcgctgcgacagcatccagtttgcagtggacagaagggtatttattgcagggctgggcctgtatggctccagctctgggaaggctgagtacagcgtgaagattgagctcaagcggctcggggtggttctggctcagaacttgaccaagttcatgtcagacggatccagtaacaccttcccggtctggtttgaacacccggtccaggttgaacaagacaccttctacacggccagtgccgtcctggacggcagcgaactcagctactttgggcaggaggggatgacggaagtgcagtgtggaaaggtggccttccagttccagtgctcctcggacagcaccaacgggactggggtccagggtgggcagatccctgagctcattttctatgcctgaggtgcccggggaggctgcagcaggtcagcgagtgagtggaggggaagtcaagatgctaactgcttcttgacaccatgaaaggctgctcttaactttgtctctctttgacatgtagtcagctgaagcttgactgtgtagagacattttccacacagccagaacccagggattggagtcttaggcatctctggtacagtggggtgcacgtctcaggtggaggaagatttacggctcaagacaggccccagatcccctcccagtggcacccatgccacctgctttgaggggttggatcttcctgctaccctcttggattctaagtggttccaagcttaacttgagaccttcccttcaaatctaaaattggcaaaaagtcacttaaaatagtggacttctgtaataaaggttgcctaaaataaca

SEQ ID NO: 2274 - DNA, 3571 bp, Homo sapiens
gcggcgcccagggcggtagcgtgaaacttggtggaagacgctgaccagtcgtgttggaatcaaaacagcggggaccctgcgccatgtcgcgactgatcgtgaagaatctcccgaatgggatgaaggaggagcgtttcaggcagctgtttgccgccttcggcacgctgacagactgcagcctgaagttcaccaaagatggcaagttccgcaagtttggttttattggcttcaagtccgaggaagaggcccagaaggcacagaagcatttcaacaagagcttcatcgacacatcccggatcacagtggagttctgcaagtcattcggggacccggccaaacccagagcctggagcaaacatgcccagaaaccaagccagcccaagcagcctccaaaagactctactactccagaaattaagaaagatgagaagaagaaaaaggtggcaggtcaactggagaagctgaaggaggatacagagttccaggagtttctgtcagttcatcagaggcgggcgcaggcagccacttgggcgaatgatggcctggatgctgagccctcgaaagggaagagcaagccggccagtgactacctgaacttcgactccgattctgggcaggagagtgaggaggagggagccggggaggacctggaagaagaggcaagcctcgaaccaaaggcagctgtgcagaaggagctgtcggacatggattacctgaaatccaagatggtgaaggctgggtcgtcctcttcctcggaggaagaggaaagtgaagatgaagccgtgcactgtgatgaagggagtgaggccgaggaagaggattcctccgccaccccagtcctgcaggaaagagacagcaagggtgcaggccaagagcaagggatgccagctgggaaaaagagaccaccggaggccagagccgagacagagaaaccagcaaaccagaaggaacccaccacctgccacaccgtgaagctgcggggagccccgttcaatgtcacagagaaaaatgttatggaattcctggcacccctgaaaccagtggccattcgaattgtgagaaacgctcatgggaataaaacaggatacatctttgtggatttcagcaatgaagaggaagtgaagcaagctctgaaatgcaaccgggagtacatgggtgggcgctacatcgaggtgttcagggaaaagaacgtccccaccaccaagggtgcaccaaagaataccaccaaatcctggcaaggccggatactcggggagaacgaagaggaggaggacctggccgaatccggaaggctctttgtacggaacctgccctacaccagcaccgaggaggatctggagaagctcttctccaaatatggtcccctgtctgagctccactaccccatcgacagcctgaccaagaaacccaagggttttgcattcatcaccttcatgttccctgagcacgctgtgaaggcctactcggaggtggacgggcaggtattccagggcaggatgctccacgtgttaccatctaccatcaagaaggaagccagcgaggatgccagtgccctgggatcgtcgtcctacaagaagaagaaggaggcccaggacaaagccaacagtgccagctctcacaactggaacacactattcatggggccgaatgccgtggccgatgccatcgcacagaagtacaacgccaccaagagtcaagtgtttgaccacgagaccaagggcagcgtggccgtgcgcgtggctctgggggaaacccagctcgtccaggaagtgcggcgttttctcatagacaacggggtcagcctggattccttcagccaggctgcagcagagcgaagcaagactgtgattctggtcaagaacctcccggcaggcaccctggcggcccagctgcaggagaccttcggccattttggcagcctgggccgcgtgctgctgccagagggcggaatcactgccatcgtggagttcctggagcccctggaggcccgcaaggccttcaggcatctggcctattccaagttccatcatgtccccctctatctggagtgggctccagttggcgtcttctccagcacagccccacagaagaaaaagctccaagacacaccttcagaacccatggaaaaggacccagcagagccagaaacagtgcctgatggcgaaaccccagaagatgaaaatccaacagaggaaggagcagacaactcttcagcaaagatggaagaggaggaggaggaagaggaagaagaagaagagagcctcccaggatgtactctgtttattaagaatctcaattttgacacaacagaagagaagctgaaggaagtgttttcaaaagtggggacagtgaagagctgctccatctccaagaagaagaacaaagcaggagtgctcctttccatggggtttggatttgtggaatacaggaagccggagcaagcccagaaagctctcaagcagctccagggtcacgtcgtggacggccacaagctggaagtgaggatctcggaacgagccactaagccagccgtgacattggctcggaagaaacaagttcccagaaagcagaccacctccaagatcctggtgcggaacatccccttccaggcccacagccgggagatccgagagctcttcagcacctttggggagttgaagacggtccgcctgccaaagaagatgactgggacaggcacacacagaggcttcggctttgtggacttcctcaccaagcaggatgcgaagagagccttcaacgccctgtgtcacagcacccacttgtacgggcggaggctggtgctggagtgggccgactccgaggtgaccctgcaggccctgcggcggaagacggccgctcactttcacgagcccccgaagaaaaagcggtctgtggtgttggacgagatcctggagcagctggaaggcagtgacagcgacagcgaggagcagacccttcagctgtgagctggcaccgagaggggctgctgagctagaattcccacctatgtctttccaagggactgttcacggcttgggacttggtctctgtcctgccccatcctcgtcacttgggaccacgagccctggttcagtcacccagggaagcctcccagcggctcatgaagcatcgagctccaagcccagatgccaagctccctggctgagctgaatgatgtcactcatggtggacgcgttctgctcacgggcccagagccctgtgaaatgcatcaaggtcctctccgctggccagcagcatccccaggcttctctcaggcgcccgtgttcacattttctccagcctgagacgcagcctcccgcctggaagggcctgtgccagcaccaggcagagggcaagacggagagggcagagcaagaactgcactgcatctcactgcagtctgaatctagacatcgccattccccgaggtgcgacctcagactaatgacatcctggctgagcctctgtttttctctctaggaaatgggggtgataattgtgcctacctcagatagacagtgccagaattaagtgagtcaagccaagtaaagcccagagaagattctcatca

SEQ ID NO: 2275 - DNA, 845 bp, Homo sapiens
gtcacgcgcccgcccgaaggctcctgtcgggacagggcgccgccccgtgtcggcccccgcagagctcgcggcccccgcctgtccgggcgccgccatggagcgcatcgagggggcgtccgtgggccgctgcgccgcctcaccctacctgcggccgctcacgctgcattaccgccagaatggtgcccagaagtcctgggacttcatgaagacgcatgacagcgtgaccgttctcttattcaactcttctcggaggagcctggtgttggtgaagcagttccggccagctgtgtatgcgggtgaggtggagcgccgcttcccagggtccctagcagctgtagaccaggacgggcctcgggagctacagccagccctgcccggctcagcgggggtgacagttgagctgtgtgccggcctcgtggaccagcctgggctctcgctggaggaagtggcttgcaaggaggcttgggaggagtgtggctaccacttggccccctctgatctgcgccgggtcgccacatactggtctggagtgggactgactggctccagacagaccatgttctacacagaggtgacagatgcccagcgtagcggtccaggtgggggcctggtggaggagggtgagctcattgaggtggtgcacctgcccctggaaggcgcccaggcctttgcagacgacccggacatccccaagaccctcggcgtcatctttggtgtctcatggttcctcagccaggtggcccccaacctggatctccagtgagactccagggttctagacagaggccagtcttggccactcaccccacaccccgcggaccccaataaaggcttgcatagctcca

SEQ ID NO: 2276 - DNA, 1697 bp, Homo sapiens
agctgggcagagccctgggggcgcggtgctgccgcctccaggtctccgccccgtgtgtgcgccctgcacttagggatccctccctcactgccccggtactcacaagcttctcggccccgaccttcgccctgggaggttctggccaggtgccgggaggggcgctgtgtcgagggcgatccccccaaagcagcgtcccgtgctaaagaaacagagcctcactctgtcacctaggctggagtgcagtggtgcaattatggctcactgcagtttcaacctcccagattccagtcatcctcctgcctcagccacccaagaagctgggaccacaggtactgcttaggatgaatatgatttggagaaattccatttcttgtctaaggctaggaaaggtgccacacagataccaaagtggttaccacccagtggcccctctgggatcaaggattttaactgacccagccaaagtttttgaacacaacatgtgggatcacatgcagtggtctaaggaagaagaagcagcagccagaaaaaaagtaaaagaaaactcagctgtgcgagtccttctggaagagcaagttaagtatgagagagaagctagtaaatactgggacacattttacaagattcataagaataagtttttcaaggatcgtaattggctgttgagggaatttcctgaaattcttccagttgatcaaaaacctgaagagaaggcgagagaatcatcatgggatcatgtaaaaactagtgctacaaatcgtttctcaagaatgcactgtcctactgtgcctgatgaaaaaaatcattatgagaaaagttctggttcttcagaaggtcaaagcaaaacagaatctgatttttccaacctagactctgaaaaacacaaaaaaggacctatggagactggattgtttcctggtagcaatgccactttcaggatactagaggttggttgtggagctggaaatagtgtgtttccaattttgaacactttggagaactctccggagtcctttctgtattgttgtgattttgcttctggagctgtggagctcgtaaagtcacactcgtcctacagagcaacccagtgttttgcctttgttcatgatgtatgtgatgatggcttaccttacccttttccagatgggatcctggatgtcattctccttgtctttgtgctctcttctattcatcctgacaggacattgtttatctgaaaatttttatgttcgaggagatggtaccagagcatatttctttacaaaaggggaagtccacagtatgttctgcaaagccagtttagatgaaaagcaaaatctggttgatcgccgcttacaagttaataggaaaaaacaagtgaaaatgcactgagtgtggattcaaggcaaattccagaaaccattgcaccagactcagaatagctccaatatggtatctacactcctttcacaagactgaactttgtaacatgttaaggtacaaagccagaggactgtgctattcaaggactactgtaagtctattgtttctcaaaagacaatgagaaaaaaagaagagaatttgtatttcctgccgttttgtcataggtgagctcctttgtgcattttaagcacatgtaagtggttcagcacagtatgcctttttctgtgctttgaaaacttgatatgctcaagcttgtttgaatttattacatctaa

SEQ ID NO: 2277 - DNA, 800 bp, Homo sapiens
gaacgcgtgcgcgcgtgcggcctggcgcttccggcaccggccgaggtgcgggtcgcctccagagatcctgtgccttcaaaccctacgagtccatactttaaaacaaaatgaagaaagtaaggcttaaggaactagagagtcgcctgcaacaagtggatggatttgaaaagcccaagctacttctggaacagtatcctaccaggccgcacattgcagcatgtatgctctatacaatccataacacttatgatgacattgaaaataaagtcgttgcagatctaggatgtggttgtggagtacttagcatcggaactgcaatgttaggagcagggttgtgtgttggatttgacatagatgaagacgcattggaaatatttaataggaatgcagaagagtttgagttaacaaatattgacatggttcaatgtgatgtgtgcttattatctaacagaatgtccaagtcattcgatacagtaattatgaatcctccctttgggaccaaaaataataaagggacagatatggcttttctaaagactgctttggaaatggcaagaacagcagtatattccttacacaaatcctcaactagagaacatgttcaaaagaaagctgcagaatggaaaatcaagatagatattatagcagaacttcgatatgacctgccagcatcatacaagtttcacaaaaagaaatcagtggacattgaagtggacctaattcggttttccttttaaaagccccgcaaacaaaagtcgtttaaaacctatttaaaatgaataaaaaattggtttactaaa

SEQ ID NO: 2278 - DNA, 615 bp, Homo sapiens
acctcgcccaggctgccagaccggaagcgctccgctgtacctggatcctgctcctctgggttgaaacccgggcgccgccaagatgccggcttaccactcttctctcatggatcctgataccaaactcatcggaaacatggcactgttgcctatcagaagtcaattcaaaggacctgcccccagagagacaaaagatacagatattgtggatgaagccatctattacttcaaggccaatgtcttcttcaaaaactatgaaattaagaatgaagctgataggaccttgatatatataactctctacatttctgaatgtctgaagaaactgcaaaagtgcaattccaaaagccaaggtgagaaagaaatgtatacgctgggaatcactaattttcccattcctggagagcctggttttccacttaacgcaatttatgccaaacctgcaaacaaacaggaagatgaagtgatgagagcctatttacaacagctaaggcaagagactggactgagactttgtgagaaagttatcaagggtgatttgaaattttctgcagcattaaagctggcgcttaataagaataagtaataataaagaaatttctaacattccatgtc

SEQ ID NO: 2279 - DNA, 6152 bp, Homo sapiens
atggcggacaccgacctgttcatggaatgtgaggaggaggagttggagccatggcagaaaatcagtgatgtcattgaggactctgtagttgaagattataattcagtggataaaactaccacagctggcaatcctttggtccagcaaggtggacagccactcatcctgacccagaatccagccccaggtctgggcacaatggttactcaaccagtattgaggcctgttcaggtcatgcagaatgccaatcatgtgactagttcccctgtggcctcacaaccaatatttatcactacgcagggatttcctgtaaggaatgtccggcctgtacaaaatgcaatgaatcaggttgggattgtgctgaacgtacagcaaggccaaacggttagaccaattacactagttccagccccaggtacccagtttgttaagccgacagttggagttccacaagtgttctcccagatgacccctgtgaggccaggctccacaatgcctgtgaggcccaccaccaacaccttcaccaccgtcatcccggccactcttaccattcgaagcaccgtcccacagtcccagtcccagcagaccaagtccactcccagcacttctaccactcccactgccacacagccaacctcactggggcaactagctgttcagtctccaggccagtcaaaccagaccacgaatcccaagctagctccctccttcccctctccacctgcagtgagcattgccagctttgtcactgtgaagcgacctggtgttacaggcgaaaatagcaatgaagtggccaaattggtgaatacccttaacaccatcccttccctgggccagagtcctgggccagtggtggtgtccaacaacagctctgctcatggctctcaaagaaccagcggacctgagtcttcaatgaaagtgacctcttccatcccagtatttgacctccaggatggtggacggaaaatatgtccacgatgtaatgctcaatttcgtgttactgaagctttgagaggtcacatgtgttactgttgcccagaaatggttgaataccagaagaaaggaaagtccctggattcagaacccagtgtcccatcagcagcaaagcccccatcccctgagaaaacagctcctgttgcttccacaccctcttctacacctattcctgctctgtcaccgcctaccaaagtaccagaaccaaatgagaacgtgggcgatgccgtccagaccaaactcattatgcttgtagatgacttctactatggacgggatggtggcaaagtagcccagctcacaaatttccctaaggtcgccacatctttccgatgcccacattgtaccaaaaggctaaaaaacaatattcgattcatgaaccatatgaaacaccacgtagaactcgatcagcagaacggtgaggtagatggtcacactatctgccagcactgttaccgccagttttccactcccttccagcttcagtgccacttggaaaatgttcatagtccctatgaatctactaccaagtgcaagatctgtgaatgggcgtttgaaagtgagccactatttctccagcatatgaaggatactcataagcctggagagatgccttatgtttgccaggtgtgtcaatatcgctcctcactctactctgaggtagatgtccattttcggatgatccatgaggatacccggcatctgctctgcccttattgcctgaaggtcttcaaaaatggcaatgcattccaacagcattacatgaggcaccagaagagaaatgtttatcactgcaacaaatgccggctgcagtttctctttgccaaggacaaaattgaacacaagcttcaacaccataaaaccttccgtaaacccaagcagctggagggcttgaaaccaggcaccaaggtgacaatccgggcttcccgagggcagccacgaactgttcctgtatcctctaatgatacacctcccagcgccttgcaggaggcagcaccgctgacctcctcaatggaccctctgcctgtcttcctttatccccctgtccagcgcagcatccagaagagagctgttaggaaaatgagtgtcatgggccggcagacatgcctggagtgcagcttcgagatcccagacttccctaatcatttccctacttacgtacactgctctctgtgtcgctatagcacctgctgttctcgagcttatgccaaccacatgatcaacaatcatgttccacggaagagccccaagtatttggctttgtttaaaaattctgtgagtggaatcaagctggcctgcacttcatgtacctttgttacctctgtgggcgatgctatggccaagcatttggtattcaacccctctcacagatccagcagcatcctgccacggggactcacttggatagctcactcaaggcatggccagactcgtgaccgagtgcatgaccggaacgtgaagaatatgtaccctcctccttccttccccactaacaaagctgccactgtgaaatctgcgggggccaccccagctgagcctgaagagctactaactcccttagccccagcactcccatcaccagcctcaactgcaaccccaccaccaacccccactcacccgcaggctttagcccttccaccgctggctacagagggagccgaatgtctgaatgttgatgatcaggatgaagggagcccagtcacccaagaacctgagctagcatcaggtggtggtggtagtggtggagttggcaaaaaggagcagctgtctgtgaagaagcttcgagtagtactgtttgctctatgctgcaatacagaacaggcagctgaacacttccgaaatccccagcgacgtattcgccgttggcttcgacgtttccaggcctcccagggggagaatctagagggcaaatatctgagctttgaggcagaagagaaactggctgagtgggtgctaacccagcgcgaacaacagctacctgtaaatgaggagaccttgttccagaaggccaccaaaataggacgttctttggaaggggggtttaagatctcctatgagtgggctgtgcgtttcatgctgcggcaccacctgactccccatgcccggcgagctgtggcccacaccctacctaaggatgtagcagagaatgcaggactcttcattgattttgtacaacggcagattcacaaccaggacttacccttgtctatgattgtggctattgatgagatctctttgttcctggatacagaggtgctgagcagtgatgatcgaaaggagaatgccctgcagacagtgggcacaggggaaccttggtgtgatgtagtcctagccattctggcagatggcactgtccttcccaccctggttttctacagagggcagatggatcagcctgctaacatgccagactccatattgctagaggcaaaggagagtggctacagtgatgacgagatcatggagctgtggtcaactcgagtgtggcagaagcacacagcttgccagcgcagcaaaggcatgcttgtgatggactgtcatcgcactcacttgtcagaagaggtactggctatgcttagtgcctctagcactttgcctgcagtggtcccagcaggctgtagctccaaaattcagccattagatgtatgcatcaaaagaactgtcaagaacttcctgcataaaaaatggaaggaacaggctcgggaaatggcagatactgcatgtgattctgatgtcctgcttcagctggtgcttgtctggctgggtgaagtgctaggtgtcattggggactgtccagagctagttcagcgctccttcctggtggctagtgttctgcctggccccgatggcaacattaactcacctacaagaaatgctgacatgcaggaggagctaattgcctccctagaggagcaactgaagctgagtggggaacattctgagtcttccactccacgacccagatcatctcctgaagagacaattgagcctgaaagtcttcaccagctctttgagggtgaaagtgagaccgagtctttctatggctttgaagaagctgacctagatctgatggagatttgagtgttggggtcatgagggggtgtggagtgagggtgggaacatgtgagggagggtaaaggggcttagggaaaagggggcataccaggtggggtatttggtttctattttttaattttataccaccactcccccctgaagttgacttacacttccctgtggatttgtggattaattaggaaaaccaatagtaatcacgtctgagccaaggagctggcccattggtcattcacttctgctaaaaacaggtttttgtgactttttttttttttaaatttaaatcactgtgtttggtatttttctgacaaaattaagaaaaagaaaaaaaattatttgtgggcaaatgttaaatttttttgtttccccttttacctcaattgtatcatagtactgggtttttttgtttgttttattgtgtggccaatgtctttgggcatgatgctatctaatcattgttaatgtgagaacatttctgaagatgggaaagacaaattatgtagctcacaaactggtttattatatatatggataaaaaacttttttcattgtggtcttaacacttttatataaaaatgaaaatggaaaaaaagtcccactgaactctctcttccttctccttttctttccttccctctccagagatgttggtttctacagcaaccctagatataaaattgtggctttaaaaatgcatgaaaccacctttaattatccagaatgaatagatttgtcttttcctcaccaccttccctccaaaacatgacataaacaatattttttgcacttgtgatccttggcccctttccccattctcaacaccatccatccctctggacaaaggatcatacaggtgttattagcaagcaagagatactgaagcgatcaaacagttttagggtggaagccattcccagtttgagtcttcatcctgtaagcccccaggggcagtccctgctttactgaacttcatcctgttagatggagagcatgcctgtttaagggattactggtcctacagccaggagctaattgttcaagaagtgttgaactttaaaaagacaagaccacttgttgaaatccagcgtgctctgtggctttcccctatttctcttaatacttagggaagaatctgacaggaagaagcgcacaggggtgtgcacaaagaaaatgacatgaatctttatttttcactgccagcttcaaggaaagaaaattttttctacaatttgcatgagggatttttttaattgtatgtactcatggttgtaaaccaaaacgtactgtaccgtacagagaaaaggagcaaaaaaccaagtcttctgtttatcctgaggctttccacaatgttcccctcctgtgagccaaggaggcaaactgcacaagcttgtaaatggttcgtctttaaaatgtacataagtggaacatttaataaaatgaggggaaatggatttataaacttgttttttttctaggtgaccctgtttaataggctttcacagactggggaatgctcaagatgtgatgggcctggtggtacaggtgtgacatttgttaccacccatttctcccaccccaccctgcttttttgtttgtttgttttttcatcccccagcacactataatatagtgaactggaaaagtcccttccagaaacagcttggccagctttgtgaacctttgacatctgaaaacaaccaaggatccatctgggcttctcttccccagctttttgcctgatgccattttattgacagacaatggactttgaagtcagcctttgcctttgagaaagttcaagaactatggttggtcacgtctatctacaacctaatcctactctttggtagtctctgcagcagccacagccttagcagagctggggttcctgtcttctgcacacgattgactttcttgatgggtaattttttttaagattataccaacagtggatcagctgggttttggccaggaagttgtctttgtggactctgcctgcatggcttagtagtagaaggaaatttttttttggttttgttttttataattcagtttaatcaataaacatgtatttattgactgtt

SEQ ID NO: 2280 - DNA, 365 bp, Homo sapiens
cagaagaatagaaggaaggtgataggatgtgatgatagaatttgtgatagccaagcaacaacttttcctaattcggcatgttaaaaaataagggtcactcatctaagaaagataacttggcagtcaatgcagttgctttacaagatcacattttacatgatcttcaacttcgaaatctttcagttgcagatcattctaagacacaagtacaaaagaaagagaacaaatctctaaaaagagatacaaaggcaataatagatactggacttaaaaaaactacacagtgccccaaactagaagactcagaaaaagaatatgttcttgatcccaaaccgccgccgttgactttgggataccattcatag

SEQ ID NO: 2281 - DNA, 2260 bp, Homo sapiens
cgtctttgcagcagaagaatagaaggaaggtgataggatgtgatgatagaatttgtgatagccaagcaacaacttttcctaattcggcatgttaaaaaataagggtcactcatctaagaaagataacttggcagtcaatgcagttgctttacaagatcacattttacatgatcttcaacttcgaaatctttcagttgcagatcattctaagacacaagtacaaaagaaagagaacaaatctctaaaaagagatacaaaggcaataatagatactggacttaaaaaaactacacagtgccccaaactagaagactcagaaaaagaatatgttcttgatcccaaaccgccgccgttgactttggcacagaagttgggcctcattgggcctccaccacctccactgtcatcagatgaatgggagaaggtgaaacagcgctctctcctgcaaggggactccgtgcaaccatgccccatctgtaaagaagaattcgagcttcgtcctcaggtgctgctttcatgctcccatgtgttccacaaagcatgtcttcaggcttttgaaaagttcacaaataagaaaacctgtcctctctgtagaaagaaccagtatcaaacccgagtgatacacgatggggcccgcctgttcagaatcaagtgtgtgaccagaatccaagcctactggagaggatgtgttgttagaaagtggtacagaaacctgaggaaaacagtacctcccacagatgccaagttaagaaaaaaattctttgaaaaaaagacacaagactggaaaccagcttaatttttcccatctcctgggctatatgtaaatgaagacatctgctgcacatctcatagtaatgaaaatagaagctgcctataaaaataaagcccccacatgctaccattgtattgagtacctcgtggggtcatcacaatgagctttagagctaacttccatgtctacccttcctcttaaccactatttatgctttagttttacttttgggggacttatttaacaatttcccattccttgtccccatatgaaaaggacagtcctaccccatcagcctgtggcttcaggcaaacagcagcagctccgaggctgtcatatgaaagccatcacttcttcctggcagtgttggcctgagaagagctgtagcatttataatggcccagcacacagtaggtgctggaaattctgtatttattatcactattaactcctttcctagaatatggagatgagttactgtgtgttctgttcctgagagcagtgtctctgatcttcagagatcattcgtctcgggtgttcattctcaatttggtaaaggaccgccatgcacgattgcgtcatccttcctttacattctttccagttttttatcttcagtcgttgacagtcagttgtgttctctgggctactcttagtaatttctaatatgtcatagtaggttgtctcttaaatcagaagtgattttttgtcacctcttatacaattttaattacagatttgatagtcattttaccttatatatataaatatttttcatgtgcacacatcattttataagaactcttgaagataaaggcccactgaaagtgttggtggtctcagcccattgaactggacgagaactggcccaggttgctggaaacaagtgaagcaaccattacaatgtgccttgtgttatcttgtaaagtagccagtgaaggttaagtttcagcgttcagtgctcaggtgttcaaatgctgcagccttcagcttcatggaaaaaggaaacgaaaaataacaaaaagcaagtgaccaagagcagtcggggcagggagacctgatcaaacaagttcctcagtttctaattcagtgtctcccacagagagatggaactttacaaggcagattcatagctctgtcccactggacgttgggtccgctgccctgtggccatcccacctccccacaaatactgttttttgttttatccttggttcatcccaactgctgcctcctcgtcctgagccctcatcgctcggaacgccccgctctgatccccgtgtctgcttttctgagcacactcttgcccgcccccgcatgtcctgcccgttcctactggttccctctgccttgcttaaaatgtgccagtttttcaaagcctagctgaagctttcttccaatttctttggtcttctctaaacctctattgtatgtttaaacaacaccatctaagagatcaagaagaacagaagtatgaatgctattcta

SEQ ID NO: 2282 - DNA, 1746 bp, Homo sapiens
tatattttgaatacatctgtcttcataaaatacaccatgtccaaaatctaaaagggccaattccaaattattccaccagctttgaagggaattgaagcaagaataacaagacagaagaatagaaggaaggtgataggatgtgatgatagaatttgtgatagccaagcaacaacttttcctaattcggcatgttaaaaaataagggtcactcatctaagaaagataacttggcagtcaatgcagttgctttacaagatcacattttacatgatcttcaacttcgaaatctttcagttgcagatcattctaagacacaagtacaaaagaaagagaacaaatctctaaaaagagatacaaaggcaataatagatactggacttaaaaaaactacacagtgccccaaactagaagactcagaaaaagaatatgttcttgatcccaaaccgccgccgttgactttggcacagaagttgggcctcattgggcctccaccacctccactgtcatcagatgaatgggagaaggtgaaacagcgctctctcctgcaaggggactccgtgcaaccatgccccatctgtaaagaagaattcgagcttcgtcctcaggtgctgctttcatgctcccatgtgttccacaaagcatgtcttcaggcttttgaaaagttcacaaataagaaaacctgtcctctctgtagaaagaaccagtatcaaacccgagtgatacacgatggggcccgcctgttcagaatcaagtgtgtgaccagaatccaagcctactggagaggatgtgttgttagaaagtggtacagaaacctgaggaaaacagtacctcccacagatgccaagttaagaaaaaaattctttgaaaaaaagttcacagaaatcagccaccgcatcctgtgctcatacaacaccaacattgaagagctctttgcagaaatcgatcagtgcttggccataaatcgaagtgttcttcagcagttggaagaaaaatgtggccatgagatcacagaagaggaatgggagaaaatccaagtgcaggctctgcgccgggagacccacgagtgctccatctgcctggcccctctctccgctgctggcggtcagcgcgtgggtgcaggcaggcgttccagagagatggccctcctgtcctgctcacatgtgttccaccatgcgtgtctgctggcactagaggagttctccgtgggagacaggcctcctttccatgcctgtcctctctgccgctcctgctaccagaagaagattcttgaatgttgaattcatagtcaaggaaagttaggtaattctgaggaaaaaagtttaccatcattttggatgaactgcatgagttctgggttaagtactacaatgtaatctgtttcccagggaaataagctattggtagttgtaggaaatcttagtatattttaaaagctgacatcccacctaattttaatctttggtctctaaaaagtaaatttcaaatttatgagtttaatcacttcaaatatgaatagcaaaaaatgagagcttgcttacttctaaaaattgaggttaagatatagctagtgtctgaacgacactccttaaagtaagttccaaatgtaaaacactccttaagttccaaatgttttccgctaatagtctgtcctaaagcctttgccattcctaatactcgttttgtaataattgctgtatttctgtgtaataaaatataaaaataaaatattcagtggtattcaacatc

SEQ ID NO: 2283 - DNA, 2171 bp, Homo sapiens
agaagagccctgggctgggtggggcagggcggaagggccctggccttgttgggtggaggtgaagagttaatggctccgcgcgcaggcactgccctctgaactggaacaaaatgcaacttccggttggagtcactcggccaggcgccggcgacctgaggggagagggaacgcagctgaaagcgtgaactgtacctgtcatttactccatcctttatagtgatgctacaggacgaagaggaatggataaaaacattggcgagcaactcaataaagcgtatgaagccttccggcaggcatgcatggatagagattctgcagtaaaagaattacagcaaaagactgagaactatgagcagagaatacgtgaacaacaggaacagctgtcacttcaacagactattattgacaagctaaaatctcagttacttcttgtgaattccactcaagataacaattatggctgtgttcctctgcttgaagacagtgaaacaagaaagaataatttgactcttgatcagccacaagataaagtgatttcaggaatagcaagagaaaaactaccaaaggtaagaagacaagaggtttcttctcctagaaaagaaacttcagcaaggagtcttggcagtcctttgctccatgaaaggggtaatatagagaagactttctgggatctgaaagaagaatttcataaaatatgcatgctagcaaaagcacagaaagaccacttaagcaaacttaatataccagacactgcaactgaaacacagtgctctgtgcctatacagtgtacggataaaacagataaacaagaagcgctgtttaagcctcaggctaaagatgatataaatagaggtgcaccatccatcacatctgtcacaccaagaggactgtgcagagatgaggaagacacctcttttgaatcactttctaaattcaatgtcaagtttccacctatggacaatgactcaactttcttacatagcactccagagagacccggcatccttagtcctgccacgtctgaggcagtgtgccaagagaaatttaatatggagttcagagacaacccagggaactttgttaaaacagaagaaactttatttgaaattcagggaattgaccccatagcttcagctatacaaaaccttaaaacaactgacaaaacaaagccctcaaatctcgtaaacacttgtatcaggacaactctggatagagctgcgtgtttgccacctggagaccataatgcattatatgtaaatagcttcccacttctggacccatctgatgcaccttttccctcactcgattccccgggaaaagcaatccgaggaccacagcagcccatttggaagccctttcctaatcaagacagtgactcggtggtactaagtggcacagactcagaactgcatatacctcgagtatgtgaattctgtcaagcagttttcccaccatccattacatccaggggggatttccttcggcatcttaattcacacttcaatggagagacttaagacacatttgaaaacagacatatcaagttctatgtgatgattttgggtttttaatactataaatacttgattgtaaactaaattcaagatcatttataggaaaatctagtttcacagctatttgaatttttttctggatttactatataactcttattttttaaaagatcattctgttctttcaaggagaaataagcctaaaagaagaaaaacaaaaaaaattctgtataaaactgtaatcctttgtattcatgtttacagtgctattactataattcaaaattatgtatgtgacttagagttatataatcataatttatgtttatttcaaatatctaagtttattgcttggatttctagtgagagctgttgaatttggtgatgtcaaatgtttctagggtttttttagtttgtttttattgaaaaatttaattatttatgctataggtgatattctctttgaataaacctataatagaaaatagcagacaacataaacatctttgtaaatatcaaacctaatacatttcttgtccagtgataaaacaactggtagaattatttaaacactttagatttttaaataatatacatggctttaatttttactgtgtgtatagctacatgatgaaattaattaaatattaagaggta

SEQ ID NO: 2284 - DNA, 840 bp, Homo sapiens
cgcggagctgaggagcagggccgggcgccatggcaccgtggggcaagcggctggctggcgtgcgcggggtgctgcttgacatctcgggcgtgctgtacgacagcggcgcgggcggcggcacggccatcgccggctcggtggaggcggtggccagactgaagcgttcccggctgaaggtgaggttctgcaccaacgagtcgcagaagtcccgggcagagctggtggggcagcttcagaggctgggatttgacatctctgagcaggaggtgaccgccccggcaccagctgcctgccagatcctgaaggagcaaggcctgcgaccatacctgctcatccatgacggagtccgctcagaatttgatcagatcgacacatccaacccaaactgtgtggtaattgcagacgcaggagaaagcttttcttatcaaaacatgaataacgccttccaggtgctcatggagctggaaaaacctgtgctcatatcactgggaaaagggcgttactacaaggagacctctggcctgatgctggacgttggtccctacatgaaggcgcttgagtatgcctgtggcatcaaagccgaggtggtggggaagccttctcctgagtttttcaagtctgccctgcaagcgataggagtggaagcccaccagttactttcagtatgaaagcaagaagcagaaatgcctgcggcttttcctgagtttttgctgcttctctgaaaggataagaattgacaagtcctatcagtgtgttaatatatctcactggcaagacagtgtaacagcaagattacaacaatatggaggaaataataaagtcactcattttgcgaccttt

SEQ ID NO: 2285 - DNA, 3517 bp, Homo sapiens
gggcccgttctccgggcctggggggcgcgcgcccctggggtcccggcgctgcccgctgtggtgtccccggcaggcagagcgcgatccaggccgggacgacttgggaaagttctaagtaaagtttgatcagccggtttgatcggtctgacgtggtccaagagtctgacccaagggtttgcgactgggagaggaaatctgtgtcctggacaagattggattatggaagtgggaagtgaagaagaaaaatgggagaagctggatgcagaatttgatcactttgtggttgatatgaagccctttgttctaaaattacctcataggacagaacggcagaggtgtgctctttggattagaaagctgtgcgaaccttcaggaacaggtgcaggaataatggggaggaagaatcggaacctgtatgcaaaattgttattgcatatgcttaaacgaggtgcgcttgaaggcccttttacacaccgacctgaacccgggacactaaaaattctaccttcatacatgtccatctattttgatgaaccaaatccagcacgagcaaaaggttcaagcccagagggattaccagcctgggtactgggtgagctggagacaagtgaacacaaattaaatgaatcatggaaactctcttctggagaagataacactttagtacagtcgccaactgatgtctacagcagggaacagtacactgggaagctccgagtgagatcacactccttgagtccaactcacagagaagatggacaaaatattaccccaaagatttgtgaagtttattcgaaaaaatctcctgtttctttggatgatagtgacattgaagctcgccttaatagttggaatcttgggatagaaaatcctcgatacctgagacagaagcctatcccagtttctctgatgacaccgaaattcagcctgagaaaatccagcagtttccatgatgatcattttctctctcgaatacgtgagaaagagctggacatgaaaacaaaaatgatggaagctaaatttcatgaagaaaagcttaaactgcaacagaaacatgatgctgatgttcagaagattttagaaagaaagaataatgaaatagaagaactgaaaactttatacaggagtaaacaacatgaaactgaagagactattagaaagcttgaaaagaaagttcagacactgatacgtgactgtcaagttatcagagagactaaagaagaccagattgcagagctgaaaaagatatgtgaacaaagtacggaatctctaaataatgactgggaaaaaaagcttcacaatgctgtagcagaaatggaacaggaaaagtttgatcttcaaaagcaacacactgaaaacattcaagaattgcttgaggatacaaatgtgcgtctgaataaaatggagagtgaatacatggcgcaaacacagtccacaaaccacatgatcaaagaactggaggcccgtgtccagcagctgactggagaagcagagaacagtaatttacagaggcagaaattaattcaagaaaaagcagaacttgaaagatgttaccagataacgtgtagtgaattacaagaagtaaaggcaaggcgtaacacactgcataaagagaaggaccatcttgtaaatgattatgagcaaaacatgaaactgttacaaaccaaatatgatgctgatataaaccttctaaaacaagaacatgctctttcagcttctaaggcatctagtatgattgaagaattagagcagaatgtctgtcaattaaaacagcagttacaggaatcagaacttcaaagaaagcaacaactaagggatcaagaaaataagtttcagatggagaaaagtcatttaaaacacatctatgaaaaaaaggctcatgacttgcagagtgaacttgataaaggaaaagaagatactcaaaagaaaattcataaatttgaggaagctttgaaggaaaaagaggagcagctaactcgtgtgactgaagttcagaggttgcaggcccagcaggcagatgccgctctggaagagtttaagcggcaggtggaactgaactcagagaaagtctatgctgaaatgaaagagcagatggaaaaagtggaggcagatctaactagatccaaatctcttcgtgagaaacaatcaaaggagtttttatggcaactggaggacatcagacagcggtatgaacaacagatagtagagctgaagctggagcatgaacaggagaagacgcacctattacagcagcataacgcagagaaggatagcctagtccgagaccatgaacgggaaattgaaaacctggaaaaacagcttcgcgctgccaatatggagcacgaaaatcaaattcaggagttcaagaaacgagatgcacaggttattgccgacatggaggcccaggttcacaagttgagagaagaattgatcaatgtgaactcacagcggaaacagcagctggtagagcttggtcttcttcgtgaagaggaaaagcaaagggctacaagggaacatgagattgtcgtcaataaactgaaggctgaatcagaaaagatgaaaatagagctgaaaaagactcatgctgctgagacagagatgacactggaaaaggccaacagcaagctgaagcagattgagaaggaatacactcagaagcttgccaaatcttcacagatcatagcagaacttcagacaaccatttcctctctgaaagaagagaacagccagcagcagcttgctgcagaaaggcggctccaggatgttagacaaaagtttgaagatgagaagaagcagctgattagagataatgaccaagcaatcaaggttttacaagatgaattagaaaaccgttctaatcaggtgcgatgtgcagagaaaaaattacaacacaaagaattggagtcacaggaacagataacttacatacgacaagaatatgaaacaaaattgaaaggattgatgccagcatccctaagacaagaacttgaagacaccatttcctccctaaaatcacaggttaattttctgcaaaagagagcttccatccttcaggaagaactgactacatatcaaggcagaaggtaactgcacgagagaatgcaacggatgcaatttccaggctgtgctgtggacttcttccagcaggtttgaagatttggatattgtaaactgtgagatcagtggcattttttaaatccttaaatgtaattaagatcataaaaacatgcatcattcatacactagtggggtggttttatttgtgtctgcctaagttatttttttaacattcctttatttccgattttcatgtttgtgtgcatttgagtatgtgctgagaactgcttatattgggcaaagtgatttcctatgatatgccttgttaatccttttgcatagaattttaccagttgcgtacgatcaaaatcacgtttgtagtatcatatcaaaaattctaacctgtttacattgttttcatgttcatgttcctatgttattaaaatattattttgtactt

SEQ ID NO: 2286 - DNA, 1379 bp, Homo sapiens
taggcgccattttcgagtgaaggacccggagccgaaacaccggtaggagcggggaggtgggtactacacaaccgtctccagccttggtctgagtggactgtcctgcagcgaccatgccccgtaaaggcacccagccctccactgcccggcgcagagaggaagggccgccgccgccgtcccctgacggcgccagcagcgacgcggagcctgagccgccgtccggccgcacggagagcccagccaccgccgcagagactgcaagtgaggaacttgataatagaagtttagaagagattttgaacagcattcctcctcccccgcctccagcaatgaccaatgaagctggagctcctcggcttatgataactcatattgtaaaccagaacttcaaatcctatgctggggagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataaggaaggggatgattatgaagtcattcctaacagtaatttctatgtatccagaacggcctgcagagataatacttctgtctatcacataagtggaaagaaaaagacatttaaggatgttggaaatcttcttcgaagccatggaattgacttggaccataatagatttttaattttacagggtgaagttgaacaaattgctatgatgaaaccaaaaggccagactgaacacgatgagggtatgcttgaatatttagaagatataattggttgtggacggctaaatgaacctattaaagtcttgtgtcggagagttgaaatattaaatgaacacagaggagagaagttaaacagggtaaagatggtggaaaaggaaaaggatgccttagaaggagagaaaaacatagctatcgaatttcttaccttggaaaatgaaatatttagaaaaaagaatcatgtttgtcaatattatatttatgagttgcagaaacgaattgctgaaatggaaactcaaaaggaaaaaattcatgaagataccaaagaaattaatgagaagagcaatatactatcaaatgaaatgaaagctaagaataaagatgtaaaagatacagaaaagaaactgaataaaattacaaaatttattgaggagaataaagaaaaatttacacagctagatttggaagatgttcaagttagagaaaagttaaaacatgccacgagtaaagccaaaactggagaaacaacttcaaaaagaaaaaaa

SEQ ID NO: 2287 - DNA, 508 bp, Homo sapiens
gcataggtgataaaatcatggtggggagagagaacctatatattgagtcctggcttgatgcctttggtgtatatgtctgccgccttttaatctcttcccctctagattgcttcctgaggaggctggcacttctgaagatcctgaagaccctaaaggagattcacaggcaggtacccccagcactttagccctgtgtggccagcgccccatgcgcaagcgtctttctgccccagagttgcggctgagtctgactaaggggcctggaaatgatggagcttcacccacccagtctgcaccttcctctcctgatggcagttctgacctggagatagacgaattggagacaccttcagactcggagcagctggacagtggacatgaatttgaatgggaagatgaactaccccgggcagagggtctgggcaccagtgagacagctgaaaggctgggccgaggttgtatgtgggatgtgactggagaagatggacatcactggagggtgttccga

SEQ ID NO: 2288 - DNA, 2678 bp, Homo sapiens
atgggtaaagttgaaaattctaagagtgcccagggtctggctggtcttcgaaaccttgggaacacgtgcttcatgaactcaattctgcagtgcctgagcaacactcgggagttgagagattactgcctccagaggctctacatgcgggacctgcaccacggcagcaatgcacacacagccctcgtggaagagtttgcaaaactaattcagaccatatggacttcatcccccaatgatgtggtgagcccatctgagttcaagacccagatccagagatacgcaccgcgctttgttggctataatcagcaggatgctcaggagttccttcgctttcttctggatgggctccataacgaggtgaaccgagtgacactgagacctaagtccaaccctgagaacctcgatcatcttcctgatgacgagaaaggccgacagatgtggagaaaatatctagaacgggaagacagtaggatcggggatctctttgttgggcagctaaagagctcgctgacgtgtacagattgtggttactgttctacggtcttcgaccccttctgggacctctcactgcccattgctaagcgaggttatcctgaggtgacattaatggactgcatgaggctcttcaccaaagaggatgtgcttgatggagatgaaaagccaacatgctgtcgctgccgaggcagaaaacggtgtataaagaagttctccatccagaggttcccaaagatcttggtgctccatctgaagcggttctcagaatccaggatccgaaccagcaagctcacaacatttgtgaacttccccctaagagacctggacttaagagaatttgcctcagaaaacaccaaccatgctgtttacaacctgtacgctgtgtccaatcactccggaaccaccatgggtggccactatacagcctactgtcgcagtccagggacaggagaatggcacactttcaacgactccagcgtcactcccatgtcctccagccaagtgcgcaccagcgacgcctacctgctcttctacgaactggccagcccgccctcccgaatgtagcgccaggagccacgtcccttctcccttccccgtggtggccccgctccctaaattttttaaaaagacaaaaacaaaacaacaacaacaacacacaaacctgacaagagaaaaacaaacctgaagctgccgagcaggagtggatgcagcctgatcagggtctggagcaaggagccgggctttcctgagctgtggcccggcagggaagatcgcctggacgtggagccagcatcgccccgtgccctcggcgtttgcatttgtaaacttgtggtcttcctatgtgtcagaaacaactgtgtcttgggggggaagaccctcgctgcgccgcttcccgccgcagcgcccgcgcctccgaggggacagcgccctctggagctcgctgggagcatcaccgcctggacgcccgcgccgcggaggagccggcgcccatctccacccgcacggctcgccggtccagagccatgagccaagagccctcttcacgctgctaactccaggggacagacgaagggacatctttggaaaacgctggttttggtttttaaaaagcccaactttttttttttaatttccataactaaagtgttcagactggagtgctctccttcaggcctcttcatagctgggacgttgcactggtccttttattgcttttccaagtacaactttctaatgctagccctccgtggtgctaggtgggcgttggccaggccccaagcacagccacagtagacctgggatctaaaacaagtttctgttttgggggtttgggttttttttttttttttttaatgttttgaatggaatttagttgcctccaagaattgtgccttatagcatttggggaccagggggtaactgcccctcctgaaatatccctcagcctcttcccttttccccagtgctctgttcaaacccgcctgggaaagggatcctgcccttagccctggctcgttgtgcattgcagtgaggcaaagaagaaagcaggtagattccttccgacagggcatcaagttcttcccgcccacgtcctctagcccacccctggtctgctccccagctgtttgaaggatagcacaagcccctcgtccctagagcttctctcccttttatttattctcttaacatccctttccccctggccttcctgcccccgcccccttctcagagcctcctagacaataggccctttggaccgagtttctcagggatgcccaggccacccctcagctcttcttagcgctggtctccagtcctgccctgggagctggagcctgggtatttggggacatcttgcctcagttgtatggttctttcctgtgggctcaattttgccctacatagttggataaaactctgtgctgtcctggagagtaaagctgttcacccacacagctgggcccggcttgtgccccgtggagcctggcacattccaggctcctaggaggaggcatcagagaaagacaccctgagttttactggcctgacacccttctccagagaagacctgtgaacctgagcccaagggcaagtgtacacttgtttactgtgtaagcaagagtagaagaatgtctaatgtacagtggaaccttgtacagaataaataatagctttgagaaatc

SEQ ID NO: 2289 - DNA, 2190 bp, Homo sapiens
gcgtgctaggaggcgaggcgaggggcatgcgtgctaggaggcgaggcgaggggcatgcgtgctaggaggcgaggcgaggggcatgcgtgctaggaggcgaggcgaggggcatgcgtgctaggaggcgaggcgagggccaggtgctagggctagaaaggaggcagggctggcgctctagggactcctggagctctcctcctgtgagcctggacccggcacctcacgcagcccatctcccacagcttccgtcgacggaggccggggcctcaccaggaaagtggtttgccctccaatcagtggtctgccttcattttccagattgatgaagtctgcctcagagaaggggcaataggcgaatatgaagaccttagagcagagaaccagaaaacaaaggagaagtgtgacaaaattaggcaagaacgagatgaagccgttaaaaaactggaagaatttcagaaaatttctcacatggtcatagaggaagttaatttcatgcagaaccatcttgaaatagagaagacttgtcgagaaagtgctgaagctttggcaacaaagctaaataaagaaaataaaacgttgaaaagaatcagcatgttgtacatggccaagctgggaccagatgtaataactgaagagataaacattgatgatgaagattcgactacagacacagacggtgccgccgagacttgtgtctcagtacagtgtcagaagcaaattaaagaacttcgagatcaaattgtatctgttcaggaggaaaagaagattttagccattgagctggaaaatctcaagagcaaactcgtagaagtaattgaagaagtaaataaagttaaacaagaaaagactgttttaaattcagaagttcttgaacagagaaaagtcttagaaaaatgcaatagagtgtccatgttagctgtagaagagtatgaggagatgcaagtaaacctggagctggagaaggaccttcgaaagaaagcagagtcatttgcacaagagatgttcattgagcaaaacaagctaaagagacaaagccaccttctgctgcagagctccatccctgatcagcagcttttgaaagctttagacgaaaatgcaaaactcacccagcaacttgaagaagagagaattcagcatcaacaaaaggtcaaagaattagaagagcaactagaaaatgaaacactccacaaagaaatacacaacctcaaacagcaactggagcttctagaggaagataaaaaggaattggaattgaaatatcagaattctgaagagaaagccagaaatttaaagcactctgttgatgaactccagaaacgagtgaaccagtctgagaattcagtacctccaccacctcctcctccaccaccacttccccctccacctcccaatcctatccgatccctcatgtccatgatccggaaacgatcccaccccagtggcagtggtgctaagaaagaaaaggcaactcaaccagaaacaactgaagaagtcacagatctaaagaggcaagcagttgaagagatgatggatagaattaaaaagggagttcatcttagacccgttaatcagacagccagaccgaagacaaagccagaatcttcgaaaggctgcgaaagtgcagtggatgaactaaaaggaatactggggacacttaacaaatccactagttcaagaagcttaaaatcccttgaccctgaaaacagtgaaactgagttagaaaggattttgcgtcgcagaaaggtgacagcagaagcagatagcagtagtccaactgggatattagccacctcagagtccaaatccatgccagtgttgggttctgtatccagtgtaacaaaaacagccttgaacaagaaaactctggaggcagaattcaacagcccgtcccccccaacacctgagccaggtgaagggccccgtaaattggaaggatgcacaagttccaaggttacgtttcaataatctgaatcagaaaatactgcaactccttcctccttttgtctgccttttgttctccaaaagtaagtggaaattacatttccaagaaaggaaatgaaataattgcaggcccaaggtctgcaaaatatgtgttgaattgacagtgaaaaggatccatgtgttgacagacacagttgttagatgccataaaggcagatgtgaagctcaatttatttctcatcttgcttg

SEQ ID NO: 2290 - DNA, 2448 bp, Homo sapiens
attgcgtcccgctctacctctgtggttctttgggagcgacccccgggaagcgtccaaagtggagttcccacacacgctgcgaacccacagccggttttctctgaactcgcgtccctgagtccgggaggtggaggcggagaaaagggtgcggagcgaccccacgcagggccgccccccctcccaccagcgcgtcctgccgcgccggcagccacaggctggcatagcggctgccgacccgccctcgttcctccaccccctgaacgggactgctgggcccgccccgccccgcctgcaggtgaagcggccgcagccgccgagtaggtgcgtggggatgatctcactcgcgcgctccgcgccaggaggaggaggagcgggagcggatccaacttccgggtagtggagccgcaagccaccggcatcttgctttttcttccccctcctcctgtgtgccccgcgccgctccctctttcccttttattcccggccccacccgccaaaatgaacagctcggacgaagagaagcagctgcagctcattaccagtctgaaggagcaagcaataggcgaatatgaagaccttagagcagagaaccagaaaacaaaggagaagtgtgacaaaattaggcaagaacgagatgaagccgttaaaaaactggaagaatttcagaaaatttctcacatggtcatagaggaagttaatttcatgcagaaccatcttgaaatagagaagacttgtcgagaaagtgctgaagctttggcaacaaagctaaataaagaaaataaaacgttgaaaagaatcagcatgttgtacatggccaagctgggaccagatgtaataactgaagagataaacattgatgatgaagattcgactacagacacagacggtgccgccgagacttgtgtctcagtacagtgtcagaagcaaattaaagaacttcgagatcaaattgtatctgttcaggaggaaaagaagattttagccattgagctggaaaatctcaagagcaaactcgtagaagtaattgaagaagtaaataaagttaaacaagaaaagactgttttaaattcagaagttcttgaacagagaaaagtcttagaaaaatgcaatagagtgtccatgttagctgtagaagagtatgaggagatgcaagtaaacctggagctggagaaggaccttcgaaagaaagcagagtcatttgcacaagagatgttcattgagcaaaacaagctaaagagacaaagccaccttctgctgcagagctccatccctgatcagcagcttttgaaagctttagacgaaaatgcaaaactcacccagcaacttgaagaagagagaattcagcatcaacaaaaggtcaaagaattagaagagcaactagaaaatgaaacactccacaaagaaatacacaacctcaaacagcaactggagcttctagaggaagataaaaaggaattggaattgaaatatcagaattctgaagagaaagccagaaatttaaagcactctgttgatgaactccagaaacgagtgaaccagtctgagaattcagtacctccaccacctcctcctccaccaccacttccccctccacctcccaatcctatccgatccctcatgtccatgatccggaaacgatcccaccccagtggcagtggtgctaagaaagaaaaggcaactcaaccagaaacaactgaagaagtcacagatctaaagaggcaagcagttgaagagatgatggatagaattaaaaagggagttcatcttagacccgttaatcagacagccagaccgaagacaaagccagaatcttcgaaaggctgcgaaagtgcagtggatgaactaaaaggaatactggggacacttaacaaatccactagttcaagaagcttaaaatcccttgaccctgaaaacagtgaaactgagttagaaaggattttgcgtcgcagaaaggtgacagcagaagcagatagcagtagtccaactgggatattagccacctcagagtccaaatccatgccagtgttgggttctgtatccagtgtaacaaaaacagccttgaacaagaaaactctggaggcagaattcaacagcccgtcccccccaacacctgagccaggtgaagggccccgtaaattggaaggatgcacaagttccaaggttacgtttcagcctcccagtagcattggatgcaggaaaaaatacattgacggtgaaaaacaagccgaaccagttgtagttttagatcctgtttctacacatgaaccccaaaccaaagaccaggttgctgaaaaagatccaactcaacacaaggaggatgaaggcgaaattcaaccagaaaacaaagaagacagcattgaaaactttttcccttttcactttggttttgagggggttttgcccctggctggggtgacactgtcaaccaaagcaagggatcccaaatag

SEQ ID NO: 2291 - DNA, 1307 bp, Homo sapiens
agttttcacaaaggtctcttgatatcaaaacttctttccttgcatgcttctctgatcctgtggagatgaaaattgacatccatagtcatattctaccaaaagaatggccagatctaaaaaagaccctgagacaaggattcagatgcaagtagtttgctttggaggtgatcccaggaaacaccagtagagtgaggaagtgagacagggaaaacagggcagccagtgaaagaggtttggctacggaggctgggtgcagctccaacaccacagcaagggagaagcaaagttgttgaaagatgggaaagtcttcagagtggtgcgagagaattgctgggatccagaagttcgtattagagaaatggaccaaaaaggccaaacctgaggacactttaaacctgtgccagcttttaaacaacgaccttgccagcaccgttgtgagctaccccaggaggttcgtgggtctggggacgttgcccatgcaggcccctgagctggcggtcaaggagatggagcgctgtgtgaaagagctgggctttcccggggtccaaattggcacccacgtcaacgagtgggacctgaacgcgcaggagctctttcctgtctatgcggcagccgaaaggctgaagtgttccctgttcgtgcatccctgggacatgcagatggatggacgaatggccaaatactggctcccttggcttgtaggaatgccagcagagaccaccatagccatttgctccatgatcatgggtggagtatttgagaagtttcccaaactgaaagtgtgtttcgcacatggtggtggtgccttccccttcacagtgggaagaatctcccatggattcagcatgcgcccagatctgtgtgcccaggacaaccccatgaacccgaagaaataccttggttccttttacacagatgctttggttcatgatcctctgtccctcaagctgttaacagatgtcataggaaaggataaagtcattttgggaaccgattacccctttccactaggtgagctggaacctgggaaactaatagagtccatggaagaatttgatgaagaaacaaagaataaactcaaagccggcaatgccctggcatttttgggtcttgagagaaaacaatttgaatgactgaatttactacaaaggcaaactttcaaaaggatatctcatttttgtttctaaatatgtatcaacaggtatcaacaaaatcctattttgaactattttactcagaaatgaatgtcccaaatatcctaaattattcataataaaaatgatttgtaagtgttttcattctgaaaa

SEQ ID NO: 2292 - DNA, 6841 bp, Homo sapiens
aaagcgaggagaggaggcgtgagagagcgtgcctgcccgccgcacacggggctggtttccggagtgcgtctctagagggatgcacgttgccttagccgagcttcggagagaagcctgatatgtaacccaggcaggtgggagcctcagtctgtcgggctgaggtctggcatctacaaagcctcttggccgtgttctgaacttgaagcctggaggagttctctgctcagcacagccaaggaacagaattagaagaaaaggaaccctggcctgaggcaggtgacaaacattaccaccccagctgtgcacgatgcagcagatgcaaccagatgttcacagaaggagaggaaatgtatcttcaaggctccaccgtttggcatcccgactgtaagcaatctacgaagaccgaggaaaagctgcggctgccaaacattcggcgttcttcatccgatttcttttattccaaaagtctgattcgacgcacaggacggtctccgtctctgcagcctaccaggacatcctcggaaagtatttattctaggccaggctccagtattcctggctcaccaggtcatactatctatgcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctgatcaaggaatcaacatttaccgaaagccacccatctacaaacagcatgctgccttggcagcccagagcaagtcctcagaagatatcatcaagttttccaagttcccagcagcccaggcaccagaccccagcgagacaccaaagattgagacggaccactggcctggtcccccctcatttgctgtcgtaggacctgacatgaaacgcagatctagtggcagagaggaagatgatgaggaacttctgagacgtcggcagcttcaagaagagcaattaatgaagcttaactcaggcctgggacagttgatcttgaaagaagagatggagaaagagagccgggaaaggtcatctctgttagccagtcgctacgattctcccatcaactcagcttcacatattccatcatctaaaactgcatctctccctggctatggaagaaatgggcttcaccggcctgtttctaccgacttcgctcagtataacagctatggggatgtcagcgggggagtgcgagattaccagacactcccagatggccacatgcctgcaatgagaatggaccgaggagtgtctatgcccaacatgttggaaccaaagatatttccatatgaaatgctcatggtgaccaacagagggcgaaacaaaatcctcagagaggtggacagaaccaggctggagcgccacttagcccctgaagtgtttcgggaaatctttggaatgtccatacaggagtttgacaggttacctctttggagacgcaacgacatgaagaaaaaagcaaaactcttctaagtcccactcgtgaatggcaattagagaaaggactgacagtggcggtgccccataggatgtcatattgaggcccaaacttgattggagaatttgcaaactaccgtcgctcagcaacaccaaaaagagaaagtctggttaaaacaccatgagtcaaatgtcgggccagccaacagtaacacttgccaagaagcatggcgtagaaatttctatgttccgaaacacagagtagtgtccacatgtgagcttttcacattaccttatgtatacaacaggagctgcgttgttttcttctttttcttttcctttatctgttgtccaacaacagtgctgactgtccggataagagctggcaagtgcccttaggatgccgcatgggaaaaatcggttatcataatttcaaagtataaatatatttattaagtagcgctgcggctaagaaggaagagtgaggggtctgtccatggggtggcagtgatttcacacccgcctttcttgaatggcttcgtgttactcagccgtgccctggcaggaatggaactccatcagggaacagggcagctctgtttgaatggggtgaaaaacagcaaaattaattcttagcaagctccttgttctctactgttcaccgggacctggctggcaaatgacttagctattagtatatttaaaaactgttcaaaagcaaaagagaaggaacaggaatgaaaggaaaccttcccttaactctttctgcttcccatagcaggtctggttcctgctccccgcctaggacaggagctgtctggagctccacctttgcaaagaaaggaaaaacacaaattgcccccagattggcccagtggcatgccattaggtgattttgcataggggccatatcattcatggccaaaaaaaaccaaaaagcaaaaaacaaaaacaagtcccatgtcctactgactctagttcttccagtcgttatcctctgctgtctctctggcatcctatgaatcagatcaagcccatgctgttgttggtttttaaggtttctttcaataataggctaaggaaagacatgtttttctcttttaaatctctgcaactccaaagtagactccttcgaacgtatttaatttggccttttcagctttcttcttgcccagctctgtcgaattcatgggtgtgtgtgcacatgttggtttcactcacccagagtaattttgtgagcatgcatgtgctttttaatttctgcttgaatgtttgtcctgctgtgttgcagcttctaaagacattgtcaccgagtgtgtgtgactcaaagatcaagagtgaggctaaactgcgaccccaacatcacttccttcatggaaaggtgttggcgctgatgtagctcatggaaggatcagactgggaaccacagaggaaggatgaggtgggatgtggaggtcagagcatctcacgagagtccctcaggctctgcaacactagattcgaatatgagcctagggtttccccaacacgtgcgtgcatatgaaaccacatcatgattcccgacgtgagttagatgagggagagtttgtgtaactccacacccaggagggtaagccactttattatcatgctttggggctgtgcttaagaatttaagctctgttttaaagccgaagaagaaaacatttgaatttaccttcatatgccactaagaacaaaagctctgaagttcttcctgctggcaccaaatattaggattacaagctgtctctctgacaccagtggtaaaaaagcaagtagaatagtttctgagtctgtgttgcagcctctgacacgtggctcaccgctgtcatttgggggatggaatgaacagtcactgttctatagcatcctcctgtgctcttacctaaggaatctaaattgtcctagccttccattgctatgcactgaatgaggactactctcgtgtgtgtgtgtgtgtgtgtgtgtgtgtgtgtgtgtgtgtgtgtgtgtgttggatctactaacatgtttagcaaatggctctgacagggtggccatgagcagatgagaccagctcttgcttggttggaagccacactgcagtttgcagtttagcctttggtgtctcagtggcttcttgcttattccatgctttttctatcccatcctctctctgtgccctcctgcaatggcagccttggcacaatgcctgggtgtcctcatccttgctttactctggaaagtgtggggatggagaggatggtgcatttccagtgcttccttacctgtcaataacaatggtggccacctgggtcccagcacttggctggtggagagatttttttcattatggagctaataaagggtccctacgttttacattgattaatgaattatcacccagacatgtgcagatgaaatgtcaatataagaaaaatcaaggtatttgggaaacatgggcataatcaggtagttttgctaaaattcctcttccttggtctacataaagaagacatgggtctgtcatagaatggggacattagactgaaaactgggacaacccccttccttattttatagagactaggagttaaggggcctgcctaagattgcagtgataaagaactgaaccctaaatcagctcccactaatgaaaccctgctttccttgtatcttttaaactcagttctgcatccaacttgagaagaaaaaaagcttctttccatatcaagtaccatatgagttcatttaaactgcaccttgcagaaatgcattgccagaaagcaccagtagcctcctatctgcaagcagagtagtgctctgctctggggaggggtcattggaaaccataatgcagagtgggccccctactccatttcccagcaaaaggctccagctggagggatgggttgtggggcaacctggttcctgctaactgccagattgaatgtgtgggctagaatgcctgcacatttagttaaactgggctcagcatgcttgtcctcaaaatgtccatcctggtcacagcacacaagatggctattggtctgcttttaccctaccctgtactatacatgaaaattccagttattaacacactcaaactggtggagcttgttcaccctaggaaggggattgtatatatggcaggcttccctggtgccgatgtaaagggctacatttgggaacatttgacttccttgggactcttaagtgcataatgatggcatgaagtaaaaggggcctcaatgatgataggaaaatcagttcttttaaaatttcttcaagaaaatccaggctatcacatagtctttctgtgtgacttattaggagataggaagagcattgggaaacttgcacagctagctatgcatctacattttggtttggggttagttatgaaatgttcttaatatgacgtgttcaataacttcacataaacttcctgttctccaaaacctcaaagagatagagttaatgagttgttgtttttttttaaatgggggtagttttctatctgtcatgggctctagcatctactccgctacccaattctgtcatctccaagctgagtttcctcttctgaggcagaggctggagcagttctttttcagttctcatcctctccatcccaatccagtatatcaatcaactctaactcggagacgtctagctggcaatgtttctaaaactttcactggatttctttagacattgaagcaaacatttttttctaagaattgcttctcagatgatgatatcaaatgtatatgcttttgcaagtttgaaaagttcaaattaaccacttttgactaggtaagtctttctaaaaaccatttaaagctaactgggtcttagcatcctcctgtgtatggaagagacaggtgaccgctccaggttgggtgctcacagaacccttttcctgactctcatggaagatggtggaaggaaaatagactgtctcatcaaccctcctgtgtcctctgaagcaatctcagtttttattaaccacctcttctgtgtttctggtagctatttaacctgtatttaatctgtacttcctatgccagcctcaattttatttgatttttacaattattctcttctaaccaatgaagtgtttgtcagtatgccccaaagcttgctcttttgtgctcccttttgaataactttctatccagaaaaagagattatttgggacttgagatttgcagtgataccaacttatagcaatgatgtactttaagggaactacccaactatgttgtgatagaagaaagagaaaccttcactttggcatttttttttaatcactgtttatttttctgtttgcggcccaggaagcagtgggaggtggtggcagatatgctttgcatatggattgttatgtttttatttgggcaagtttaatcatggaaaactcaaaaagaaggggggaaatggtcagtttaagccaaaagaaactttctaaacaatgtataggtacacagcaaaattaaacaaatccaacaatttctgaagcttagtgtaattgagtggtggttgttattcaataaaattattcccaaaagtgtttctcctaagagtgcagttcccatgagtcacttcctgaacccattgaccaaaggtggacagagacaatcctgtagaccttgacattcagaaagatgtgagctgcttactgatcatatatgcatacgtttctttacagcagaggaaaccattgtccacaaaactgatgttcttttggggttttatgtacagacttgtccaatcatgtgtgtggttcctgcgagttgctgatgactccgcattgaagctctctgagttctttgattttaagttgggtttatggaattttttcaaatgttggaaggtgtgtggttcttcctgccctccctccccttttggaaatatgaaagcaaatgtttagaagaattccttttgaaaagctgtgtcgtgttccctgtgaaactgagcaggtgtgtgttggcgcgctaagtgccacatgcttgtgtgtagaggaggaggtggccctgccggctccgcgctgctgtgcctgtgatccctacctgctccccgctcctgttgccagcagcactcactgcactcctttgtcatatactctgcatcactgtcatactcacaacttcgtgaataaagttgtgtgctttattcgt

SEQ ID NO: 2293 - DNA, 7105 bp, Homo sapiens
ggtctcatgctttcatctcccagtgggtgtgcagacactggagagacccagtggcccaccctcaggaccctcaccacccatcagagaagcctgtcattcactgccataaatgtggggagccttgcaagggtgaagtgcttcgggtccagaccaaacatttccacatcaagtgtttcacctgcaaagtgtgtggctgtgacctggcacaagggggcttcttcataaagaacggagagtatctctgcaccctggactaccatcccaattgctttgcttgtactatctgcaagcgcccgtttccacccggagaccgagtcacattcaatgggagagactgcctttgtcaactctgtgcacagccgatgtcgtccagtccgaaagaaaccaccttctccagcaattgtgccggctgcggaagagatatcaagaatgggcaggcgctgctggcgctggataagcagtggcacttggggtgctttaaatgcaagtcctgcgggaaggtcctcaccggggagtacatcagcaaggatggtgctccgtactgtgaaaaggactaccagggactctttggggtgaaatgtgaggcgtgtcaccagtttatcacagggaaagtcctggaggcaggtgacaaacattaccaccccagctgtgcacgatgcagcagatgcaaccagatgttcacagaaggagaggaaatgtatcttcaaggctccaccgtttggcatcccgactgtaagcaatctacgaagaccgaggaaaagctgcggcctaccaggacatcctcggaaagtatttattctaggccaggctccagtattcctggctcaccaggtcatactatctatgcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctgatcaaggaatcaacatttaccgaaagccacccatctacaaacagcatgctgccttggcagcccagagcaagtcctcagaagatatcatcaagttttccaagttcccagcagcccaggcaccagaccccagcgagacaccaaagattgagacggaccactggcctggtcccccctcatttgctgtcgtaggacctgacatgaaacgcagatctagtggcagagaggaagatgatgaggaacttctgagacgtcggcagcttcaagaagagcaattaatgaagcttaactcaggcctgggacagttgatcttgaaagaagagatggagaaagagagccgggaaaggtcatctctgttagccagtcgctacgattctcccatcaactcagcttcacatattccatcatctaaaactgcatctctccctggctatggaagaaatgggcttcaccggcctgtttctaccgacttcgctcagtataacagctatggggatgtcagcgggggagtgcgagattaccagacactcccagatggccacatgcctgcaatgagaatggaccgaggagtgtctatgcccaacatgttggaaccaaagatatttccatatgaaatgctcatggtgaccaacagagggcgaaacaaaatcctcagagaggtggacagaaccaggctggagcgccacttagcccctgaagtgtttcgggaaatctttggaatgtccatacaggagtttgacaggttacctctttggagacgcaacgacatgaagaaaaaagcaaaactcttctaagtcccactcgtgaatggcaattagagaaaggactgacagtggcggtgccccataggatgtcatattgaggcccaaacttgattggagaatttgcaaactaccgtcgctcagcaacaccaaaaagagaaagtctggttaaaacaccatgagtcaaatgtcgggccagccaacagtaacacttgccaagaagcatggcgtagaaatttctatgttccgaaacacagagtagtgtccacatgtgagcttttcacattaccttatgtatacaacaggagctgcgttgttttcttctttttcttttcctttatctgttgtccaacaacagtgctgactgtccggataagagctggcaagtgcccttaggatgccgcatgggaaaaatcggttatcataatttcaaagtataaatatatttattaagtagcgctgcggctaagaaggaagagtgaggggtctgtccatggggtggcagtgatttcacacccgcctttcttgaatggcttcgtgttactcagccgtgccctggcaggaatggaactccatcagggaacagggcagctctgtttgaatggggtgaaaaacagcaaaattaattcttagcaagctccttgttctctactgttcaccgggacctggctggcaaatgacttagctattagtatatttaaaaactgttcaaaagcaaaagagaaggaacaggaatgaaaggaaaccttcccttaactctttctgcttcccatagcaggtctggttcctgctccccgcctaggacaggagctgtctggagctccacctttgcaaagaaaggaaaaacacaaattgcccccagattggcccagtggcatgccattaggtgattttgcataggggccatatcattcatggccaaaaaaaaccaaaaagcaaaaaacaaaaacaagtcccatgtcctactgactctagttcttccagtcgttatcctctgctgtctctctggcatcctatgaatcagatcaagcccatgctgttgttggtttttaaggtttctttcaataataggctaaggaaagacatgtttttctcttttaaatctctgcaactccaaagtagactccttcgaacgtatttaatttggccttttcagctttcttcttgcccagctctgtcgaattcatgggtgtgtgtgcacatgttggtttcactcacccagagtaattttgtgagcatgcatgtgctttttaatttctgcttgaatgtttgtcctgctgtgttgcagcttctaaagacattgtcaccgagtgtgtgtgactcaaagatcaagagtgaggctaaactgcgaccccaacatcacttccttcatggaaaggtgttggcgctgatgtagctcatggaaggatcagactgggaaccacagaggaaggatgaggtgggatgtggaggtcagagcatctcacgagagtccctcaggctctgcaacactagattcgaatatgagcctagggtttccccaacacgtgcgtgcatatgaaaccacatcatgattcccgacgtgagttagatgagggagagtttgtgtaactccacacccaggagggtaagccactttattatcatgctttggggctgtgcttaagaatttaagctctgttttaaagccgaagaagaaaacatttgaatttaccttcatatgccactaagaacaaaagctctgaagttcttcctgctggcaccaaatattaggattacaagctgtctctctgacaccagtggtaaaaaagcaagtagaatagtttctgagtctgtgttgcagcctctgacacgtggctcaccgctgtcatttgggggatggaatgaacagtcactgttctatagcatcctcctgtgctcttacctaaggaatctaaattgtcctagccttccattgctatgcactgaatgaggactactctcgtgtgtgtgtgtgtgtgtgtgtgtgtgtgtgtgtgtgtgtgtgtgtgtgttggatctactaacatgtttagcaaatggctctgacagggtggccatgagcagatgagaccagctcttgcttggttggaagccacactgcagtttgcagtttagcctttggtgtctcagtggcttcttgcttattccatgctttttctatcccatcctctctctgtgccctcctgcaatggcagccttggcacaatgcctgggtgtcctcatccttgctttactctggaaagtgtggggatggagaggatggtgcatttccagtgcttccttacctgtcaataacaatggtggccacctgggtcccagcacttggctggtggagagatttttttcattatggagctaataaagggtccctacgttttacattgattaatgaattatcacccagacatgtgcagatgaaatgtcaatataagaaaaatcaaggtatttgggaaacatgggcataatcaggtagttttgctaaaattcctcttccttggtctacataaagaagacatgggtctgtcatagaatggggacattagactgaaaactgggacaacccccttccttattttatagagactaggagttaaggggcctgcctaagattgcagtgataaagaactgaaccctaaatcagctcccactaatgaaaccctgctttccttgtatcttttaaactcagttctgcatccaacttgagaagaaaaaaagcttctttccatatcaagtaccatatgagttcatttaaactgcaccttgcagaaatgcattgccagaaagcaccagtagcctcctatctgcaagcagagtagtgctctgctctggggaggggtcattggaaaccataatgcagagtgggccccctactccatttcccagcaaaaggctccagctggagggatgggttgtggggcaacctggttcctgctaactgccagattgaatgtgtgggctagaatgcctgcacatttagttaaactgggctcagcatgcttgtcctcaaaatgtccatcctggtcacagcacacaagatggctattggtctgcttttaccctaccctgtactatacatgaaaattccagttattaacacactcaaactggtggagcttgttcaccctaggaaggggattgtatatatggcaggcttccctggtgccgatgtaaagggctacatttgggaacatttgacttccttgggactcttaagtgcataatgatggcatgaagtaaaaggggcctcaatgatgataggaaaatcagttcttttaaaatttcttcaagaaaatccaggctatcacatagtctttctgtgtgacttattaggagataggaagagcattgggaaacttgcacagctagctatgcatctacattttggtttggggttagttatgaaatgttcttaatatgacgtgttcaataacttcacataaacttcctgttctccaaaacctcaaagagatagagttaatgagttgttgtttttttttaaatgggggtagttttctatctgtcatgggctctagcatctactccgctacccaattctgtcatctccaagctgagtttcctcttctgaggcagaggctggagcagttctttttcagttctcatcctctccatcccaatccagtatatcaatcaactctaactcggagacgtctagctggcaatgtttctaaaactttcactggatttctttagacattgaagcaaacatttttttctaagaattgcttctcagatgatgatatcaaatgtatatgcttttgcaagtttgaaaagttcaaattaaccacttttgactaggtaagtctttctaaaaaccatttaaagctaactgggtcttagcatcctcctgtgtatggaagagacaggtgaccgctccaggttgggtgctcacagaacccttttcctgactctcatggaagatggtggaaggaaaatagactgtctcatcaaccctcctgtgtcctctgaagcaatctcagtttttattaaccacctcttctgtgtttctggtagctatttaacctgtatttaatctgtacttcctatgccagcctcaattttatttgatttttacaattattctcttctaaccaatgaagtgtttgtcagtatgccccaaagcttgctcttttgtgctcccttttgaataactttctatccagaaaaagagattatttgggacttgagatttgcagtgataccaacttatagcaatgatgtactttaagggaactacccaactatgttgtgatagaagaaagagaaaccttcactttggcatttttttttaatcactgtttatttttctgtttgcggcccaggaagcagtgggaggtggtggcagatatgctttgcatatggattgttatgtttttatttgggcaagtttaatcatggaaaactcaaaaagaaggggggaaatggtcagtttaagccaaaagaaactttctaaacaatgtataggtacacagcaaaattaaacaaatccaacaatttctgaagcttagtgtaattgagtggtggttgttattcaataaaattattcccaaaagtgtttctcctaagagtgcagttcccatgagtcacttcctgaacccattgaccaaaggtggacagagacaatcctgtagaccttgacattcagaaagatgtgagctgcttactgatcatatatgcatacgtttctttacagcagaggaaaccattgtccacaaaactgatgttcttttggggttttatgtacagacttgtccaatcatgtgtgtggttcctgcgagttgctgatgactccgcattgaagctctctgagttctttgattttaagttgggtttatggaattttttcaaatgttggaaggtgtgtggttcttcctgccctccctccccttttggaaatatgaaagcaaatgtttagaagaattccttttgaaaagctgtgtcgtgttccctgtgaaactgagcaggtgtgtgttggcgcgctaagtgccacatgcttgtgtgtagaggaggaggtggccctgccggctccgcgctgctgtgcctgtgatccctacctgctccccgctcctgttgccagcagcactcactgcactcctttgtcatatactctgcatcactgtcatactcacaacttcgtgaataaagttgtgtgctttattcgt

SEQ ID NO: 2294 - DNA, 2299 bp, Homo sapiens
atgacccagcagtggagggaagtgaatgaggacagagaagcagtggcccaggccaggagctggcaatcgctgaatctgggcgatagggacatgggggtcagtttcatcgaaactgccttggcgctctctgcagcccgggcccgccgccctctccttacctcccatcccccatcccgccccttccagcctcccaagcacacgccctcgcccccacccgccccccgcgttaattcgcgccatccagggcgctctgtgagtctgtcattacccagcgcgagtcaggcccctcctgtgcccctcgccagccccgaggggcgcccgcacacagtcggcgccccacacgcaagtacctggaagagaacaagaggacgccagcgggcgcggccgccaaagatcgttaaggaggctgaggtgccgcaggctgcgctgggcgtcccagcccaggggacaggggacaatggccacacgcctgtggaggaggaggtcgggggcatcccagtaccagcaccggggctcctgcaggtcacggagaggaggcagcctctgagcagcgtctcctctctggaggtccacttcgacctcctggacctcactgagctcaccgacatgtcggaccaggagctggccgaggtctttgctgactcggacgacgagaacctcaacaccgagtccccagcaggtctgcacccgctgccccgggccggctacctgcgctccccttcctggacgaggacaagggctgagcagagccacgagaagcagcccctaggcgaccccgagcggcaggccacagtcctggacacgtttctcactgtggagaggccccaggaggactagaccatctccacctgccccagctcctgcagggatggggtccgaacacgatggcagatctgggcagtgctgacccagcagacacacttcacccgcccacgaggctccagccgtcacctcctgacacacaccctgggggcagctctctgccagccccgagaccggccttgtctgctgggcacgggtcttcgcctcacttggagaccagccggctttcctgggggacacacggggcccccggatgcctctgggagccccagcacaagcacagcccagtggccttacgtccagctcgttcctgggccccgagtcaggaagacagcgtcacggagtcactgccaggaacgtgctgaggaatggagtggcccacggcggccttggggtgaaggggacccaggcctgtgacagccactccaggaactcctgggggtgctccaacctccgcgttttcctgtgctgccaagctcagaagccagaggcgggtttggtagtggctaatgggacaatgtgctgtccagcaaagcacacatggagaagcggccccaaaattcccaccttgatttccatcctgccccttcttctactccacggaggcgctgtctcactagggtcccctccccaaggctcagctctaagacctgcacctgcttctcttggcccctgcgtgacagacaagtccattccctccttagctcagaacaccaaatatcaccagactgcctaagagacttgatgacacctcccggaatgctctcggggtggggttcacctctccttgtcctgcacccactgctaggccacattctcgtttctgctcacatcccattgcccggctacaaggcctgcccacggcccttaaacttgctgggcaggtttggagcccatgggaccccgtgggtctctgtccaggagcagcagaggaggctgacaggccctgctccctctgctctgggggtgtctgggagccccagctcacaccctcccaatgcttatatgctgaagctcacagaatgggcttcttgcctgacagcaagtcaaagaatgagtttaatatcaaagtgtaagcttactttccatccccaagccagcctgccccctgccccatttcccatgagcacacttctggggaaggaaaacaggctcctggccttcactctcagcagagctttggagatgccccaggcatgccctgagctccttctgtgtacctgctcccacttctgagccacccgctgcccctccgcactgctggcaaacccagttcctgcctcagccaggtctccttccctggtttccagtcacacagagcccagcagctttctctttcagtcccataagggcagccttgtgtccctggccacacttccacccgccagggtcttcctccccatctttccatccttcctgctgagcttccacagagctcgtttgcaaacagggggattaaagcatcactgcgcattcg

SEQ ID NO: 2295 - DNA, 927 bp, Homo sapiens
gcggcggccatctctgggcggcggcggcgggcggtgtttgcgcggtcggtgagacccgcgcgggtgagacgctggccctccttacagcctagaaaaaatgacagatctcgtagctgtttgggatgttgctttaagtgacggagtccacaagatcgaatttgaacatgggactacatcaggcaaacgagtagtatatgtagatggaaaggaagagataagaaaagagtggatgttcaaattagtgggcaaagaaacattctatgttggagctgcaaagacaaaagcgaccataaatatagacgctatcagtggttttgcttatgaatatactctggaaattaatgggaaaagtctcaagaagtatatggaggacagatcaaaaaccaccaatacttgggtattacacatggatggtgagaactttagaattgttttggaaaaagatgctatggacgtatggtgcaatggtaaaaaattggagacagcgggtgagtttgtagatgatgggactgaaactcacttcagtatcgggaaccatgactgttacataaaggctgtcagtagtgggaagcggaaagaagggattattcatactctcattgtggataatagagaaatcccagagattgcaagttaatgaattttcatcttaagaagtaaagatcaggactttttaattactgtggtaattaaatgtgttcagtatgtacttatcagtacatttagtctgcaatgttttaattttttaaaaagttacatgaaactaacattccaagggtcaggaaaaaaaccaattatgtatagtcataaaaattacaatttatgatgcaaataatgtaaaatgttttaaagacaaatggcaaataagatatggaccaaagtcactaatgttttacaacagtaacctttactataataaatactttt

SEQ ID NO: 2296 - DNA, 946 bp, Homo sapiens
ggccacgcggcctacgcagccgagtcggaaccaaccggttgtttggtgaaacctaccccagagcctcccgcggcccacagagcacagccctccttacagcctagaaaaaatgacagatctcgtagctgtttgggatgttgctttaagtgacggagtccacaagatcgaatttgaacatgggactacatcaggcaaacgagtagtatatgtagatggaaaggaagagataagaaaagagtggatgttcaaattagtgggcaaagaaacattctatgttggagctgcaaagacaaaagcgaccataaatatagacgctatcagtggttttgcttatgaatatactctggaaattaatgggaaaagtctcaagaagtatatggaggacagatcaaaaaccaccaatacttgggtattacacatggatggtgagaactttagaattgttttggaaaaagatgctatggacgtatggtgcaatggtaaaaaattggagacagcgggtgagtttgtagatgatgggactgaaactcacttcagtatcgggaaccatgactgttacataaaggctgtcagtagtgggaagcggaaagaagggattattcatactctcattgtggataatagagaaatcccagagattgcaagttaatgaattttcatcttaagaagtaaagatcaggactttttaattactgtggtaattaaatgtgttcagtatgtacttatcagtacatttagtctgcaatgttttaattttttaaaaagttacatgaaactaacattccaagggtcaggaaaaaaaccaattatgtatagtcataaaaattacaatttatgatgcaaataatgtaaaatgttttaaagacaaatggcaaataagatatggaccaaagtcactaatgttttacaacagtaacctttactataataaatacttttaaaaaaa

SEQ ID NO: 2297 - DNA, 1412 bp, Homo sapiens
agttgcaacttgtctttgagtgcagggacaggagaagtgtgggctacccggccactgccctggagctgtggtgactgctgcgtttttctcccatgcacttgcacgtccaggactcctgggagaacttgggccacactccttccttgccctcttgagctcattcgtcaccctgttgggtgagcacagccctagctcaggccactgggcaagccacaccatccaaagaggaggtcctctgccccaggacccccacaccaccccagctccctgtttcgctgaggcctggagcccccatggcctcactgagccgagccctacgtgtggctgctgcccaccctcgccagagccctacccggggcatggggccatgcaacctgtccagcgcagctggccccacagccgagaagagtgtgccatatcagcggaccctgaaggagggacagggcacctcggtggtggcccaaggcccaagccggcccctgcccagcacggccaacgtggtggtcattggtggaggcagcttgggctgccagaccctgtaccacctggccaagctgggcatgagtggggcggtgctgctggagcgggagcggctgacctccgggaccacctggcacacggcaggcctgctgtggcagctgcggcccagtgacgtggaggtggagcttctggcccacactcggcgggtggtgagccgggagctggaggaggagacgggactacacacgggctggatccagaatgggggcctcttcatcgcgtccaaccggcagcgcctggacgagtacaagaggctcatgtcgctgggcaaggcgtatggtgtggaatcccatgtgctgagcccggcagagaccaagactctgtacccgctgatgaatgtggacgacctctacgggaccctgtatgtgccgcacgacggtaccatggaccccgctggcacctgtaccaccctcgccagggcagcttctgcccgaggagcacaggtcattgagaactgcccagtgaccggcattcgtgtgtggacggatgattttggggtgcggcgggtcgcgggtgtggagactcagcatggttccatccagacaccctgcgtggtcaactgtgcaggagtgtgggcaagtgctgtgggccggatggctggagtcaaggtcccgctggtggccatgcaccatgcctatgtcgtcaccgagcgcatcgaggggattcagaacatgcccaatgtccgtgatcatgatgcctctgtctacctccgcctccaaggggatgccttgtctgtgggtggctatgaggccaaccccatcttttgggaggaggcagtcaaatacagacccagggcagctggagggctttgcctcaaaacatccacagagaaggtctgcgcagtgtggagtgatgacctcagaagggcatga

SEQ ID NO: 2298 - DNA, 3100 bp, Homo sapiens
cgcggctgcatggacgcgggtccggcgcgcgggaggcgatgacggccccgccatggcccgggcgggcagctgcggcggcgccgcggcgggcgcagggcggccggagccctgggagctgtccctggaggaggtgctgaaggcctacgagcagccgctcaacgaggagcaggcgtgggccgtgtgcttccagggctgccgcgggctgcggggctcgccgggccggcgcctgcgggataccggggacctcctgctgcgcggggacggctcggtcggggcgcgggagcccgaggccgcggaacctgcaaccatggtcgtgccactagccagctcggaagcccagaccgtgcagtccctcggcttcgccatctaccgcgcgctggactgggggctggacgagagcgaggagcgcgaactcagccctcagctggagcggctcatcgacctcatggccaacaacgacagcgaggacagcggctgcggtgccgccgatgagggctacgggggtcccgaggaggaggaggaggccgagggcgtcccccgcagcgtgcgcacctttgcccaggccatgcggctgtgcgcggcgcggctgaccgacccccggggcgcacaggcgcattaccaggccgtgtgccgcgcgctcttcgtggagacgctggagctgcgggccttcctggccagggtccgggaggccaaggagatgctgcagaagcttcgggaggacgagccgcatctggagacgcctcgggcagagctggacagcctgggtcacacagactgggcccgactgtgggttcagctcatgcgggagctccgccgcggagtgaagctgaagaaggtgcaagagcaggagttcaaccccctccccaccgagttccagctcacgcccttcgagatgctgatgcaggacatccgggcccggaactacaagctgcgcaaggtcatggtggatggggacatcccgccccgggtgaagaaggacgctcacgagctcatcctggactttatccgctcacggcctccactgaagcaggtctctgagaggcggctgcgcccgttgccaccaaagcaaaggtccctgcatgagaagatcctggaggagatcaagcaggagcggaggctgcgcccggtgcggggcgagggctgggctgcccgcgggtttggctctctgccctgcatcctcaacgcctgctccggagatgccaagtccacctcctgcatcaacctgtcagtcacagatgctgggggcagcgcccagcgcccgcggccccgcgtgctgctcaaggcgcctaccttggctgaaatggaagagatgaatacatctgaggaagaagagtctccgtgtggggaggtgacgctgaaacgggaccgctccttctcagagcatgacctggcccagctccgaagtgaggtggcctctggcctgcagtcggccacccaccccccaggagggacggagccaccacggccccgagctggcagtgcgcatgtgtggaggcccggctcccgagaccagggtacctgtcccgcgagtgtctctgaccccagccaccccctactcagcaaccggggctcctcgggggacagacccgaggcctccatgacccccgatgccaaacacctgtggctggagttcagccaccccgtggagagcctggcgctgactgtggaagaggtgatggacgtgcgccgtgtgctggtgaaggccgagatggaaaagtttttgcagaacaaggagctcttcagcagtctgaagaaggggaagatttgctgctgctgccgggccaagttcccgctgttctcgtggccgcccagctgtctcttctgcaagaggtctctgcaagggccacagtggcagagcgtggaggaggcgttcccccacatctactcccacggctgtgtcctgaaggatgtctgcagtgagtgcaccagctttgtggcagacgtggtgcgttccagccgcaagagcgtggacgtcctcaacactacgccacgacgcagtcgccagacccaatccctctacatccctaacaccaggactcttgacttcaagtgacagccccaggtggccaggcctccaggaggcaccaggcaggccctgtatcaggctaggacgctctgagctgtgcatgtacatatatacatatatagatacatttataatatatacacacagtctatatatttatatacactgtttcctggccccagagctcatttgggttcaggcgcacttcaaaaccctccctgggggaggctgtttcttctcaggattccttgccagggaggaaggggagggaacagggtgggttttctcactgaagagagaaagcagaaggttctagatcctggcacagactgcatcccatgttcccatgctcttctccgtccccaggaatgcgaacggcagtttcccttccccagtggacgtctaggtggggacagggtatcttggctcccagctggaccagagtgccctgcttgcctctgctctccctttgtggggactcaggcagcagaggcatctgggaagtctctgagtaggcagggtcctcctgggaggcacccccacctgtttgaaaggtctggccaggcgtggtggttcaggcctgtaattccagcactttgggaggccgaggagggaggatcacctgaggtcaggagtttgagaccagcctggccaacatgatgaaatgttgtctctactgaaaatgcaaaaattagccaggtatagtggcaggaacctgtaatcccagctacaggggaggctgaggcaggagaatcgcttgaacccgggaggtgtaggttgcagtgagccgagattgcaccactgcactccagcctgggcgacagagcgagactctgtctcgaaaaaaaaaaaggtccgtgccaagctgctccctgcccttgccctttccctttccctggggtccaaaccacatgtgtcctgcctctcctggccctaccacattctggtgctgtcctcactcgcccctggcccagaggctcctgaagatgctgggcggtcctggcacagggaggagcagctctgtaaatctgtgcacatggccactcttggcctaataaaggaggtctcacagtc

SEQ ID NO: 2299 - DNA, 1482 bp, Homo sapiens
cagagtttgggcgccaggcgagacggcagggcttaaagttccgggaatcaaagatcaactcccactgaggacaaatggacctgtaattccgggtgtgacgagagaacgagatttaccttcctgaattaaaaaacaggtcattaagcttgggccctgactcttctttgtgagaaggtacagagatggaaaccttacaatccgagactaaaacgagggtccttccctcatggctgacagcccaggtggctacaaagaatgtggcaccaatgaaggcccccaagaggatgagaatggcagcagtgccagtggcagcagcaagactccctgcgacaaggactgtgtactgcatgaatgaggctgagatagttgatgttgctctgggaatcctgattgagagccgcaaacaggaaaaggcctgcgagcagccggccctggcgggggctgataacccagagcactcccctccctgctccgtgtcgcctcacacaagttctgggagcagcagtgaggaagaggacagtgggaaacaggcactggctccaggcctcagcccttcccagaggccggggggttccagctctgcctgtagcaggagccctgaggaggaggaggaagaggatgtgctgaaatacgtccgggagatctttttcagctagggcataaactgtgcactgaactgtctgccgagagcagctggaggacagctgagcttccactggtgctgctgggccgcccgcctgtgggaatggggctctctgtgctcctacctttgtgccttcttgggcctggcagattcacctcaggccagaagcccctggacactccgggccttggggctgccgttctgagtgtgcggaaggcaggactcaaaatgagatcccatttgactccctctgtatgtactgtgccctctcctggctcttgaggctctggagtcccaattgtctgtgttagtcagtgaccaggttccagggaaaatgatgtcatgtggtggtccaacttactggaaccaaagagacagtactttgcaaagaaaaggatcactgccaggtgcactggaattgctacagtttagtccgcatgatctctcctgaaggaggaagcctgtttcaaaaatagtttccatcatgagtctatcaatgagctcccacctctccagccagcctagaaagcaaacgagctgcccacagttctctgccctgtctgggaggttgaggccacagtgtatagactggtaagccagacaggcctcctcccgcaagctgctaccttgctttcacctgtaccttggtccccgggcagctagctataaagcaagagggacaggagcccagaagagacactgaggacaagagatcacaccagagtacatgtctctgcctctgttttcagtgtggctttggacaggaatatatgaataaatcactgccatacaggttttccaatacacaagtgctagaaaatacacacaattccccaatg

SEQ ID NO: 2300 - DNA, 1021 bp, Homo sapiens
aaccacgtgggtcccgggcgcgtttcgggtgctggcggctgcagccggagttcaaacctaagcagctggaaggaaccatggccaactgtgagcgtaccttcattgcgatcaaaccagatggggtccagcggggtcttgtgggagagattatcaagcgttttgagcagaaaggattccgccttgttggtctgaaattcatgcaagcttccgaagatcttctcaaggaacactacgttgacctgaaggaccgtccattctttgccggcctggtgaaatacatgcactcagggccggtagttgccatggtctgggaggggctgaatgtggtgaagacgggccgagtcatgctcggggagaccaaccctgcagactccaagcctgggaccatccgtggagacttctgcatacaagttggcaggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacctgaaagaccgaccattcttccctgggctggtgaagtacatgaactcagggccggttgtggccatggtctgggaggggctgaacgtggtgaagacaggccgagtgatgcttggggagaccaatccagcagattcaaagccaggcaccattcgtggggacttctgcattcaggttggcaggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagcttttggaagccgga

SEQ ID NO: 2301 - DNA, 1193 bp, Homo sapiens
ggagttcaaacctaagcagctggaagggccctgtggctaggtaccatagagtctctacacaggactaagtcagcctggtgtgcaggggaggcagacacacaaacagaaaattggactacagtgctaagatgctgtaagaagaggttaactaaaggacaggaagatggggccaagagatggtgctactgtctactttagggatcgtctttcaaggcgaggggcctcctatctcaagctgtgatacaggaaccatggccaactgtgagcgtaccttcattgcgatcaaaccagatggggtccagcggggtcttgtgggagagattatcaagcgttttgagcagaaaggattccgccttgttggtctgaaattcatgcaagcttccgaagatcttctcaaggaacactacgttgacctgaaggaccgtccattctttgccggcctggtgaaatacatgcactcagggccggtagttgccatggtctgggaggggctgaatgtggtgaagacgggccgagtcatgctcggggagaccaaccctgcagactccaagcctgggaccatccgtggagacttctgcatacaagttggcaggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacctgaaagaccgaccattcttccctgggctggtgaagtacatgaactcagggccggttgtggccatggtctgggaggggctgaacgtggtgaagacaggccgagtgatgcttggggagaccaatccagcagattcaaagccaggcaccattcgtggggacttctgcattcaggttggcaggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagcttttggaagccg

SEQ ID NO: 2302 - DNA, 1084 bp, Homo sapiens
cctttctgagcagctgtgtttgaagaaagctagtgggaaaagttccaggattacatgtcaggaaactacaagaggtagaaacatttgttgatttaccagtgtttttaacttcctgctgggctgaaaactgcttgtttcgtggaaaagcaaaacttgacagcaaacatctaaaatgaagagctcccaaacttttgaggaacaaacggaatgcattgtgaacactctactcatggacttcttgagcccaacattgcaggttgccagccggaacctatgctgtgtagatgaagtagattcaggagagccttgttcttttgatgtggctatcattgctggtcgccttcggatgttgggtgaccagttcaacggagaattggaagcttctgccaaaaacgtcattgcagaaaccattaagggacagacaggagctatactccaggacactgtggaatctctcagcaagacctggtgtgctcaggattccagcttagcttatgagagagcttttctggcagtgtcagtgaaacttcttgagtacatggctcacattgctcctgaagtagtgggacaggtggctatccccatgacgggtatgatcaatgggaaccaagccatccgggagttcatccagggccagggaggttgggaaaatctggagagctgaagagttggagctattcacgagactgaacatcacttccttgttgactgattgggtgattgattcctgggaattcaaacaaacaaataaaaaagcacttttttcattttatcagaactgaacttagctgaataagttattttttactgattgttaaagttgggagcagctgccagaggcctgcagagttggtttttgttttgttttgttttgtcaacttaatgcaaaccacagagattttctactttctgttttcacatgagttttaatgaggttctgttgaagcaaagacccctagacacaaagtaatgacttgttagtagtggaattataagcaacagggcaggcctttgctggaggtattttgagagaaagggagaacaatggaaactatttcttcagatgtagccctgtcttttggta

SEQ ID NO: 2303 - DNA, 2422 bp, Homo sapiens
gtgagggaacgcgctttcgaggcggaggttaggagcggggagcgcgcccgggtccagcgtcctgcttctccgcttcccgcgctgagctcttcgcctgtcgctgaggcgtcggtgccagctgcgtgaaggatggagagggcggggcgcgaatcctgagccagagactgagtgcttgggggtgggccgagcacttgggggccgctcttcggggcccgggtggtctggaacaatgttgcttggctgggcggctgcgggatagggcggaaggggacaggcttgaggcttggataggcgtgaggaggcgcatacgaccgcacaacccgaggtttgtaactgtattcggaagacgccgggtccggctgggactgccagaggaacctggctttgcaggactacggaggagtaacgtcgagtgaattggaagagggcccagggccgcacaagcagcgtcaccctttacaccagaaagctggcgggcactatggggaaaaaacaaaacaagaagaaagtggaggaggtgctagaagaggaggaagaggaatatgtggtggaaaaagttctcgaccgtcgagtggtaaagggcaaagtggagtacctcctaaagtggaagggattctcagatgaggacaacacatgggagccagaagagaacctggattgccccgacctcattgctgagtttctgcagtcacagaaaacagcacatgagacagataaatcagagggaggcaagcgcaaagctgattctgattctgaagataagggagaggagagcaaaccaaagaagaagaaagaagagtcagaaaagccacgaggctttgctcgaggtttggagccggagcggattattggagctacagactccagtggagagctcatgttcctgatgaaatggaaaaactctgatgaggctgacctggtccctgccaaggaagccaatgtcaagtgcccacaggttgtcatatccttctatgaggaaaggctgacgtggcattcctacccctcggaggatgatgacaaaaaagatgacaagaactaacgctcctgagtaccagcccctgtcacatctgactgtgggtttcaagtgggaagggaaggagttctacttgtcttgacaccatagaggtggcttgagaagatgtcctttgaagagccagtatagtttctgtgccctgcagcagcccaagtgctttaaagccgtttcaagctgtatagtttgcacacccatcccagtggaggggaaaggggataagtgtttcaaggcaaccttttctgcactttgctgcgaaaagcaaagggccttctatgaaggacaaaacttgcagaattgggtgtgtgggagagcaaaaaaatactgtagatcttcaaagagcatctccacaacccacagccttcttcccaatagtgttaactctgcatttttacagcgtagcatgtgtgtagtttttggctattactggtgtattatttgggggagggagggatggggaggggagaaagggagatgggtagcatcattttgattaacatttggggcctgataggggaaatggtgaagcaatggaaaagaacagacaactaatgatttgcttctatgtccagaatattttacctttaaaaaaatgtcattggcaccataaataaggactgtgagagactgtttaaaagctgtgaaagtctgaaacctataagccaaggtgttccctgcctaaacttattgctgttcccacaaaggactaagcctgttcataagttaccaaagttgccattttggagatggaaattgacgaggagggaaggtcttttattggagagtatacagtacaagcagatcattctgccttagaggtgctaattcccgaaattagaagaccctttcttttccagtaacgaagttataaatatcagcttgttcatccaagccactggctgaggtgttaggaagaggaagagggtggtagaggaggtaagacagtagggaaagacaagggcccatgctcttagtggggaaaactcttggagccgtttactttgagctttgaacactgaaaccattgttggcagggttcagtcactgacagcacaagtttcactgaattgatccaagagtttagtgatttcaaaagccttggtctcaggagaagattaaactttcatattgggcagtggttcactttaaaacacacacatacacacacaaaacaattttttaagaaatcctaataagtaacatacccaaaatgctctgtcttgagtcatgagaaccatcagttcttgatattgtctagacttgcatctagagctacgttgtaaaattcttttaggcatgtgttagatttctgtgtaaactttgtttaaatgtaaacttcatactacattgtcagtttttgtcttaataaaactatagatttataatccctga

SEQ ID NO: 2304 - DNA, 2279 bp, Homo sapiens
acaagggaccttatttaggttgcgcaggcgcccgctggccatttcgtcttagccacgcagaagtcgcgtgtctaggtgagtcgcggtgggtcctcgcttgcagttcagcgaccacgtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcagggttggaaatcgtgccaaatgggataacattgccggtggacttccaggggaggagtacgggggaggccttcgtgcagtttgcttcacaggaaatagctgaaaaggctctaaagaaacacaaggaaagaatagggcacaggtatattgaaatctttaagagcagtagagctgaagttagaactcattatgatccaccacgaaagcttatggccatgcagcggccaggtccttatgacagacctggggctggtagagggtataacagcattggcagaggagctggctttgagaggatgaggcgtggtgcttatggtggaggctatggaggctatgatgattacaatggctataatgatggctatggatttgggtcagatagatttggaagagacctcaattactgtttttcaggaatgtctgatcacagatacggggatggtggctctactttccagagcacaacaggacactgtgtacacatgcggggattaccttacagagctactgagaatgacatttataattttttttcaccgctcaaccctgtgagagtacacattgaaattggtcctgatggcagagtaactggtgaagcagatgtcgagttcgcaactcatgaagatgctgtggcagctatgtcaaaagacaaagcaaatatgcaacacagatatgtagaactcttcttgaattctacagcaggagcaagcggtggtgcttacgaacacagatatgtagaactcttcttgaattctacagcaggagcaagcggtggtgcttatggtagccaaatgatgggaggcatgggcttgtcaaaccagtccagctacgggggcccagccagccagcagctgagtgggggttacggaggcggctacggtggccagagcagcatgagtggatacgaccaagttttacaggaaaactccagtgattttcaatcaaacattgcataggtaaccaaggagcagtgaacagcagctactacagtagtggaagccgtgcatctatgggcgtgaacggaatgggagggttgtctagcatgtccagtatgagtggtggatggggaatgtaattgatcgatcctgatcactgactcttggtcaaccttttttttttttttttttttttctttaagaaaacttcagtttaacagtttctgcaatacaagcttgtgatttatgcttactctaagtggaaatcaggattgttatgaagacttaaggcccagtatttttgaatacaatactcatctaggatgtaacagtgaagctgagtaaactataactgttaaacttaagttccagcttttctcaagttagttataggatgtacttaagcagtaagcgtatttaggtaaaagcagttgaattatgttaaatgttgccctttgccacgttaaattgaacactgttttggatgcatgttgaaagacatgcttttatttttttgtaaaacaatataggagctgtgtctactattaaaagtgaaacattttggcatgtttgttaattctagtttcatttaataacctgtaaggcacgtaagtttaagctttttttttttttaagttaatgggaaaaatttgagacgcaataccaatacttaggattttggtcttggtgtttgtatgaaattctgaggccttgatttaaatctttcattgtattgtgatttccttttaggtatattgcgctaagtgaaacttgtcaaataaatcctccttttaaaaactgca

SEQ ID NO: 2305 - DNA, 4598 bp, Homo sapiens; identical to SEQ ID NO: 337

SEQ ID NO: 2306 - DNA, 842 bp, Homo sapiens
ggaaaacagtgtggcatattctgctgagcttcgccctggaagaagcctcttttatacatctcttcagggaagagagaagcaatgggcatgttagtatacaatgatcacagccacgcaggcctgcaagctgccttttggacaggctgttgactgccgttccaattagctgattggagaatgtggaatgcagagtgataatgctgcatatctgctatcaggcagcagcaaaggtttttgtcttgggaaggcaagctttccctgcaatattatctcagcagctccctagctgcttaccctgaaaacgagggatccaaacggagggtgttgcactctgctaacgctggtcctgtgcgtggctgtggcatatgagcggcaggtctgaaaaagcaggtgtgtgctgggacgggcactggactggaacgcaggcggacgctctcgggtttacctgcttcctgttaacagattgtgggctcccagggcatatgtctgcacgctgaggccgaggcggagaaggggcttcctgagcgtcccagtacactgacagagacacttggattggacttaatcttaaacctctggagttcaagaccttttaaaaagggctaaataaacaatctctacatgtaaaaggccactgactcctacttcctctgtatagagcaactgttgaactcagctgcctgtagggcgtgattctcagtcaccagactcagcaaaaggttttagaagcgttcgaccaaacctacaagataaaagatcaccaactcagagccagataacagtgaatggaaactcaggaggtgccgtgagtcccatgagttactatcagaggccgttttccc

SEQ ID NO: 2307 - DNA, 3043 bp, Homo sapiens
cattttacttatggaaaacagtgtggcatattctgctgagcttcgccctggaagaagcctcttttatacatctcttcagggaagagagaagcaatgggcatgttagtatacaatgatcacagccacgcaggcctgcaagctgccttttggacaggctgttgactgccgttccaattagctgattggagaatgtggaatgcagagtgataatgctgcatatctgctatcaggcagcagcaaaggtttttgtcttgggaaggcaagctttccctgcaatattatctcagcagctccctagctgcttaccctgaaaacgagggatccaaacggagggtgttgcactctgctaacgctggtcctgtgcgtggctgtggcatatgagcggcaggtctgaaaaagcaggtgtgtgctgggacgggcactggactggaacgcaggcggacgctctcgggtttacctgcttcctgttaacagattgtgggctcccagggcatatgtctgcacgctgaggccgaggcggagaaggggcttcctgagcgtcccagtacactgacagagacacttggattggacttaatcttaaacctctggagttcaagaccttttaaaaagggctaaataaacaatctctacatgtaaaaggccactgactcctacttcctctgtatagagcaactgttgaactcagctgcctgtaggaaaactgaagactttaataacaaactctccaaggtgaaaatgaacacagggcgtgattctcagtcaccagactcagcaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaagccccgcattacccagggatcgggcccgtggatgaatccggaatccccacagcaattagaacgacagtcgaccggcccaaggactggtacaagacgatgtttaagcaaattcacatggtgcacaagccggatgatgacacagacatgtataatactccttatacatacaatgcaggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccaactgatcgcataaatccagatgacatagatttagaaaatgagccctggtataaattcttttcagaactggagtttggacgcccgcctcctaaaaagcctctggactatgttcaagatcattcttctggtgttttcaatgaggcctccttgtatcagtcctctatagacagaagcctggaaagacccatgagttctgcaagcatggccagtgacttcaggaagcggaggaagagcgagcctgcagtgggtccaccacggggcttgggagatcaaagtgcgagcaggactagcccaggccgagtggacctcccaggatcaagcaccactcttacaaagtctttcactagctcttctccttcttccccatcaagagcaaaagaccgtgagtcccctagaagttactcatccactttgactgacatggggagaagtgcaccaagggaaagaagaggaactccagaaaaagagaaattgcctgcaaaagctgtttatgattttaaggctcagacatctaaggagttgtcatttaagaaaggagatactgtctacatcctcaggaaaattgatcaaaattggtatgagggagaacaccacgggagagtgggcatcttcccgatctcatacgtagagaaactcacacctcctgagaaagcacagcctgcaagaccacctccgccagcccagcccggagaaatcggagaagctatagccaaatacaacttcaacgcagacacaaatgtggagctgtcactgagaaagggagatagagttattcttcttaaaagagttgatcaaaactggtatgaaggtaaaatcccaggaaccaacagacaaggcatcttccctgtttcctatgtggaggtcgtcaagaagaacacaaaaggtgctgaggactaccctgaccctccaataccccacagctattctagtgataggattcacagcttgagctcaaataagccacagcgtcctgtgtttactcatgaaaatattcaaggtgggggggaaccgtttcaggctctgtataactatactcccaggaatgaagatgagctggagctcagagaaagtgatgtcattgatgtcatggaaaagtgtgatgacggctggtttgtggggacctcaagaagaaccaaattctttggtactttccccggaaactacgtcaagaggctgtgaattgcgctccctccttctgtagaggccgcctgccagccatgcacctgcgtcaacgcgcctgaaacaccccgcgggcctcccgttgtcatgccttacggtttccaatgcgccgtcaccatctccacctgccaccaaaccaccagcagagtagccgccgctgctgtgagcctggggacgacatggcaggctggtccccctccgtgaaagtgtggattcctacttcctgctctaagctttgacacgtcaaaatgtgggatcagaaagaaaaaaatcatgatatttaaaaatggtcaaatatttgagg

SEQ ID NO: 2308 - DNA, 6400 bp, Homo sapiens
aggggcggaggtgacagcgggctggggactggcggctgcaactgcctgccgcgccgagggaccgccgggcggcggaaagcaggttataaaacatggaggctggctcagtggttcgagccatttttgacttctgccctagcgtatcagaagaactgccgctctttgtgggagatattattgaggtgctggcagtggtggatgaattttggcttctaggaaagaaggaggatgttacaggacaattccccagcagttttgtggaaattgtgaccattcccagtctaaaagagggagagaggctgtttgtgtgcatttgtgaattcacatcccaagagttggataatcttcccctccatcgaggtgacctggtgattctcgatggcattcccactgcaggctggctgcagggccgaagctgctggggcgcacggggcttcttcccatcttcatgtgtccgcgagctctgcctctcctcacagagccggcagtggcactcccagagcgccctgtttcagattccggaatattccatgggacaagcccgggccctaatggggctttctgctcagctggatgaagagctggacttcagggaaggggatgtgatcaccattattggagttcctgaaccaggctggtttgaaggggagttagagggccgaagaggcatttttccagaaggttttgtagagctgttggggcccctgaggactgtggatgagtcagtaagttctggaaatcaagatgactgcattgttaatggtgaagtagatacccctgtaggagaagaagagatagggccggatgaggatgaggaggagccagggacctatggggtcgccctgtacagattccaagccctggagccaaatgagctggatttcgaggtcggggataaaatccgaattctggcgaccttggaagatggctggctggaaggatccctgaagggcaggacaggcatctttccttaccggtttgtgaaattatgtcctgacacacgggtggaggaaaccatggctctgccccaggaaggcagccttgccaggatcccggaaacttctttggattgtttggagaacaccttaggagtagaggaacaaagacatgaaaccagtgaccatgaggccgaggagcctgactgcattatttctgaagcacccacttctcccctcggtcatctgacttcagagtatgacacagacagaaactcttatcaggacgaggacaccgcaggagggcccccgagaagcccaggcgtggagtgggaaatgcctcttgccacagactctcccacatctgaccctacagaagtagtcaatggtatttcctcccaacctcaggtcccttttcatcccaacttgcagaaaagccagtattattctacagtgggagggagccacccgcactcagaacagtaccccgaccttcttcccctagaagcaaggactagagactatgccagcctacctcccaaaagaatgtattcccagctaaaaactcttcagaagccagtgctccctctttacaggggctcttctgtttcagcttcaagggtagtcaaacccagacaatcaagtcctcagctccacaacctagcaagttatactaaaaagcaccacacgtccagtgtttactccatctcagagagattggagatgaagcctggtccgcaagcccaagggcttgttatggaagcagcaacacattcacagggagacggcagcactgacctggactcgaagctgacacaacagctgatcgagtttgagaagagcttggcagggcccggcacagagccagataaaattttacgccacttttcaatcatggactttaactctgagaaggatattgtccgaggttcctcaaagttaatcaccgagcaggagctgccggaaaggagaaaggccctaaggccaccgccacctcgtccctgtactccggtatccacttctccccatttgctggttgaccagaacctaaaacctgcaccacccttggtggtgcgaccctctcgcccagctcccctgcctccctcagcacagcagagaacgaatgcggtatcccccaagctcctatctcgacaccgtcctacctgtgagaccttagaaaaggagggccctggtcatatgggaaggagtctggaccagacctccccatgccccttagtgctggtgaggattgaggaaatggagcgggacttggatatgtacagtagagctcaagaagagctaaacctcatgctggaggagaagcaggatgaatcatcaagagcagagaccctcgaggatctcaagttctgtgaaagtaacattgaaagtttgaatatggaactccagcaactaagagaaatgacgctcctctcctcccagtcttcatcactggtggccccttctgggtctgtgtctgccgaaaatccagagcagaggatgctggagaagagagccaaggtcatagaagaacttcttcagacagaaagagactacattcgggatctggaaatgtgtattgagcggatcatggtacccatgcagcaggcacaggtaccaaacattgattttgagggactttttggaaatatgcagatggtgattaaggtctcgaagcaattattggctgctctggaaatcagcgatgctgtaggacctgtgtttcttggtcaccgggatgagcttgagggaacatacaagatttactgccagaatcatgatgaggccattgcgctgcttgaaatctacgagaaggatgagaagatccagaagcatcttcaggactccttggcagatctgaactctttagttctaaaaaagggatgcacaaattatattaacctgggctccttcctcatcaaaccagtacagagagtaatgcgttacccgctgttgctaatggagttgctgaattccaccccagaatcccacccagataaagtgcctttaaccaatgcagtccttgcggtcaaggaaatcaacgttaacattaatgaatataaacggcgaaaggacctggtcctcaagtaccgtaagggtgatgaagatagccttatggagaaaatttccaaactgaacatccactccatcatcaagaaatccaaccgagttagcagtcacctgaagcatctcactggctttgctcctcagataaaagatgaagtatttgaagaaacagaaaaaaacttccgaatgcaagaaagattgattaagtcttttatccgagacctgtctctctacctccagcacatccgggagtccgcatgtgtgaaagtggtggctgctgtgagcatgtgggatgtgtgcatggagagaggacaccgggacctggagcagtttgagagggtgcatcgctacatcagtgaccagctcttcacaaactttaaggagaggacagagcggcttgtcatctcccccttaaatcagttactgagcatgtttacagggccccataagctggtacagaaacgctttgacaagctcctggacttctataactgtacagaacgggcagaaaagctaaaggacaagaagaccctggaggagctgcagtcggcccggaacaactatgaggccctgaatgcacagctgctggatgagctgcccaagttccaccagtacgcccagggcctcttcaccaactgtgtccacggctatgctgaagcccactgtgactttgtgcaccaggctctggagcaattaaagccactgctttcgttactcaaagtggctggcagagagggaaaccttattgccatcttccacgaagagcacagcagagttctgcagcaactccaggtttttaccttcttcccggagtctcttccagctaccaagaagccatttgagaggaaaaccattgaccgccagtctgctcgaaagccactcctgggcctgccaagttacatgctacagtcagaagaactccgggcctccctcctggccaggtatccccctgaaaaactcttccaggcagaacggaacttcaatgctgctcaagacttggatgtctcacttttggaaggtgacctggtgggtgtgattaagaaaaaagaccccatgggcagccagaaccgctggctgattgacaatggagtcaccaaaggcttcgtgtacagctctttcctaaagccctacaatcctcgccgcagccactccgatgcctccgtgggtagccactcctccacagagtctgagcacggcagctcctcccccaggttcccacgccagaacagcggcagcaccctgaccttcaaccccagcagcatggctgtatcctttacctcggggtcttgccagaagcagcctcaagatgcatctcctccgccaaaagaatgtgaccaaggaactctcagtgcatccctaaatccgagtaattcagagagtagtccttccagatgcccttcagacccagactccacctcccagccaaggtcaggggactctgcagatgtagctagagatgtaaagcaacccactgccacgccgaggagctaccggaacttcaggcatccagaaatagttggctactccgtaccaggacgaaatgggcaaagtcaagacctcgtcaaaggatgtgcaagaacagcccaggctccggaagacagaagtacagagccagatggcagtgaggcagaaggcaaccaggtctattttgctgtctacaccttcaaggcacgaaacccaaatgagctgagcgtgtcagccaatcagaaactcaagatcctcgagtttaaagatgttacaggaaatacagagtggtggttagctgaggttaacgggaagaagggctacgttccctccaattatatccgcaaaaccgagtacacctgagcccacgttgcctgccacccagccttgctgcctttgctttcagtccgccgagggttctggcggcccaccgagagggcgcctgctcctgagacacaggccctgtctgcgttgcttaaccatggcatggtggagcacaccacagatcttgttctcctcgattgggttgtaaaccttgatgctcactagaatctctagaatttgaaatggaccctggggctttgcaaatgacttagtgactatgagaagagagacaagtcttagagctggcttttggaaaggagaaacttgcagtcagaagcccagtgtcctatgtatgcaggaagctgtgctctagcaatagacagtgttggtaatggttgtgctgtacggcgtttggggtggccccatgttccatgctcagctgaccggatgccaactcagatgaaaagaattcatggctctgggcaccccgtgaggcagtgcttgcacatggctgggagtttgtcgggattgaaccaaacctagtgcttcaaagctcctgggacacctccagtgtccagcacacattctcatacatactgcccctaatttctaaagtccctaaagcactacattctgtaaccttgtttcttttactccattcccagattagttatgcaaaattcaactgcgttctacttttagaagtgtttagggtctttattttctgttgacccttcatctgaaagattctcttcccttgttaggtacaatcactgcccccccgcttttttttttgagatggggtcttgctatgttgcccaggctggtcttaaacgcctgggctcaagcaaccctcccgcctccctgctgagattacaggtgtaagccaccataccgcaacctcaatgacacctttctgatggtctttacacagtctgtgatgtctggtggcccccctgccctggactcaataattgatagattttcctagagtaacagtatgagagctccagccattccattaaaagtattagttctgctttgagctgaaaccagttgagcctaatggaagactggatgtctttcttcttcatccaagcaccctaatgactgtttagttacatccatagatgcagacaacataacacctgtgacttacttgaattgggataagccattccagaagtagcttatcctagacttggaaataagatttttttcaccactaacttccatgcttcagagatgacattcaaagccagattcccaagtgcctgatcatacctcccagtctcaggaagatatttgcttaccccttagaccaagaatcttaagatcttccccagctatgaagcctatcttggaatgggaaaccatgaaatttgtcttttaaaagaaagggaagaaatagccttacagcccctgttcctccaagtgcacatttagccttaaaatcctgggagtcgggagacaccgtggagtcctaacatccacagtgtctgctggtcgtggtcagaaggcagtaatgcaagagtccttttgtgaagagtgtttctatgtagagatgtttatatttaagtagttcttttataaataaaagcatttctaatggc

SEQ ID NO: 2309 - DNA, 3132 bp, Homo sapiens
gtggtttggggaaagtgtaggggcaaccaaagatcatcggcttgactaggccctttgccctgaacctcatgaagaaatgataggaggcagacatatgtgcctaaaaagagcgttgagctcagagaagagcaactcggagttttgggggtgtgctttgatttgtgtacatcaatggcagaatcatccagcgaatcagatcacttccgctgtcgtgaccgattgagtccatgggctgccagatcaacgcacaggggaactcgaagtcttcctacagtagaagttaccgagaaggtcaacactataacaagtactttacaggataccagtcggaacctgcgacaagtggaccagatgcttggacgataccgagaatacagtaatggacaggcgggtgcgatagaacatttaaaagaaagcttggaacaatcaatcgaccaactccggagtcaacgtttattgagaaactcaggagggagaagtatttctgttacaagtttgagtgcaagtgaccttgatggtggcactgggtcagagctccatcattttccacctacctcacctctcaaggactatggggatccacagggtattaaacgaatgagatcaagaactggtgtccggtttgttcaagagactgatgatatgactcagcttcatggttttcatcagtctcttcgagacctcagcagtgaacaaattcgccttggagatgatttcaacagggagctttccagaaggagccggtcagatgccgaaacaaaaagggctttggaagaattgactgaaaaacttaatgaagcccagaaacaagaagtggtttcagatcgggtggagcggcggcttcaggaactggagagagagatgcgcacagaaagggagctggtggaaagacgccaggatcaactgggactcatgtccctgcagctacaggaggcactaaagaaacaagaagctaaagcagatgagcatgagggggcaataaaaaataagctaagacaaactgaaactgagaagaatcaacttgaacaggaattggagctatctcgaaggttattgaatcaatcagaaggcagccgagaaacacttttgcatcaggtagaagaactgcgtacacaacttacgaaagcagaaggtgatcgaaagggtttacagcatcaagtatctcagatttccaagcaacagtcaaactatcaggatgaacaaggggaggactggagatttaggagaggggttgagcgggaaaaacaggacctggagaagcaaatgtcagatttgagagtgcagctgaacttcagcgcaatggcatctgagttagaggaagtgaaacggtgcatggagagaaaagacaaggagaaagcacatttggcatcacaagtagagaatttaacacgtgaactggagaatggggaaaaacagcaactgcagatgttggatcgacttaaggagatccagaatcactttgacacatgtgaggccgagcgtaagcatgctgaccttcagatctcagagctgactcgccatgcggaggatgcaaccaagcaggctgagcggtacctcagtgagctccagcagtcagaggctctgaaagaggaggcggagaagaggagggaagacctgaaactgaaagctcaagaatccattaggcagtggaagcttaagcataagaagttagaacgagcgttggagaaacaatctgaaactgttgatgaactgacaggcaagaataatcagattttaaaagaaaaggatgaattgaaaacccagctgtatgcagcattacaacaaatagagaatcttcgaaaggaattgaatgatgtcctaacaaagcgtgcccttcaggaggaggagcttcactccaaggaggagaaattacgtgatattaagtctcatcaagctgaccttgaattggaagttaagaattccctggataccatccatagactggagagcgaattgaaaaagcagagtaagatccaaagccagatgaaagttgagaaagctcacttggaggaagaaattgcagagctcaagaagagccaggcccaggacaaagctaaacttcttgagatgcaagagtccatcaaggacctgagtgccatccgagcagatcttgctaataaattggctgaggaagagagagccaagaaagcagtgcttaaggacctttctgacctcactgcacaggcaaaatccagggatgaagaaacagctacaatcatcacacagttaaagctggaacgagatgtgcaccagagggagctgaaagatctcacatcatcattgcagagtgtgaaaacaaaacacgaacagaatatccaggagcttatgaagcactttaagaaagaaaagagtgaggctgagaatcatatcaggactctgaaggctgaaagtttagaagagaagaatatggctaaaattcatcgtggtcagctggagaagttgaaatcacagtgtgacagactgacagaggaattaacccagaatgaaaatgagaacaaaaaactgaagctaaaatatcaatgtttgaaggatcaactagaagaaagggaaaaacatataagcattgaagaggagcacttaaggaggatggaagaggccagattgcagctcaaggatcaacttctttgcttggagactgaacaggaatccattcttggtgtgataggaaaggaaattgatgcagcttgtaaaacattctccaaggactcagtggagaaattaaaagttttttcatctggtcctgatatacattatgacccacatcgctggttagcagaaagcaagactaaacttcagtggctctgtgaggaactgaaagagagagaaaacagagagaaaaatctgcgacaccagctgatgctctgcagacaacaactcaggaatttgactgaaaacaaggaatctgagttgcagtgtctctttcaacagatagaaaggcaggagcagcttctggatgaaatacatcgtgagaagagagatctactggaagagacccaaagaaaagatgaagaaatgggatctctgcaggaccgtgtaattgcattagaaacgagtacccaagtggccttggaccatctggagtctgtgcctgagaaactgagcctactagaagatttcaaagacttcagaaga

SEQ ID NO: 2310 - DNA, 10382 bp, Homo sapiens
attgtgggcgactcggctaatggcgtcggcgagtcttaggggcctggggagctggcgctgaagcttcttgccaggttggctggtgacacccggtgtggctgggccccgcggcagcggagggacctgcccgccttgtgggtttctcggccagagtcggcggagcctagcgggacggtgcgactgcggggggcgcctccgagaaaagccagaggtgttgcggggaagctgctgggggacgctcgagcaggctccgggttcgcagcccagggcccaagaagcgggctgctgaaggaccagagacaccgggagggagctgcctgtggccctaaggagctgaccgtgccagagcttgtttgtacctctcggaaattggctgggaccttggaggatcatgtccggcaccagcagccccgaggcggtgaagaagctgctggagaatatgcagagcgacttgcgcgccttgtcactggagtgcaagaagaaattcccacctgtcaaagaggctgctgaatcaggaataataaaagttaaaacaattgctgcacgaaacactgaaattttggcagcactgaaagagaacagctcagaggttgtacagccttttttaatgggttgtggaaccaaggaaccgaagatcactcagctatgtttggctgctattcagagactcatgtcacatgaagtcgtgtctgagactgcagctggaaatataattaacatgctttggcagctaatggagaatagtcttgaagaacttaagctacttcaaacagttcttgttcttttaacaaccaatacagtagttcatgatgaggcactttctaaggcaatcgttctttgttttcgactacacttcacaaaagataatattacaaataatacagctgctgctacagtgcgacaagttgttactgttgtttttgagaggatggttgctgaagatgaacgacacagagatattatagaacaaccagtactggtacaaggaaatagtaacagaagatctgtcagtaccctcaaaccttgtgctaaagatgcatatatgcttttccaggatctttgtcagttggttaatgctgatgctccttattggctagtgggcatgacagaaatgactcggacgtttggcctcgaattacttgagtcagtcctcaatgattttccgcaggtctttttacaacaccaagaatttagtttcctcctcaaagaaagggtatgtcctcttgtgataaagctcttttctccaaatataaagttcagacaaggttccagcacctcatcttctccagcaccagttgaaaaaccatattttcctatctgcatgcgtttgctgagagtagtatctgttctgattaagcagttttacagtcttttggtaactgaatgtgagatatttctgtcacttctggtgaaatttctggatgcagataaaccacagtggctacgagctgttgcggtggaatcaatacacagattctgtgtgcagcctcaactattaaggtcattttgtcagtcctatgatatgaaacagcattctaccaaggtttttcgtgatattgtaaatgcactgggatcttttatacagtccttgtttcttgtcccccctactggaaatcctgcaacaagcaaccaagctggaaacaataatttaggtggctcagtctcagcaccagctaactcaggaatggtggggattggtggaggtgttactttgctaccagcatttgaatataggggaacctggatacctattctgacaatcacagttcaaggcagtgctaaagccacctacttagaaatgttggacaaagttgagcctccaactatacctgaaggttacgccatgtctgtggcattccattgtttgctagaccttgttcgtggaatcacaagtatgattgaaggagagctaggagagcttgaaacagaatgtcaaaccaccactgaagaaggttcttcaccaacacagtcgacagaacagcaggatttacagtcaacatcagaccaaatggataaggaaattgttagtagggctgtttgggaagaaatggtgaatgcctgctggtgtggtcttcttgctgcactctcactccttcttgatgccagcacagatgaagctgccactgagaatattttaaaagctgaactgactatggctgctctttgtggaagactgggccttgtaacttcaagagatgcctttataactgcaatatgcaaaggttccctgcctccccattatgctcttactgtattgaataccaccactgcagctacactttccaacaaatcatattccgttcagggccaaagtgttatgatgataagtccatcaagtgaatctcaccaacaagttgtggcagtgggtcaacctttagcagtccagcctcaagggacagtaatgctgacttccaaaaatatccagtgtatgaggactttacttaacttggcgcattgccatggggctgttcttggaacatcatggcaacttgtcttggcaactcttcagcatcttgtgtggattctgggattaaagcctagtagtggcggtgccttgaaacctgggagagctgtagaaggacccagtacagttctaacaacagcagtgatgacagatttaccagtgatttccaatatactttcaagattgtttgaaagctcacagtatcttgatgatgtatcactgcatcatttaataaatgcactttgctccttgtctctagaagcaatggatatggcctatggaaataataaggaaccatctctttttgctgttgccaaattgttagaaactggtttagttaatatgcaccgaatagaaattctgtggagacctctgactggccatctacttgagaaggtctgccagcatccaaactctcgaatgagagaatggggagcagaagctttaacttctcttattaaagcaggattaacatttaaccatgatcctccactctcacaaaaccagaggctgcagttgcttttattgaacccgttaaaggagatgtccaatattaatcatccagatattcgactcaagcagttagaatgcgtgttgcagattctgcagagtcagggagacagtcttgggcctggatggccattagtgcttggagtcatgggagcaatcagaaatgatcaaggagaatccttgatacgaactgcattccagtgtcttcagttggttgtgacagattttctaccaacaatgccttgtacttgcctgcaaatagttgtagatgttgcaggtagctttggcctccataaccaagaactcaatattagtttaacttcaataggtttattgtggaatatttcagattattttttccaaagaggggaaactattgaaaaagaactaaataaggaagaggcagcacagcaaaagcaggcagaagagaaaggagttgttttaaatcggccattccaccctgcaccgccatttgattgcttgtggttatgtctttatgcaaaattgggtgaactatgtgtggatccccgtcctgctgtcaggaagagtgcagggcaaactctgttttctacaattggtgcgcatggaactttattacagcattcaacctggcacactgttatctggaaggtactctttcatctactggacagagttcgagagtcctctaccactgcagacaaagaaaagattgagtctggaggtggcaatattctcattcatcattcaagggacaccgccgagaagcaatgggctgagacgtgggtattaacattggctggagtagcaaggatcttcaacactagaagatatttgctgcagcctttaggagatttttcaagagcttgggatgttcttcttgaccatatacagtcagcagcactcagcaaaaacaatgaagtatctctggctgctctgaaaagcttccaggaaattttacagattgtgtcccctgtcagagactcagataagcctgagacaccacctgtagttaatgtacctgtgcctgttcttatagggcccatatcaggcatgagcaggccatttgtaagaacagattccattggagaaaaactaggaagatatagtagctctgagccacccattgttactgatgagcttgaagatttgaatctatggtgggctgcgtggaatacctggtatagaattggatctgaaagtactaagcctcctattacttttgataaactaacttttattcctagccagccttttcttacagctttaattcagatatttccagctctctaccaacacataaaaactggtttcaatatggatgacttgcaaaagttgggagtcatattgcacagtgctatttcagtcccaataagttcagatgcatccccttttattcttccatcttataccgaagcagttttgacaagtttacaggaagctgtacttacagctttagatgttctccaaaaggccatttgtgtaggaccagaaaacatgcagataatgtatccagctatatttgaccagttgttggcatttgtagaattttcctgtaaacctccacagtatggacagctggaaacaaagcacattgcaaatgcaaaatataatcagatccaactatttgcaccggcggaatgggtagccttgaattatgtgccgtttgctgaaaggtctttagaagtagttgtggatttataccaaaaaacagcgtgtcacaaagcagtggtgaatgagaaagtgctccagaatattattaagactcttagggttcctctcagtttgaagtattcctgcccttctgaaagcacatggaaactagcagtatcctctctcctcagagttctttctattgggctacctgttgcccggcagcatgcttcttctggaaaatttgacagtatgtggccagaactagccaatacttttgaagattttctctttactaaaagcatacctccagataatctctctattcaagagtttcaaagaaatgaaaatattgatgtcgaggtagttcaacttatcagcaatgagatactaccttatgccaattttattcctaaggaatttgttggtcaaataatgacaatgcttaacaagggctcaatacattctcagtcatcttcatttacagaagcagagattgatattcgtttgagagaggaattttctaaaatgtgttttgaaacattactccagttttccttcagtaataaagtcacaacacctcaagaaggctacatctcacgaatggcactctcagtgcttttaaagaggtcccaagatgtactacatcgctatatagaggatgaaagattaagtggtaaatgccctcttccaaggcaacaagtaacagaaattatatttgttttaaaagcagtcagtactcttattgattcacttaagaaaactcagcctgagaatgttgatggaaatacctgggcacaagtaattgccttatacccaactttagtagaatgcatcacctgttcttcttcagaagtctgttctgcacttaaagaggcactagttccttttaaggatttcatgcagccaccagcatccagagttcaaaatggagaatcttgaccggctacaatatatttgaaagcaggaagatagtctaaaaaatgtttgctcctaattgagtcttctgtgagaaggacatttcttactgcagataattcttggcagctgttgttggcctcctttaaattctacttacctgagttcagtaattcatattacaggcttgcacatcaacaaaggctcctgaatgaacagcagtgtaaggctttaataaattaaactgatgggagggataattaacactacagtatacatgctaccatatctccagttggtgatttaaagtgagcttatgtacagtttgtggtgtatgtgttaatgatgtactttttaaaaagaaagaagagatatttcaattcagtcagatttattagtctggtgtttttgcaccctttttcaagtacaaaatcgtactagaattttatgcaagatggtactgtaacattccatattatctataaccagcctttgttaacaaagggaactgatatacttgtgtgtataataaatggtacagttctgtataaaatagtgcatttatttaaattttaaaagtattgataatgttaaatgcttaaagctctatttattattaatacaaaattgtttgcttacatttttacttataatttgccttcatatgtggcggataagctcaccatatgatcatgcagttagcttcatgcttattttaaatgtattattagtgaccattaaacatctgaccagtaaggtcatgtgaacacagcagcaaatagtttatgatttgctgattttggagctttgaaatataggttcttaatacattgatacatattgtagcactatgacttcatcatacctcatttctttaaacagctctccaagctttcactgaagtctgtctgttttttatattggctgtctggattttaaagacttttcatattttatatttctactgattttgtttcccctaacaacatttgtcactgtctttgaattatgacccaggcaagatgatttcagattttctaaaatcttgcctgtgaggttttgttcatatcagtgcttcattttgtaatgtcttctcaagaaaaatacctatgttaactcacaagtataaaatatgtgtgtattataaaacaatgaaaagtgtatttttggagatagtcaagcatttagaagtgcagtgaacttgctgtcacggagtaaaatgctaattatgtttcactttcctagcctagtgaaaaagaaaagtgctcttgagtacaataccttaattatttcttaaaatactgactttgacctagctcactgtattttttatttaatggattatggattacagtatttttcttctgagttaaattttcataatttatgtgaagacacaaagatgtttaaaacaatgattattcataagaaatcatgatggtctcagtattattttagtgtattggaaggtctttgatcttaatagaatttataaatttcagcttctccagaataatcataaaactgcaaaaagatattataattgagtcatgattgagatacagttttgaggctattataattgtataattatttaatttgcattatctgtaaaatgtagtaaggtctttgaggggatattttttatttacatgaattactgaatttctattttattatttcacctaaaattaaggtaaaatatggcatttcataagttctgctttcagcattttccttaaagttgtaaaaaatcaagctatgtacttattttctatatttgggtgtgttaaattgaggattagaaaaatccacataatcactgataaagcattgaaacagaataacccaagggtagtgtaccgattcagtaacatgttaaaaatattgctatgcatttattcaaaggaaaatggtctgttcttgagaaataaaagatcagttgcaattaggataattaaatagttaaatatgagtcaagtgtatgcaatatacatttatatgaaccaaagcttgctttatcaggaccatgccctacagttcaaaacataaacatagtgaatgtgttaatatcatataataaggtaataaatgccagtcttagtgtgaagcaagtgggtggcccccttggtagtataattggacaggattttcctccagaatatttcctgtcaccctccaagagtcactacagtaattgattgctggcatggaacacattgcccttgtcttgttagtatgaattgggttctccagtgactagaagaactggggtgtgtgaaagtattcgatgccaggagattcaaaaaggaagctctcaaagataagatcattttatggcacaattgagtctataaccagccctttaagcagtagtaaaaatgtcctttgtcatacttactagaaatactatgagttttttttttttttttcatttgagacggagtctcgctctgtcacccaggctggaatgcagtggcacgatcttggctcactgcaacctctgcttcccgggttcaagcagtttcctgcttcagacttccaagtagctgggattacagacatgccaccatgccaggctaatttttttaatatttttagtagagatggggtttcaccattttggccattctagtcttgaactcctgacctcaggtgatctgcccgccttggcctcccaaagtgctgacattacaggcctgagccactgcgcccagccaataccatgagttttaagcctcacatcgtcacttgctgtcactgccagtgcctgttttattcatattgctggacaacagacatatgccaccaattgtatgattaataaagtctttttctggccattttgtccattataaaggaaataaactaattgttaacttgcatagattacttcttagtttcctatgctaccaccactgccaagggagaaaaaaatacatcattttgtaatgtctttagtatttctttataactagtgttaaggttttgttaattttattgtatacatttgtaacatttattaggagccttttaggttccaaaacaaacaaaaggcataaaaaagtctagcttagaaccacttttcacttgctttcatttttaattttattcacttaacagctaacatctttcttgtttcttgttttttccattatatggttatcgattcaactcttgctatattccttaaatttgtatgtatcatcagaagaaagagatgaacaatttagtgtagatattttattctggagaataatattcaattaaattatttctacagcaggccagtaacaactagattatttgtcctttctcagtataattttaaagagcattttgttttattgtcacaatttggtaccactagtcccaggtaaccattgggccaaaggatcagttgagaaacagttaaggatgaattagcataagttatggaacagtgttagaaaacaactcaaaagtatattctttattaatgaggtggtcattattacatttgtgtcaatgaagggcagtgtagttattttaaaatgactaatattttctccccaaatacagaataattcagatgggcaaccaagttttcaagagactgctgtaggtgaagtctgtctagccaaggcagaacacttacaggagtccctaactgtgccacccttggaatgggttagtgtacaggctcagaatattgtggattacagtttttcagagaaaactaccacagatgtagacaaaaatgatctctgaaagcattgccagcagccaggtatgttccttagatttccacttaggtttggcattttggcagataagctaatcttgtataaagcatcacattttactatgcttagtgttcctgggttgtatttatctacattattagagggaatttttattttaaaaaaattgtcattcatgagaagaatgggagttcatgccacatagtattttaccaatttatataaagtgggaaaagtctttaatacttcatgatcacttgaattaaagtttttgtatctctggaaagtagaatagtgctttcatttgaatgaaaagtgtttatagattcagaaagagagatgatatctttgtatcttgatttatatacagaccatttcagaggaagttaaatgtcttacaaatccaatactttctaatgctctaacagtgttggctatttaaaagaacatgtggcaagttctatatgaatattcttggtcatctcgactaattctgaggcaatgatggacagagatgctacttcttatttaactctaggcatgttgacttttcaaagcggtttccttatttctaaacagagatgatgatcaatgagttactaattctttagaggaaaaaatgcataatttgagtgtggagttgattttaatgacagggtaattcaagttgtttgataaatttattactatattgtaagagagatctttgaccatttttcttcctttttcttggacatcactttcttccctccccttctctcttttatgtttttatccttgttaaattttatgtttacgttaccatctttcttatactttcccctgatttttctcttttaattcctctttcattctctgcctcttctctttcagctctttctctaattgtgcctattccttgttcataagaagtggagctgttagtggtagaaccactgctcatggttctaccactacaaagtggaaagtagaaatactttgcactttggccactgttgcgtttttgccaaggtaaagttcccctgccattttgaaatagctgaacaagttaaagtaatatgttccaaaaactggaagtgccataaaaaactaaaaataaaaaaaaattgtgacta

SEQ ID NO: 2311 - DNA, 3650 bp, Homo sapiens
ggcggagcgagtggaggctgcagcccagctcgtctcggcgcccgcgtcgccgtcgcgaagccccccgccccgcttccgccgcgtcggaatgagctcccggaaagtgctggccattcaggcccgaaagcggaggccgaaaagagagaaacatccgaaaaagccggagcctcaacagaaagctcctttagttcctcctcctccaccgccaccaccaccaccaccgccacctttgccagaccccacacccccggagccagaggaggagatcctgggatcagatgatgaggagcaagaggaccctgcggactactgcaaaggtggatatcatccagtgaaaattggagacctcttcaatggccggtatcatgttattagaaagcttggatgggggcacttctctactgtctggctgtgctgggatatgcaggggaaaagatttgttgcaatgaaagttgtaaaaagtgcccagcattatacggagacagccttggatgaaataaaattgctcaaatgtgttcgagaaagtgatcccagtgacccaaacaaagacatggtggtccagctcattgacgacttcaagatttcaggcatgaatgggatacatgtctgcatggtcttcgaagtacttggccaccatctcctcaagtggatcatcaaatccaactatcaaggcctcccagtacgttgtgtgaagagtatcattcgacaggtccttcaagggttagattacttacacagtaagtgcaagatcattcatactgacataaagccggaaaatatcttgatgtgtgtggatgatgcatatgtgagaagaatggcagctgaggccactgagtggcagaaagcaggtgctcctcctccttcagggtctgcagtgagtacggctccacagcagaaacctataggaaaaatatctaaaaacaaaaagaaaaaactgaaaaagaaacagaagaggcaggctgagttattggagaagcgcctgcaggagatagaagaattggagcgagaagctgaaaggaaaataatagaagaaaacatcacctcagctgcaccttccaatgaccaggatggcgaatactgcccagaggtgaaactaaaaacaacaggattagaggaggcggctgaggcagagactgcaaaggacaatggtgaagctgaggaccaggaagagaaagaagatgctgagaaagaaaacattgaaaaagatgaagatgatgtagatcaggaacttgcgaacatagaccctacgtggatagaatcacctaaaaccaatggccatattgagaatggcccattctcactggagcagcaactggacgatgaagatgatgatgaagaagactgcccaaatcctgaggaatataatcttgatgagccaaatgcagaaagtgattacacatatagcagctcctatgaacaattcaatggtgaattgccaaatggacgacataaaattcccgagtcacagttcccagagttttccacctcgttgttctctggatccttagaacctgtggcctgcggctctgtgctttctgagggatcaccacttactgagcaagaggagagcagtccatcccatgacagaagcagaacggtttcagcctccagtactggggatttgccaaaagcaaaaacccgggcagctgacttgttggtgaatcccctggatccgcggaatgcagataaaattagagtaaaaattgctgacctgggaaatgcttgttgggtgcataaacacttcacggaagacatccagacgcgtcagtaccgctccatagaggttttaataggagcggggtacagcacccctgcggacatctggagcacggcgtgtatggcatttgagctggcaacgggagattatttgtttgaaccacattctggggaagactattccagagacgaagaccacatagcccacatcatagagctgctaggcagtattccaaggcactttgctctatctggaaaatattctcgggaattcttcaatcgcagaggagaactgcgacacatcaccaagctgaagccctggagcctctttgatgtacttgtggaaaagtatggctggccccatgaagatgctgcacagtttacagatttcctgatcccgatgttagaaatggttccagaaaaacgagcctcagctggcgaatgccttcggcatccttggttgaattcttagcaaattctaccaatattgcattctgagctagcaaatgttcccagtacattggacctaaacggtgactctcattctttaacaggattacaagtgagctggcttcatcctcagacctttattttgctttgaggtactgttgtttgacattttgctttttgtgcactgtgatcctggggaagggtagtcttttgtcttcagctaagtagtttactgaccattttcttctggaaacaataacatgtctctaagcattgtttcttgtgttgtgtgacattcaaatgtcatttttttgaatgaaaaatactttcccctttgtgttttggcaggttttgtaactatttatgaagaaatattttagctgagtactatataatttacaatcttaagaaattatcaagttggaaccaagaaatagcaaggaaatgtacaattttatcttctggcaaagggacatcattcctgtattatagtgtatgtaaatgcaccctgtaaatgttactttccattaaatatgggagggggactcaaatttcagaaaagctaccaagtcttgagtgctttgtagcctatgttgcatgtagcggactttaactgctccaaggagttgtgcaaacttttcattccataacagtcttttcacattggattttaaacaaagtggctctgggttataagatgtcattctctatatggcactttaaaggaagaaaagatatgtttctcattctaaaatatgcattataatttagcagtcccatttgtgattttgcatatttttaaaagtacttttaaagaagagcaatttccctttaaaaatgtgatggctcagtaccatgtcatgttgcctcctctgggcgctgtaagttaagctctacatagattaaattggagaaacgtgttaattgtgtggaatgaaaaaatacatatatttttggaaaagcatgatcatgcttgtctagaacacaaggtatggtatatacaatttgcagtgcagtgggcagaatacttctcacagctcaaagataacagtgatcacattcattccataggtagctttacgtgtggctacaacaaattttactagctttttcattgtctttccatgaaacgaagttgagaaaatgattttccctttgcaggttgcacacagttttgtttatgcatttccttaaaattaattgtagactccaggatacaaaccatagtaggcaatacaattttagaatgtaatatatagaggtatatttagcctcttttagaagtcagtggattgaatgtctttttattttaaattttacattcattaaggtgcctcgtttttgactttgtccattaacatttatccatatgcctttgcaataactagattgtgaaaagctaacaagtgttgtaacaataatccattgtttgaggtgcttgcagttgtcttaaaaattaaagtgttttggtttttttttttcca

SEQ ID NO: 2312 - DNA, 1710 bp, Homo sapiens
cgcgccgcttccggtctgcagccttgtagtggggctggagcagagcctgccgcgaacccccggagcccacgatccctcgtgccatccctcgaatccaccagcacgagcgtcccacccgcgcctgggaccatggccactgactcatgggccctggcggtggacgagcaggaagctgcggctgagtcgaggacagagctgcccagtccttactcaacaagctgatcagaagcaaccttgttgataacacaaaccaagtggaagtcctgcagcgggatccaaactcccctctgtactcggtgaagtcttttgaagagcttcggctgaaaccacagcttctccaaggagtctatgccatgggtttcaatcgtccatccaagatacaagagaacgcattgccactgatgcttgctgagcccccacagaacttaattgcccaatctcagtctggtactggtaaaacagctgccttcgtgctggccatgcttagccaagtagaacctgcaaacaaatacccccagtgtctatgtctctccccaacgtatgagctcgccctccaaacaggaaaagtgattgaacaaatgggcaaattttaccctgaactgaagctagcttatgctgttcgaggcaataaattggaaagaggccagaagatcagtgagcagattgtcattggcacccctgggactgtgctggactggtgctccaagctcaagttcattgatcccaagaaaatcaaggtgtttgttctggatgaggctgatgtcatgatagccactcagggccaccaagatcagagcatccgcatccagaggatgctgcccaggaactgccagatgctgcttttctccgccacctttgaagactctgtgtggaagtttgcccagaaagtggtcccagacccaaacgttatcaaactgaagcgtgaggaagagaccctggacaccatcaagcagtactatgtcctgtgcagcagcagagacgagaagttccaggccttgtgtaacctctacggggccatcaccattgctcaagccatgatcttctgccatactcgcaaaacagctagttggctggcagcagagctctcaaaagaaggccaccaggtggctctgctgagtggggagatgatggtggaacagagggctgcagtgattgagcgcttccgagagggcaaagagaaggttttggtgaccaccaacgtgtgtgcccgcggcattgatgttgaacaagtgtctgtcgtcatcaactttgatcttcccgtggacaaggacgggaatcctgacaatgagacctacctgcaccggatcgggcgcacgggccgctttggcaagaggggcctggcagtgaacatggtggacagcaagcacagcatgaacatcctgaacagaatccaggagcattttaataagaagatagaaagattggacacagatgatttggacgagattgagaaaatagccaactgagaagctccaccagccactgatgccagccctggcactgcccctgcacaggagacaagtgcgttcagggcacaggccccgacatcaccccaaggacaacggcacaagtagagagaaactacctacctcacttcaaattatgtttggacttgacaaaaatgtatgcaaatgatgggggatggtagaaaaaaattatttacacaaccttggaagattaggcatgaatacacagagatttaccttttgg

SEQ ID NO: 2313 - DNA, 5119 bp, Homo sapiens
gaactcaaggcctgcttgatacgtccgccattttgggcgcttcgctgatggtgtcggtgagcgcgtttcccgcctgagcgcaactagcggcgggtcgtgggcacctccaggagagcttgtttcatatccatatcccactgtattcctgctaatctgctaatgcagtaaattggaggaaaactgttaccaggataacctgtaatgggcaaggagccacaaagaagaaaacatttcttttaatttttaaacttggtttgaaagaccagcatgttttggaaatttgatcttcactcatcatcccacatagacacacttctagaaagagaagatgtaacactgaaggagttaatggatgaggaagatgttttacaggaatgtaaagctcagaaccgcaaacttatagagtttctgttaaaagcagaatgtctcgaagatttagtctcattcattatagaagaaccacctcaagacatggatgaaaagatcagatacaagtatccaaatatatcttgtgagttgctcacttctgatgtctcccagatgaatgatagactgggagaagatgaatccttgctaatgaaattatatagcttcctcctaaacgattcccctttgaatccactacttgccagtttcttcagcaaggtgctaagtattcttatcagcagaaaaccagaacagattgtggatttcttaaagaagaagcatgattttgtagaccttattataaagcacataggaacttctgctatcatggatttgttgctcaggctcctgacgtgtatcgaacctccacagcccaggcaagatgtgctgaattggttaaatgaggagaaaattatccagaggcttgtggaaatagttcatccatcgcaagaagaagatcgacattcaaatgcatcacaatcactttgtgaaattgttcgcctgagcagagaccagatgttacaaattcagaacagtacagagcccgaccccctgcttgccactctagaaaagcaagaaattatagagcagcttctatcaaatattttccacaaggagaaaaatgagtcagccatagtcagtgcaatccagatattgctgactttacttgagacacgacgaccaacatttgaaggccatatagagatctgcccaccaggcatgagccattcagcttgttcagtaaacaagagtgttctagaagccatcagaggaagacttggatcttttcatgaactcctgctggagccacccaagaaaagtgtgatgaagaccacatggggtgtgctggatcctcctgtggggaatacccggttgaatgtcattaggttgatatccagcctgcttcaaaccaataccagcagtataaatggggaccttatggagctgaatagcattggagtcatattgaacatgttcttcaagtatacatggaataactttttgcatacacaagtggaaatttgtattgcactgattcttgcaagtccttttgaaaacacagaaaatgccacaattaccgatcaagactccactggtgataatttgttattaaaacatcttttccaaaaatgtcaattaatagaacgaatacttgaagcctgggaaatgaatgagaagaaacaggctgagggaggaagacggcatggttacatgggacacctaacgaggatagctaactgtatcgtgcacagcactgacaagggccccaacagtgcattagtgcagcagcttatcaaagatcttcccgacgaagtcagggaacgatgggagacgttctgcacaagctccttaggagaaactaacaagaggaacacggtagatctagttacaacctgccatattcattcatccagtgatgatgaaattgactttaaagaaacgggtttctcacaggattcttctttgcagcaagccttttctgattatcagatgcaacaaatgacgtccaattttattgaccagtttggcttcaacgatgagaagtttgcagatcaagatgacattggcaatgtttcttttgatcgagtatcagacatcaactttactctcaatacaaatgaaagtggaaatattgccttgtttgaagcatgttgtaaggaaagaatacaacagtttgatgatggtggctctgatgaggaagatatatgggaggaaaagcacatcgcattcacaccagaatcccaaagacgatccagctcggggagtacagacagtgaggaaagtacagactctgaagaagaagatggagcaaagcaagacttgtttgaacccagcagtgccaacacggaggataaaatggaggtggacctgagtgaaccacccaactggtcagctaactttgatgtcccaatggaaacaacccacggtgctccattggattctgtgggatctgatgtctggagcacagaggagccgatgccaactaaagagacgggctgggcttctttttcagagttcacgtcttccctgagcacaaaagattctttaaggagtaattctccagtggaaatggaaaccagcactgaacccatggaccctctgactcccagtgcggctgccctggcagtgcagccagaagcggcaggcagtgtggccatggaagccagctctgacggagaggaggatgcagaaagtacagacaaggtaactgagacagtgatgaatggcggcatgaaggaaacgctcagcctcactgtagatgccaagacagagactgcggtcttcaaaaggttattgggaggatgcagtgaggaagggaaactgtctacctctcaagatgctgcttgtaaagacgcagaggagtgtcccgagactgcagaggcgaagtgcgcggcgcccaggcctcccagcagcagtcccgagcagaggactggccaaccaagcgcaccaggtgacacttcagtgaatggccctgtatgacgggtgacgtctgctgctgctgactgaggactgcagaccgccaccactcaggggctctggaggggtcagctggagcccaccaagctgtcactgctgcactcactctgcaagggatcaggaccagcaacctttatattctagattctaagacattgtacagagaaattcagaagtgtaaaaatattgcacattgacaaataccaagaatttttgcgtatgtttatattgtattgttctaaataatgggtagcctgtgaaataagatcttgccacccatgtaataatagtagtaatactatagttaaaatggctgtaagaatagttttataaaagtgaatacacagatctattgtatttgaaacataactttgacaattattagtgtgaccaaagtattaggcggttttcatacatttttcaccttgtacaaaattatgaattcatttttcctccaggccgacaaggagttgtagaatgaaaatgccctctaagtgttattttggttgttctaacttacaaaagtgattttgaataagaaatatttggtgttctttttataaccagtttttgattggtaattgttttctgtattgtttaaaacggatcaaaaatgtaagtctattggtagagattaagtaaagtatttattgctacatcatagttgataaattgatgttatcgtaaagccatatgttctgttcaagtcttgtttgcttgaaatgattattcctacaagtgaaacactagactatttggagtgtatatggcttgtgttttgggattttttttttttttttttggcttttgtttttgtttgtttttttgtttcatttggtagttcatctgccttttaacccattcaccaaaatttaccttgttaacaagcatcaccaatgaacatttcagagcaatctgcatatttaacagacctaaaataaatcctattaggcaagtcagttgaaaatgctcgtgctgctaatggaattagagtgcgttcattttacaggctagtattttaaaagtagaaatcaaaatctggcaccgaagcatgctaattgtttactgtaccttgtgaggttttcactcataaatttaaaccagtgtatttttttagaactggtttgtgtatatatatagtgattatggatactaattcaatgtaatttataattttctatgtcaatacaaaaatacatcacagccttctcaaacagctcaagcaatatattgtatattgccatatcgtctggtgaaagggttaaattacttcacctcttgcacttttagatgcaaatcagtttttcatttctgtaatagaaaattattcacgtatttttacatcatttgtttttcctgaccagtatttaaaaccaaaaggatattctgaaaaatggccaacaatttttttagaagtagcatcccaagcagcgtgcctaaacattacattgcatatggaaataaaagaatcaaacgtctaatgccttattatttctgatttcctttttcattttaagtggtgtggagattccagcactcccaggacagtggagtcagcagtaagccctgggacaggtggcaagggtgggtcccttgacctttgcacgcctcctcaggaaccccctttcccgggtgagcccctctctgaagagactgtccttgggcctcctctggaagcagcacccccagaggacagggctcctcctgcttgcctcagggctgcctgacttgaatggcgttggacctcggggattactggtagataatatgctctggtctcgcctggtggtgagttttgccagccatggccagggtttggctccactggtggcacacgtggcctccgtggtatggacctggtggcttctccatcccactgtggcctctgtggtatggacctggtggcttctccatcctacccaaggtaacagtgtcttgcttcatcccactgactgctgggagagagcctctgggacttttctttggggcatcattttgttttgtctttcgtagcagggaaaggatatgacaatggggaggacagttcttttggaggttggaggggccaagccaaggacaggagcaagtgtgccctcattttgtttctacttttaatttctgtgtgttggccatactgaattatgagactaacagatgtctacaatacaatacctgtattcaaaataacaaaaataaagcctgattctttgtttct

SEQ ID NO: 2314 - DNA, 5093 bp, Homo sapiens
gcttgatacgtccgccattttgggcgcttcgctgatggtgtcggtgagcgcgtttcccgcctgagcgcaactagcggcgggtcgtgggcacctccaggagagcttgtttcatatccatatcccactgtattcctgctaatctgctaatgcagtaaattggaggaaaactgttaccaggataacctgtaatgggcaaggagccacaaagaagaaaacatttcttttaatttttaaacttggtttgaaagaccagcatgttttggaaatttgatcttcactcatcatcccacatagacacacttctagaaagagaagatgtaacactgaaggagttaatggatgaggaagatgttttacaggaatgtaaagctcagaaccgcaaacttatagagtttctgttaaaagcagaatgtctcgaagatttagtctcattcattatagaagaaccacctcaagacatggatgaaaagatcagatacaagtatccaaatatatcttgtgagttgctcacttctgatgtctcccagatgaatgatagactgggagaagatgaatccttgctaatgaaattatatagcttcctcctaaacgattcccctttgaatccactacttgccagtttcttcagcaaggtgctaagtattcttatcagcagaaaaccagaacagattgtggatttcttaaagaagaagcatgattttgtagaccttattataaagcacataggaacttctgctatcatggatttgttgctcaggctcctgacgtgtatcgaacctccacagcccaggcaagatgtgctgaattggttaaatgaggagaaaattatccagaggcttgtggaaatagttcatccatcgcaagaagaagatcgacattcaaatgcatcacaatcactttgtgaaattgttcgcctgagcagagaccagatgttacaaattcagaacagtacagagcccgaccccctgcttgccactctagaaaagcaagaaattatagagcagcttctatcaaatattttccacaaggagaaaaatgagtcagccatagtcagtgcaatccagatattgctgactttacttgagacacgacgaccaacatttgaaggccatatagagatctgcccaccaggcatgagccattcagcttgttcagtaaacaagagtgttctagaagccatcagaggaagacttggatcttttcatgaactcctgctggagccacccaagaaaagtgtgatgaagaccacatggggtgtgctggatcctcctgtggggaatacccggttgaatgtcattaggttgatatccagcctgcttcaaaccaataccagcagtataaatggggaccttatggagctgaatagcattggagtcatattgaacatgttcttcaagtatacatggaataactttttgcatacacaagtggaaatttgtattgcactgattcttgcaagtccttttgaaaacacagaaaatgccacaattaccgatcaagactccactggtgataatttgttattaaaacatcttttccaaaaatgtcaattaatagaacgaatacttgaagcctgggaaatgaatgagaagaaacaggctgagggaggaagacggcatggttacatgggacacctaacgaggatagctaactgtatcgtgcacagcactgacaagggccccaacagtgcattagtgcagcagcttatcaaagatcttcccgacgaagtcagggaacgatgggagacgttctgcacaagctccttaggagaaactaacaagaggaacacggtagatctagttacaacctgccatattcattcatccagtgatgatgaaattgactttaaagaaacgggtttctcacaggattcttctttgcagcaagccttttctgattatcagatgcaacaaatgacgtccaattttattgaccagtttggcttcaacgatgagaagtttgcagatcaagatgacattggcaatgtttcttttgatcgagtatcagacatcaactttactctcaatacaaatgaaagtggaaatattgccttgtttgaagcatgttgtaaggaaagaatacaacagtttgatgatggtggctctgatgaggaagatatatgggaggaaaagcacatcgcattcacaccagaatcccaaagacgatccagctcggggagtacagacagtgaggaaagtacagactctgaagaagaagatggagcaaagcaagacttgtttgaacccagcagtgccaacacggaggataaaatggaggtggacctgagtgaaccacccaactggtcagctaactttgatgtcccaatggaaacaacccacggtgctccattggattctgtgggatctgatgtctggagcacagaggagccgatgccaactaaagagacgggctgggcttctttttcagagttcacgtcttccctgagcacaaaagattctttaaggagtaattctccagtggaaatggaaaccagcactgaacccatggaccctctgactcccagtgcggctgccctggcagtgcagccagaagcggcaggcagtgtggccatggaagccagctctgacggagaggaggatgcagaaagtacagacaaggtaactgagacagtgatgaatggcggcatgaaggaaacgctcagcctcactgtagatgccaagacagagactgcggtcttcaaaagtgaggaagggaaactgtctacctctcaagatgctgcttgtaaagacgcagaggagtgtcccgagactgcagaggcgaagtgcgcggcgcccaggcctcccagcagcagtcccgagcagaggactggccaaccaagcgcaccaggtgacacttcagtgaatggccctgtatgacgggtgacgtctgctgctgctgactgaggactgcagaccgccaccactcaggggctctggaggggtcagctggagcccaccaagctgtcactgctgcactcactctgcaagggatcaggaccagcaacctttatattctagattctaagacattgtacagagaaattcagaagtgtaaaaatattgcacattgacaaataccaagaatttttgcgtatgtttatattgtattgttctaaataatgggtagcctgtgaaataagatcttgccacccatgtaataatagtagtaatactatagttaaaatggctgtaagaatagttttataaaagtgaatacacagatctattgtatttgaaacataactttgacaattattagtgtgaccaaagtattaggcggttttcatacatttttcaccttgtacaaaattatgaattcatttttcctccaggccgacaaggagttgtagaatgaaaatgccctctaagtgttattttggttgttctaacttacaaaagtgattttgaataagaaatatttggtgttctttttataaccagtttttgattggtaattgttttctgtattgtttaaaacggatcaaaaatgtaagtctattggtagagattaagtaaagtatttattgctacatcatagttgataaattgatgttatcgtaaagccatatgttctgttcaagtcttgtttgcttgaaatgattattcctacaagtgaaacactagactatttggagtgtatatggcttgtgttttgggattttttttttttttttttggcttttgtttttgtttgtttttttgtttcatttggtagttcatctgccttttaacccattcaccaaaatttaccttgttaacaagcatcaccaatgaacatttcagagcaatctgcatatttaacagacctaaaataaatcctattaggcaagtcagttgaaaatgctcgtgctgctaatggaattagagtgcgttcattttacaggctagtattttaaaagtagaaatcaaaatctggcaccgaagcatgctaattgtttactgtaccttgtgaggttttcactcataaatttaaaccagtgtatttttttagaactggtttgtgtatatatatagtgattatggatactaattcaatgtaatttataattttctatgtcaatacaaaaatacatcacagccttctcaaacagctcaagcaatatattgtatattgccatatcgtctggtgaaagggttaaattacttcacctcttgcacttttagatgcaaatcagtttttcatttctgtaatagaaaattattcacgtatttttacatcatttgtttttcctgaccagtatttaaaaccaaaaggatattctgaaaaatggccaacaatttttttagaagtagcatcccaagcagcgtgcctaaacattacattgcatatggaaataaaagaatcaaacgtctaatgccttattatttctgatttcctttttcattttaagtggtgtggagattccagcactcccaggacagtggagtcagcagtaagccctgggacaggtggcaagggtgggtcccttgacctttgcacgcctcctcaggaaccccctttcccgggtgagcccctctctgaagagactgtccttgggcctcctctggaagcagcacccccagaggacagggctcctcctgcttgcctcagggctgcctgacttgaatggcgttggacctcggggattactggtagataatatgctctggtctcgcctggtggtgagttttgccagccatggccagggtttggctccactggtggcacacgtggcctccgtggtatggacctggtggcttctccatcccactgtggcctctgtggtatggacctggtggcttctccatcctacccaaggtaacagtgtcttgcttcatcccactgactgctgggagagagcctctgggacttttctttggggcatcattttgttttgtctttcgtagcagggaaaggatatgacaatggggaggacagttcttttggaggttggaggggccaagccaaggacaggagcaagtgtgccctcattttgtttctacttttaatttctgtgtgttggccatactgaattatgagactaacagatgtctacaatacaatacctgtattcaaaataacaaaaataaagcctgattctttgtttctagaaa

SEQ ID NO: 2315 - DNA, 5069 bp, Homo sapiens
gtcggtgagcgcgtttcccgcctgagcgcaactagcggcgggtcgtgggcacctccaggagagcttgtttcatatccatatcccactgtattcctgctaatctgctaatgcagtaaattggaggaaaactgttaccaggataacctgtaatgggcaaggagccacaaagaagaaaacatttcttttaatttttaaacttggtttgaaagaccagcatgttttggaaatttgatcttcactcatcatcccacatagacacacttctagaaagagaagatgtaacactgaaggagttaatggatgaggaagatgttttacaggaatgtaaagctcagaaccgcaaacttatagagtttctgttaaaagcagaatgtctcgaagatttagtctcattcattatagaagaaccacctcaagacatggatgaaaagatcagatacaagtatccaaatatatcttgtgagttgctcacttctgatgtctcccagatgaatgatagactgggagaagatgaatccttgctaatgaaattatatagcttcctcctaaacgattcccctttgaatccactacttgccagtttcttcagcaaggtgctaagtattcttatcagcagaaaaccagaacagattgtggatttcttaaagaagaagcatgattttgtagaccttattataaagcacataggaacttctgctatcatggatttgttgctcaggctcctgacgtgtatcgaacctccacagcccaggcaagatgtgctgaattggttaaatgaggagaaaattatccagaggcttgtggaaatagttcatccatcgcaagaagaagatcgacattcaaatgcatcacaatcactttgtgaaattgttcgcctgagcagagaccagatgttacaaattcagaacagtacagagcccgaccccctgcttgccactctagaaaagcaagaaattatagagcagcttctatcaaatattttccacaaggagaaaaatgagtcagccatagtcagtgcaatccagatattgctgactttacttgagacacgacgaccaacatttgaaggccatatagagatctgcccaccaggcatgagccattcagcttgttcagtaaacaagagtgttctagaagccatcagaggaagacttggatcttttcatgaactcctgctggagccacccaagaaaagtgtgatgaagaccacatggggtgtgctggatcctcctgtggggaatacccggttgaatgtcattaggttgatatccagcctgcttcaaaccaataccagcagtataaatggggaccttatggagctgaatagcattggagtcatattgaacatgttcttcaagtatacatggaataactttttgcatacacaagtggaaatttgtattgcactgattcttgcaagtccttttgaaaacacagaaaatgccacaattaccgatcaagactccactggtgataatttgttattaaaacatcttttccaaaaatgtcaattaatagaacgaatacttgaagcctgggaaatgaatgagaagaaacaggctgagggaggaagacggcatggttacatgggacacctaacgaggatagctaactgtatcgtgcacagcactgacaagggccccaacagtgcattagtgcagcagcttatcaaagatcttcccgacgaagtcagggaacgatgggagacgttctgcacaagctccttaggagaaactaacaagaggaacacggtagatctagttacaacctgccatattcattcatccagtgatgatgaaattgactttaaagaaacgggtttctcacaggattcttctttgcagcaagccttttctgattatcagatgcaacaaatgacgtccaattttattgaccagtttggcttcaacgatgagaagtttgcagatcaagatgacattggcaatgtttcttttgatcgagtatcagacatcaactttactctcaatacaaatgaaagtggaaatattgccttgtttgaagcatgttgtaaggaaagaatacaacagtttgatgatggtggctctgatgaggaagatatatgggaggaaaagcacatcgcattcacaccagaatcccaaagacgatccagctcggggagtacagacagtgaggaaagtacagactctgaagaagaagatggagcaaagcaagacttgtttgaacccagcagtgccaacacggaggataaaatggaggtggacctgagtgaaccacccaactggtcagctaactttgatgtcccaatggaaacaacccacggtgctccattggattctgtgggatctgatgtctggagcacagaggagccgatgccaactaaagagacgggctgggcttctttttcagagttcacgtcttccctgagcacaaaagattctttaaggagtaattctccagtggaaatggaaaccagcactgaacccatggaccctctgactcccagtgcggctgccctggcagtgcagccagaagcggcaggcagtgtggccatggaagccagctctgacggagaggaggatgcagaaagtacagacaaggtaactgagacagtgatgaatggcggcatgaaggaaacgctcagcctcactgtagatgccaagacagagactgcggtcttcaaaagagtgttgaaatcctatcgtgaggaagggaaactgtctacctctcaagatgctgcttgtaaagacgcagaggagtgtcccgagactgcagaggcgaagtgcgcggcgcccaggcctcccagcagcagtcccgagcagaggactggccaaccaagcgcaccaggtgacacttcagtgaatggccctgtatgacgggtgacgtctgctgctgctgactgaggactgcagaccgccaccactcaggggctctggaggggtcagctggagcccaccaagctgtcactgctgcactcactctgcaagggatcaggaccagcaacctttatattctagattctaagacattgtacagagaaattcagaagtgtaaaaatattgcacattgacaaataccaagaatttttgcgtatgtttatattgtattgttctaaataatgggtagcctgtgaaataagatcttgccacccatgtaataatagtagtaatactatagttaaaatggctgtaagaatagttttataaaagtgaatacacagatctattgtatttgaaacataactttgacaattattagtgtgaccaaagtattaggcggttttcatacatttttcaccttgtacaaaattatgaattcatttttcctccaggccgacaaggagttgtagaatgaaaatgccctctaagtgttattttggttgttctaacttacaaaagtgattttgaataagaaatatttggtgttctttttataaccagtttttgattggtaattgttttctgtattgtttaaaacggatcaaaaatgtaagtctattggtagagattaagtaaagtatttattgctacatcatagttgataaattgatgttatcgtaaagccatatgttctgttcaagtcttgtttgcttgaaatgattattcctacaagtgaaacactagactatttggagtgtatatggcttgtgttttgggattttttttttttttttttggcttttgtttttgtttgtttttttgtttcatttggtagttcatctgccttttaacccattcaccaaaatttaccttgttaacaagcatcaccaatgaacatttcagagcaatctgcatatttaacagacctaaaataaatcctattaggcaagtcagttgaaaatgctcgtgctgctaatggaattagagtgcgttcattttacaggctagtattttaaaagtagaaatcaaaatctggcaccgaagcatgctaattgtttactgtaccttgtgaggttttcactcataaatttaaaccagtgtatttttttagaactggtttgtgtatatatatagtgattatggatactaattcaatgtaatttataattttctatgtcaatacaaaaatacatcacagccttctcaaacagctcaagcaatatattgtatattgccatatcgtctggtgaaagggttaaattacttcacctcttgcacttttagatgcaaatcagtttttcatttctgtaatagaaaattattcacgtatttttacatcatttgtttttcctgaccagtatttaaaaccaaaaggatattctgaaaaatggccaacaatttttttagaagtagcatcccaagcagcgtgcctaaacattacattgcatatggaaataaaagaatcaaacgtctaatgccttattatttctgatttcctttttcattttaagtggtgtggagattccagcactcccaggacagtggagtcagcagtaagccctgggacaggtggcaagggtgggtcccttgacctttgcacgcctcctcaggaaccccctttcccgggtgagcccctctctgaagagactgtccttgggcctcctctggaagcagcacccccagaggacagggctcctcctgcttgcctcagggctgcctgacttgaatggcgttggacctcggggattactggtagataatatgctctggtctcgcctggtggtgagttttgccagccatggccagggtttggctccactggtggcacacgtggcctccgtggtatggacctggtggcttctccatcccactgtggcctctgtggtatggacctggtggcttctccatcctacccaaggtaacagtgtcttgcttcatcccactgactgctgggagagagcctctgggacttttctttggggcatcattttgttttgtctttcgtagcagggaaaggatatgacaatggggaggacagttcttttggaggttggaggggccaagccaaggacaggagcaagtgtgccctcattttgtttctacttttaatttctgtgtgttggccatactgaattatgagactaacagatgtctacaatacaatacctgtattcaaaataacaaaaataaagcctgattctttgtttctag

SEQ ID NO: 2316 - DNA, 1395 bp, Homo sapiens
acttccttcgtctgggtggttgccccagcgacacgttgggccgaagagcggtgttgggtacccgagagacccggcggtggggaagtcacttcctcccgaagacgctgtttcctagcaaccgccctccgcctctgttattagcccctcctcctcgctcggtccaggaccggctctgcgggcgccgccaggcccagaccaagctactatcagaagttgaattctaataattagctattttataaaggtaacgagaaaaaatacactatgtctgatgaagtttttagcaccactttggcatatacaaagagtccaaaagttaccaaaagaactactttccaggatgagctaataagagcaattacagctcgctcagccagacaaaggagttctgaatactcagatgactttgacagtgatgagattgtttctttaggtgatttttctgacacttcagcagatgaaaattcagttaataaaaaaatgaatgactttcatatatcagatgatgaagaaaagaatccttcaaaactattgtttttgaaaaccaataaatcaaacggtaacataaccaaagatgagccagtgtgtgccatcaaaaatgaagaggaaatggcacctgatgggtgtgaagacattgttgtaaaatctttctctgaatctcaaaataaggatgaggaatttgaaaaagacaaaataaaaatgaaacctaaacccagaattctttcaattaaaagcacatcttcagcagaaaacaacagccttgacacagatgatcactttaaaccatcacctcggccaaggagtatgttgaaaaagaaaagtcacatggaggagaaggatggactagaagataaagaaactgccctcagtgaagaattggagttacattctgcaccttcttcccttccaacgccgaatggcatacaattagaagctgagaaaaaagcattctctgaaaaccttgatcctgaggattcatgcttaacaagtctagcatcatcatcacttaaacaaattcttggagattctttttcaccaggatctgagggaaacgcatctggaaaagatccaaatgaagaaatcactgaaaaccataattccttgaaatcagatgaaaataaagagaattcattttcagcagaccatgtgactactgcagttgagaaatccaaggaaagtcaagtgactgctgatgaccttgaagaagaaaaggcaaaagcggaactgattatggatgatgacagaacagttgatccactactatctaaatctcagagtatcttaatatctaccagtgcaacagcatcttcaaagaaaacaattgaagatagaaatataaagaataaaaagtcaacaaataatagagcatccagtgcatctgccagcaaagctagt

SEQ ID NO: 2317 - DNA, 1644 bp, Homo sapiens
agcctacaccgactctggaggaagactggagcctttgcggcggcgctgcccctcccctggtccccgcgagctcggagggcccggctggtgctgcgggggccccgggaggtacggacctgggaggcgaggctcgtccggcgctaggatcggcctccgcctccgggccgctttaggttgaaaactaagcatggggaagagctgcaaggtggtcgtgtgtggccaggcgtctgtgggcaaaacttcaatcctggagcagcttctgtatgggaaccatgtagtgggttcggagatgatcgagacgcaggaggacatctacgtgggctccattgagacagaccggggggtgcgagagcaggtgcgtttctatgacacccgggggctccgagatggggccgaactgccccgacactgcttctcttgcactgatggctacgtcctggtctatagcacagatagcagagagtcttttcagcgtgtggagctgctcaagaaggagattgacaaatccaaggacaagaaggaggtcaccatcgtggtccttggcaacaagtgtgacttacaggagcagcggcgtgtagacccagatgtggctcagcactgggccaagtcagagaaggtgaagctgtgggaggtgtcagtggcggaccggcgctccctcctggagccctttgtctacttggccagcaagatgacgcaaccccagagcaagtctgccttccccctcagccggaagaacaagggcagcggctccttggatggctgaagagctgccgttcctctttcacgatcccagccccatttcagtgtctggggctctggtagatgtgttgagggcaaagtagaggacaagctgtctttcccagtcagccagggagctccccgccaggccacgccccagccactttgctccctctcacctctgggaagtgcaaatactcttggttgacatccccttcctcagccctcccagcctactccccatcccagcttttagaggatctgctccactgtctcctggggcagttgtgggtcactgtcccttccagctgccccagacaggaagcagagtcaccacgcagcagtgtcccttcttgggtctgagttcctattataggtaggggccccaccctctgggcttcccatcagcgacacacacacacttatggcaccagcctggactccagaaaaagggtgtccaggtattgtgtgtatgcatttagttgtgcacacacaaatatgctcctatactggcattaggcgtctcctcatccctcaccctgacctttctcctgtccttttcttggctggaagaagttggcctcctgggagtgtagttttctgttttaaatcccccacccctggctgggctcagtggctcacccctgtaatcccagcactttgggaggccaaggcgggtcgattacttgaggtcaggagttcacgaccagcctggccaacattgtgaaaccccatctctgccaaaaatacaaaagttagccgggcgtagtggcacatgcctgtaatcccagctacccggggaggctgaggcaggagaattgcttgaactcagaaggcggaggctgcagtgagccgagatcgtgccactgcactccagcctggtcaacagagcaagactccatctcg

SEQ ID NO: 2318 - DNA, 1598 bp, Homo sapiens
agcctacaccgactctggaggaagactggagcctttgcggcggcgctgcccctcccctggtccccgcgagctcggagggcccggctggtgctgcgggggccccgggagcgtgcttctgttcttcaaggttgaaaactaagcatggggaagagctgcaaggtggtcgtgtgtggccaggcgtctgtgggcaaaacttcaatcctggagcagcttctgtatgggaaccatgtagtgggttcggagatgatcgagacgcaggaggacatctacgtgggctccattgagacagaccggggggtgcgagagcaggtgcgtttctatgacacccgggggctccgagatggggccgaactgccccgacactgcttctcttgcactgatggctacgtcctggtctatagcacagatagcagagagtcttttcagcgtgtggagctgctcaagaaggagattgacaaatccaaggacaagaaggaggtcaccatcgtggtccttggcaacaagtgtgacttacaggagcagcggcgtgtagacccagatgtggctcagcactgggccaagtcagagaaggtgaagctgtgggaggtgtcagtggcggaccggcgctccctcctggagccctttgtctacttggccagcaagatgacgcaaccccagagcaagtctgccttccccctcagccggaagaacaagggcagcggctccttggatggctgaagagctgccgttcctctttcacgatcccagccccatttcagtgtctggggctctggtagatgtgttgagggcaaagtagaggacaagctgtctttcccagtcagccagggagctccccgccaggccacgccccagccactttgctccctctcacctctgggaagtgcaaatactcttggttgacatccccttcctcagccctcccagcctactccccatcccagcttttagaggatctgctccactgtctcctggggcagttgtgggtcactgtcccttccagctgccccagacaggaagcagagtcaccacgcagcagtgtcccttcttgggtctgagttcctattataggtaggggccccaccctctgggcttcccatcagcgacacacacacacttatggcaccagcctggactccagaaaaagggtgtccaggtattgtgtgtatgcatttagttgtgcacacacaaatatgctcctatactggcattaggcgtctcctcatccctcaccctgacctttctcctgtccttttcttggctggaagaagttggcctcctgggagtgtagttttctgttttaaatcccccacccctggctgggctcagtggctcacccctgtaatcccagcactttgggaggccaaggcgggtcgattacttgaggtcaggagttcacgaccagcctggccaacattgtgaaaccccatctctgccaaaaatacaaaagttagccgggcgtagtggcacatgcctgtaatcccagctacccggggaggctgaggcaggagaattgcttgaactcagaaggcggaggctgcagtgagccgagatcgtgccactgcactccagcctggtcaacagagcaagactccatctcg

SEQ ID NO: 2319 - DNA, 2463 bp, Homo sapiens
ggcaggcggcgggggcggggcctggaggagcctacaccgactctggaggaagactggagcctttgcggcggcgctgcccctcccctggtccccgcgagctcggagggcccggctggtgctgcgggggccccgggaggttgaaaactaagcatggggaagagctgcaaggtggtcgtgtgtggccaggcgtctgtgggcaaaacttcaatcctggagcagcttctgtatgggaaccatgtagtggctatgatcgagacgcaggaggacatctacgtgggctccattgagacagaccggggggtgcgagagcaggtgcgtttctatgacacccgggggctccgagatggggccgaactgccccgacactgcttctcttgcactgatggctacgtcctggtctatagcacagatagcagagagtcttttcagcgtgtggagctgctcaagaaggagattgacaaatccaaggacaagaaggaggtcaccatcgtggtccttggcaacaagtgtgacttacaggagcagcggcgtgtagacccagatgtggctcagcactgggccaagtcagagaaggtgaagctgtgggaggtgtcagtggcggaccggcgctccctcctggagccctttgtctacttggccagcaagatgacgcaaccccagagcaagtctgccttccccctcagccggaagaacaagggcagcggctccttggatggctgaagagctgccgttcctctttcacgatcccagccccatttcagtgtctggggctctggtagatgtgttgagggcaaagtagaggacaagctgtctttcccagtcagccagggagctccccgccaggccacgccccagccactttgctccctctcacctctgggaagtgcaaatactcttggttgacatccccttcctcagccctcccagcctactccccatcccagcttttagaggatctgctccactgtctcctggggcagttgtgggtcactgtcccttccagctgccccagacaggaagcagagtcaccacgcagcagtgtcccttcttgggtctgagttcctattataggtaggggccccaccctctgggcttcccatcagcgacacacacacacttatggcaccagcctggactccagaaaaagggtgtccaggtattgtgtgtatgcatttagttgtgcacacacaaatatgctcctatactggcattaggcgtctcctcatccctcaccctgacctttctcctgtccttttcttggctggaagaagttggcctcctgggagtgtagttttctgttttaaatcccccacccctggctgggctcagtggctcacccctgtaatcccagcactttgggaggccaaggcgggtcgattacttgaggtcaggagttcacgaccagcctggccaacattgtgaaaccccatctctgccaaaaatacaaaagttagccgggcgtagtggcacatgcctgtaatcccagctacccggggaggctgaggcaggagaattgcttgaactcagaaggcggaggctgcagtgagccgagatcgtgccactgcactccagcctggtcaacagagcaagactccatctcgaagaaaaaaaaaaaaaattccccacccctaccaattgttttacttcctcttcctgctcagggagcagatgggcctcactggttgagatggaatagaataactgggctatgagtcaccagcccactttgtgacccagcaagacctttcccctctctgggcatcagtttctcatctgtaagatgaccagagttgcttagatgatctcctagatcctttccagttctcttgatttcgtaaagccaatggcttctccctctttaaggtgctatgccaaccagccctggaggctgggatctgccgctccctccagccaccagggggcaggagtgcactacctgctgtcagtcaccagagtggccgctcagtgcccagcccgccagcctcgctcttggaggctgctctttatcctgcctgtggttttcagctcagagctggacttctatttataagttacctgtatttatatttatatgcccgctctcatggtgaaggctggacaaggtgctcctctggcccctccttcttacctcagatgcctgaacagaacaaggcaaacccgtagcagcctctcaggagctgacaggtcctctttcggggctcaggagggtgggcacacacccagcggcctgcagagtaagcttattacccacaactgtgcccgctttgtgcttctaaggtgcacacctagcctaggtgagacactgcagccaggcaaccaccgacacacgccccttctcaaagccagaggtgagtggggcaggtgcccggggctgggtgagtggaattaggacacacacaggcttgggcttcaagttcatttattgatgcattggttggacacaataaaaccacaattgttatc

SEQ ID NO: 2320 - DNA, 1863 bp, Homo sapiens
agcctacaccgactctggaggaagactggagcctttgcggcggcgctgcccctcccctggtccccgcgagctcggagggcccggctggtgctgcgggggccccgggaggttgaaaactaagcatggggaagagctgcaaggtggtcgtgtgtggccaggcgtctgtgggcaaaacttcaatcctggagcagcttctgtatgggaaccatgtagtgggttcggagatgatcgagacgcaggaggacatctacgtgggctccattgagacagaccggggggtgcgagagcaggtgcgtttctatgacacccgggggctccgagatggggccgaactgccccgacactgcttctcttgcactgatggctacgtcctggtctatagcacagatagcagagagtcttttcagcgtgtggagctgctcaagaaggagattgacaaatccaaggacaagaaggaggtcaccatcgtggtccttggcaacaagtgtgacttacaggagcagcggcgtgtagacccagatgtggctcagcactgggccaagtcagagaaggtgaagctgtgggaggtgtcagtggcggaccggcgctccctcctggagccctttgtctacttggccagcaagatgacgcaaccccagagcaagtctgccttccccctcagccggaagaacaagggcagcggctccttggatggctgaagagctgccgttcctctttcacgatcccagccccatttcagtgtctggggctctggtagatgtgttgagggcaaagtagaggacaagctgtctttcccagtcagccagggagctccccgccaggccacgccccagccactttgctccctctcacctctgggaagtgcaaatactcttggttgacatccccttcctcagccctcccagcctactccccatcccagcttttagaggatctgctccactgtctcctggggcagttgtgggtcactgtcccttccagctgccccagacaggaagcagagtcaccacgcagcagtgtcccttcttgggtctgagttcctattataggtaggggccccaccctctgggcttcccatcagcgacacacacacacttatggcaccagcctggactccagaaaaagggtgtccaggtattgtgtgtatgcatttagttgtgcacacacaaatatgctcctatactggcattaggcgtctcctcatccctcaccctgacctttctcctgtccttttcttggctggaagaagttggcctcctgggagtgtagttttctgttttaaatcccccacccctggctgggctcagtggctcacccctgtaatcccagcactttgggaggccaaggcgggtcgattacttgaggtcaggagttcacgaccagcctggccaacattgtgaaaccccatctctgccaaaaatacaaaagttagccgggcgtagtggcacatgcctgtaatcccagctacccggggaggctgaggcaggagaattgcttgaactcagaaggcggaggctgcagtgagccgagatcgtgccactgcactccagcctggtcaacagagcaagactccatctcgaagaaaaaaaaaaaaaattccccacccctaccaattgttttacttcctcttcctgctcagggagcagatgggcctcactggttgagatggaatagaataactgggctatgagtcaccagcccactttgtgacccagcaagacctttcccctctctgggcatcagtttctcatctgtaagatgaccagagttgcttagatgatctcctagatcctttccagttctcttgatttcgtaaagccaatggcttctccctctttaaggtgctatgccaaccagccctgg

SEQ ID NO: 2321 - DNA, 1302 bp, Homo sapiens
tcgaacgggatggcagaggaggtgaggagggaggaagcgtccggagtggggcgggcccggactccgacccccggggcgcttcgagccccccagctggtcaccgaggcaccgccgcttcacccaggccacaccctgatgaaggccacggtcctgatgcggcagcctgggcgggtgcaggagatcgtgggcgccctccgcaagggcggcggagaccggttacaggtgatttctgattttgacatgaccttgagcaggtttgcatataatggaaagcgatgcccttcttcttacaatattctggataatagcaagatcatcagtgaggagtgtcggaaagagctcacagcgctccttcaccactattacccaattgagatcgacccacaccggaccgtcaaggagaagctacctcatatggtggaatggtggaccaaagcacacaatctcctatgtcagcagaagattcagaagtttcagatagcccaggtggttagagagtccaatgcaatgctcagggagggatataagaccttcttcaacacactctaccataacaacattccccttttcatcttttctgcgggcattggtgatatcctggaagaaattatccgacagatgaaagtgttccaccccaacatccacatcgtgtctaactacatggattttaatgaagatggttttctccagggatttaagggccagctcatacacacatacaacaagaacagctctgcgtgtgagaactctggttacttccagcaacttgagggcaaaaccaatgtcatcctgctgggagactctatcggggacctcaccatggccgatggggttcctggtgtgcagaacattctcaaaattggcttcctgaatgacaaggtggaggagcggcgggagcgctacatggactcctatgacatcgtgctggagaaggacgagactctggatgtggtcaacgggctactgcagcacatcctgtgccagggggtccagctggagatgcaaggcccctgaaggcgcaggctccagcccggcctgcaggccgtggtgaggaggggcgcctccccagagtctgctcccccgtgaacacagagcagaggccagggtggccagcagtggctgggtccttccgcgcccctccgtcctcctttccctgagcaccttcatcaccagaggcttgaaggaaccccgccatgtggcagggcacaggcactgttcctggtgaaccttggaccacagcatgtcagtgctctagggattgtctactccagggattttcttcaaaatttttaaacatgggaa

SEQ ID NO: 2322 - DNA, 1058 bp, Homo sapiens
gaaacaggggataatacggcggagccgcctgggctgcagtcccacccgggagccggcagggagcggagctgcggagccgcctggtctcccgcgtccatcggtccattcctgcgtcgttctgtccttccgaacgcacacttcaggagcagccgcgagggtggcatggcagcgagcacagacatggctgggctggaggagagcttccgcaagtttgccatccatggtgaccccaaggccagtgggcaagagatgaatggcaagaactgggccaagctgtgcaaggactgcaaggtggctgacggaaagtccgtgacagggaccgatgtggacatcgtcttctccaaagtcaaggggaagtctgctcgggtcatcaactatgaggagttcaagaaggccctggaagagctggcgaccaagagattcaaggggaagagcaaggaggaggccttcgatgccatctgccagctggtggcaggcaaagagccagccaatgtgggcgtcactaaagcaaaaacagggggtgctgtagaccggctgacggacaccagcagatacacgggctcccacaaggagcgcttcgatgagagcggcaagggcaagggcattgcgggacggcaggacatcctggacgacagtggctacgtgagcgcctacaagaatgcaggcacctacgatgccaaggtgaagaagtgaggcttgggaagaccgccctgccaagtgcggctgcccctgccagaggctcaggcctgggtctaaggggcacgtggagcaagagatcctggtcccctccctgctggacctgccacccagagcttcctgcctagtcccactgggctggcccaccaggcctctgacccaggctgctctgcggccccttcctcctcctcttcctgctccaacttctgtccacctggggacagtctgtgcctgtagcctcatgaccccaacccagccccaggcatggctaacccctgactgcttgcctcatatttaagctgctgctctggccaagtgcctaattttaacccagacctcaataaagacaccttttgtaccaa

SEQ ID NO: 2323 - DNA, 1331 bp, Homo sapiens
ggatccggtcgggctccggaagtccctaggcaccctaggggaccgttctcggtgacggccggggtgggccaggggtcgaggtgatttgtgggtccaggacgggggttgggagctgcccccgctaacccaccctcgtctgagaggccgcgaggtttcggcctgagatcccgtgaaggcgagaaatctcgcgatttctcgggagaggaatcggttaggagaagggggattcctcactcagctgtgcgctctgatttcgtgcgcttcctcgtccttcatgttggatggccagtttttcgtttgtgcgtcatcctctacctgagaaatggtcgcttgcccctagtctagacacgcattaaagggcagtatttaaagtcagttggcaagcagtggaataagatttttgtaaagaaaccttgtgcagcatggattctctaccagatgaattttttgtgaggcatcctgctgtggaggatcagaggaaggaagaaactgagaataagctagaaaaatcatctggtcaactgaacaaacaggaaaatgacatacctactgatcttgtccctgttaacctactattagaagtgaagaagttattaaatgcaattaatactctaccaaaaggtgtggttcctcacattaagaagttcttacaagaagatttttccttccaaactatgcagagagaagttgcagctaacagccagaatggtgaggaaattgttcctgctttgactttacgtttcttgattacacagctagaagcagcacttaggaacattcaagctggcaattataccgcacaccagattaatattggttattatttgacattactgtttttatatggagtagcactcactgaaagaggaaagaaagaggattatacagaagctgagaataaatttctggtgatgaagatgatgatccaagaaaatgaaatttgtgaaaactttatgtctttagtttattttggacgtggtttactgcgatgtgctcaaaagagatataatggaggactgctagaatttcataaaagcttacaagaaattggagacaaaaatgaccattggtttgacatagatcctacagaagatgaagatttacctacaacttttaaagatcttcttaataattttatcaagacaactgaaagcaatataatgaagcagacgatttgtagttacctagattgtgaacgatcttgtgaagctgacattttgaagaacaccagttataagggattttttcagttaatgtgcagtaaaagttgctgtgtttatttccataaaatttgctggaaaaagttcaagaatttaaagtatccaggattt

SEQ ID NO: 2324 - DNA, 2301 bp, Homo sapiens
gtgggcagctccccgctctgccgctgccgccgccgtcgcccaaggaggatcggggccgggccgggccgggatgatccgggtcggaaggccgccgccgccggagggagcgggtcacccaacgccgcactgagccgcccccgccccgccccggccccgggggatgcgccgccccgagctgctgcctccgccgccgccgcagccgcagccgcagcgggcacagagcaggtagatggccccctcagggcaggcccggcggacacccctccctctggctggcggatgcagtgcctagcggccgcccttaaggacgaaaccaacatgagtgggggaggggagcaggccgacatcctgccggccaactacgtggtcaaggatcgctggaaggtgctgaaaaagatcgggggcgggggctttggtgagatctacgaggccatggacctgctgaccagggagaatgtggccctcaaggtggagtcagcccagcagcccaagcaggtcctcaagatggaggtggccgtgctcaagaagttgcaagggaaggaccatgtgtgcaggttcattggctgtggcaggaacgagaagtttaactatgtagtgatgcagctccagggccggaacctggccgacctgcgccgtagccagccgcgaggcaccttcacgctgagcaccacattgcggctgggcaagcagatcttggagtccatcgaggccatccactctgtgggcttcctgcaccgtgacatcaagccttcaaactttgccatgggcaggctgccctccacctacaggaagtgctatatgctggacttcgggctggcccggcagtacaccaacaccacgggggatgtgcggccccctcggaatgtggccgggtttcgaggaacggttcgctatgcctcagtcaatgcccacaagaaccgggagatgggccgccacgacgacctgtggtccctcttctacatgctggtggagtttgcagtgggccagctgccctggaggaagatcaaggacaaggaacaggtagggatgatcaaggagaagtatgagcaccggatgctgctgaagcacatgccgtcagagttccacctcttcctggaccacattgccagcctcgactacttcaccaagcccgactaccagttgatcatgtcagtgtttgagaacagcatgaaggagaggggcattgccgagaatgaggcctttgactgggagaaggcaggcaccgatgccctcctgtccacgagcacctctaccccgccccagcagaacacccggcagacggcagccatgtttggggtggtcaatgtgacgccagtgcctggggacctgctccgggagaacaccgaggatgtgctacagggagagcacctgagtgaccaggagaatgcacccccaattctgcccgggaggccctctgaggggctgggccccagtccccaccttgtcccccaccccgggggtcctgaggctgaagtctgggaggagacagatgtcaaccggaacaaactccggatcaacatcggcaaaagcccctgtgtggaggaggaacagagccgaggcatgggggtccccagctccccagtgcgtgcccccccagactcccccacaaccccagtccgttctctgcgctaccggagggtgaacagccctgagtcagaaaggctgtccacggcggacgggcgagtggagctacctgagaggaggtcacggatggatctgcctggctcgccctcgcgccaggcctgctcctctcagccagcccagatgctgtcagtggacacaggccacgctgaccgacaggccagtggccgcatggacgtgtcagcctctgtggagcaggaggccctgagcaacgccttccgctcggtgccgctggctgaggaggaggatttcgacagcaaagagtgggtcatcatcgacaaggagacggagctcaaggacttccctccaggggctgagcccagcacatcgggcaccacggatgaggagcccgaggagctgcggccactgcccgaggagggcgaagagcggcggcggctgggggcagagccccccttcccactcacccctgcactcgggaccccgccctcgacggagagagtcggaccccacaggcccacagagacagttggaggaggacagactctcggggcactccctcccgcggtacagccccctgcgacgactggcgtcctccgtgttctcctcctccacgctggagacggagcattaccctcaccccggcggcggcggctcctcgggctcctccggttccctcattcagcgcagccgctcggctga

SEQ ID NO: 2325 - DNA, 796 bp, Homo sapiens
ggagagcgcgggcggctggggaatggctgctgccatggtgccggggcgcagcgagagctgggagcgcggggagcctggccgcccggccctgtacttctgcgggagcattcgcggcggacgcgaggacaggacgctgtacgagcggatcgtgtctcggctgcggcgattcgggacagtgctcaccgagcacgtggcggccgccgagctgggcgcgcgcggggaagaggctgctgggggtgacaggctcatccatgagcaggacctggagtggctgcagcaggcggacgtggtcgtggcagaagtgacacagccatccttgggtgtaggctatgagctgggccgggccgtggcctttaacaagcggatcctgtgcctgttccgcccgcagtctggccgcggtgagcaccccaagcctccctcctggctttctatggacccagccctcagctccttccctggtgggctctgagcaccgcgcctctcccaaggggtaagggagctgtgagggtgtggatgggaggcagcttcacctttccctgccctttccagtgctttcggccatgatccggggagcagcagatggctctcggttccaggtgtgggactatgaggagggagaggtggaggccctgctggatcgatacttcgaggctgatcctccagggcaggtggctgcctcccctgacccaaccacttgacttaatctcactttcttaaattcttctattctcagacactgctctagtaccattccttcctcttagccccaggagcaaattaaaaggtacagttaaaa

SEQ ID NO: 2326 - DNA, 1077 bp, Homo sapiens
ctcactctcctggaaacccaccgagaacctccaccctctgacaccatggtcaactcctgttgtggctctgtgtgctctgaccagggctgtggcctggagaactgctgccgccccagctgctgccagaccacctgctgcaggaccacctgctgccgccccagctgctgtgtgtccagctgctgcaggccccagtgctgccagtctgtgtgctgtcagcccacctgctgccgccccagctgctgtcagaccacctgctgtaggaccacctgctgccgccccagctgctgtgtgtccagctgctgcagaccccagtgctgccagtctgtgtgctgccagcccacctgctgccgccccagctgctgtcagaccacctgctgcaggaccacttgctgccgccccagctgctgtgtgtccagctgctgcagaccccagtgctgccagtctgtgtgctgccagcccacctgctgccgccccagctgctgcatctccagcagctgctgcccctcttgctgtgaatccagctgctgccgcccctgctgctgcctgcgtccagtctgtggccgagtctcctgccacaccacttgctatcgcccaacctgtgtcatctccacctgcccccgccccttgtgctgtgcctcctcttgctgctaaatctctgctgtgaacacaccacttccttattacgtcctttcctacagatgaaggctctcattgcaaacatgcggactgttcaagagaattgatctgggtcccataagcaaacctcatccttagaaattctgtatttgcattctaccttttgtccaaactcccttccttccaaaggaattcattgacaatctcctaataaattgacaaattgtcctccaacatcctcccacctctttgacttcaggacatttattcatcatgcctaaggaatttgaagattgcctccatcatttgtagggccacagatcttaaagcctccaaccttgaagtccagtgaagtctctctcttaaagtcttttgcaaacatttttgtaccttgttatttccatgtaccaaaataaacctctattctattggcactgaaaa

SEQ ID NO: 2327 - DNA, 763 bp, Homo sapiens
aatagcccaacccacaccagcctcagacaccaccatgaccggctcctgctgcggctccaccttgtcctccctgagctacgggggaggctgctgccagccctgctgctgccgcgacccctgctgctgccgccccgtgacctgccagaccaccgtgtgccgccccgtgacctgcgtgccccgctgcacgcgccccatctgcgagccctgccgccgcccggtgtgctgcgacccctgctccctgcaggaaggctgctgccgccccatcacctgctgcccctcgtcgtgcacggctgtggtgtgcaggccctgctgctgggccaccacctgctgccagcctgtgtctgtgcagtccccctgctgccggcccccctgcggccagccgaccccttgcagcaccacctgcaggacctcctcctgctgagaccccaatgcccccacagagcaatacactgaagcctaaacatctatctggtgtttttaaaaagttaaaagaaaaatagattttttttcacaaggtgacaatagtgatttttaccatctggatacagcctggtgtaagcagacgtccattaccaccctcacccacattttcaggtgtctacatcagccttagtcattatggatagtaaatcgacctttaagaattcctggggtggactttgcaaacacattctacaacctgatggtttttactgctcaaactgtcaccatcatcttttgcaatgtgttgctcactgttgtcaataaactaatttttcctggc

SEQ ID NO: 2328 - DNA, 1458 bp, Homo sapiens
aagaaggcactccattctggctttcacaaatacagctctgcaacgcgtttgccctgataccatgtctcttcgactttccagtgcatccaggaggtcctgtcctcgtcccaccactggatcactcagactctatggtgggggaaccagctttggtactggaaattcttgtggcatttcagggattggaagtggcttctctagtgccttcggaggcagctcatcgggaggaaacacagggggaggtaatccctgtgctggcttcactgtgaatgagcgggggctcctttctggcaatgagaaggtgaccatgcagaacctcaatgaccgcctggcatcctacctggacagtgtgcatgctctggaggaggccaacgctgacctggagcagaagatcaagggctggtatgagaaatttgggcctggctcttgccgtggtcttgatcatgactatagcagatatttcccaataattgatgaccttaaaaatcagatcatcgcatccaccaccagcaatgctaatgctgttctgcagatcgataatgccaggcttacagctgatgatttcagactcaagtatgaaaatgagctggctcttcaccagagtgtagaggctgatgtcaatgggttacgaagagttttggatgaaataaccctgtgcagaacagatctggagattcagtatgaaaccctgagtgaggagatgacttacctcaaaaagaaccataaagaggaaatgcaagttctgcagtgcgcagctggaggcaacgtgaacgtggaaattgaacttcagtctctcctagccacgaaacactccctggagtgctccttgacagagaccgagagcaactactgtgcgcagctggcgcagatccaggctcagatcggggccctggaggagcagctgcaccaggtcagaaccgagaccgagggccagaagctggagtatgagcagctcctggacatcaagctccacctggaaaaagaaattgagacctactgtctccttataggaggagatgatggagcctgtaagtctgggggttacaagtctaaagattatggatctggaaatgtgggaagtcaagtcaaagacccagccaaagccatagtggttaagaaagttcttgaggaggtagaccaacgcagcaaaatacttaccaccaggctccactccctggaagagaaatctcaaagcaattaatttgagatgcaacagagaacgtatgccacatagcccctgcgaagaaaaggcattatgtatctgtccagaaaaatgtgcatgtctaagaaaaatgtctaacctgttgtctttctgttactttctttctgggcaatcaatgacagcatctccccattcatctagaagaatgccacacacaaatatgactcatttgattatcctacagaaatctgttgtcaattctttgtattcaataaacctcttctttagcaagttat

SEQ ID NO: 2329 - DNA, 2764 bp, Homo sapiens
gcagcgactcatcctatcgataaggttcagttagccaaggtggaggatgggaaaagaatggaactgtcccagctactcaatgagatcagggcaaactatgaaaagatcctcaccagaaatcagatagagacggtgctctcaacaaggatccaggtaatgatttcatacagacaggcaccttccagaataaggagacagtccatgtctacccaattcctgtcccggcctctctgagctagaagaagacataagcaaaaaaatggacaaagatgaagaggctttgaaggcagctcaagcagaactcaaggaggcccgacgccagtggcaccacctgcaagtggaaattgaatctctccatgctgtggaaaggggccttgaaaactccctacatgccagcgagcagcattaccagatgcagctgcaagacctagagactgtgattgaaggactagaaaaagagctacaggaagtaaggcgcggcatcgaaaagcagcttcaagagcacgagatgcttctcaacacgaagatgaggctggaacaagaaatagcaacttatcgccacctcctagaaaaagaagaaatcagatattatggttgtatccaaggtgggaaaaaagacaaaaagcctaccacaagtagagttggttttgttttaccatcagccattataaatgaaatatcttttactacaaaagtcccacaaaagtatgagaatgaaaatgtagaaacagtaaccaaacaggcaatcttaaatgggagtatcgttaaggagagcactgaagctcatggcactattcagacagagaaagtggatgaagttattaaagaatgggaaggttctttctttaaagataaccctcgattgaggaaaaagtctgtttctcttcgatttgatcttcatttagcagccactgatgaagggtgtttagagactaagcaggataatctaccagatatagaagtcaggcttatcatgagaagatcatgcagtattccctctatcaaacctccatcaacagctaattaatccaaagatagtatttgacttgattggaaaatgttaggatggaccaaggtgggccataccaactccctctgtcccaaaatgtaagttattacgtatgtatggaaaatgttatgatcaatatgtggttctcttcagaagaaaaaaacaataaaggacatttctctgaatctaattatggagatagacatatatatatatatatgaatgagagggagtagcttaaaaataaaatcacaaatccagtacagtctctttctttatattctcccaatagtcttctttttcccttgaaacttcatcagagactgtaagcattaacctggtttagtaaagtctttgtaatttttttcaatggctgaatacgctaaggaaaaaagaattgtttgaataggattgtgttaagagtcacactgagttattcaccattattccatgactggttaaacctacaatgtttgttctatttttcaaaaagagcaattataaacaagtttttaaagggggactcactattcacctaatgaggattcttctttttgagataaatcatttgtatactgagaaaaatgagttattttccatgagaaattctgagcaaactatagaacacaccccagggctaatttgagataagtacaattaagttaatctacatatatctaaaaggttttttttgtaataagtatctgatttccggaagatttactttactcaaggaactttaaaggttgtatcccccaccaaaaaaagaaaaaaaatcagaaggccaactgcgcaaacaaaacatgaaaagcaaattgaaaaggtagttactatagttatcagaacagttacccaccatcccagtttttccaactgtaaagctaaatgtgattagattgtttgctataagccgtagataagatactatatgaagtattataaatatttcttgcaatcatttatgtgaactaagataacggtattgttatctaagctaagagtatttagaggatttgtttttaaatcgttcaaattgtaataaatatgggtagaaaatatatttgtgaataagtgaggtattgttgcaaagtttttaaaataacctaatttgtttaatacaggtatatttaagatcttaataaatacctgttttaagacattagaaatttataagttcttaattcttttctaagcagaaaaagtagctgagtacaactcaccatactttttcccagctaaagtatcatctaagggctatagctacgttagcattttagtacagcctttaaaatatttctctctctctctcctctctcttctcctctatctctctctccatatatacttattatatatatacatatatataatttatatatatgtatatatatatttcaaccagaaaaatgtatgttttaaccaggaaaatattatgttaaataatctttaacataatacagggatataaaatttttaattttctttcaattacttcagattccttttagtctggtttattctatttagtgaaaagggatgattttgttttgtcaaggatataacagcatgttaagtgcttattcttgcataagcatctgacctaaaatacatcctatacataaaaaatgtttcatttgatattgctaaatgctactaactttattaaagctttaaaaatgcaatcatataagctattgtactaaagttactgtactaagcaacagtgatcataataaagcaatatatctagcataa

SEQ ID NO: 2330 - DNA, 1102 bp, Homo sapiens
atcgataaggttcagttagccaaggtggaggatgggaaaagaatggaactgtcccagctactcaatgagatcagggcaaactatgaaaagatcctcaccagaaatcagatagagacggtgctctcaacaaggatccagctagaagaagacataagcaaaaaaatggacaaagatgaagaggctttgaaggcagctcaagcagaactcaaggaggcccgacgccagtggcaccacctgcaagtggaaattgaatctctccatgctgtggaaaggggccttgaaaactccctacatgccagcgagcagcattaccagatgcagctgcaagacctagagactgtgattgaaggactagaaaaagagctacaggaagtaaggcgcggcatcgaaaagcagcttcaagagcacgagatgcttctcaacacgaagatgaggctggaacaagaaatagcaacttatcgccacctcctagaaaaagaagaaatcagatattatggttgtatccaaggtgggaaaaaagacaaaaagcctaccacaagtagagttggttttgttttaccatcagccattataaatgaaatatcttttactacaaaagtcccacaaaagtatgagaatgaaaatgtagaaacagtaaccaaacaggcaatcttaaatgggagtatcgttaaggagagcactgaagctcatggcactattcagacagagaaagtggatgaagttattaaagaatgggaaggttctttctttaaagataaccctcgattgaggaaaaagtctgtttctcttcgatttgatcttcatttagcagccactgatgaagggtgtttagagactaagcaggataatctaccagatatagaagtcaggcttatcatgagaagatcatgcagtattccctctatcaaacctccatcaacagctaattaatccaaagatagtatttgacttgattggaaaatgttaggatggaccaaggtgggccataccaactccctctgtcccaaaatgtaagttattacgtatgtatggaaaatgttatgatcaatatgtggttctcttcagaagaaaaaaacaataaaggacatttctctgaatctaa

SEQ ID NO: 2331 - DNA, 2770 bp, Homo sapiens
agtgacctcggggtcgttaggcctccacgtcctcgctggagctgcggacctcagtcgtccatccacacctcccccctgccgcccccgcccatctcactctcccaaccctgggcaccagggcaggtcgacagcccgaggcactcctctactgcgtttccaggcccaggagacccactccagcgccgcggttccttgcgacccggcagccgttcagcagacctcccattctttcctgcatcatcgggcattgtggaggcaccctacggtgattcctctcagagcctgtttgtaggtgaccgtgacagagacaaaaccatggaagtgactgggtttggagtgaccaggtgttcctccctcccctttcccagacacgcctcttgctggcagatcctctgactctctggctgcagaacagtttcttccgtgctctggcctgagtgccacagccagggcctctgctctgtacacagaccgggcaaggtcccccaggccaggatgtcaggcctggtgttggggcagcgggatgagcctgcaggccaccggctcagccaagaggagatcctggggagcacacggctggtcagccaagggctagaggccctacgcagtgaacaccaggccgtgctgcaaagcctgtcccagaccattgagtgtctgcagcagggaggccatgaggaagggctggtgcatgagaaggcccggcagcttcgccgttctatggaaaacattgagctcgggctgagtgaggcccaggtgatgctggctctagccagccacctgagcacagtggagtcggagaaacagaagctgcgggctcaggtgcggcggctatgccaggagaaccagtggctgcgggatgagctggctggcacccagcagcggctacagcgcagtgaacaggctgtggctcagctggaggaggaaaagaagcacctggagttcctggggcagctgcggcagtatgatgaggatggacatacctcggaggagaaagaaggcgatgccaccaaggattccctggatgacctctttcctaatgaggaggaagaggaccccagcaatggcttgtcccgtggtcaaggtgctacagcagctcagcagggtggatatgagatcccagcaaggttgcggacgttgcacaacctggtgatccagtacgcagcccaaggtcgctatgaggtggccgtgccactctgtaagcaggcactagaggacctggagcgcacatcaggccgtggccaccctgatgtcgccaccatgctcaacatccttgctttggtgtatcgtgaccagaataagtataaggaagctgcccacctgctgaatgatgcccttagcatccgggagagcaccttgggacctgaccatcctgctgtggctgccacactcaacaatttggctgtgctctatggcaaaaggggcaagtacaaggaggcagagcctctgtgccagcgggcactggagattcgagaaaaggtcctgggcacgaatcatccagatgtggcaaaacagctgaacaacctggccctcttgtgccaaaaccagggcaagtatgaggccgtggaacgctactaccagcgagcactggccatctacgaggggcagctggggccggacaaccctaatgtagcccggaccaagaacaacctggcttcctgttacctgaaacagggcaaatatgctgaggctgagacactatacaaagagatcctgacccgtgcccatgtacaggagtttgggtctgtggatgatgaccacaagcccatctggatgcatgcagaggagcgggaggaaatgagcaaaagccggcaccatgagggtgggacaccctatgctgagtatggaggctggtacaaggcctgcaaagtgagcagccccacagtgaacactactctgagaaacctgggagctctgtataggcgccagggaaagctggaggctgctgagaccctggaggaatgtgccctgcggtcccggagacagggcactgaccctatcagccagacgaaggtggcagagctgcttggggagagtgatggtagaaggacctcccaggagggccctggagacagtgtgaaattcgagggaggtgaagatgcttctgtggctgtggagtggtccggggatggcagtgggaccctgcagaggagtggctctcttggcaagatccgggatgtgctccgcagaagcagtgaactcttggtgaggaagctccaggggactgagcctcggccctccagcagcaacatgaagcgagcagcctccttgaactatctgaaccaacctagtgcagcacccctccaggtctcccggggcctcagtgccagcaccatggacctctcttcaagcagctgacattcaacccggcccccaggtctgctgggtccccccacccccacagccctcacagcattccccattgctcctggctcttccccacccctaggtgggacagtgaaggggagcagtttaaccagaagattgctgctgcccttagggtctcagctccctcctcaggaatccctcttaggaaggaccctcaggacaccctctctgcaccctgtggtcctctagagtagctagctctgaggccccaaggtgggtacaaagcaggtatggccctcagagatgcagcctgctgctggcttttcagtcagagggttgggggctggccagccaagctgccttgccctggccgctcttactccctccctctgctgtctcacttcaggtccatgtatttcacttttcttaaataaaagaatcaggt

SEQ ID NO: 2332 - DNA, 2470 bp, Homo sapiens
gggccaggtcctctgggtagctgtgaagtggtgaaagaaggggtgggaacgctggacttctggactttgggcagggcagatcctctgactctctggctgcagaacagtttcttccgtgctctggcctgagtgccacagccagggcctctgctctgtacacagaccgggcaaggtcccccaggccaggatgtcaggcctggtgttggggcagcgggatgagcctgcaggccaccggctcagccaagaggagatcctggggagcacacggctggtcagccaagggctagaggccctacgcagtgaacaccaggccgtgctgcaaagcctgtcccagaccattgagtgtctgcagcagggaggccatgaggaagggctggtgcatgagaaggcccggcagcttcgccgttctatggaaaacattgagctcgggctgagtgaggcccaggtgatgctggctctagccagccacctgagcacagtggagtcggagaaacagaagctgcgggctcaggtgcggcggctatgccaggagaaccagtggctgcgggatgagctggctggcacccagcagcggctacagcgcagtgaacaggctgtggctcagctggaggaggaaaagaagcacctggagttcctggggcagctgcggcagtatgatgaggatggacatacctcggaggagaaagaaggcgatgccaccaaggattccctggatgacctctttcctaatgaggaggaagaggaccccagcaatggcttgtcccgtggtcaaggtgctacagcagctcagcagggtggatatgagatcccagcaaggttgcggacgttgcacaacctggtgatccagtacgcagcccaaggtcgctatgaggtggccgtgccactctgtaagcaggcactagaggacctggagcgcacatcaggccgtggccaccctgatgtcgccaccatgctcaacatccttgctttggtgtatcgtgaccagaataagtataaggaagctgcccacctgctgaatgatgcccttagcatccgggagagcaccttgggacctgaccatcctgctgtggctgccacactcaacaatttggctgtgctctatggcaaaaggggcaagtacaaggaggcagagcctctgtgccagcgggcactggagattcgagaaaaggtcctgggcacgaatcatccagatgtggcaaaacagctgaacaacctggccctcttgtgccaaaaccagggcaagtatgaggccgtggaacgctactaccagcgagcactggccatctacgaggggcagctggggccggacaaccctaatgtagcccggaccaagaacaacctggcttcctgttacctgaaacagggcaaatatgctgaggctgagacactatacaaagagatcctgacccgtgcccatgtacaggagtttgggtctgtggatgatgaccacaagcccatctggatgcatgcagaggagcgggaggaaatgagcaaaagccggcaccatgagggtgggacaccctatgctgagtatggaggctggtacaaggcctgcaaagtgagcagccccacagtgaacactactctgagaaacctgggagctctgtataggcgccagggaaagctggaggctgctgagaccctggaggaatgtgccctgcggtcccggagacagggcactgaccctatcagccagacgaaggtggcagagctgcttggggagagtgatggtagaaggacctcccaggagggccctggagacagtgtgaaattcgagggaggtgaagatgcttctgtggctgtggagtggtccggggatggcagtgggaccctgcagaggagtggctctcttggcaagatccgggatgtgctccgcagaagcagtgaactcttggtgaggaagctccaggggactgagcctcggccctccagcagcaacatgaagcgagcagcctccttgaactatctgaaccaacctagtgcagcacccctccaggtctcccggggcctcagtgccagcaccatggacctctcttcaagcagctgacattcaacccggcccccaggtctgctgggtccccccacccccacagccctcacagcattccccattgctcctggctcttccccacccctaggtgggacagtgaaggggagcagtttaaccagaagattgctgctgcccttagggtctcagctccctcctcaggaatccctcttaggaaggaccctcaggacaccctctctgcaccctgtggtcctctagagtagctagctctgaggccccaaggtgggtacaaagcaggtatggccctcagagatgcagcctgctgctggcttttcagtcagagggttgggggctggccagccaagctgccttgccctggccgctcttactccctccctctgctgtctcacttcaggtccatgtatttcacttttcttaaataaaagaatcaggtaacctttc

SEQ ID NO: 2333 - DNA, 1494 bp, Homo sapiens
ctcgttggggactaaggcgtcggttggcgcgcaacgggttctaggctgcaggcagctcgaggacccgcggccccgccccggctcggcctggcagatagcagaggcagcaggccgtgccgggggggcatgttgctgtaaccagtggcccaggggatgttacggtggacagtgcacctggagggcgggccccgcagggtgaaccatgctgcagtggctgtcgggcatcgggtatactccttcgggggttactgctctggtgaagactatgagacactgcgtcagatagatgtgcacattttcaatgcagtgtccttgcgttggacaaagctgcccccggtgaagtctgccatccgtgggcaagctcctgtggtaccctacatgcgctatggacactcaaccgtcctcatcgacgacacagtcctcctttggggcgggcggaatgacaccgaaggggcctgcaatgtgctctatgcctttgacgtcaatacgcacaagtggttcacaccccgagtgtcagggacagttcctggggcccgggatggacattcagcctgtgtcctaggcaagatcatgtacatttttgggggctacgagcagcaggcggactgtttttccaatgacattcacaagctagataccagcaccatgacatggactcttatctgtacaaagggcagccctgcacgctggagggacttccactcagccacaatgctgggaagtcacatgtatgtctttgggggccgtgccgaccgctttgggccattccattccaacaatgagatttactgcaaccgcattcgagtctttgacaccagaactgaggcttggctggactgtcccccgactccagtgctgcctgaggggcgccggagccactcggcctttggctacaatggggagctgtacatctttggtggttataatgcaaggctgaaccggcacttccatgacctctggaagtttaatcctgtgtcctttacctggaaaaagattgaaccgaaggggaaggggccatgtccccgccggcgccagtgctgctgtattgttggtgacaagattgtcctctttgggggtaccagtccatctcctgaggaaggcctgggagatgaatttgaccttatagatcattctgacttacacattttggactttagccctagtctgaagactctgtgcaaactggccgtgattcagtataacctagaccagtcctgtttgcctcatgatatcaggtgggagctgaatgccatgaccaccaacagcaatatcagtcgccccatcgtctcctccccctttgcctatcccctcccctctgcttgagccttgagccttgactgggagctgaaaggagttgcagctgttggcatgagacctccttctccccgtcttggggaggtggggaccagcagataaatcccacccttccttgagctgtcgctgtactctgaagttcagccagctcagattttataaaaattaattaaaatctcc

SEQ ID NO: 2334 - DNA, 2378 bp, Homo sapiens
aaaaggggcggtggcggcggcggcggcggcggcggcggcggcgacggcgagaaagagcttgccggggggcgagcaggacaggacgaagccggagtgtaggcggcagaggattcgctcccagagcagctgcggccaggtatatgaatgacctaaaggtacaaataaagacggagagagaacagtgccaactgggagcagggcaagaatgccaattcctcctcccccgccacccccacctggtcctcctccacctcccacatttcatcaggcaaacacagagcagcccaagctgagtagagatgagcagcggggtcgaggcgccctcttacaggacatttgcaaagggaccaagctgaagaaggtgaccaacattaatgatcggagtgctcccatcctcgagactcctccacccccaccacctgtgatccgaaatggtgccagggatgctccccctcccccaccaccataccgaatgcatgggtcagaacccccgagccgaggaaagcccccacctccaccctcaaggacgccagctgggccaccccctcctcctccaccgcccctgaggaatggccacagagattctatcaccactgtccggtctttcttggatgattttgagtcaaagtattccttccatccagtagaagactttcctgctccagaagaatataaacactttcagaggatatatcccagcaaaacaaaccgagctgcccgtggagccccacctctgccacccattctcaggtgaagcctggcttggtcccgttcctcaggaaaaggatggaccttctcttcttctcagatggtcccttccattcccctgaaacctgcatgagagctcctaacatgtttctccaatgcaatcaagccctagactccaaatgtcctcccagctcacctccatctatgcatctcatctctggatttggtgatcagactctatattgacagtaggatctcaaaccctgcatccatccttcctccagcaagccctgctagccacatgaggaacaagtttccgtgtcttctgccttcctcttggggaaaggtgccttgttgtgatgaattaactcactgttagggcagggtggagaatggtactccttccttctcctgtccactgtgggggaagcttggcaggtatattatatttcatcatttaggaggctggcatgaccaggacttatgggtgggaggggagcatttttagtgaagcaagaaaggagtttgccaagaagtgatctgttttaaaggtcatatttggagaaagggcaaggaattgggtctgctttatttttgggggtattttgtttttgttctcacctgctgcccccccaccccaccaccccagggataaattggatataaacactaaatactaatcagttgaacttaacatttaataaaaagaaagggtgaaataaactgaagaccattttagaactagtcagttctctgcagcaaagggaacaggagccatttgaaccctctgggacccctcaccccactgcttcagggtgctaggctgagggatgtttttcctcccccttaccgcccatgcccttgaaagaaaagtcactttttgtggagggcatcattcattcctgattcacaaaccccaaaaacctctggtgggagataggaagatagggcgtgggcctgggccttaacctcaatcttgtgtctgcctcagtcttttctgactggccctgaagttgtcagtggctctttctgtccttcagcccctggaaggtgctccaggataacaaagaagggcaggttgaagcccctcatggaaggagctggctttgtggggctgcaaaggacttttaagtcctgcctgtactgaagttcacagcccacctgactgagcagactcttcctgttcctttctctaccacccttgccttcccaggactgcacggtttaacacagcagagtacagaagggtgaagaagtgagcagaggcttatgaagatattcagatactcttctatgccaggaagcacaaagactttgttgagatttgcctcagttcagtagatcttccttggcagccagccataggttgtttctttgtcttccgggtcctaaagagcacagagaaaatggaggtccccagtctaggtaggaagctgattggatgaggacttctttttttccgacagcaggatggggctcttgggctccacacaccagatgctttggttttctacaactgttgctatgtgtagagggtgctcagagcgtggcatgagagcaaggagaccatggctactctttgaaatggatggggaaaattagcttaaaaatttaatcacgagattgcgccactgcactccagcctgggcgacagagccagactccgtctc

SEQ ID NO: 2335 - DNA, 1259 bp, Homo sapiens
gacgcggtccccgccccaccgtagcgacgccgcggtccgccggatctccagcgctcagtccgcgccgcaggtggtgcttgtctgcagagtcatgacctctttccgcttggccctcatccagcttcagatttcttccatcaaatcagataacgtcactcgcgcttgtagcttcatccgggaggcagcaacgcaaggagccaaaatagtttctttgccggaatgctttaattctccatatggagcgaaatattttcctgaatatgcagagaaaattcctggtgaatccacacagaagctttctgaagtagcaaaggaatgcagcatatatctcattggaggctctatccctgaagaggatgctgggaaattatataacacctgtgctgtgtttgggcctgatggaactttactagcaaagtatagaaagatccatctgtttgacattgatgttcctggaaaaattacatttcaagaatctaaaacattgagtccgggtgatagtttctccacatttgatactccttactgcagagtgggtctgggcatctgctacgacatgcggtttgcagagcttgcacaaatctacgcacagagaggctgccagctgttggtatatccaggagcttttaatctgaccactggaccagcccattgggagttacttcagcgaagccgggctgttgataatcaggtgtatgtggccacagcctctcctgcccgggatgacaaagcctcctatgttgcctggggacacagcaccgtggtgaacccttggggggaggttctagccaaagctggcacagaagaagcaatcgtgtattcagacatagacctgaagaagctggctgaaatacgccagcaaatccccgtttttagacagaagcgatcagacctctatgctgtggagatgaaaaagccctaaagtttatgtttctaatgtgtcacagaataggacgatatgattctacaacataatcaactccctattaaattctttaatgaagattttttttttaattcggccttgtccttcctaggttctctattgagatgagaaagcctcattatgctgacattttccacgccacattaaatagttaaaaaggatgcagcctggagccagagagcagaaagctgggctggttctgaagcttcttccatacttaagttgcctccaagcagtttgtgaaagtatcagatcttggtatcctggtgattgattcacctaatataaatatatttgtgtcatgaacctctta

SEQ ID NO: 2336 - DNA, 4528 bp, Homo sapiens
cggcgtccggccgcggccgacggtagttcgcttccccgagagtgcgcggaggcccgggtgcgaggagggcctgtttctcttcagccctggttcattcacctcgcggaccgagggccccgccgtcaggagccggcgaccgtgccctggtgcgagctgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactggggatggagagaccagagaagagaacaagctgttgattcctaagcagaaaatttcggaagaagtgcattcatacaaagtgagagtaggaagactcaaacacgatattacccaagttcctgagactagagaagtgtataagtctgaggacagattagaaagacttcaggaaattctaaggaaatttctgtacctggagagagagtttaggcaaataacaatcagcaaggaaaccttcaccagtgagaagaacaatgaatgtcatgaacccgaaaaaagcttcagtctggactctactattgatgcagatcagagagttcttagaatacagaataccgatgacaatgataagtatgacatgagcttcaaccagaattcagcctctggtaaacatgaacacttaaatctaacagaggattttcagagtagtgaatgtaaggaaagcttaatggatctctcccaccttaataaatgggagagcatccctaacactgagaaatcctataaatgtgatgtatgtgggaaaattttccatcagagctcagcccttactagacatcagagaatccatactagagagaagccctacaaatgtaaagaatgtgaaaagtctttcagtcagagctcaagtcttagtcgacataaaagaatacacactagagaaaaaccttacaaatgtgaagcatctgataaatcctgtgaagcgtctgataaatcctgtagtccaagctcaggcataattcagcataagaaaattcacaccagagccaaatcttacaaatgtagcagttgtgaaagagtcttcagtcgtagtgtccaccttactcaacatcagaaaattcacaaagagatgccctgtaagtgtactgtatgtggcagtgacttctgccatacttcatacctacttgaacatcagagggtccatcatgaagagaaagcctatgagtatgatgaatatgggttggcctatattaaacaacaaggaattcatttcagagaaaagccctatacgtgtagtgaatgtggaaaagacttcagattgaattcacatcttattcagcatcaaagaattcacacaggagagaaagcacatgaatgtaatgaatgtggaaaagctttcagtcaaacctcatgccttattcagcatcacaaaatgcataggaaagagaaatcgtatgaatgtaatgagtatgagggcagtttcagtcatagctcagatcttatcctgcaacaagaagtcctcaccagacagaaagcctttgattgtgatgtatgggaaaagaactccagtcagagagcacatctagttcaacatcagagcattcataccaaagagaactcatgaatgtaatgaagatgggaagatatttatcaaattcaggcttcattcagcatctgagagttcacaccagggagaaatcatgtatgtactgcatgtggtaaagccttcagtcatagctcagccattgctcagcatcagataattcacaccagagagaaaccctctgaatgtgacgaatgaagaaaaggtattagtgttaaactcttaatcgactcctgcaaatctataccagtgagaaatcttacaaatgtattgaatgtggcaaatttttcatgctattagtattttcataccttagtcacatttggagaattcacatgggaataaaattccattgctgcaatgaatgtgaaaaagccatcagtcaaagaaactaccttgtttagtatcaaattcacgccatgcaaaaagattataaatgtaataagcatgtatgtgtgtgaggagattcagtcataacccaacgctcattcaacatcaaagaatttatacctaagagaacttatttgggtgtagtaaatggcagatctttcaataggagtttaactagtctttgtcatatcagaatatccatagtagacaagaatttgatgtaacgcaaatggaaaaactcgacaccacatttcaggctttacccaacatcgaaataatggagagaaaattgttgattatttgtttatgaaattgttaatacatagtcccaatctttttcattgcacaaaaatctagggttgacttggtaaatgcagtgacattttctcatggagttcctttatttaatatgtattctaagtaggtacgtttatttttacttttttattataattttgatattaaaaagaacagagatggggtcttgctttgttgcccaggctggtcttgaactcctggcctcaagcgatcctcccacctgtcctcccaaagtgctggggttacaggcgtgtgtcactgtgctgggcctattttatttatagaactcatttaagctgtttttattttaatatgccctataaacatttttatattttttgaaattggttcttagtgttcacaacttccataagatactgctaatgcaccagtattaaaacacatcgacgtaagtagctcatttagctttttctgctgttcttggcccaagttctttccaaaaccaactcttaggcctgctctttactagggatcttatgtcgtattgctttacagccacaacacttggattcctgttgattaacttctccattctcttaagcacctttagaagatttagaagtttcctagttttaagtgtttcaccagcaagtattccatacctacttgatgttgctggtctggtgtcttatttcctaaagtgaagcatctttttttaaaaaagaatttgattgacaatatatccagtccaatataagtatgaaggattctctctcctgagattgtagcaggcagccaaacattttcaaatgatgcccaaggttttagctgtcttgtgtgcatccacagtctgcgaagaagacatgataaggacatcagggagccaacaagactcctaatagcctcactacattcatccagtgcctattctgcatgcctaagcttagagttcttttatatacctctacggccagcaaaatgctcaggtctgctcttggtagggtaaacataaagaagatacacaggccgggcatggtggctcacacctgtaatcccagcactttgggaggctgaggcggatggatcacgaggtcaggcagtcgagaccatcctggccaacatggtgaaaccccgtctctactaaaaatacaaaagttagccgggtgtggtggcacgcgcctgtaatcccagctactcaggaggctgaggcaggagaactgcttgaacctgggaggcggaggttgcagtgagccgagattgcaccactgcactccagcctgggcgacagagcaggactctctctcaaaaaaacacaaaaaaacaaaaacaaaaaaccatacacacacacacacacacacaaatcagcatcataagggaatgtagccttccaacagagatgatgctgttcgtatgttaatctcagagacagtatttcaagagagtggcaggtctgttcctggtaaaattttaaccattaggattgcagataaatgtttgaattctgctcctctctcatcaatccaggacagtatttgaagtgtgagggctttgtgtatagttgtttatccattaccacatttttgtattttaatagtctacaggctatataaaagaacatggctttttgactgataaaagtgattacagatgttggctcaagttcagggccaccatcatatacctaacaagagttcatgattctttaggtaatgtcaaaacattttgtatttttccatcttaagctttataacattttgtgagtaagacaaatgttatttaaaattcttgttgtcagtccagcaattgaggctttcatagttcagtgttataatattcagtagggaccctcaacaaatatataaaaatatgttgctcactctataatcctcctatggctaacctctaggatagttctgccactatattttacttctttgccatcagcaagagtaggatttcatcaaggcaaggtaggaatctaaatgaaattgatatataaatgaattgatctaaatgtaaaagcaaatgaaaaatgcatgtgttttttcctgtcaaacatgtatacccttatgtatagagaccagtagtcacgtatggtgactgaaacaggattatgtaatccctaaaaagcagaatatgtaaaaatcacatgtatgcgtttggtttaggaatgtgcttttgtacttccacttgaataaaggtgtgtttggtattctgagaa

SEQ ID NO: 2337 - DNA, 1183 bp, Homo sapiens
agctttgggatctcaggaggaggagaacccaagaaactgtggaatgatgcactaagtgaccgcttcagcggtgagatccccgatgaccagatggcgcacagctccttttttccagatgagtatttcacctgctcctccttgtgcctcagctgtggggttggatgtaagaaaagcatgaatcatgggaaggaaggagtgcctcatgaagccaagagccgctgcagatactcccaccagtatgacaaccgagtgtatacctgcaaggcctgctatgagagaggcgaggaagtcagtgtagtgcccaaaacatctgcttccactgactccccctggatgggtctcgcaaaatatgcctggtctgggtatgtgatcgaatgtcctaactgtggcgtggtctatcgtagtcggcagtactggtttggaaaccaagatcctgtggatacggtggtgcggacagagattgtgcatgtgtggcctggaactgatgggtttctgaaggacaacaacaatgctgcccagcgcctgttggacgggatgaacttcatggctcagtcggtgtccgagcttagccttggacccaccaaggctgtgacttcctggctgacagaccagatcgcccctgcctactggaggcccaactcccagattctgagctgcaacaagtgtgcgacgtcctttaaagataacgacactaagcatcactgccgagcctgtggggagggcttctgtgacagctgttcatcaaagactcggccagtgcctgagcggggctggggccctgcgccagtgcgggtctgtgacaactgctacgaagccaggaacgtccagttagctgttaccgaggcacaagtggacgatgaaggtggaacgctcattgctcggaaggtgggcgaggccgtgcagaacactctgggagccgtggtgacagccattgacataccactaggtctggtaaaggacgcggccaggcctgcgtactgggtgcctgaccacgaaatcctccactgccacaactgccggaaggagttcagcatcaagctctccaagcaccactgccgggcctgcggacagggcttctgtgatgagtgctcccatgaccgccgggctgttccttctcgtggctgggaccatcccgtccgagtctgcttcaactgcaataaaaagcccggtgacctttaacccc

SEQ ID NO: 2338 - DNA, 1006 bp, Homo sapiens
cattagagtaaatgaagccatgaagtccagcggacaccgggagtggggagtggggaagcccggcactccgggagaccgggccagggaaggagggtctggaccggacccagcccctgcccggggagcgagctccggagctgccctacgaggtcaaaacgtagcagtggcggagacccgcagggggcgcccgaacgccaccctcggcccctccccgctccagaggccccgccccgtcacgtgcccgcggttcgcgtcacacccggaagcaggggcccgagcggagccggccgcgatgagcggggagccggggcagacgtccgtagcgccccctcccgaggaggtcgagccgggcagtggggtccgcatcgtggtggagtactgtgaaccctgcggcttcgaggcgacctacctggagctggccagtgctgtgaaggagcagtatccgggcatcgagatcgagtcgcgcctcgggggcacaggtgcctttgagatagagataaatggacagctggtgttctccaagctggagaatgggggctttccctatgagaaagatctcattgaggccatccgaagagccagtaatggagaaaccctagaaaagatcaccaacagccgtcctccctgcgtcatcctgtgactgcacaggactctgggttcctgctctgttctggggtccaaaccttggtctccctttggtcctgctgggagctccccctgcctctttcccctacttagctccttagcaaagagaccctggcctccactttgccctttgggtacaaagaaggaatagaagattccgtggccttgggggcaggagagagacactctccatgaacacttctccagccacctcatacccccttcccagggtaagtgcccacgaaagcccagtccactcttcgcctcggtaatacctgtctgatgccacagattttatttattctcccctaacccagggcaatgtcagctattggcagtaaagtggcgctacaaacactaa

SEQ ID NO: 2339 - DNA, 1419 bp, Homo sapiens
ttttcatttctcacaaggactgggtgaagagttctgcagccttacagagactggaaaagaagcccaaaccaaggcccccagagaggtcccccaggcccctttgggtccctgagcctcagctggagatccggcgcaggagaccaacgcctgccatgctgttccggctctcagagcactcctcaccagaggaggaagcctccccccaccagagagcctcaggagaggggcaccatctcaagtcgaagagacccaacccctgtgcctacacaccaccttcgctgaaagctgtgcagcgcattgctgagtctcacctgcagtctatcagcaatttgaatgagaaccaggcctcagaggaggaggatgagctgggggagcttcgggagctgggttatccaagagaggaagatgaggaggaagaggaggatgatgaagaagaggaagaagaagaggacagccaggctgaagtcctgaaggtcatcaggcagtctgctgggcaaaagacaacctgtggccagggtctggaagggccctgggagcgcccaccccctctggatgagtccgagagagatggaggctctgaggaccaagtggaagacccagcactaagtgagcctggggaggaacctcagcgcccttccccctctgagcctggcacataggcacccagcctgcatctcccaggaggaagtggaggggacatcgctgttccccagaaacccactctatcctcaccctgttttgtgctcttcccctcgcctgctagggctgcggcttctgacttctagaagactaaggctggtctgtgtttgcttgtttgcccacctttggctgatacccagagaacctgggcacttgctgcctgatgcccacccctgccagtcattcctccattcacccagcgggaggtgggatgtgagacagcccacattggaaaatccagaaaaccgggaacagggatttgcccttcacaattctactccccagatcctctcccctggacacaggagacccacagggcaggaccctaagatctggggaaaggaggtcctgagaaccttgaggtacccttagatccttttctacccactttcctatggaggattccaagtcaccacttctctcaccggcttctaccagggtccaggactaaggcgtttttctccatagcctcaacattttgggaatcttcccttaatcacccttgctcctcctgggtgcctggaagatggactggcagagacctctttgttgcgttttgtgctttgatgccaggaatgccgcctagtttatgtccccggtggggcacacagcggggggcgccaggttttccttgtcccccagctgctctgcccctttccccttcttccctgactccaggcctgaacccctcccgtgctgtaataaatctttgtaaataac

SEQ ID NO: 2340 - DNA, 1504 bp, Homo sapiens
ttttcatttctcacaaggactgggtgaagagttctgcagccttacagagactggaaaagaagcccaaaccaaggcccccagagaggtcccccaggcccctttgggtccctgagcctcagctggaggtggggggtgcctgcagtgcgctggctcagtctccttctgaaaagctggatccagcttgtttgaagcccttgagctgatcttagatccggcgcaggagaccaacgcctgccatgctgttccggctctcagagcactcctcaccagaggaggaagcctccccccaccagagagcctcaggagaggggcaccatctcaagtcgaagagacccaacccctgtgcctacacaccaccttcgctgaaagctgtgcagcgcattgctgagtctcacctgcagtctatcagcaatttgaatgagaaccaggcctcagaggaggaggatgagctgggggagcttcgggagctgggttatccaagagaggaagatgaggaggaagaggaggatgatgaagaagaggaagaagaagaggacagccaggctgaagtcctgaaggtcatcaggcagtctgctgggcaaaagacaacctgtggccagggtctggaagggccctgggagcgcccaccccctctggatgagtccgagagagatggaggctctgaggaccaagtggaagacccagcactaagtgagcctggggaggaacctcagcgcccttccccctctgagcctggcacataggcacccagcctgcatctcccaggaggaagtggaggggacatcgctgttccccagaaacccactctatcctcaccctgttttgtgctcttcccctcgcctgctagggctgcggcttctgacttctagaagactaaggctggtctgtgtttgcttgtttgcccacctttggctgatacccagagaacctgggcacttgctgcctgatgcccacccctgccagtcattcctccattcacccagcgggaggtgggatgtgagacagcccacattggaaaatccagaaaaccgggaacagggatttgcccttcacaattctactccccagatcctctcccctggacacaggagacccacagggcaggaccctaagatctggggaaaggaggtcctgagaaccttgaggtacccttagatccttttctacccactttcctatggaggattccaagtcaccacttctctcaccggcttctaccagggtccaggactaaggcgtttttctccatagcctcaacattttgggaatcttcccttaatcacccttgctcctcctgggtgcctggaagatggactggcagagacctctttgttgcgttttgtgctttgatgccaggaatgccgcctagtttatgtccccggtggggcacacagcggggggcgccaggttttccttgtcccccagctgctctgcccctttccccttcttccctgactccaggcctgaacccctcccgtgctgtaataaatctttgtaaataact

SEQ ID NO: 2341 - DNA, 1779 bp, Homo sapiens
gggaggtggagaaggacgggagaggcagagagaggagacacgcagagacactcaggaggggagagacaccgagacgcagagacactcaggaggggagagacaccgagacgcagagacacccaggccggggagcgcgagggagcgaggcacagacctggctcagcgagcgcggggggcgagccccgagtcccgagagcctgggggcgcgcccagcccgggcgccgaccctcctcccgctcccgcgccctcccctcggcgggcacggtatttttatccgtgcgcgaacagccctcctcctcctctcgccgcacagcccgccgcctgcgcgggggagcccagcacagaccgccgccgggaccccgagtcgcgcaccccagccccaccgcccaccccgcgcgccatggaccccaaggaccgcaagaagatccagttctcggtgcccgcgccccctagccagctcgacccccgccaggtggagatgatccggcgcaggagaccaacgcctgccatgctgttccggctctcagagcactcctcaccagaggaggaagcctccccccaccaggtgacccctttaacctggcacttcccctggcagagagcctcaggagaggggcaccatctcaagtcgaagagacccaacccctgtgcctacacaccaccttcgctgaaagctgtgcagcgcattgctgagtctcacctgcagtctatcagcaatttgaatgagaaccaggcctcagaggaggaggatgagctgggggagcttcgggagctgggttatccaagagaggaagatgaggaggaagaggaggatgatgaagaagaggaagaagaagaggacagccaggctgaagtcctgaaggtcatcaggcagtctgctgggcaaaagacaacctgtggccagggtctggaagggccctgggagcgcccaccccctctggatgagtccgagagagatggaggctctgaggaccaagtggaagacccagcactaagtgagcctggggaggaacctcagcgcccttccccctctgagcctggcacataggcacccagcctgcatctcccaggaggaagtggaggggacatcgctgttccccagaaacccactctatcctcaccctgttttgtgctcttcccctcgcctgctagggctgcggcttctgacttctagaagactaaggctggtctgtgtttgcttgtttgcccacctttggctgatacccagagaacctgggcacttgctgcctgatgcccacccctgccagtcattcctccattcacccagcgggaggtgggatgtgagacagcccacattggaaaatccagaaaaccgggaacagggatttgcccttcacaattctactccccagatcctctcccctggacacaggagacccacagggcaggaccctaagatctggggaaaggaggtcctgagaaccttgaggtacccttagatccttttctacccactttcctatggaggattccaagtcaccacttctctcaccggcttctaccagggtccaggactaaggcgtttttctccatagcctcaacattttgggaatcttcccttaatcacccttgctcctcctgggtgcctggaagatggactggcagagacctctttgttgcgttttgtgctttgatgccaggaatgccgcctagtttatgtccccggtggggcacacagcggggggcgccaggttttccttgtcccccagctgctctgcccctttccccttcttccctgactccaggcctgaacccctc

SEQ ID NO: 2342 - DNA, 5241 bp, Homo sapiens
attgtttgaatttgaaaacggtaacatcgcagtgctgctcgcgggtctggctagtcaggcgaagtttgcagaatggaatctaattttaatcaagagggagtacctcgaccatcttatgtttttagtgctgacccaattgcaaggccttcagaaataaatttcgatggcattaagcttgatctgtctcatgaattttccttagttgctccaaatactgaggcaaacagtttcgaatctaaagattatctccaggtttgtcttcgaataagaccatttacacagtcagaaaaagaacttgagtctgagggctgtgtgcatattctggattcacagactgttgtgctgaaagagcctcaatgcatccttggtcggttaagtgaaaaaagctcagggcagatggcacagaaattcagtttttccaaggtttttggcccagcaactacacagaaggaattctttcagggttgcattatgcaaccagtaaaagacctcttgaaaggacagagtcgtctgatttttacttacgggctaaccaattcaggaaaaacatatacatttcaagggacagaagaaaatattggcattctgcctcgaactttgaatgtattatttgatagtcttcaagaaagactgtatacaaagatgaaccttaaaccacatagatccagagaatacttaaggttatcatcagaacaagagaaagaagaaattgctagcaaaagtgcattgcttcggcaaattaaagaggttactgtgcataatgatagtgatgatactctttatggaagtttaactaactctttgaatatctcagagtttgaagaatccataaaagattatgaacaagccaacttgaatatggctaatagtataaaattttctgtgtgggtttctttctttgaaatttacaatgaatatatttatgacttatttgttcctgtatcatctaaattccaaaagagaaagatgctgcgcctttcccaagacgtaaagggctattcttttataaaagatctacaatggattcaagtatctgattccaaagaagcctatagacttttaaaactaggaataaagcaccagagtgttgccttcacaaaattgaataatgcttccagtagaagtcacagcatattcactgttaaaatattacagattgaagattctgaaatgtctcgtgtaattcgagtcagtgaattatctttatgtgatcttgctggttcagaacgaactatgaagacacagaatgaaggtgaaaggttaagagagactgggaatatcaacacttctttattgactctgggaaagtgtattaacgtcttgaagaatagtgaaaagtcaaagtttcaacagcatgtgcctttccgggaaagtaaactgactcactattttcaaagtttttttaatggtaaagggaaaatttgtatgattgtcaatatcagccaatgttatttagcctatgatgaaacactcaatgtattgaagttctccgccattgcacaaaaagtttgtgtcccagacactttaaattcctctcaagagaaattatttggacctgtcaaatcttctcaagatgtatcactagacagtaattcaaacagtaaaatattaaatgtaaaaagagccaccatttcatgggaaaatagtctagaagatttgatggaagacgaggatttggttgaggagctagaaaacgctgaagaaactcaaaatgtggaaactaaacttcttgatgaagatctagataaaacattagaggaaaataaggctttcattagccacgaggagaaaagaaaactgttggacttaatagaagacttgaaaaaaaaactgataaatgaaaaaaaggaaaaattaaccttggaatttaaaattcgagaagaagttacacaggagtttactcagtattgggctcaacgggaagctgactttaaggagactctgcttcaagaacgagagatattagaagaaaatgctgaacgtcgtttggctatcttcaaggatttggttggtaaatgtgacactcgagaagaagcagcgaaagacatttgtgccacaaaagttgaaactgaagaaacacataattatgtaggatttgaagatattattgattctcttcaagataatgttgctgatattaagaaacaggctgaaattgctcacttatatattgcatctcttcctgacccccaggaagctactgcttgtttagaactaaagtttaatcaaattaaagctgaattagctaaaaccaaaggagaattaatcaaaaccaaagaagagttaaaaaagagagaaaatgaatcagattcattgattcaagagcttgagacatctaataagaaaataattacacagaatcaaagaattaaagaattgataaatataattgatcaaaaagaagatactatcaacgaatttcagaacctaaagtctcatatggaaaacacatttaaatgcaatgacaaggctgatacatcttctttaataataaacaataaattgatttgtaatgaaacagttgaagtacctaaggacagcaaatctaaaatctgttcagaaagaaaaagagtaaatgaaaatgaacttcagcaagatgaaccaccagcaaagaaagggtctatccatgttagttcagctatcactgaagaccaaaagaaaagtgaagaagtgcgaccgaacattgcagaaattgaagacatcagagttttacaagaaaataatgaaggactgagagcatttttactcactattgagaatgaacttaaaaatgaaaaggaagaaaaagcagaattaaataaacagattgttcattttcagcaggaactttctctttctgaaaaaaagaatttaactttaagtaaagaggtccaacaaattcagtcaaattatgatattgcaattgctgaattacatgtgcagaaaagtaaaaatcaagaacaggaggaaaagatcatgaaattgtcaaatgagatagaaactgctacaagaagcattacaaataatgtttcacaaataaaattaatgcacacgaaaatagacgaactacgtactcttgattcagtttctcagatttcaaacatagatttgctcaatctcagggatctgtcaaatggttctgaggaggataatttgccaaatacacagttagaccttttaggtaatgattatttggtaagtaagcaagttaaagaatatcgaattcaagaacccaatagggaaaattctttccactctagtattgaagctatttgggaagaatgtaaagagattgtgaaggcctcttccaaaaaaagtcatcagattgaggaactggaacaacaaattgaaaaattgcaggcagaagtaaaaggctataaggatgaaaacaatagactaaaggagaaggagcataaaaaccaagatgacctactaaaagaaaaagaaactcttatacagcagctgaaagaagaattgcaagaaaaaaatgttactcttgatgttcaaatacagcatgtagttgaaggaaagagagcgctttcagaacttacacaaggtgttacttgctataaggcaaaaataaaggaacttgaaacaattttagagactcagaaagttgaatgtagtcattcagccaagttagaacaagacattttggaaaaggaatctatcatcttaaagctagaaagaaatttgaaggaatttcaagaacatcttcaggattctgtcaaaaacaccaaagatttaaatgtaaaggaactcaagctgaaagaagaaatcacacagttaacaaataatttgcaagatatgaaacatttacttcaattaaaagaagaagaagaagaaaccaacaggcaagaaacagaaaaattgaaagaggaactctctgcaagctctgctcgtacccagaatctgaaagcagatcttcagaggaaggaagaagattatgctgacctgaaagagaaactgactgatgccaaaaagcagattaagcaagtacagaaagaggtatctgtaatgcgtgatgaggataaattactgaggattaaaattaatgaactggagaaaaagaaaaaccagtgttctcaggaattagatatgaaacagcgaaccattcagcaactcaaggagcagttaaataatcagaaagtggaagaagctatacaacagtatgagagagcatgcaaagatctaaatgttaaagagaaaataattgaagacatgcgaatgacactagaagaacaggaacaaactcaggtagaacaggatcaagtgcttgaggctaaattagaggaagttgaaaggctggccacagaattggaaaaatggaaggaaaaatgcaatgatttggaaaccaaaaacaatcaaaggtcaaataaagaacatgagaacaacacagatgtgcttggaaagctcactaatcttcaagatgagttacaggagtctgaacagaaatataatgctgatagaaagaaatggttagaagaaaaaatgatgcttatcactcaagcgaaagaagcagagaatatacgaaataaagagatgaaaaaatatgctgaggacagggagcgtttttttaagcaacagaatgaaatggaaatactgacagcccagctgacagagaaagatagtgaccttcaaaagtggcgagaagaacgagatcaactggttgcagctttagaaatacagctaaaagcactgatatccagtaatgtacagaaagataatgaaattgaacaactaaaaaggatcatatcagagacttctaaaatagaaacacaaatcatggatatcaagcccaaacgtattagttcagcagatcctgacaaacttcaaactgaacctctatcgacaagttttgaaatttccagaaataaaatagaggatggatctgtagtccttgactcttgtgaagtgtcaacagaaaatgatcaaagcactcgatttccaaaacctgagttagagattcaatttacacctttacagccaaacaaaatggcagtgaaacaccctggttgtaccacaccagtgacagttaagattcccaaggctcggaagaggaagagtaatgaaatggaggagagcgcctctcctcctccaaaggaatgcagttcctcaccagcaatggaacaaagctggaaggagaatgactttgacaaattgagagaagaaggcttcagacgatcaaactactccgagctacaggaggaaattcaaaccaaaggcaaagaagttgaaaactttgaaaaaaatttagactaa

SEQ ID NO: 2343 - DNA, 10274 bp, Homo sapiens
gggttgaagttgaggctgaggagagagccgagctagcgacgagcagtcgttgcggccgccggcgccgcgggaggtggtggaggcctagccggagccgagaggtctcttgttcccgtcccacggtcccggcgtcacccctccggcgcccagtccccgtcccggaactcccgggcctgtcctgggcccccggtctgtgcactccgctcgccgcagcgcccggcccgggccgcacccgccggccccatgaggagggacgtgaacggagtgaccaagagcaggtttgagatgttctcaaatagtgatgaagctgtaatcaataaaaaacttcccaaagaactcctgttacggatattttcttttctagatgttgttaccctgtgccgctgtgctcaggtctccagggcctggaatgttctggctctggatggcagtaactggcagcgaattgacctatttgatttccagagggatattgagggccgagtagtggagaatatttcaaaacgatgtgggggctttttacgaaagttaagtcttcgtggatgtcttggagtgggagacaatgcattaagaacctttgcacaaaactgcaggaacattgaagtactgaatctaaatgggtgtacaaagacaacagacgctgagggatgtccactgttggagcagttgaacatttcctggtgtgaccaagtaaccaaggatggcattcaagcactagtgaggggctgtgggggtctcaaggccttattcttaaaaggctgcacgcagctagaagatgaagctctcaagtacataggtgcacactgccctgaactggtgactttgaacttgcagacttgcttgcaaatcacagatgaaggtctcattactatatgcagagggtgccataagttacaatccctttgtgcctctggctgctccaacatcacagatgccatcctgaatgctctaggtcagaactgcccacggcttagaatattggaagtggcaagatgttctcaattaacagatgtgggctttaccactctagccaggaattgccatgaacttgaaaagatggacctggaagagtgtgttcagataacagatagcacattaatccaactttctatacactgtcctcgacttcaagtattgagtctgtctcactgtgagctgatcacagatgatggaattcgtcacctggggaatggggcctgcgcccatgaccagctggaggtgattgagctggacaactgcccactaatcacagatgcatccctggagcacttgaagagctgtcatagccttgagcggatagaactctatgactgccagcaaatcacacgggctggaatcaagagactcaggacccatttacccaatattaaagtccacgcctacttcgcacctgtcactccacccccatcagtagggggcagcagacagcgcttctgcagatgctgcatcatcctatgacaatggaggtggtcaaccttggcgaactgagtatttaatgacacttctagagctaccgtggagtctctccagtggaagcaaccccagtgttctgagcaagggttacaaagtgagggagggcagtgtccagatccccagagccacacatacatacacatacacacccttacccccatccactctagctttgtgaccatgggactgaagtttgtgatggcttttttatcaagtagattggtaaaatttaaccattcctgttgaggtgcccataagaaaatcataggccaagatagggaggggcattccagcaaaccccgtgttaatgctactgtggtttttaaatttttgtctaggggtttctttggggattttagaacagcatctgctgtcctccggggtcaagaaaagcatggaaagacaatatatgatgtacccagggaccagaaagaaaatttctttgcatcttagaaatggtagacattcattgtgactaaagagcttctatgcttccttgtttccatgccaacatgctgagcatgctcacaaagaaggctcgtccattcctcctgtgttttagtatttggcccagaggtttcctaaatggttgccttgaaatcactgtggtccaaatgtaattcttacacactcaaattatcactgtctgtagcacacttgtgcacctgtcttacattctctgttgctcccccccacactcttgctcagtctgtcacctgttcagtctgcttactcactcaattgttacccttttgctgttgtcgtgtttacagtttgcattttgaatgattagttgggattaccaaacattttttaaaaagatattatcaataaatatttttttaattctaaattttaccattaggggaccctgcctgaatctttgccaacctgcaaggaaactctaatgaaagcaagaaaagttatgagaagaaactgttttgatgaaaacagatgctaccttttggtttctattttatcttctgatatgtgataattcgcatggtatccccaatattccccctacatattcttccttctgtcagactccaccaactgtatcataaggaaagagagagatgtattattaggaaagagtgaaaatgataaatcacaaaacagagcctgaaagtccccaacacccaagttcagacattaatgattaatgttattatatatttactgaaatctaggagtgatcagtggcatctctgacctatgaggttgttttaacaggaatgccactagaggagctgtgtattctagccagtctgtttctctcttttcccccatttcagcctttcagggatacaagaatggctctataacagctggtcaattgtatgtcagtgttaatggattcatatctagtgttggcaccccaaagggccagaaccttcccataacctgtcagtcatctctcttttctgccccagtctttttttttttttttttttttttttaagacgggttctcactcttgcccagactggagtgcagtggtgcgatctcggctcaccgcaacctccacttcccaggctcaagcgattctcttgcctcagcctaccgagtagctgggattacaggcatgcaccactactgcctggctaatttttgtatttttagtagagatggggtttcacatgttggccagcctggtcttgaactcctgacctcaaatgatccacctgcctcagcctcccaaagtgctgggactacaggcatgagccaccatgcccggccctgttcagacttctgaatgaagtatgaatgtagccaggtgaagcattgaggcagctgaaagagaacactgagaggaagtaaggggtttagtgtctctgcttagcctgggcactagaactgagggaggaatttagtgtccaggactcaagagtccaagaagaagcaccctctgtcttcccaaaaaatcagaggataaaggaagtaaaatgagtttttaaagcataagaagaaaatttctaaaccccaagattagaaacccagtgtgatttttagtagggtgattttggcggggggtgtcctttgagacattaatgtgcaatccatcataatattaatcttctatatgatccagactattaaaaggcttgttttatttatttattttattttattttatttttttagagatggggtctcgctatcttgcccagcctggactcaaactcctgggctcaagccttcctcccacctcagcctcccaagtagctgggactacaggtgtgtgccactgtacccagcttaagaggtttgttttaatgctgcagttgctgattataccagcatatataagaataaagtctgatttatttatccattgatttagaaggcaattggatgaaagggtcttagaagtctatactatccattaatatttatcatattaaatttattttaaatcctgttttattgtgccgctttaaaaacgcagattacttgtttattcattcccctttccccttattctctttcagattaccttataaggaatatagtttttaacatgaaactcagtttcttgtctgtacccctacacataaaaatacatacgtgcatacacacatacttccagatgtggttaataatattcagatccctaggttactcaaacaaaactaaaggagagaactatttaggggccatctgctttaaagtttaaggtgttttgttgttgttttagtgcctgtacaaattgaccataaaacccagattgattagtgagtgtggatttgagttgcctaagttgaggctattaaggtacttctttacttaaaagataagtttaaaagactctattcatcagttcatgatgatcttggaaatgctgtttctctgctcaaaggatatacccacaggcaggtccatggggacttgctctggtgatctctgctattaaggcaaattccagcctgtttgtgccaagaacagagtcaagtgagagagaatgaagactcagagatgtgcagcactggcttgtatgttgtcaggcagaagccttgttcctttctcaagaaaacttcaggcctatcaagcttggaaggaaatacatttttttatgctgatttgcagcctacaccagctgatgaatatgctaggactttgagagaacacaaagcatggtaagttttggtcaggtggaaaggagcctgacatctgaacataatgcttcctctctcaacatctgggatacttttgaaaattcagtaaggcttaatgtaggaaaaattctttacaggaaaagctaattgatctgtttgtctaacctcatagccactccaaaatatgccttttataatggaaaaaaacagtgaacagagagaagagatttggggataagttagaaggtaccctcaaaactactgccgtaaacctacaggtgggcaaggaggaattactgtagtgtctctggagaaagttcttgaacatccaaatcatctcttttctaagcagtttttcccctaatctcataccttacatcttccagcatcatttgctacatcaatgtcttttcatcctcttcatcagccccattgagctgactccagcttatttttgcactgatttccaccatttccttcccacacccatcctttccctctatttaaagcctccatctcaccctcagtaatgctgctgatttactctcagatgtctcaagtctagcttcctttttgaatccttctcctactccaggggctgtcaaaggcagccttaaagttcagtgactgttaggtggctcaggccatttttcattgggtggtctttggtgtttgcatactgaatttgaattcagtttaaaagcaaactgttggatatgaggaagaaagggatatggccttagccctttttccaatatttggaatatgaaagcatattgtgctttgtgtaaaaaatgttttcttctcctattctgctcttgtctttactgaaggtaaaagtattccttaagtagcttttgcaaatttctagtctgatttccacattcattaagttgatttagcagacatgtaagtcagaagtttcacatatcccttgtatcaaacattttatagggaaacctagtaaatttatgatgcttcattttgggctttccagactatttgagttattcaagatagccataatgttttagtagcgacattcttttattacttctaattgccttgtaaaatgcattgttatggcccggcacggtgggtggatcacaaggtcaggagttcaagaacagcctggccaagatggtgaaatgctgtctctactgaaaatacaaaaattagccaggtgtggtggcaggtgcctgtaatcccagctactcgggaggctgaggcagagaattgcttgaacccgggaggtggaggttgcagtgagctgagatcgcaccactgcactccaccctgggcgacagagtgagactatctcaaaaaaaaagaaagaaagaaagaaaaaaatgcatcgttactagtttgatagcccactaatgccatgggggactaaacaaaatatgtgatgaaacctgtcttggtttgaagttgttagaaagtgtgagagtgtcactggaaagaagagagtggcttcctgcctgcttgtttagtcagcatgtccttaggtgactgtgttgttgggagaagagcactcatgggtcatgggtgacccttggccattttatgtttattgtgctgaaagtcacaggcggctcatgccagttgctaccagtgagaggaggggtttaaaggaaattgctctattttgccttattcctccttatgtgtatgatttaagggtaggcttttatcctggttgtatctcctggctgacagactttctcaatcatatgtttgagctctgaagcattttacaaaaagattgcctctctatctgcctgccaatcctagaatctttagccacctcaaacccaggcactgtgaattagccaagtcctgtttgagaagaaatgtaggatgtttggttggaattcttgagacagaacctctctccccattaatgatgttgtaccaaagaattctaaagcagtaaaaggataatggggaaaaatggagtcacagcctttcctcgcctatatttcttttttttttttttttttttgacatggagtctcgctctgtcacccaggttggagtgccatggcacaatctcagttcactgcaacctctgcctcctgggttcaagtgattcttctgtttcagcctcccaagaggccaggattacaggtgcccaccaccacgcccagctaatgtttgtatttttcatagagatggggttttgccatgttggccaggctagtctcgaacttctgacctcaagtggtccacctgccttggcctcccaaagtgctgggattacaggtgtaagccaccgcacctggccagtttctatcataaattttaaatgtaagattggaagatacagagagctgtataaaatcataccagtagggtataattagcccaggtagtttaggaataaaattgggttgtatccgagtgccctaacttgacattttgattctccagcaaagaacataggttactaggttactaaccttgccttctcacttgggataaactttttttttttttcttgttgcccaggctggagtgcaatagtgagatctcggctcaccgcaacctccgcctcttgggttcaagcgattctcctcccttagcctcccgagtagctggaattacagcctgtgccaccacgcccggcaaaatttgtatttttagtagagacggggtttcaccatgttggtcaggctggtttcaaactcccaacctcaggtgatctgcccacctcagcctcccaacatgctaggattacaggcgtgagccactgcgcccagcccaggataaacattctacctgcctgaaagtaccataagaggcaagtgagtttcttgcatgatgggcttctgcagcttccccctcaagtcacatctacctgttgtatttatttatttatttatttttgagacagagtctcgctctgtttcccaggctggagtgcagtggcgtgatctcggctcactgcaagctccacctcccaggttcacgccattctcctgcctcagcctcccaagtagctgggactacaggctcccgccaccacgcccggctaattttttgtatttttagtagagacggggtttcaccctgttagccaggatggtctcgatctcctgacctcatgatccacccgcctcggcctcccaaagtgctgggattacaggcgtgagccaccgcgcccggcccgttgtatctattttttttagacgcatcaattcagtgtctctgaagcctttgatcgttaggaaggtcagtacataacctcttaggtgaagctgagttgatctttggagcccaagagagttaattttcaggagaaaaagaattagggcaagctcccctgtgggatgttaagagaaagtccatatgcgcttcttccatctctgcctcttgtttttaaataagtgcttgtgaagttcagtttatagaggttgagtctcagtgcttcctcagccagggtggtttattgctgttttacaaagaaccatgaacaagcaaaatcctatcaatagtcctttctgttttatgttttatagtcttattttgaagaatcggcatggtaaaatgatagacaagtttcaaataaagcagataattagctctagaattggggtactttgcctcaggtacagcatctgtcttgaatacatagtgatggctgtgtcacacatgggtacatttactttcctctctgatcaactgcacccctttttactggcaaagagggctcctactttctacacacttaaccagtcaaacagataggttttggcaccaccgaaagaaccacaagtgcaccccagctgcatctgggcatggttttggtactaggactagagaagtgagcagtaaatgacagtccttaccctaggaagagatgggagaagagaggtgtccagacatatttaccttttctcttctgtcatgccccaagaaccaaggatcatctttgaagtgacgtcttttttgttaaattggaagaagaaaactttgcagccaggcgtggtggctcacgcctgtaatcccagcactttgggaggccgaggcgggcggatcacaaagtgtcaggagtttgagaacagcctggccaacatggtgaaaccccatctctactgaaaatacaaaatcccagctacttgggaggctgaggcaagagaatcacttgaacctgggaggcggatgttgcagtgagccgagatcacgccactgcactccagcctgggcaacggagtgagactccatctcacaaaaaagagaaaagaaaagaaaactttgcttcactaagtttctcttgccattatctcattaattcagatctgtacctcattgctgctcacacatatatgtttcttaccttagcctgaaccttctcaggccttgaagtcattattctactctttttttttcttttccttttttatggcactagagaatgaaaacctaaggtcttagaaaatcttaacttgaaaaagtctctaactggcatgatttgattacttttttcccctgtggacaaataattttctttcctatataatagatttttagtaagtgaaacctttgctgctgctttcctgggtttacattagttttttcctgcccttaagaataatttatctgtgcttctctgatgactgttaatttctaatagtgcaggaagggatgagcttttgatttcttctcactcccctcctcaccctacttccaaattacacactaacttctaacccttacagcctgttggcacatacacaagatccacgagaccatgctcctcagaagctacccatgtcctttctcaccatggtgtggctcttggagccctgagtatctgtgactacccactccaaaggttgactgtaagaggagagcggccttcttaattttgcatttcttaattttgtttttctccattcctgttttatgacttggccttcagatgcttcctactctggcctcctccttttttctcctaggaattgtttccaggtaacctaccatgtgcacttctcagctgctctgctcacctttgcccaccttcccgtgaccctgagagtacagatccgaataatgtggcctgtgcagagctcagagaactgtgaggactacccatgcctgtcagactctgctcagggacagagatggatgggtaaatggtgctgttggagacatttttatcttcataccaggctctgtttcatccctgcaccccgcacccccactcactcccctgagggggtaaaatgcagaggtggttgacctgaagggtctgattccctccttcccaagccttagggcctaccctggagtgctgcagtgtgtgagagctgctgcttgcttgtttctccactaggcctgctccaaatgcttagccaatctctggagccgacacagttgcctacggggtgacttagcaccaggttccattagctctccaagtgactgtttccacccagtacttttggcgcttgaggatggggggagggggattatttaaaataaataaaatccgaggtggcagtagaggattccttttgctttaaaaatctttggactaaaaaaaaaaaaaaaaagttttttatatataaatatataaagtaaattgttatgtaactattattgtttcttgtatgttctaattttgttttatgatgtaattaaagaaagtaagctgtgaagacttttcattttcctgtg

SEQ ID NO: 2344 - DNA, 3288 bp, Homo sapiens
ctcctcttcctaaagcggcgaggcgcagaggagcggcatcactcgagcccaggtcccagccaccaccactcacagcgctcggcgttcaggaagaggagcagcagcggaggcggctgcttcagcggcgggcgggcgccagaaaggccccgatcgaaaagcctgggagggccgccgaactacccccggagggaggagccagtccgaacccaaggcgccaccgccgcagaagcggagcgaggcagcattcgcctccatggcccactcgccggtggctgtccaagtgcctgggatgcagaataacatagctgatccagaagaactgttcacaaaattagagcgcattgggaaaggctcatttggggaagttttcaaaggaattgataaccgtacccagcaagtcgttgctattaaaatcatagaccttgaggaagccgaagatgaaatagaagacattcagcaagaaataactgtcttgagtcaatgtgacagctcatatgtaacaaaatactatgggtcatatttaaaggggtctaaattatggataataatggaatacctgggcggtggttcagcactggatcttcttcgagctggtccatttgatgagttccagattgctaccatgctaaaggaaattttaaaaggtctggactatctgcattcagaaaagaaaattcaccgagacataaaagctgccaatgtcttgctctcagaacaaggagatgttaaacttgctgattttggagttgctggtcagctgacagatacacagattaaaagaaatacctttgtgggaactccattttggatggctcctgaagttattcaacagtcagcttatgactcaaaagctgacatttggtcattgggaattactgctattgaactagccaagggagagccacctaactccgatatgcatccaatgagagttctgtttcttattcccaaaaacaatcctccaactcttgttggagactttactaagtcttttaaggagtttattgatgcttgcctgaacaaagatccatcatttcgtcctacagcaaaagaacttctgaaacacaaattcattgtaaaaaattcaaagaagacttcttatctgactgaactgatagatcgttttaagagatggaaggcagaaggacacagtgatgatgaatctgattccgagggctctgattcggaatctaccagcagggaaaacaatactcatcctgaatggagctttaccaccgtacgaaagaagcctgatccaaagaaagtacagaatggggcagagcaagatcttgtgcaaaccctgagttgtttgtctatgataatcacacctgcatttgctgaacttaaacagcaggacgagaataacgctagcaggaatcaggcgattgaagaactcgagaaaagtattgctgtggctgaagccgcctgtcccggcatcacagataaaatggtgaagaaactaattgaaaaatttcaaaagtgttcagcagacgaatccccctaagaaacttattattggcttctgtttcatatggacccagagagccccaccaaacctacgtcaagattaacaatgcttaacccatgagctccatgtgccttttggatctttgcaacactgaagatttggaagaagctattaaactattttgtgatggcgtttatcattttatattttgaaaggattattttgtaaggaataacttttaatactatagtttcacctgtattctagtaaatgttgagacaccgttttgcttttaagtatccctatttcttaagttacgaggatgaatacctttcacattttgatctttagttgactctacagtcatgaaacatacaggtctttcaaagtcattctcaatattcagcttttgtaaattatcaagcttcaaaaagcttttttttttaaaaaaaaacatgcatattctaaaaatgactattggtggggaggtgtaaataagtcataccttcttaaaacagaaaatttaagtaaagtcttttaaatgaaacctgtaaaagtattgactcttctaccaagttggtatgatattccaggcagctcaatgattatcacatttgagaccctgtgtttgaagcatttacaggcaatgtacagcaacagaggtacctcttggtgtatagtatttacattctcttttaggtagaagaggcaattttacccttatttcacatggttagaaatttaaagcaagatcatttacccaaggataggtgtttggtaatgttgaaggagttagtctggcttcatgttttacatcttcaactaaaatcccatactatctgcttggatttggagagccaaaaaataaagctgattgtcatgtgattaaatatctgatcaacaggtatgaatataacttaaatcagcatatttttgccatggtaataaattgtcctataaactatttatatatttttgttcttcataattatcactaataagcatcagtttgttgtttttaaaaggatatttaagtgagcattttctagttcatatgaaaataaccatagtacaggatgatttctgtccacacaaaggttaaattagattgcacagttaattttcacttatatttatggtactattatgtgggtgatgcctttttcttttaagcccagtacatatattatgcctgcctaagttctgaactggggctgtatttcagtagttgtagaattattgatatttagttttgatagctaatgtttaattgtttggatctgcacagtttggtttttgcacaaaagtcatttaaaaaaatctgagtaattgtcaaatattaaaagaaagatattcttcctgtaaggaatacagtttttagtcaaagtggccattacatcctctttttaatttacataatacagatacttgagaaagttgttgtggtgttgtatgccaagaaaattctttttattggtgcctatattgtaacaattatttttaatgcattgtattttgaagtaacggttcagttaaatttttcacctgctgtgtaactgaaacacaattacagtttataatcatctgtagaagtctggagataattttgcaactcatgttatgggttaaatgaatatttttgtaaaagtaaaagcaacaaatttataaattgattatttgaaactttacaacacaattgcatcccaaatacaaattgtattgcttattcattatagctattcgtcctgtaatctgtttctaggtgaagcatactccagtgttttaggggttttgaaaataaatatttaaatttcacagtc

SEQ ID NO: 2345 - DNA, 3017 bp, Homo sapiens
actcgagcccaggtcccagccaccaccactcacagcgctcggcgttcaggaagaggagcagcagcggaggcggctgcttcagcggcgggcgggcgccagaaaggccccgatcgaaaagcctgggagggccgccgaactacccccggagggaggagccagtccgaacccaaggcgccaccgccgcagaagcggagcgaggcagcattcgcctccatggcccactcgccggtggctgtccaagtgcctgggatgcaggggtctaaattatggataataatggaatacctgggcggtggttcagcactggatcttcttcgagctggtccatttgatgagttccagattgctaccatgctaaaggaaattttaaaaggtctggactatctgcattcagaaaagaaaattcaccgagacataaaagctgccaatgtcttgctctcagaacaaggagatgttaaacttgctgattttggagttgctggtcagctgacagatacacagattaaaagaaatacctttgtgggaactccattttggatggctcctgaagttattcaacagtcagcttatgactcaaaagctgacatttggtcattgggaattactgctattgaactagccaagggagagccacctaactccgatatgcatccaatgagagttctgtttcttattcccaaaaacaatcctccaactcttgttggagactttactaagtcttttaaggagtttattgatgcttgcctgaacaaagatccatcatttcgtcctacagcaaaagaacttctgaaacacaaattcattgtaaaaaattcaaagaagacttcttatctgactgaactgatagatcgttttaagagatggaaggcagaaggacacagtgatgatgaatctgattccgagggctctgattcggaatctaccagcagggaaaacaatactcatcctgaatggagctttaccaccgtacgaaagaagcctgatccaaagaaagtacagaatggggcagagcaagatcttgtgcaaaccctgagttgtttgtctatgataatcacacctgcatttgctgaacttaaacagcaggacgagaataacgctagcaggaatcaggcgattgaagaactcgagaaaagtattgctgtggctgaagccgcctgtcccggcatcacagataaaatggtgaagaaactaattgaaaaatttcaaaagtgttcagcagacgaatccccctaagaaacttattattggcttctgtttcatatggacccagagagccccaccaaacctacgtcaagattaacaatgcttaacccatgagctccatgtgccttttggatctttgcaacactgaagatttggaagaagctattaaactattttgtgatggcgtttatcattttatattttgaaaggattattttgtaaggaataacttttaatactatagtttcacctgtattctagtaaatgttgagacaccgttttgcttttaagtatccctatttcttaagttacgaggatgaatacctttcacattttgatctttagttgactctacagtcatgaaacatacaggtctttcaaagtcattctcaatattcagcttttgtaaattatcaagcttcaaaaagcttttttttttaaaaaaaaacatgcatattctaaaaatgactattggtggggaggtgtaaataagtcataccttcttaaaacagaaaatttaagtaaagtcttttaaatgaaacctgtaaaagtattgactcttctaccaagttggtatgatattccaggcagctcaatgattatcacatttgagaccctgtgtttgaagcatttacaggcaatgtacagcaacagaggtacctcttggtgtatagtatttacattctcttttaggtagaagaggcaattttacccttatttcacatggttagaaatttaaagcaagatcatttacccaaggataggtgtttggtaatgttgaaggagttagtctggcttcatgttttacatcttcaactaaaatcccatactatctgcttggatttggagagccaaaaaataaagctgattgtcatgtgattaaatatctgatcaacaggtatgaatataacttaaatcagcatatttttgccatggtaataaattgtcctataaactatttatatatttttgttcttcataattatcactaataagcatcagtttgttgtttttaaaaggatatttaagtgagcattttctagttcatatgaaaataaccatagtacaggatgatttctgtccacacaaaggttaaattagattgcacagttaattttcacttatatttatggtactattatgtgggtgatgcctttttcttttaagcccagtacatatattatgcctgcctaagttctgaactggggctgtatttcagtagttgtagaattattgatatttagttttgatagctaatgtttaattgtttggatctgcacagtttggtttttgcacaaaagtcatttaaaaaaatctgagtaattgtcaaatattaaaagaaagatattcttcctgtaaggaatacagtttttagtcaaagtggccattacatcctctttttaatttacataatacagatacttgagaaagttgttgtggtgttgtatgccaagaaaattctttttattggtgcctatattgtaacaattatttttaatgcattgtattttgaagtaacggttcagttaaatttttcacctgctgtgtaactgaaacacaattacagtttataatcatctgtagaagtctggagataattttgcaactcatgttatgggttaaatgaatatttttgtaaaagtaaaagcaacaaatttataaattgattatttgaaactttacaacacaattgcatcccaaatacaaattgtattgcttattcattatagctattcgtcctgtaatctgtttctaggtgaagcatactccagtgttttaggggttttgaaaataaatatttaaatttcacagtc

SEQ ID NO: 2346 - DNA, 2910 bp, Homo sapiens
aggttgttaccatggagatggctaacagctagagcaggctgtcctcggagggagacattccatctccagacacccagagacgctccagaatggaggtcctgagggagaaggtggaggaggaggaggaggccgagcgggaggaggcggccgagtgggctgaatgggcgaggatggagaaaatgatgaggccagttgaggtgcggaaggaggaaatcaccttaaagcaggagacgctcagagacctggagaagaagctgtcagagatccagatcactgtctcagcggagctcccggcctttaccaaggacactattgacatctccaagctgcccatttcctacaaaaccaacacacccaaggaggaacacctgctgcaggtggcagacaacttctcccgccagtacagccatctgtgcccggaccgcgtgcccctcttcctgcaccccctgaacgagtgtgaagtgcccaagttcgtgagcacaaccctccggcccacactgatgccctaccccgagctctacaactgggacagctgtgcccagtttgtctccgacttcctcaccatggtgcccctgcctgaccctctcaagccgccctcgcacctgtactcctcgaccactgtgctcaagtaccagaaggggaactgctttgacttcagtacgctgctctgctccatgcttatcggctctggctatgatgcttactgcgtcaacggctacggctcgctggacctgtgccacatggacctgacgcgggaggtgtgcccactcactgtgaagcccaaggagaccatcaagaaggaggaaaaggtgctgcctaagaagtataccatcaaaccccccagggacctgtgcagcaggtttgagcaggagcaagaggtgaagaagcagcaggagatcagagcccaggagaagaagcggctgagggaggaggaggagcgcctcatggaagcggagaaggcaaagccggatgccctgcacggcctgcgggtgcactcctgggtccttgtgctatcggggaagcgcgaggtgcctgagaacttcttcatcgacccattcacaggacatagctacagcacccaggatgagcacttcctgggcatcgaaagcctgtggaaccacaagaactactggatcaacatgcaggattgctggaactgctgcaaggacttgatctttgacctgggtgaccctgtgagatgggagtacatgctcctggggactgataagtctcagctgtccttgactgaagaagacgacagtgggataaacgatgaggatgatgtggaaaatctgggcaaggaggatgaggataagagcttcgacatgccccactcgtgggtggagcagattgagatctccccggaagcatttgagacccgctgcccgaacgggaagaaggtgattcagtacaagagggcaaagctggagaagtgggccccgtacctcaatagcaatggccttgtgagccgcctcaccacctatgaggacttgcagtgtaccaatattttggagataaaggagtggtaccagaaccgggaagacatgctggagctgaaacacataaacaagaccacagacctgaagacagactacttcaagcctggccacccccaggctctgcgcgtgcactcgtacaagtccatgcaacctgagatggaccgtgtcattgagttttatgaaacggcccgtgtggatggcctgatgaagcgggaggagacacccaggacaatgacagagtactatcaaggacgcccagacttcctctcctaccgccatgccagcttcggaccccgagtcaagaagctcactctgagcagtgcagagtcaaacccccggcccattgtgaaaatcacagagcggttcttccgcaacccagcgaagcccgcggaggaggacgtggcagagcgcgtgtttctggtcgcggaggagcgcatccagctgcgctaccactgccgtgaggaccacatcacggcctccaagcgcgagttcctgcggcgcaccgaggtggacagcaaaggcaacaagatcatcatgacgcccgacatgtgcatcagcttcgaggtggagcccatggagcacaccaagaagctgctctaccagtacgaggccatgatgcacctgaagagggaggagaagctgtccagacatcaggtctgggagtcagagctggaggtgctggagattctgaagcttcgagaggaagaggaggcggcgcacacactgaccatctccatctatgacaccaagcggaatgagaagagcaaggaatatcgggaggccatggagcgcatgatgcacgaagagcacctgcggcaggtggagacccagctggactacctggccccattcctggcccagctcccgccaggagagaaactaacatgctggcaggcggtgcgcctcaaggatgagtgcctcagcgacttcaagcagcggctcatcaacaaggccaacctcatccaggcccgctttgagaaggagacccaggagctgcaaaagaagcagcagtggtaccaggagaaccaggtgacgctgacacccgaggatgaagacctgtacctgagttactgctctcaggccatgttccgcatccgcatcctggagcagcgcctcaatcgacacaaggaactggccccactgaagtacctggctctggaggaaaagctctacaaggacccacgcctgggggagctccagaaaatattcgcttgatgtccctcctggggcctcagccagagctgccagagaaaggaaacctcttcccgcagcctggctcctgtgttccctctatccagccaatgcctgtttacacagacacctggcctcactgccagcccacctcccctacagccctgtttgttcctgcttctcatgattttcctgtaaataaacacactcttaatttgcc

SEQ ID NO: 2347 - DNA, 7356 bp, Homo sapiens
gttttgatgaacacctggctttattcttgcaatgaagaaaggttctcaacaaaaaatattctccaaagcaaagataccatcatcatctcactctcctatcccatcatctatgtccaatatgagatctaggtcactttcacctttgattggatcagagactctaccttttcattctggaggacagtggtgtgagcaagttgagattgcagatgaaaacaatatgcttttggactatcaagaccataaaggagctgattcacatgcaggagttagatatattacagaggccctcattaaaaaacttactaaacaggataatttggctttgataaaatctctgaacctttcactttctaaagacggtggcaagaaatttaagtatattgagaatttggaaaaatgtgttaaacttgaagtactgaatctcagctataatctaatagggaagattgaaaagttggacaagctgttaaaattacgtgaactcaacttatcatataacaaaatcagcaaaattgaaggcatagaaaatatgtgtaatctgcaaaagcttaaccttgcaggaaatgaaattgagcatattccagtatggttagggaagaagttaaaatctttgcgagtcctcaatttgaaaggcaacaagatatcatcgctccaagatataagcaagttgaaaccgcttcaagatttgatttctctgatcctagttgaaaatccagttgtgacccttcctcattacctccagtttaccattttccacctccgttcattggaaagtttggaaggtcagccagtaaccactcaggatagacaggaggcttttgagagattcagtttagaagaggtagaaagactggaaagagacctagaaaaaaagatgatagaaactgaagagcttaagagcaaacaaacaaggttccttgaggaaattaaaaatcaagataaattgaataaatcattaaaagaggaggccatgttacagaaacagagctgtgaggaactcaagagtgacttaaacacaaaaaatgaattgctaaaacagaagaccatagaattaacacgagcatgtcagaagcaatatgagctggaacaggaattggccttttataaaattgatgctaaatttgagccactaaattattatccatcagagtatgctgaaattgataaagccccagatgaaagcccttacattggcaaatccagatacaagagaaatatgtttgccacagagagttatattattgacagtgctcaggcagtacagatcaagaagatggagccagatgaacaacttagaaatgatcacatgaacttgagaggccacacaccactggacacgcaactggaagacaaagaaaaaaaaataagtgcagcacaaactcgactatcagaactgcatgatgaaatagaaaaggcagaacaacaaattttgagagctactgaagaatttaaacaactggaagaagctatacaactaaaaaagatttcagaagcagggaaagaccttctttacaagcagttgagtggtagactacaacttgtaaataaattacgccaggaagctctggatctagaactgcagatggaaaagcaaaagcaggaaattgccggaaagcagaaggagattaaggacctgcaaatagccatagatagcctggattccaaagacccaaaacattcccatatgaaggctcaaaagagcggtaaagaacaacagcttgacattatgaacaagcagtaccaacaacttgaaagtcgtttggatgagatactttctagaattgctaaggaaacggaagagattaaggaccttgaagaacagcttactgaaggccagatagcagcaaatgaagccctgaagaaggatttagaaggtgttatcagtgggttgcaagaatacctggggaccattaaaggccaggcaactcaggcccagaatgagtgcaggaagctgcgggatgagaaagagacattgttgcagagattgacagaagtcgagcaggagagagaccagctggaaatagttgccatggatgcagaaaatatgaggaaggagcttgcagagctagaaagtgccctccaagagcagcatgaggtgaatgcatctttgcagcagacccagggagatctcagtgcctatgaagctgagctagaggctcggctaaacctaagggatgctgaagccaaccagctcaaggaagagttggaaaaagtaacaagacttacccagttagaacaatcagcccttcaagcagaacttgagaaggaaaggcaagccctcaagaatgcccttggaaaagcccagttctcagaagaaaaggagcaagagaacagtgagctccatgcaaaacttaaacacttgcaggatgacaataatctgttaaaacagcaacttaaagatttccagaatcaccttaaccatgtggttgatggtttggttcgtccagaagaagtggcagctcgtgtggatgagctaagaagaaaactgaaattaggaactggggaaatgaacatccatagtccttcagatgtcttagggaaaagtcttgctgatttacagaaacaattcagtgaaattcttgcacgctccaagtgggaaagagatgaagcacaagttagagagagaaaactccaagaagaaatggctctgcagcaagagaaactggcaactggacaagaagagttcaggcaggcctgtgagagagccctggaagcaagaatgaattttgataagaggcaacatgaagcaagaatccagcaaatggagaatgaaattcactatttgcaagaaaatctaaaaagtatggaggaaatccaaggccttacagatctccaacttcaggaagctgatgaagagaaggagagaattctggcccaactccgagagttagagaaaaagaagaaacttgaagatgccaaatctcaggagcaagtttttggtttagataaagaactgaagaaactaaagaaagccgtggccacctctgataagctagccacagctgagctcaccattgccaaagaccagctgaagtcccttcatggaactgttatgaaaattaaccaggagcgagcagaggagttgcaggaagcagagaggttcagcagaaaggcagcacaagcagccagagatctcacccgagcagaagctgagatcgaactcctgcagaatctcctcaggcagaagggggagcagtttcgacttgagatggagaaaacaggtgtaggtactggagcaaactcacaggtcctagaaattgagaaactgaatgagacaatggaacgacaaaggacagagattgcaaggctgcagaatgtactagacctcactggaagtgacaacaaaggaggctttgaaaatgttttagaagaaattgctgaacttcgacgtgaagtttcttatcagaatgattacataagcagcatggcagatcctttcaaaagacgaggctattggtactttatgccaccaccaccatcatcaaaagtttccagccatagttcccaggccaccaaggactctggtgttggccttaagtactcagcctcaactcctgttagaaaaccacgccctgggcagcaggatgggaaggaaggcagtcaacctccccctgcctcaggatactgggtttattctcccatcaggagtgggttacataaactgtttccaagtagagatgcagacagtggaggagatagtcaggaagagagtgagctggatgaccaagaagaacccccatttgtgcctcctcctggatacatgatgtatactgtgcttcctgatggttctcctgtaccccagggcatggccctgtatgcaccacctcctcccttgccaaacaatagccgacctctcacccctggcactgttgtttatggcccacctcctgctggggcccccatggtgtatgggcctccaccccccaacttctccatccccttcatccctatgggtgtgctgcattgcaacgtccctgaacaccataacttagagaatgaagtttctagattagaagacataatgcagcatttaaaatcaaagaagcgggaagaaaggtggatgagagcatccaagcggcagtcggagaaagaaatggaagaactgcatcataatattgatgatcttttgcaagagaagaaaagcttagagtgtgaagtagaagaattacatagaactgtccagaaacgtcaacagcaaaaggacttcattgatggaaatgttgagagtcttatgactgaactagaaatagaaaaatcactcaaacatcatgaagatattgtagatgaaattgagtgcattgagaagactcttctgaaacgtcgctcagagctcagggaagctgaccgactcctggcagaggctgagagtgaactttcatgcactaaagaaaagacaaaaaatgctgttgaaaagttcactgatgccaagagaagtttattgcaaactgagtcagatgctgaggaattagaaaggagagctcaggaaactgctgttaacctcgtcaaagctgatcagcagctaagatcgctccaggctgatgcaaaggatttggagcagcacaaaatcaagcaagaagaaatcttgaaagaaataaacaaaattgtagcagcaaaagactcagacttccaatgtttaagcaagaagaaggaaaaactgacagaagagcttcagaaactacagaaagacatagagatggcagaacgcaatgaggatcaccacctgcaggtccttaaagaatctgaggtgcttcttcaggccaaaagagccgagctggaaaagctgaaaagccaggtgacaagtcagcagcaggagatggctgtcttggacaggcagttagggcataaaaaggaggagctgcatctactccaaggaagcatggtccaggcaaaagctgacctccaggaagctctgagactgggagagactgaagtaactgagaagtgcaatcacattagggaagtaaaatctcttctggaagaactgagttttcagaaaggagaactaaatgttcagattagtgaaagaaaaactcaacttacacttataaagcaggaaattgaaaaagaggaagaaaatcttcaggttgttttaaggcagatgtctaaacataaaaccgaactaaagaatattctggacatgttgcaacttgaaaaccatgagctacaaggtttgaagctacaacatgaccaaagggtatctgaattagagaagactcaggtggcagtgctagaggagaaactggagttagagaatttgcagcagatatcccagcagcagaaaggggaaatagagtggcagaagcagctccttgagagggataaacgagaaatagaacgaatgactgctgagtcccgagctttacaatcgtgtgttgagtgtttgagcaaagaaaaggaagatctccaagagaaatgtgacatttgggaaaaaaagttggcacaaaccaaaagggttttagcagcagcagaagaaaatagcaaaatggagcaatcaaacttagaaaagttggaattgaatgtcagaaaactgcagcaggaactagaccaactaaacagagacaagttgtcactgcataacgacatttcagcaatgcaacagcagctccaagaaaaacgagaagcagtaaactcactgcaggaggaactagctaatgtccaagaccatttgaacctagcaaaacaggacctgcttcacaccaccaagcatcaggatgtgttgctcagtgagcagacccgactccagaaggacatcagtgaatgggcaaataggtttgaagactgtcagaaagaagaggagacaaaacaacaacaacttcaagtgcttcagaatgagattgaagaaaacaagctcaaactagtccaacaagaaatgatgtttcagagactccagaaagagagagaaagtgaaaaaagcaaactggaccaagtgctctcaaaggtgctggcagctgaagagcgtgttaggactctgcaggaagaggagaggtggtgtgagagcctggagaagacactctcccaaactaaacggcagctttcagaaagggagcagcaattggtggagaaatcaggtgagctgttggccctccagaaagaggcagattctatgagggcagacttcagccttctgcggaaccagttcttgacagaaagaaagaaagctgagaagcaggtggccagcctgaaggaagcacttaagatccagcggagccagctggagaaaaaccttcttgagcaaaaacaggagaacagctgcatacaaaaggaaatggcaacaattgaactggtagcccaggacaaccatgagcgggccaggcgcctgatgaaggagctcaaccagatgcagtatgagtacacggagctcaagaaacagatggcaaaccaaaaagatttggagagaagacaaatggaaatcagtgatgcaatgaggacacttaaatctgaggtgaaggatgaaatcagaaccagcttgaagaatcttaatcagtttcttccagaactaccagcagatctagaagctattttggaaagaaacgaaaacctagaaggagaattggaaagcttgaaagagaaccttccatttaccatgaatgagggaccttttgaagaaaaactgaacttttcccaagttcacataatggatgaacactggcgtggagaagcactccgggagaaactgcgtcaccgggaagaccgactcaaggcccaactccgacactgtatgtccaagcaagcagaagtattaattaaaggaaagcggcagacagagggcactttacacagtttgaggagacaagtagatgctttaggggaattggtcaccagcacctctgcagattcagcgtcatcacccagtctgtctcagctggagtcttccctcacagaggactctcaacttggacaaaatcaggaaaagaatgcctcagccagatgaggaatactgtcttgtgtaaatatattcaaggaaaacacctccactacctcactgacttcataattggaatgtcacatggtttttttaatcaagatgcagtgaactgagattctgaaactccactgtagtttactttgcctgtaccattaatgccaatgtttttataaatcacttgtacatagtacatatgggaatagttgcatatgggaatttaaaccaacatgtggctgagcctttttttttttaatcttcgtaacatgtttaaaaaaaaacagtgattttaactgcatatttgaacctacaaactggtaaatcttattaacaaaaagaatgtacttaaggccctctttatttatagtgtcgagttatttttgaattttgcttaaaatctatttttcatatgaaaataaaagataacaatc

SEQ ID NO: 2348 - DNA, 3859 bp, Homo sapiens
gaaggcagcggcaggtcgggagcaagatggcgctgcggccaggagctggttctggtggcggcggggccgcgggagctggcgcggggtccgccgggggaggcggcttcatgtttcctgttgcaggtgggataagaccccctcaagcaggcctgatgccgatgcagcaacaaggatttcctatggtctctgtcatgcagcctaatatgcaaggcattatgggaatgaattacagctctcagatgtcccaaggacctattgctatgcaggcaggaataccaatgggaccaatgccagcagcgggaatgccttacctaggacaagcacccttcctgggcatgcgtcctccaggcccacagtacactccagacatgcagaagcagtttgccgaagagcagcagaaacgatttgaacagcagcaaaaactcttagaagaagaaagaaaaagacgccagtttgaagagcagaagcaaaagctcagacttttgagcagtgtgaaacccaagacaggagagaagagtagagatgatgctttggaagccataaaaggaaatttagatgggttttccagagatgcaaaaatgcaccctactccagcatcgcaccccaagaaaccaggtgtgggagtatttccctcacaggatcctgctcagcccagaatgcctccttggatttacaatgagagtttggttccagatgcctataagaaaatcttagaaaccacaatgactccaactggaatagatactgccaaactgtatcccattctgatgtcatctgggcttcccagggaaactcttggacagatatgggccttagctaatcgaactacacctggcaaacttacaaaagaagaactttataccgttctagccatgatagcggtaacacagaggggcgttcctgcaatgagtcctgatgctttaaaccagttcccagcagctcctattccaactttaagtggcttttctatgactctgcctacaccggtgagtcagccaactgtgataccttcaggtcctgcgggctccatgcccctcagccttggacagccagtcatgggcattaaccttgttggaccagtgggtggagctgcagcccaggcttctagtggtttcataccaacctaccctgcaaatcaggtagtaaagccagaagaagatgacttccaggattttcaagatgcttctaagtcaggatcccttgatgactcattcagtgatttccaagagttgcctgcttcttcaaaaacaagtaactcccagcatggaaacagtgccccttctttgttgatgccacttcctggaactaaagcattgccttcaatggacaaatatgctgtgtttaaaggaattgcagctgacaagtcctctgaaaatactgttccacctggagatcctggtgataaatatagtgctttcagagaacttgaacagacagcagagaataaacctttaggagaaagctttgcagaattcagatctgcaggaactgatgatggtttcaccgattttaaaacagccgatagtgtatcaccactagagccaccaacaaaagacaaaacttttccaccatccttcccctcaggaactatacaacagaaacaacaaacacaagtgaaaaaccctctgaacttagcagacctagatatgttttcctcagttaattgcagcagcgagaaaccattgtctttttcagctgtgtttagcacatcaaaatcagtttctacaccacagtcaacaggttctgctgctactatgacagcattggcagcaacaaaaacttctagtttggctgatgattttggagaattcagcctttttggggaatattctggtctagcacctgttggggagcaggatgactttgcagattttatggctttcagtaatagctctatttcatctgagcaaaagccggatgacaaatatgatgcccttaaagaggaagccagtcctgttcctctaaccagcaacgtgggcagcacagtgaagggtggacaaaactcgactgctgcgtctaccaagtacgatgtcttcagacaactttctctggaagggtctggactaggtgttgaagacctgaaagataacactccttcaggaaaaagtgatgatgattttgctgacttccactccagtaaattttcttccataaactcggacaaatccctgggagagaaagcagtggctttcagacacaccaaagaagactctgcatcagtgaagtccttagatctcccttccattggtggcagcagtgttggcaaggaggactctgaagatgcactctctgttcagtttgacatgaaattggctgatgtgggaggagatcttaagcatgtcatgtctgatagctctttggatttaccaacagttagtggccagcatcctcctgctgcagatatagaggacttaaaatatgctgcttttggaagctacagtagcaattttgcagtgagcacacttacaagctatgactggtcagacagggatgatgcaactcagggcagaaaactctctccatttgtcctctcagcaggaagtggatccccctcagccacctcaattcttcaaaagaaagagacttcatttggcagttctgaaaacatcaccatgacatctctctccaaagtaacgacctttgtaagtgaagatgctcttccagagaccaccttcccagctcttgccagttttaaagacacgattcctcagaccagtgagcaaaaggaatatgaaaacagagactataaagatttcacaaaacaggacctgcctacggctgaacggagccaggaggccacgtgtcccagcccagcgtccagtggtgcctctcaagaaaccccgaacgaatgttcggatgactttggagagtttcaaagtgaaaagcccaaaatcagcaaatttgacttcttagtagccacttcacaaagcaaaatgaaatccagtgaagaaatgatcaaaagtgagctggcaacctttgacctttctgttcaaggatcacacaagaggagtttgagccttggtgataaagaaataagccgttcttctccttctccagctttggagcagcctttcagagaccgttccaatactctgaatgagaagcccgccctgcccgtcatccgagacaagtacaaagacctgacgggagaggtggaggaaaatgagagatatgcatatgaatggcagagatgcctggggagtgccctgaatgtcattaagaaggcaaatgataccttaaatggaatcagtagtagttctgtttgcacagaagtaattcagtcagctcaaggcatggaatatttattaggtgttgttgaagtgtacagggtaaccaagcgtgtggagctggggataaaagccactgcagtgtgcagtgagaaactccagcagttgctgaaggacatcgataaagtatggaataacctaatcggcttcatgtcactcgccacactcacatgctgctgggaaaagatgactgtgattacaaagcatctctctccttaccatgagctcttagaagaaaagccagatgaaaactcgctggatttttcctcctgtatgttacggcctgggattaaaaatgctcaggagcttgcctgtggagtgtgcctcttgaatgtggactcgaggagccggaaagaagagaagcctgcagaagaacatcctaaaaaagcattcaactcagaaacagacagtttcaagctggcctatggagggcaccagtatcacgccagctgtgccaacttctggatcaactgtgtcgaaccaaagcctcctggcctcgtcctgcctgacctgctctgaacaactcctctgtgaagcattgacttttttttttctgtgacaccccacggggt

SEQ ID NO: 2349 - DNA, 1377 bp, Homo sapiens
ggtgtttgacccggaagtggctgtgttcagctgacagctgctgataaggtggcggcggcgaaggcagcggcaggtcgggagcaagatggcgctgcggccaggagctggttctggtggcggcggggccgcgggagctggcgcggggtccgccgggggaggcggcttcatgtttcctgttgcaggtgggataagaccccctcaagcaggcctgatgccgatgcagcaacaaggatttcctatggtctctgtcatgcagcctaatatgcaaggcattatgggaatgaattacagctctcagatgtcccaaggacctattgctatgcaggcaggaataccaatgggaccaatgccagcagcgggaatgccttacctaggacaagcacccttcctgggcatgcgtcctccaggcccacagtacactccagacatgcagaagcagtttgccgaagagcagcagaaacgatttgaacagcagcaaaaactcttagaagaagaaagaaaaagacgccagtttgaagagcagaagcaaaagctcagacttttgagcagtgtgaaacccaagacaggagagaagagtagagatgatgctttggaagccataaaaggaaatttagatgggttttccagagatgcaaaaatgcaccctactccagcatcgcaccccaagaaaccagattgccccacatcatctcattctactaaaactgtctccccatcacctgcctttcttgatgaagaagaattcagtgactttatgcaggggcctgttgaagttcccccatgtgggccttcttccacgtcccagccctttcagtctttccacccctccaccccacttggccagttgcatacacagaaggctgggacacagcctctccctccaagtcagagtccagtgccttttgccttacatggcgtccctgggcaaattccttacttctctactgcttcagcctcacacagtgtaccagaagcaggcccttccttggaggagaagttcctagtatcttgtgatataagtacatctgggcaggaacaaattaaattaaatacttctgaagttggccacaaagccctaggcccaggttccagtaagaagtatcccagtttaatggccagtaacggggttgctgtagatggatgtgtgtgggagtatttccctcacaggatcctgctcagcccagaatgcctccttggatttacaatgagagtttggttccagatgcctataagaaaatcttagaaaccacaatgactccaactggaatagatactgccaaactgtatcccattctgatgtcatctgggcttcccagggaaactcttggacagatatgggccttagctaatcgaactacacctggcaaacttacaaaa

SEQ ID NO: 2350 - DNA, 2181 bp, Homo sapiens
cagataccgccgccgccgccattttggaagcgggcacgtcgcccacggcgacgcgaccggtagctacgggaccacggccctaaggagggcggaagtcgtcgctccgtggagcctcctcctctcgcgagaggcgcaaggcgtggagtcgacggctggagagaagccgggagcgagcccaggcggcagtcttgattcccttttggccagcagtttttaggtctgtcagtactgcactgcaagaatggcagattttgggatctctgctggccagtttgtggcagtggtctgggataagtcatccccagtggaggctctgaaaggtctggtggataagcttcaagcgttaaccggcaatgagggccgcgtgtctgtggaaaacatcaagcagctgttgcaatctgcccacaaagaatccagctttgacattattttgtcaggtttagtcccaggaagcaccactctgcacagtgctgagattttggctgaaatcgcccggatccttcggcctggtggatgtctttttctgaaggagccagtagagacagctgtagataacaatagcaaagtgaagacagcatctaagctgtgttcagccctgactctttctggtcttgtggaagtgaaagagctgcagcgggagcccctaacccctgaggaagtacagtctgttcgagaacaccttggtcatgaaagtgacaacctgctgtttgttcagatcacaggcaaaaaaccaaactttgaagtgggttcttctaggcagcttaagctttccatcaccaagaagtcttctccttcagtgaaacctgctgtggaccctgctgctgccaagctgtggaccctctcagccaacgatatggaggacgacagcatggatctcattgactcagatgagctgctggatccagaagatttgaagaagccagatccagcttccctgcgggctgcttcttgtggggaagggaaaaagaggaaggcctgtaagaactgcacctgtggccttgccgaagaactggaaaaagagaagtcaagggaacagatgagctcccaacccaagtcagcttgtggaaactgctacctgggcgatgccttccgctgtgccagctgcccctaccttgggatgccagccttcaaacctggggaaaaggtgcttctgagtgatagcaatcttcatgatgcctaggaggttcctgacatgggacccatctgctcctccagccaactcctgtccctcacatcccaccatggtggctcctcccacctcctctggatttgttcactctgagatctgtttgcagagtgggtgcttagcagacagagtgaagctggctggggggcacagtggtgtgtagtgctgctgtgtatcaaaagaccaaggtattatgggacctggtttcagaatgggatgggtttcttcacctcatgttaagagaagggagtgtgtcctgaagaagcccttcttctgatgttaaaatgctgaccagaacgctcttgagcccaggcatcgttgagcattaacactctgtgacagagctgcagacccctgccttgagtctcatctcagcaatgctgccaccctcttgtctttcagagttgttagtttactccattctttgtgacacgagtcaagtggctcacaacctcctcagggcaccagaggactcactcactggttgctgtgatgatatccagtgtccctctgcccccttccatccccaaccacatttgactgtagcattgcatctgtgtcctgttgtcatttatgttaaccttcaggtattaaacttgctgcatatcttgacatatcttgagattctgcatgtcttgtaaagagaggggatgtgcatttgtgtgtgatgttggatagtcatccacgctcagtttggaccattggaggaacttagtgtcacgcacaaatggggctattcctacgcttagaatagggcttgtctgcccactttagaagagtccaggttggtgagcatttagagggaagcagggcagaactctgaacgacaatacgtctctctgagcagagacccctttgttcttgttatccacccatatggacttggaatcaatcttgccaaatatttggagagattgtgtggatttaagagacctggatttttatattttaccagtaaataaaagttttcattgatatctgtccttgaaacttga

SEQ ID NO: 2351 - DNA, 1316 bp, Homo sapiens
tagataggggttttcatttaggccttgcgacatggctgttacatgaccttggttggtctgtttccctaacctctttgtgcctcatttgtcttacctactaaataggctaatagtactacctcgcagcatgaagatgattttaataagatgaatgagagtaacgactcgacaaactatgacatggctccttactatgaagccttgtgcaaatccctcgactggcagatagacgtggacctactcaataaaatgaagaaggcaaatgaagatgagttgaagcgtttggatgaggagctggaagatgcagagaagaatctaggagagagcgaaattcgcgatgcaatgatggcaaaggccgagtacctctgccggataggtgacaaagagggagctctgacagcctttcgcaagacatatgacaaaactgtggccctgggtcaccgattggatattgtattctatctccttaggattggcttattttatatggataatgatctcatcacacgaaacacagaaaaggccaaaagcttaatagaagaaggaggagactgggacaggagaaaccgcctaaaagtgtatcagggtctttattgtgtggctattcgtgatttcaaacaggcagctgaactcttccttgacactgtttcaacatttacatcctatgaactcatggattataaaacatttgtgacttatactgtctatgtcagtatgattgccttagaaagaccagatctcagggaaaaggtcattaaaggagcagagattcttgaagtgttgcacagtcttccagcagttcggcagtatctgttttcactctatgaatgccgttactctgttttcttccaatcattagcggttgtggaacaggaaatgaaaaaggactggctttttgcccctcattatcgatactatgtaagagaaatgagaattcatgcatacagtcagctgctggaatcatataggtcattaacccttggctatatggcagaagcgtttggtgttggtgtggaattcattgatcaggaactgtccaggtttattgctgccgggagactacactgcaaaatagataaagtgaatgaaatagtagaaaccaacagacctgatagcaagaactggcagtaccaagaaactatcaagaaaggagatctgctactaaacagagttcaaaaactttccagagtaattaatatgtaaagccatgtaactaacaaaggatttgctttagagataattatttggaatttttatagcttacttcacaatgtgcccaggtcagctgtataaaataaatactgcattgttgtttc

SEQ ID NO: 2352 - DNA, 2922 bp, Homo sapiens
ccacgccgccatggccaagtggggccaggggaacccccactggatcgtggaggagcgggaggacgggaccaacgtgaacaactggcgctggcgcggctggcggcggcctccttccgggatctggggagggccgggccgcgggagccggggctgccctggggtctgtgcggggccgcggggccagggggtcagggggccgccccccctcagctgctggacgcagggctcggccttcgcctctcggctcgggagagtccttgagtacggagaccggctaggagggttgcagctgcctctttttgaaagttgggttgggccccaagagtgacttccgacagacctttccactcccaccgtctgtggcctgagggccttcccttctcctcccgcccacccctctggatgtttcggggagttagaagggagctggattgagagactgtgttaggggcgggggtatggaacgtagtggaaagggcagaaatttggatctcagttcgcgcccaccccgcaggcgcctcccgcgagccgggccctctgtgagtgagacaagctccccttcctttacgcgcctcacctggcgcgtggggagaggtcggcagccctccgccgcagaacctccggaagggatgtcctctgccctgcgcctctggccggggctgtggtccctccaggccgtcgaggggatgctgaggccggtccccagaggagcatgacttggctggtccggaggagctctgagggcatgggcaatcttggctcgctgcaacctcagcttccagagttcaagcgagtctcctgcttcagcctcatgagtagctgggactacagatgcgtgccactacgtccgtctgatgtttgtatttttagtagagacagggtttcaccatgttggtcaggctgctctcgaactccagatctcgtgatccgcccgcctgggcctactaaagtgctgggattacaggcgtgagctagatctgactttctagtgtcctagccttggcccgatggacatgtcatttctctcagctcgtttctgtcccctaaagtgagaatattgcctgggaagattacattagacgatgtatatgcgaagacacttgatagctggtattgtcatgattctgattagttcactactgctactttccctgtggcctaggctttgcctatttccagtgggcgagctagctagatcctcctcccttaaataagccagtgtttttaagacagaatactacttgcatagtggacaataatatcttaaagaactgagcaggatgaaaagaatttgatagaaagcaggtttgaggagcacattggaggttggcaggtttcgaggctgcttgagaggacttgggccgatctgggctgggcttggacgtgaccctggcacccaggcaggtggatcccagctggggcttccattcacgactttctggtccctggcaggacagagcgggatgccaccagcttgtccaaagggaagttccaggagctcctggtgggcatcgttgtggagaatgacgctggccgcggcgagatcaacgagttgaagcaggtggaaggggaggcttcgtgcagcagccgcaaaggaaagctgattttcttctatgagtggaacatcaaactgggctggaaaggcatcgttaaagaatctggagtgaagcacaagggattgattgaaatacccaatctttctgaggaaaatgaagtagatgacactgagaatttacaacgggaatgattttaccaacgaaagctatggcaacccaggaattgactgtcaaaagaaaactgagtgggaataccctgcaggttcaggcctcatctccagtggcactgggtgtaaggattcccactgtggctcttcacatgatggaactgtttgacacaactgtagagcagctgtatagcatcttcactgtaaaggagttaacaaataagaagatcatcatgaaatggagatgtgggaactggccagaagaacactatgccatggttgcactgaattttgtgcctactctagggcaaacagaattacaattgaaggagttcctatctatctgtaaagaagagaacatgaaattctgttggcagaagcagcattttgaagaaataaaaggttcactgcagctgacccccctaaatggttgaattaaaatttattataaggcattactttttgtaagcggaaaaagtgtcacatttacctcttccctatcttttgtttaaaaggactgtctttattttatattggatgaaatctatgaacatatatacaatgtaaagcattgtttgactctttattataactagacactgcattgatttaaaagtagcaaacaacctgaaattaagtattaacctgaccttccatcgatattcctctggaaataggtaagtcctgagtgcagatagttgatgtttcccaagctgaagcttgtcctatagcaagcttgcttgcagctgtacttttagttcaagatgacaaaaaataaatggcatgttgacactattcctttattttactttagggtttttaaggtgtgtagatcttaggtcgtaaaacagtggtatattgcattcaaaagcatgttgaggtgagggcaaattggctgtgttttgctccacatctccctgcacatctccctgctgtggttttgcacttcggtgtggagaggattgagaagtctgtggggacacattagttctgtggactgctggtaacacttccagtgaaacagcatataatggataaatgtttcccccctctttcacggttttctcactactttcacctgagaagactgaagcaacgtatgtaaacaaatgaaaagtcatcacaatcagtttaattaagtgcacagaatagcaatcaatcaatcagtcatgtcaataaaaataaaacaattattttta

SEQ ID NO: 2353 - DNA, 6029 bp, Homo sapiens
agactgaggctggctggctggaggttgacacaggagtgctcaggggagcagcatcacaagagggcagatcgaaagcatcgtccttgctgaaaaagtgagcatgggcctggggtgtgccctggactggggagggagacggcaaacttctaagacctgcaatgagagttcaggcctttggcacaaactaagcagcttcgcctgctcaggctgggagggacagagagtgaggcacagggactctcaacttgggccaagctctgagcaaatgctataatgtcctcatggggcaatagatttgggggttctgggggtgggtcccttccaggcagaatccccaccatcctctctggtgtgaggggaccctggagctccggacctcaggccaggagcccagccctgggtctgcagtgaggggctgaccagacagagcttctcctgtcccagcagatggcagaggtggaagcggtacagctgaaggaggaaggaaaccggcatttccagctccaggactacaaggccgccacaaatagctacagccaggccctgaagctgaccaaggacaaggccctgctggccacgctttatcggaaccgggcagcctgtggcctgaaaacggagagctacgtccaggcagcttcagatgcctccagagccatcgacatcaactcctcggacatcaaggctctgtatcggcgatgccaggcactggagcacctggggaagctggaccaggccttcaaagacgtgcagcgttgtgccaccctcgagccacggaaccagaacttccaggagatgctgaggagactcaacaccagcattcaggagaagctccgagtgcagttctccacagactcgagggtacagaagatgtttgagatcctcttggatgaaaacagtgaggctgataagcgggaaaaggctgccaacaatctcattgtcctaggccgtgaggaagcaggggctgagaagatcttccagaacaatggagtagccttgctactgcagcttctggacactaagaagcctgagctggtgctggctgcagtgcggaccctgtcgggcatgtgcagcggccaccaagccagagccacagtgattctgcatgcagtgcggatagaccgaatctgtagcctcatggccgtggagaatgaggagatgtctctggctgtctgcaacctgctccaagccatcattgactccttgtctggggaggacaagcgggagcatcgagggaaggaggaggccctggttctagacaccaagaaggacctgaagcagatcaccagccacctgctggacatgctagtcagcaagaaggtgtctggccagggcagggatcaggcgctgaacctgctcaataagaatgttcccaggaaggaccttgccattcatgacaactcacgtaccatctatgtggtggataatggtctgaggaagatcctgaaggttgtggggcaggttccagatctgccatcctgcctgcccctgactgacaacacccgcatgctggcctctatcctcatcaacaagctctatgatgacctgcgctgtgacccggagcgcgatcacttccgcaagatctgtgaggaatatatcacgggcaagtttgacccccaggacatggacaagaacttgaatgccatccagacagtgtcagggatcctgcagggcccctttgacctgggcaaccagctgctgggactgaaaggtgtgatggagatgatggtggcactatgtggctcagagcgcgagacggaccagctggtggccgtggaggccctcatccatgcctccacgaagctcagccgcgccaccttcatcatcaccaatggagtgtcactgctcaaacagatctacaagaccaccaaaaatgagaagatcaagatccgcacactggtgggactctgtaagctcggctctgcaggtggcacagactacggtctcaggcagtttgcggaagggtcgacagaaaaactggccaaacagtgtcgcaagtggctgtgcaatatgtccatagacactcggacccgacgctgggcagtggagggcctggcctacctcacgctggacgctgatgtgaaggacgactttgtccaggacgtccctgccctgcaggccatgtttgagctggccaaggcaggtaccagtgacaagaccatcctgtactcggtggccaccaccctggtgaactgcaccaacagctacgatgtcaaggaggtcatcccagagcttgtccagctcgccaagttctccaagcagcatgtgcccgaggaacaccccaaggacaagaaggactttatagacatgcgggtgaagcggcttctgaaggcgggtgtcatctctgccctggcttgcatggtgaaagcagatagtgccatcctcactgaccagaccaaggagctgctggccagggtattcctggcactgtgtgacaacccaaaggaccgaggcaccattgtggctcaaggtggtggcaaggccctgattcccctggctttggagggcacagatgtgggcaaggtgaaggcagcccacgctctagcaaagatcgctgctgtctccaatccggacattgcttttcctggggagcgggtgtatgaggtggtgcggccccttgtaagactcttggacacacagagggatgggcttcagaactatgaggctctcctaggcctcaccaacctgtctgggcggagtgacaaactccggcagaagatctttaaggagagggccttgccagacatcgagaactacatgtttgagaatcatgatcagctgcggcaggcggccaccgagtgcatgtgcaacatggtgctccacaaggaggtacaggaaaggttcttggctgacgggaatgaccggctgaagctggtggtgctgctctgcggggaggatgatgataaggtgcagaatgcggctgcaggggctctggccatgctgacagcagcacacaagaaactgtgcctcaagatgactcaagtgacaacccagtggttggagatcctccagcggctttgcctgcacgaccagctgtctgtccaacaccggggcctggtcattgcctacaacctactggcagccgatgctgagctggccaagaagctggtggagagtgagctgctggagatcctgactgtggtgggcaaacaggagccagatgagaagaaggcagaagtggttcagacagcccgagaatgtctcatcaagtgcatggattatggtttcattaaaccagtgtcttagacagcgaccctcagggatgctgggagtggtcctgtactgtgcagagtcctgggttggttgggttctcctgaagagtcaggtcatctagggatcatagcagtgacaatgaagtctcaatataaaggaaagacttgattgttctctgagttgtgagtcttctcctttgtcctgacagagtttggatgtttcactctctctcttgcttcctgtctccttatatttgtcatgtttcagaaattcccagaataattttcacccatgattagaaataggttggatcattctttctgtacccattctgaaggccaggataataggttgaagttctttatattttggaaaatggattttgtggtaaggtaggaactaacgggtgtgtgcatataaaggttaatgctgttgtatttggatgctgatctgtgctgttttcatgacctctctcccacactatttgaatcagtctgttcagaactgtgtgtttcacctgcagtgctctgtcccagtcccatgcccattcccatcacttcactgtgatggaaatagagtttatgttcaacagtggggcatgacctctgcaatttgcttgggaaagtcttccaagcaagatggacatgatgaatacaaataagatctactcaaagtacttcaaacaaaaaataaataattcattggctcatgtatcttggccacccagggaaggtctgacattgttagttagatccagagtttcaaatgtcatcaccatggatgtgtctttttctctctctcatttcccctccccatatcttgtcttttatttattataggtttgtctcattccctggcaggctctctccctgtgataggaaagagagtccccagcagccccagggtgacatagttgttatagttcattatggaatagaagagagaagagcattctcaataacccggcaaagttcccagggatgactctgatatgtctatgtctcaggtcacatttccatctatgaaccaatcatattcagaggtggaatgctaattggccaggcctgggtcatatatacaagtctagggaagaaatgagcttcatccctgtccaattgacatggactgattaggggtattaatggaagaggtgtgccaccacaaaagaatgtaccctgggcagatcaaagaacatattctgtatgtcaggcttggccacaaaagaatgacacaagtaatatgctgtagatcagaacctctctgctaatattgcctttttagcatggttaagatagctaagatctagtactgtcactccagtatgtcccaattctacctacgtttattgaagggtcaacagttctgatctcagcattgggtaaagggtgggacattcagatttacggtccttgataaaaacaatttacaacgttccgttgtgtaataaatgtaagtgtacatatgcctgggacatcagctggaaaagggacagactatcagagagttgcactgttgcggtatgggccaaatccaacataatacccgctgtacctctagagaactaaaaccttaatttctcagatcttttctgcactaatggtctttacatacagcctacattttaactaactcttgcatgggcttgtttcacagcaggaaactatattcatcatatccttattatgatagagaatgacaacattcaaaagggtgtggtgcttctgaaaatatacacaataaatggcatgatttgacctctgtcaaattcttctttcctgctttcctcatatgtgggcttgagtgggtgtatttagctcctttaaaggaaactctttcacaggcagggccacactcttactcgttttgatctcatgaggttacatctgccagtggcgttcagggccagttagataaagttcatcttgtttggattggagagactttttttttttttttttttgagacagggtcttgctctgtaacctaggctcaagtgcagtgcagtggtgcagtcatggctcaccgcagccttggtctcctgggctcaagtgatctttctacttcagcctcctcaatagctgggactacaggcacacaccaccacccccaggtaattaaaaaatttttttttgtagagacagggtctcactatgttgcccagtctgggagaccacattctttaacatgaatattttgtaaatagtccaagaagatctagaggaaagctgaattccttcatctgatttttgccactgggctgcctcccattgtctggctaagtcttcatgggaggcctttaagaaaagctgtgacaaatacctttgtttcccactgcctaggttacataagtagttggcttttccagcctagactcttatattgttgcttgtaagagggcccttctttgcagatttcttttttttttcatctatgctttcaaataggcagatgctagcctgagatcatctctttattgaggtagtttgcccaaaaacagcaaggaacagccaatacctgccaactttctaggtttttccaaccaattctcttacagaaaatctataaatatcttagaggtatgtttcttagtttcccaacatataatgggaaaattcatcatttatattattacttttaactgaagtatgttgttatcagagaacttggtctgtgtcatattaatcctttgccatttgagaagcatacagttttaaagtttatatctccaaaaggatattttgtaaaaatttaacccctttgactcttagtcttctcatttgtgaaaggtaaataataaagaatttctgttcctagtaaga

SEQ ID NO: 2354 - DNA, 533 bp, Homo sapiens
gtttcccgcactgccggtatccgccgccatccggactcccgggtcctctgtgcaggttggaggatggttggttgtggcgagcgaggctgaaggagccgggacgcggggctctgggcctcgggaactgagccggtactcacctccgccccttctccccgtcgctgtccgcagccatggccctacgctaccctatggccgtgggcctcaacaagggccacaaagtgaccaagaacgtgagcaagcccaggcacagccgacgccgcgggcgtctgaccaaacacaccaagttcgtgcgggacatgattcgggaggtgtgtggctttgccccgtacgagcggcgcgccatggagttactgaaggtctccaaggacaaacgggccctcaaatttatcaagaaaagggtggggacgcacatccgcgccaagaggaagcgggaggagctgagcaacgtactggccgccatgaggaaagctgctgccaagaaagactgagcccctcccctgccctctccctgaaataaagaacagcttgac

SEQ ID NO: 2355 - DNA, 2196 bp, Homo sapiens
ttcatggctctcgggtagaacctagtgaaacggccagaatgaattctatggacaggcacatccagcagaccaatgaccgactgcagtgcatcaagcagcacttacagaatcctgccaacttccacaatgccgccacggagctgctggactggtgcggagacccacgggccttccagcggcccttcgagcagagcctgatgggctgtttgacggtggtcagtcgggtggcagcccagcaaggctttgacctggacctcggctacagactgctggctgtgtgtgctgcaaaccgagacaagttcaccccgaagtctgccgccttgttgtcctcctggtgcgaagagctcggccgcctgctgctgctccgacatcagaagagccgccagagcgatccccctgggaaactccccatgcagccccctctcagctccatgagctccatgaaacccactctgtcgcacagtgatgggtcgttcccctatgactctgtcccttggctgccagcctaccctgcctgcactcctccaccatcacaatctcacccaaactcctgctcactcaagcaaaagcagcctctggccttccctccaccgctttgctccatctggcttaccactctccagggcctcctggggagcctgtcctgtgttcactttgtttcaggctggtctgtgccccgtgagccacatggcctagggtgatgccaggttgtcccgtcactggggtcccatctgtaaattctttgcgcccttcccggctgctgcctggggccctttcctgctctcccgtccgctgtgggtggtccccagctctcctctgtgggttttaccggaaaggtggccccagctgttgacttccagtcactgtcccagacggcacaaggttttctgtaggaaagctgccattgccccggccccttttcttcctttgtcccgttgtcgaggttttttcaaatagcgtgttgttcagtatgcaaatcaattattttaagaatcgcttttgtaaatatctttgtgaatattttagtatcgtctttgataatattcaacattttcatgacctggttatagcctttgctggtgtttttaaaatacctggactcaatgacaaagaccgagtcttctttttttttaaacaaaaacaaaaaaagcaaccagggctatttgtacagttgaaggggtgaacagaatgggcggctgtgctgggagttggaagaccgggcagcccgctatttagagccatccctcagtcagctggcagggacaagccaacgccaggtagcatgtggccacccttgcccagtgtctgtggcctggcaagtggccacgccctgtgtcagaccatctgggaattaagctccagacagacttacagatgccttccttaggagttcttgcttcttgcgttgatactttgccccagaaaggcctgggattcattctggttcttatcagggtgtgtccacactctgctcacaggtggatccacggctttccagtgcggagagtcgagatgctccctgcagcccaggccccgggcacctcctgcaaccatctctgggctcagcacctgaggcgggtttcctgggtcccctctccagcaagcctccaccagcaagctcggcccagagcttcccttccggctggctctgaaccgtgcgtggtgcctacagcctgcagtctggagacaagctcttccggagtgctctgggagccaggccagggtgtgagggaggtgcagaggcatccggggcgggagcaagccccaggttgtgacaggtgcaggtagacaacgcccataaacagagatggtcctgaactctggagagatccttccctgatcctttcggacgactacttggagccataagtaacctcagcaaaaacgaggcctctgcaagccacttttccatgccaagcatccacccggcccacaggcatgtttctgccgccactccgcaagatggacagggagccagcaggcaggcgggaagggccaagtacaggcaatcacccccatcttcttggtttgaagctttatccatgtatcatgttccgtgtagccattttattttttaagaaactgctaatactttctccctaatggaagccctgatcccccagagagctacaggtctgctcccgacgggcctcgggcctgacccgtccacacagggccgtgtcaacagcagcgact

SEQ ID NO: 2356 - DNA, 529 bp, Homo sapiens
gttgtctgcaggtatggatgttgttctcttttccctgtctttatttccttaccaatcggctgccatccgaggagctgaggaagcctagagctctcagaagcagtcctttgagctggtgtaggggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgt

SEQ ID NO: 2357 - DNA, 441 bp, Homo sapiens
cttttttcttcctcttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgt

SEQ ID NO: 2358 - DNA, 853 bp, Homo sapiens
ccgaggagctgaggaagcctagagctctcagaagcagtcctttgagctggtgtaggggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgtccaatagaaaaagttggtgtgctggagctacctcacctcagcttgagagagccagttgtgtgcatctctttccagttttgcatccagtgacgtctgcttggcatcttgagattgttatggtgagagtatttacacctcagcaaatgctgcaaaatcctgttttcccccagagagctggaggttaaatactaccagcacatccctagatactactcaagttacagtatatgatcactaatatagtatgctcttggtaccaggagctctgatatatatctggtacatgtttgataatgacttgattgttattataagtacttattaatacttcgattctgtaaagagtttagggtttgattttataaaatccaaaatgagccttttattgaa

SEQ ID NO: 2359 - DNA, 4049 bp, Homo sapiens
atgaaagccataaagaaaagtcttacagaagaagaatacctgtacctggacttttctcaccaaacagaaggatgcatctttcctcttcatacatctgtaactttatttctgttatcttactgtgactgtaaaatctttaaaatttgcttagttgtcaccaaagaggtgagtagagatagttcactactaagagatgacctgatccaggatgttgaaatacagattatttcaaggcaggagctcccaccaatagtccaaaattgctgtttgcctgcagtagtagaacgatcagacaatttttgtagagcaggacttgctgttgtattgagacacataatccagaaatcctatgaagcagaccccttaaagaaggaacttttggaacttctgggctttaaaaagacttgcttgaaagcctgtgctgaagttagtcagtggaccaggctatgtgaactcaccatccctttggctattgagaattttctcagagaatcttctgaccagcccccaactatacctgtagaaatactacagctagagaaaaagcttagtgagcctgttagagtgcataatgatgataaactccgcaggcagaagctcaagcaacagaaggctgatggagttgggcctccccttactaagggaaaggcaaagagcaaggtccacacacaggaaacatctgaagggttggattcttcatccaagagtctggaactgaaagtggcattctcaaagctcacagtacaggaagaaccagctactaccaacagagagccttctcacatcagaaaagcaaaagcctccgaccttccacctctggagcatgtgtttgcagaagggctttacttcactctggcagatattgtgctcttgccctgtatccatcatttcttggtaattatcagcaggaaattttctgagaagctggtagaatttccattgctagcctcttggtaccagaggattcaggaagtgccaggagtaaaaacagcagcttctaagtgtgggatccaatttctccatttaccaaagttgttgacaacctcaactgaacagcatccaaacttatgtgaagtcccaggtgtagaagagcaaagcgatcctttatttataggaggaccaagaccaaccatggccaagttaatggaaaagggcattgaagtgatgttttctccccacccttgccctacttggactcttgattggaatgttctccctgcagcagtcagcccaaaggaaggtaaaatgtccagtgatcgagctttgaggaagcagcaacagttgaacaaccttgtctatgtggtaacaaatcaggccaaacctggtgacagaattgtggatttctgcagcggtgggggccatgttggaattgtccttgctcacatgctgccatcatgtcaggttacattaatagaaaacaaggaattatcattaattcgtgctaagaagagaagtgatgaactgggtttaagcaacatttggttcattcaagcaaatatggaatattttactgggatgtttaatattggagtagcattgcatgcttgtggagtggcaacagacatggtgattgagcactgtatcaaaacacgggcttccttcgtcacatgcccttgctgttatggtttcattcagaacacctcaaagttcaattttccaaaaagtgaacaattcaagaaaactttatcatacaaggaacacatgattctgtgcagatttgcagaccagacagctgtccagctcccaccccaacgaaggctcataggaaaacagtgcatgtgcttggtggatctggatcgagcaagagctgcagaagaatgtggatactccgttcaagtgatatccatggagccagagagctgctctcccaaaaataacatgattgtgggagtccccatttaaaatgagatattcacatttgatattttgccatccgtcttcacgttggatgcccagtggcattcaggaggttcttggcataactaggaaacagcattagccatcttgaacctattgtgctcaggaaggaaagcaacagggaaatcttggaagtaaaggctccctgcaaagcatcacaaatgctttacaatgtgtgattaaaggactgctggtttttatagtgagaatcccctgaagtctcagctgccaaaagaataatactagtggaggttccatcacaggaataacaatttccttctcacttcacaagctcctctgatcttgccaatgtgatgtttaattcaaaacagcgcacttacagcctttattttatacttatttagatattcacatgggaactgaaagtagactcagtggagttttttgttttttatatttttaacaattgtactttttctatcactttaaaaaaatctagtcaggtaattatagtacagttatttttaagctggggttagttgaacttgtatagcatttaatatactccttttaaatatatttctgccaggcatggtggctcatgcctataatcccagcactttgagaggccaaggtgggaggatcatttgagcccaggatatcgagaccagcctgcactacaaaaaaatccaaaaaatgaggtgggaggatcacttgagcccaggaagtcaaggctgcagtgagccttgatagcgccactgcactcctgcctgggaaaatgagacccagactcaaaataaatcaatgaatgaattaataaacaaataaataaataaataaatttcccataaattaccaaatgagattgtcactggttcaaattattaaataattgccataaatttcctattacgggaatgtggaatttggacatacattttaacaataagtacattgattaatacatttaagtttataagtaattattgaggatccagtattttcaagaccttggcctagtttcttttcaattcaaagatgagttgcaaaagacataatgttttgcctatggaagtagatcatctagaagaaaaagattaaagaattagttaagcttttttttttttttttttttgagacagagtttcactcttgttgcccaggctggaattcagtggctcgatcttggctcaccacaacctctgcattctcctgcctcagcctcccgagtagctaggattataggcacctgccaccatgcccggctaattttgtttgtaattttagtagagatggggtttctccatgttggccaggctggtttcgaactcctgacctcaggtgatctacccgcctcagcctcccaaagtgctgaaattacaggcgtgagccacctcacctggccatgttctttatggaatactacaatgtgttgtcacaggatttgttattcagatgtcaatcatttttatttatatatttctgggtaaaacttattagtggtgtgaggagtgcagaatatggaagcttacctaaattctttttctgccagccaacattttaaaagacaaatgatgcatcctttctcaatgctgctaattctttaaattttacatgtcccaatttattccatttgagatttattttaatgttttcaacccctgtgtaacatgtatcatgaggagaaagcactatcattgatcatcactatggattaaaatataggaatattttacagggcagtatgggtgggggtgggagacatattggaatcgtgttttctgggataaaatttttaaaaagaattaatcattagccctgagtattttagtcatttgtgcctatagaaaacaacatgctcttttattgtggactttcttcttttaagtgaggtttaatttatatacaatacaataacagatttttaagtattcatttgagatgttttgacaactgtatatatacatgtaaccatcactggaatcagatatagaatattccccttaaatattgtcaggtaaacacattgagaatattttttccagtctgtggcttacctacttattttcataatgaatgttttacttgtgatgaagatttaacttacccttttactttaatgattaatattttctgtgttctttctaataaattttacgaactctgaggtt

SEQ ID NO: 2360 - DNA, 4043 bp, Homo sapiens
gttacttccctttttccggtccgccggattatgaatgacggccggcgcgagtattttccacataaggtggctgtcgtttttctcctggcgtctgtggaggcgagtggtctgcgggcagcagctcccagaggcagccttggaattccagctcggactgggcgggaaggcgcaggcggcccaggtcgccgacacgctcacgcaccctccctgcctggccgcgcctctgcgaccaggtgacccaatgaaagaagaaaatgaaagccataaagaaaagtcttacagaagaagaatacctgtacctggacttttctcaccaaacagaaggatgcatctttcctcttcatacatctgtaactttatttctgttatcttactgtgactgtaaaatctttaaaatttgcttagttgtcaccaaagaggttagtcagtggaccaggctatgtgaactcaccatccctttggctattgagaattttctcagagaatcttctgaccagcccccaactatacctgtagaaatactacagctagagaaaaagcttagtgagcctgttagagtgcataatgatgataaactccgcaggcagaagctcaagcaacagaaggctgatggagttgggcctccccttactaagggaaaggcaaagagcaaggtccacacacaggaaacatctgaagggttggattcttcatccaagagtctggaactgaaagtggcattctcaaagctcacagtacaggaagaaccagctactaccaacagagagccttctcacatcagaaaagcaaaagcctccgaccttccacctctggagcatgtgtttgcagaagggctttacttcactctggcagatattgtgctcttgccctgtatccatcatttcttggtaattatcagcaggaaattttctgagaagctggtagaatttccattgctagcctcttggtaccagaggattcaggaagtgccaggagtaaaaacagcagcttctaagtgtgggatccaatttctccatttaccaaagttgttgacaacctcaactgaacagcatccaaacttatgtgaagtcccaggtgtagaagagcaaagcgatcctttatttataggaggaccaagaccaaccatggccaagttaatggaaaagggcattgaagtgatgttttctccccacccttgccctacttggactcttgattggaatgttctccctgcagcagtcagcccaaaggaaggtaaaatgtccagtgatcgagctttgaggaagcagcaacagttgaacaaccttgtctatgtggtaacaaatcaggccaaacctggtgacagaattgtggatttctgcagcggtgggggccatgttggaattgtccttgctcacatgctgccatcatgtcaggttacattaatagaaaacaaggaattatcattaattcgtgctaagaagagaagtgatgaactgggtttaagcaacatttggttcattcaagcaaatatggaatattttactgggatgtttaatattggagtagcattgcatgcttgtggagtggcaacagacatggtgattgagcactgtatcaaaacacgggcttccttcgtcacatgcccttgctgttatggtttcattcagaacacctcaaagttcaattttccaaaaagtgaacaattcaagaaaactttatcatacaaggaacacatgattctgtgcagatttgcagaccagacagctgtccagctcccaccccaacgaaggctcataggaaaacagtgcatgtgcttggtggatctggatcgagcaagagctgcagaagaatgtggatactccgttcaagtgatatccatggagccagagagctgctctcccaaaaataacatgattgtgggagtccccatttaaaatgagatattcacatttgatattttgccatccgtcttcacgttggatgcccagtggcattcaggaggttcttggcataactaggaaacagcattagccatcttgaacctattgtgctcaggaaggaaagcaacagggaaatcttggaagtaaaggctccctgcaaagcatcacaaatgctttacaatgtgtgattaaaggactgctggtttttatagtgagaatcccctgaagtctcagctgccaaaagaataatactagtggaggttccatcacaggaataacaatttccttctcacttcacaagctcctctgatcttgccaatgtgatgtttaattcaaaacagcgcacttacagcctttattttatacttatttagatattcacatgggaactgaaagtagactcagtggagttttttgttttttatatttttaacaattgtactttttctatcactttaaaaaaatctagtcaggtaattatagtacagttatttttaagctggggttagttgaacttgtatagcatttaatatactccttttaaatatatttctgccaggcatggtggctcatgcctataatcccagcactttgagaggccaaggtgggaggatcatttgagcccaggatatcgagaccagcctgcactacaaaaaaatccaaaaaatgaggtgggaggatcacttgagcccaggaagtcaaggctgcagtgagccttgatagcgccactgcactcctgcctgggaaaatgagacccagactcaaaataaatcaatgaatgaattaataaacaaataaataaataaataaatttcccataaattaccaaatgagattgtcactggttcaaattattaaataattgccataaatttcctattacgggaatgtggaatttggacatacattttaacaataagtacattgattaatacatttaagtttataagtaattattgaggatccagtattttcaagaccttggcctagtttcttttcaattcaaagatgagttgcaaaagacataatgttttgcctatggaagtagatcatctagaagaaaaagattaaagaattagttaagcttttttttttttttttttttgagacagagtttcactcttgttgcccaggctggaattcagtggctcgatcttggctcaccacaacctctgcattctcctgcctcagcctcccgagtagctaggattataggcacctgccaccatgcccggctaattttgtttgtaattttagtagagatggggtttctccatgttggccaggctggtttcgaactcctgacctcaggtgatctacccgcctcagcctcccaaagtgctgaaattacaggcgtgagccacctcacctggccatgttctttatggaatactacaatgtgttgtcacaggatttgttattcagatgtcaatcatttttatttatatatttctgggtaaaacttattagtggtgtgaggagtgcagaatatggaagcttacctaaattctttttctgccagccaacattttaaaagacaaatgatgcatcctttctcaatgctgctaattctttaaattttacatgtcccaatttattccatttgagatttattttaatgttttcaacccctgtgtaacatgtatcatgaggagaaagcactatcattgatcatcactatggattaaaatataggaatattttacagggcagtatgggtgggggtgggagacatattggaatcgtgttttctgggataaaatttttaaaaagaattaatcattagccctgagtattttagtcatttgtgcctatagaaaacaacatgctcttttattgtggactttcttcttttaagtgaggtttaatttatatacaatacaataacagatttttaagtattcatttgagatgttttgacaactgtatatatacatgtaaccatcactggaatcagatatagaatattccccttaaatattgtcaggtaaacacattgagaatattttttccagtctgtggcttacctacttattttcataatgaatgttttacttgtgatgaagatttaacttacccttttactttaatgattaatattttctgtgttctttctaataaattttacgaactctgaggtta

SEQ ID NO: 2361 - DNA, 2161 bp, Homo sapiens
gaagccactagccggttactagctgcgcttttgttccacttgagcgggcactcttctgcggcaagcaggtctaggaattcgcctggttcccacctcgcgtcccttgccttccttcctagtctacccactgtagtgccccctgcgtcccgctccctcctagccgactcagagcacaagaaggattgccacggtttccattgcagcagccgtggcgcctctgaccctttttttatatcgcggcgacggcgggctgtcgtcacgacgacgtgcggacgcagcggcgggggcctttcagcttatgtggagaagtcgctgtgaagccacctataaatccatttactgaatttatggagaaggctgtaaatgatggaagtcattcagaagaactcttttgccatcttaaaactatatcagagaaagaagatttaccacggtgtaccagtgaaagtcatctcagctggcgaatctttctgcattgaatttgaagatttctgaacagaaggaaatattaataaaagaattagacaccttcaaaagtgtaaaactagctttagaacatcttcttagaaagagagactacaaacaaacaggagacaatttatccagcatgttgctagaaaatctaactgataatgaaagtgaaaatactaatcttaagaagaaggtatttgaaaaggaggcccatatccaagaactttcttgtttgtttcagagtgaaaaggcaaatactttgaaagcaaaccgtttttcccaatcagtaaaagtagtacatgaacgactacagatccaaattcataaaagggaagccgagaacgataagttgaaagaatatgtaaagagcttagaaaccaagatagccaagtggaacctgcaatcaagaatgaataagaatgaggctatagtgatgaaagaagcaagtaggcaaaaaactgtagctttaaaaaaggcatctaaagtttacaaacaaaggcttgaccattttacaggagctattgaaaagcttacttcccaaattagagatcaggaagccaagttgtctgaaacaatttcagcttccaatgcctggaaaagtcattatgagaaaattgtgatagaaaaaaccgaattggaagtacagattgaaacaatgaaaaagcaaatcattaatcttttggaagatctgaagaaaatggaagaccatggaaaaaattcatgtgaagaaattcttagaaaagttcactcaattgaatatgaaaatgaaactctgaatcttgagaatacaaaattaaagactacacttgctgctttgaaggatgaagttgtatctgttgaaaatgaactctcagaattgcaagaagtagaaaaaaaacagaaaacccttattgaaatgtataaaactcaggtacaaaagttgcaagaagcagctgaaatagtaaaaagcagatgtgaaaatttgctacataaaaataaccaaataacaaaaaccaaaaataaaaatgtagagaagatgagaggccagatggagtctcatctgaaggagttagagcgtgtctgcgattccttgacggcggcggaacggaggcttcacgagtgtcaggagagtctgcagtgctgcaaggggaagtgtgcagaccaggaacacaccattagggagcttcagggccaggttgatggaaatcacaatcttctgacaaagctttctctggaagaggaaaactgtcttattcagctgaagtgtgaaaaccttcaacaaaaattagaacagatggacgcagaaaataaagagcttgagaagaagctggcaaaccaagaagaatgtcttaagcacagcaatcttaagtttaaagagaaatctgcagagtatacagcattggccagacaactggaagctgctttagaagaaggaagacaaaaggttgctgaagaaatagagaaaatgtcatctagagagagtgctttacaaattaaaatattagatctggaaactgagcttagaaagaaaaatgaagaacaaaatcaacttgtttgcaaaatgaacagtaaagcacaacatcaggaagtgtgtttgaaagaagtacaaaatagtcttgagaagtcggaaaatcaaaatgagagtattaagaattatttacagtttcttaaaacttcttatgtaacaatgtttgaataaattgtcaaattt

SEQ ID NO: 2362 - DNA, 1810 bp, Homo sapiens
ggagtatagggcttgaactgagagcctggcctcccagaaggttttaatagacctacggcacagaaattgacacagcccggaaaaggcccacaaagagaagcccaaccagccagcccccaggccgccccgccagggacccaccaatgaggcacagatggcagccgctgccgccctagcccggctggagcagaagcagtcccgggcctggggccccacatcgcaggacaccatccgaaaccaggtgagaaaggaacttcaagccgaagccaccgtcagcgggagccccgaggccccagggaccaacgtggtatctgagcccagagaggaaggctctgcccacctggctgtgcctggcgtgtacttcacctgtccgctcactggggccaccctgaggaaggaccagcgggacgcctgcatcaaggaggccattctcttgcacttctccaccgacccagtggccgcctccatcatgaagatctacacgttcaacaaagaccaggaccgggtgaagctgggtgtggacaccattgccaagtacctggacaacatccacctgcaccccgaggaggagaagtaccggaagatcaagctgcagaacaaggtgtttcaggagcgcattaactgcctggaagggacccacgagttttttgaggccattgggttccagaaggtgttgcttcccgcccaggatcaggaggaccccgaggagttctacgtgctgagcgagaccaccttggcccagccccagagcctggagaggcacaaggaacagctgctggctgcggagcccgtgcgcgccaagctggacaggcagcgccgcgtcttccagccctcgcccctggcctcgcagttcgaactgcctggggacttcttcaacctcacagcagaggagatcaagcgggagcagaggctcaggtccgaggcggtggagcggctgagcgtgctgcggaccaaggccatgcgggagaaggaggagcagcgggggctgcgcaagtacaactacacgctgctgcgcgtgcgcctccccgatggctgcctcctgcagggcactttctacgctcgggagcggctgggggcggtgtacgggttcgtccgggaggccctgcagagcgactggctgccttttgagctgctggcctcgggagggcagaagctgtccgaggacgagaacctggccttgaacgagtgcgggctggtgccctctgccctcctgaccttctcgtgggacatggctgtgctggaggacatcaaggccgcgggggccgagccggactccatcctgaaacccgagctcctgtcagccatcgagaagctcttgtgaaataaaagcagggttggcctcagccctgtgggtctgtctcatgctctccctgttcctctccccgccaccccagggcctccaagccacctctggaaatacttggctctgccccatgggcacgggaggggcgccagccgtggagctgtggaattgggccccgtggcagagcccccatcccttgggggctgtggggatgcgcccaagcccccgagggagaggcctggggacaccaacaaatctaagccctccctagctgcttggtaactgtgtcatgaagctgccggacagacacacgtggcatctccctgggcaggagagcaggcctgcagcatgggtcctgttcccgtgtgccgtgggtggcagtggctgcacctggcactagggctgctctgtggatgtgggtgacaacggcaggaggggatgctggccttcctgcacatagacctgcagttagtaaatcataagcccaaataaacaggttgtttgaat

SEQ ID NO: 2363 - DNA, 3256 bp, Homo sapiens
ggctccgcgtccggcgcctgtttgtgctgcggcgctgtggcaccggacggccctgccaccccacccccgggagccgagagcggccccgggagagtccgagggcccgggggggtctggagactgcggccccgggcccacagcgccccctccaggccccttccccgcgcccgacagcgccccctcggggtggtggtacggcgcccttcgcgcgcgccccggggtgcttccccttcccctctccccggccgtggcccccgcggcttagacgcctcctccgccgccgccgctcggagcaacccgggggccggatggacggggccgcggggcccggtgacggccctgctcgggaggccctccagtctctgagccagcggcttcgggtgcaggagcaggagatggaactggtaaaggcagccctggcagaagcccttcgcctgctgcggctgcaggtgcccccttcctccctgcagggctctggcacaccagctcctccgggggacagtcttgcagcccccccaggactgccacccacgtgcaccccttccttggtgagccgaggcacccagacggagacagaggtggagctcaagtcatcccctggaccccctggcctgagcaatggacccccagcccctcagggggccagcgaagagcctagcgggacccaatctgaaggagggggcagcagcagcagtggtgctggctcccctggccccccggggatcctcaggcccttgcagcccccacagcgtgctgacacgccgcgaagaaattcttcctcctcctcatccccctcagagcggcctcggcagaagctctccaggaaggcaatctcctccgccaacctgttagtgcggtccgggagcacagagagccgtgggggaaaagaccccctctccagccctgggggccctggatctcggaggagcaattacaatttggaaggcatctcagtgaagatgttccttcgagggcgccccattaccatgtacatcccgtctggcatccgcagccttgaggagctgccgagtggcccaccgccagagaccctcagccttgactgggtttatgggtacaggggtcgtgactcccgctctaatctgtttgtgttgcgctctggggaggtggtctactttatcgcctgtgtggtggtgctgtaccggcctggaggaggcccagggggtcctggaggtggcggccagagacattaccgggggcacacagactgcgttcgatgccttgctgttcaccctgatggtgttcgggtagcctcgggacagacagctggagtggataaggatggaaagcccctgcagcctgtggttcacatctgggactcagagacgctgttgaaactgcaggagattggactgggggccttcgagcggggtgttggggccctggccttttcagctgcggatcagggtgcctttctttgtgtggtggatgattccaatgagcacatgctgtcggtgtgggactgcagccggggaatgaagctggctgagatcaagagtacaaatgactcagtcctggccgttggcttcaaccctcgtgacagcagctgcatcgtcaccagtgggaaatctcacgtccacttctggaattggagtggtggagtaggggttcctgggaatgggacccttacccggaaacagggtgtctttgggaaatacaagaaacccaagtttatcccttgctttgtgttccttccggatggagacattctcactggagactcagaggggaacattctcacctgggggcggagcccttcagattccaagaccccaggcaggggtggcgccaaagagacctatgggattgtggcccaggctcacgctcatgaaggttctatcttcgccttgtgtctccggagggacgggacagtgctgagtggtggcgggcgggaccgccggctggtacagtgggggcccgggttggtggccctccaggaggctgagattcccgagcacttcggggccgtgcgagccattgctgaagggcttggctctgagctgctggtgggaaccacgaagaatgcattgctgaggggagacctggcccagggcttctcccctgtaatccagggccacactgatgagctctgggggctctgcacacacccctcccagaaccgcttcctcacctgcggccacgaccggcagctctgcctgtgggatggggagagccatgcactggcctggagcatcgacctcaaggagactggtctctgtgctgacttccacccgagtggggcagttgtggccgtaggactgaacacggggaggtggttggttttggacacagagaccagagagatcgtgtctgatgtcattgatggcaatgagcagctctcagtggtccggtacagcccagatgggttgtacctggccattggttcccatgacaacgtgatctacatctatagtgtttccagtgatggtgccaaatccagccgctttggccgctgtatgggtcactccagcttcatcactcatcttgactggtccaaggatgggaatttcatcatgtccaattctggggactatgagattctttactgggacgtggctggaggctgcaagcagctgaagaatcgctatgagagccgagaccgggaatgggctacctacacctgtgtgctgggctttcacgtctacggcgtctggccggacggctccgatgggaccgacatcaactccctgtgccgctcccacaacgagcgcgtggtggcggtggccgacgacttctgcaaagtgcatctcttccagtacccgtgcgctcgtgccaaggcgccgagccgcatgtacgggggccacggcagccacgtgaccagcgtccgattcacgcacgacgactcgcacctcgtctcgctgggcggcaaggacgccagcatcttccagtggcgagtgctgggcgctgggggcgcggggccggcgcccgccacgccctctcgaaccccctccctgtcccccgcctcctccctcgacgtttgatcgctgcctggcgggaccgactggcccggcggcgtggccccgccccgccctgcccttccctggcccaatcccccacgactaggggccgactctttcctggactgacttcgagacattcccgatcgcgcattttcctggagggcgcgaacggcgcccctgcacacactgtttagacccgctggctgagccgggcagccccagcctaggccttgactcccgctgcctgctgaggggcaataaaccagaaccaaagtcgc

SEQ ID NO: 2364 - DNA, 4921 bp, Homo sapiens
gttgcctgcctgtggtgtgtggtgtgggggggaggcctggggcagcaggagcaggacagccggacaggaagcccagacggggttcgagcacctcaacttctctcctggggacactgttcaaactccgggggccataggccaagctgagcgatgggtgctgaggaggaggtgctggtcacactatcagggggagccccctggggcttccgacttcatgggggggccgagcagaggaaaccgttacaggtgtctaagattcgaagacggagccaggctggcagagcaggactccgagagagggaccagctcttggcaatcaatggggtctcttgcaccaacctctcccatgccagtgccatgagcctcatcgatgcctcaggaaatcagcttgtcctcactgtgcagcggttagcagacgagggtcctgtgcaatctccatctccccatgagcttcaggtgctgtcacccttatctccactaagtcctgagccccctggtgctccagttcctcagcctcttcagcctgggagccttcgttcacctcctgatagtgaggcttactacggagagactgacagtgatgctgatggccctgccacccaggagaagccccgtcgacctcgccgccgaggccccacaaggcccacccctccgggtgccccacctgatgaggtctacctgtctgacagccctgcagagccagcacctactatccctggccctcccagccagggtgacagccgtgtgagctccccgtcttgggaggatggggcagcccttcagccacccccagctgaggctctgctgttaccccatggccccctccgacctggtcctcatctcatccctatggtggggcctgttccccacccagtggcagaagatcttactaccacctacacccagaaggccaagcaagccaaactgcaacgtgcagagagcctccaagagaagagcataaaagaggccaagaccaaatgcaggacaattgcatccctgctcactgcagcccccaacccccactccaaaggggtacttatgtttaagaaacggcggcagagagccaagaagtacaccctggtgagcttcggggctgctgctgggacaggcgctgaggaggaggacggcgttccccccacgagtgagtccgagctggacgaagaagccttctctgacgcccgcagcctcaccaatcaatctgactgggacagtccctatctggacatggagcttgccagggcgggctcaagagcatcagagggccagggctctgggctgggagggcagctgagtgaggtctctgggcgaggggtgcagctctttgaacagcagcgccagcgcgcagactccagcacccaggaactggcacgggtcgaaccagcagccatgctcaacggggaaggcctgcagtcaccacctcgggcccagagtgctcccccagaggcagctgtgctcccacccagccccttgccggcgcctgtagccagccccagacccttccaaccaggtggtggagccccgaccccagctccaagcatctttaaccggtcagccaggccctttaccccgggcctacaagggcagcggccaactaccacctcggttattttccggcctttagcccccaaaagggcgaacgacagcctggggggcctcagccccgccccaccccccttcttgtcttcgcaggggcccacccctctgcccagcttcacttcaggggttcccagccacgcgccagtctctggttcccccagcaccccacgctcctcgggccctgtgacagccaccagctccctgtacatcccagcccctagtcggcctgtcaccccaggtggagctccagagccccccgctcctcctagcgcagctgccatgacctccaccgcttctatcttcctatctgcgcctttgcgaccctctgcgcgcccagaggcgcctgccccaggcccaggggctcctgagccccccagcgctcgcgagcagcgcatctctgtgccagctgcccgcacgggtatcctgcaggaggcccggcgccgggggacccggaagcagatgttccggccgggaaaggaggagacgaagaactcgcccaaccccgagctgctatcgctggtacagaacctggatgaaaagcctcgggccgggggtgcagaatctggtcctgaagaagatgctctgagcctcggggctgaagcctgcaacttcatgcagccagtaggggccaggagttacaagaccctgcctcacgtgacacctaagaccccccctccaatggctcccaagaccccgccccctatgactcctaagactccacccccagtggctcctaagcccccatctcgagggctccttgatgggctcgtgaatggggcagcctcttcggctggaatccctgagccaccaaggctgcagggcaggggtggggagctgtttgctaagcggcagagccgtgcggacaggtatgtggtggaaggtacacctggtcctggtcttggccctcggcctagaagtccttctcctaccccgtctctgcccccttcctggaaatattcacccaacatccgtgccccgcctcctattgcttacaacccactgctctctccctttttcccccaggcggcccgaactctccctaaggcccaatcccaggggcctcgggcaacacccaagcagggcatcaaggctctagattttatgcggcatcagccctatcaacttaaaactgccatgttctgttttgatgaggttcccccgactcctggccctatcgcctcagggtcccccaaaactgcccgagtccaggagattcgccggttttccactccggcaccccagcccactgcagaacccctggctcccactgtgcttgccccccgagcagccactacactggatgagcccatctggagaacagaactggcctcagcccctgttcctagcccagcccctcctccagaggctcccaggggccttggggcttctcccagctcctgcggtttccaggtagccaggccccgattttcagccaccagaacaggattgcaagctcatgtgtggaggcctggggcagggcaccagtgaacaggcacaggtcccaggaccaaggagaggtggaacatccagttcctaaagttgcttctcctaccctatcccatcccctgtcacgcatctggaagctaaattgcctcctgccagagatggtttccaagttgatgtccccttcccccaccttcctcctcactctctacctccctgccgctttccaaccaagtatgtctgctttggtatctttgcctctctttgtctctgcatttcctttcctggatctctgtctttatttccaggcttctccacccatattcctccacagatctctcttccttgacatttgtgcttttctccctgggcctcattttaatgttcagtgagaagtaaacagagcagaagtgaccactgggacttcaggcaagaagctcaccaccaggcacacagcaaagggactgaactgacccctgtttgcactaagccacccccaccccccactctgctttcccaagcttgactggcatatacctaggcctgtgtgtgtgtgtgtgtgtgtgtgtgtgtgtgtgtgtgtgctcttccgtctaaggcatgaataagaggggaggtcaaaataaagacccaatctgaggccgggcacggtggctcacgccggtaatcccagcactttgggaggccgaggcgggcggatcacgaggtcaggagatcgagaccatcctggctaacacggtgaaaccccatttccactaaaaatacaaaaaattagctgggcgtggtggcgagcgcctgtagtcccagctactcgggaggctgaggcaggagaatggcatgaacctggaaggcggagcttgcagtgagctgagattgcgccactgcactccagcctgggcgacggagcgagactctgtctcaaaacaaacaaacaaacaaaagacccaatctgagtcttatcgttgtactgatagaagggtcagatatccccacatggagttgagtgggagaaagagattcactagagaataactccttagagaccaatgtctgtagcaggtgtacagcatcttgtgaaagttatggagcatgaaaagactgaagggccaggacagtttgcatgggctgagttataccagctagaccaggaatagaacaaagaattctatacctcaggatttcaaaaagttagcaacttgagaggccagtgctgagcaacccagtacccaggaaatgaaaaaaagaaagaaaattccctccgagaatgaacaaatcattggcttcattgcctcatgagcttgagagaaaggagaagagagccagagtgtggcaagtgaggccaaaatcagaagcatggcagaaatgagtgtaagtgattgagccacagacagaagtgtggcgagggacaatgccatattgggagaaggtaaagttgagtaacaagaaaccaaccgtgtgtgagagggggattggaaaaaaatttgagggagaagaatgttagaatggaagggaatgatggtggaagggaggtgtgagggtgtgtgctgagtgttgaaagaacggttggtgtctgtgtgattttccttgagtctgttcttcagtgtgtcttctgcagcttgccatgactgcctgggaaagagtagggaaatacccagagccaaaacctcctttcagtcccaccccatccctcaaaaccccagctattgcttcttttcagcttcaggtcctgatctccaatcttagtatggactcccttctcaccaagaccaccaccagctacgtttgctgtgtaatctggaaagtgataatttcctttgcttgttgggtgtgagtcacaatactttggtttgtgcacaagaataaatttatgccccataccttc

SEQ ID NO: 2365 - DNA, 3964 bp, Homo sapiens
cttgccgaggattggctgagccttcagttttgaaaatcatagttttcgcccgcgctgcgccgcctggttgctcctcccgtgcggtgagtcccgaaggcccggagccaagtgggtctgggcaagcggggccttacctagggataccaccggacttggatcggagcagccttcaggggacgtggcgcagtcgaacagagccaccatggggacgacggccccagggcccattcacctgctggagctatgtgaccagaagctcatggagtttctctgcaacatggataataaggacttggtgtggcttgaggaaatccaagaggaggccgagcgcatgttcaccagagaattcagcaaagagccagagctgatgcccaaaacaccttctcagaagaaccgacggaagaagagacggatttcttatgttcaggatgaaaacagagatcccatcaggagaaggttatcccgcagaaagtctcggagcagccagctgagctcccgacgcctccgcagcaaggacagtgtagagaagctggctacagtggtcggggagaacggctccgtcctgcggcgtgtgacccgtgctgcggctgcagctgccgcggctaccatggcattggctgcaccttcttcacccacccctgagtctcccacgatgctgactaagaagcccgaggataaccacacccagtgccagctggtgcctgtggtggagatcggcatcagtgagcgccagaatgctgagcagcatgtcacccagctcatgtccaccgagcctctgccccgcactctgtccccgactccagcttcagccacagctccaacctcccagggcatcccgacatcagatgaggaatcaacacctaagaagtcgaaggccaggatactggagtccatcacagtgagctccctgatggctacaccccaggaccccaagggtcaaggggtcgggacggggcggtctgcgtctaagctcaggattgcgcaggtctcccctggcccacgggactcgccagcctttccagattctccatggcgggagcgggtgctggctcccatcctgccggataacttctccacgcccacgggctctcgcacggactctcaatcggtgcggcacagcccgatcgccccgtcttccccgagtccccaagtcttagcccagaagtactctctggtggccaaacaggaaagtgttgtccgcagggcgagcagaaggcttgccaagaagactgccgaagagccagctgcctctggccgcatcatctgtcacagttacctggagaggctcctgaatgttgaggtgccccagaaagttggttctgagcagaaggaaccccccgaggaggctgagcctgtggcggcagctgagccagaggtccctgagaacaatggaaataactcgtggccccacaatgacacggagattgccaacagcacacccaacccgaagcctgcagccagcagcccggaaacaccctctgcagggcagcaagaggccaagacggaccaagcagatggacccagagagccaccgcagagtgccaggaggaagcgcagctacaagcaggccgtgagtgagctggacgaggagcagcacctggaggatgaggagctgcagccccccaggagcaagaccccttcctcaccctgcccagccagcaaggtggtacggcccctccggacctttctgcacacagtgcagaggaaccagatgctcatgaccccgacctcagccccacgcagcgtcatgaagtcctttattaagcgcaacactcccctgcgcatggaccccaagtgcagcttcgtcgagaaggagcggcagcgcctggagaatctgcggcggaaggaggaggccgagcagctgcgcaggcagaaggtggaggaggacaagcggcggcggctggaggaggtgaagctgaagcgtgaggaacgcctccgcaaggtgctgcaggcccgcgagcgggtggagcagatgaaggaggagaagaagaagcagattgagcagaagtttgctcagatcgacgagaagactgagaaggccaaggaggagcggctggcagaggagaaggccaagaaaaaggcggcggccaagaagatggaggaggtggaagcacgcaggaagcaggaagaggaggcacgtaggctcaggtggctgcagcaggaggaggaagagcggcggcaccaagagctgctgcagaagaagaaggaagaggagcaggagcggctgcggaaggcggccgaggctaagcggctggcagagcagcgggagcaggagcggcgggagcaggagcggcgcgagcaggagcggcgcgagcaggagcggcgggagcaggagcggcgcgagcaggagcgacagctggcagagcaggagcgtcggcgggagcaggagcggctccaggccgagagggagctgcaggagcgggagaaggccctgcggctgcagaaggagcagctgcagagggaactggaggagaagaagaagaaggaagagcagcagcgtctggctgagcggcagctgcaggaggagcaagagaagaaagccaaggaggcagcaggggccagcaaggccctgaatgtgactgtggacgtgcagtctccagcttgtacctcatatcagatgactccgcaagggcacagggcccctcccaagatcaacccagataactacgggatggatctgaatagcgacgactccaccgatgatgaggcccatccccggaagcccatccccacctgggcccgaggcaccccgctcagccaggctatcattcaccagtactaccacccaccgaaccttctggagctctttggaaccattctcccactggacttggaggatatcttcaagaagagcaagccccgctatcacaagcgcaccagctctgctgtctggaactcaccgcccctgcagggcgccagggtccccagcagcctggcctacagcctgaagaagcactgaggctggcctgcggccttcttggcagcctcgcctcctgtccatgtctatctgtctgtctgtcggtctctgtcttggtctgttgccctccttcttggcatgccattgtggagggcttggccaggtgtatataaacgtcctctgtgctgggtgtttctgctgcaggtggcaggtggccccaggcctgtttggaggatgggctgggtgggtgggtggggaagaaatgggcccagccccacatggcctgcagacagtgctctgtaaatagttgttttaatttagctgaatgttagcattttagtctttggcattttagcgtttgggaggtagattaataaagtatattccttcaagcctgctgttgataccatgaagactgggcgcctcagtcccagccctgtagctgtgtgtcttgggccaccagtggcctgcaggacgaaggtactgttccatcacctgcggtgtgcctcaggatcaccaggtgcaggcccccaccctcggagatgctgctgcagtgagtggttccactgcctggataacccttgaggaacacgtcagttactgtcacgatggggcaggtggagctccttcctattttttggggtgctccctgtttgtaaaggggagtttgttcattgggaaagacctgggtcttgacacggccctgccacttagtcccctaccctctccattccccaggctccacccgtgctgctcaggtgcaaatggacttgagagcatctatgtgctggtgaagcatgaggtctgagtagaaaaggggtatcccttgagaccaccttgggaccagtgcttgcaagcagcgagatatttccccagcaaaaccaggcagctgctaattaaatgcttagaaccaatgaaagctggctgtggtcctgcctgtgagctgcctactgctgccttctgaatgcatatatctgctactgtagccccgggttgtcaaactatggcctgtgggccaaatccagccacagtcggttctttaaagtt

SEQ ID NO: 2366 - DNA, 4696 bp, Homo sapiens
accgcctcgcctctttccgccagcgcccgcaggacccggatgagagcgcacgcttcggggtctccgggaagtcgcggcgccttcggatgtggcggatgcggccgtgagccggcgggggaggtgctgctgctgcctccactgtactcagacccaggtagcacaggattgtccatcctccagcagctcagtgcaacggtgtgaactcagcctgtttcagagcctccacaccatgacctccaagaagctggtgaactcggtggctggctgtgctgatgacgctcttgctggcctggtggcctgcaaccccaacctgcagctcctgcagggccaccgcgtggccctccgttctgacctggacagcctcaagggccgggtggcactgctgtcgggtgggggctctggccatgagcctgcccatgctggtttcatagggaaggggatgctgactggggtcatcgcgggagctgtgttcacctccccggcagtgggcagcatcctggcagccatcagggccgtggcccaggccggcacagtggggacgctccttatcgtgaagaactacactggggatcggctcaacttcggcctggcccgggagcaggcccgggctgaaggcatcccggtggagatggtggtgattggggacgacagcgccttcactgtcctgaagaaggcaggccggcgggggctgtgcggcacggtgcttatacacaaggtggcaggtgctctggctgaggctggtgtggggctggaggagatcgcaaagcaggtgaacgtggtcgccaaggccatgggtaccctgggggtgagcttatcctcctgcagcgtccctggttccaaacccaccttcgagctctcagccgacgaggtggagctgggcctggggatccacggggaagctggtgtgcgccggataaagatggcaaccgccgatgagattgtgaaactcatgctcgaccacatgacaaacaccaccaacgcgtcccatgtgcctgtgcagcccggctcctcagttgtgatgatggtcaacaacctgggtggcctgtcattcctggaactgggcatcatagccgacgctaccgtccgctccctggagggccgcggggtgaagattgcccgtgccctggtgggcaccttcatgtcagcactggagatgcctggcatttctctcaccctcctgctggtggatgagcctctcctgaaactgatagatgctgaaaccactgcagcagcctggcctaacgtggctgcagtctccattactgggcggaagcggagccgggtagcccctgccgagccccaggaggcccctgattccactgctgcaggaggctcagcctcgaagcggatggcgctggtgctggaacgggtgtgcagcactctcctgggcctggaggaacacctgaatgccctggaccgggctgctggtgacggcgactgtggcaccacccacagccgtgcggccagagcaatccaggagtggctgaaggagggcccaccccctgccagccctgcccagctgctctccaagttgtctgtcctgctcctggagaagatgggaggctcatctggggcgctctatggcctgttcctgactgcggctgcacagcccctgaaggccaagaccagcctcccagcctggtctgctgccatggatgccggcctggaagccatgcagaagtatggcaaggctgctccaggggacaggactatgctggattctctgtgggcagcggggcaggagctccaagcctggaagagcccaggagctgatctgttacaagtcctgaccaaagcagtcaagagtgccgaagctgcagccgaggccaccaagaatatggaagctggagccggaagagccagttatatcagctcagcacggctggagcagccagaccccggggcggtggcagctgctgccatcctccgggccatcttggaggtcttgcagagctagggtgtgtgactgcctcccttggcctcagctcctctcactgctgtgctgaggtggcctttgtcacttccttctgccttccaaccctcaccttcccccggcctggccccattggcccaccctctaagttgagcaggaaatcctccaccaagcttccagaactacagacagcacccagagtgagctggagtgggtccccatgcctctccagcatgccctttccctttgcaggagggtggagtccctgggtcatgccctcccctgccagctctgggcttcagagataaggcattttccttgtgcagcctttacctggcaatcctaatttggttttaagactccctgtgaaatgctttccgcaccttaaccccagtgagcgtgaaaaagaaagttaataaactataatacatggaagcaagaaagacactgcctcctctgagggaccttttcccaagcatgtaaacaagggggcccacagccctggctgcaggcatcatgacccatcttctaccaggcagatctttattacctgagcccctaaggcagtgtctcctcagctgggctgcttccactgagacccccgacccatcccctttccagtacacacacctgatgcatgtaagaatggtagaggggcttttcttagcattgaattaataattcagtggctcctcgggagtcgaatgggcatttgggacaccagaaggaaaagaaatcatcatagtctaaggttcagttgtagatcaaaaaatgcagccaggccgggcacggtggctcacacctgcaatcccagcactttgggaggccaaggcaggcggatcccttacactcaggagttcaagaccagtctgggcaacatggtaaaaccctgtctctaccaaaaaatacaaaattagccaggcatagtagtgtgtgcctatagtcctaacttgggaggctgagttgggaggatggcttgggcccaggaggtcgaggctgcggtgagccataagcatgccactatactccagcctgggcaacaaagcgagaccctgtctcaaaaaaaaaaaaaaaaaaaaaagaaactgcagccaagccagcccctaggtctctttctagagcgatcactgatggcaccagggtgagcaggggcactgtatgcatgtggagacaaacagcacatgcctggcacacatgtagggtagggagtggttaaaggcactggctgtcgactcatacacatgatctgaaatctgattctgctttaacccggctacaggagctaaggcctattttttagccctttgggatctgtaaaatcagaatggtacccacctcatggggacatgaaaggattcaaatgaattgatgaagatgggccataaagcccagcacagtccaagtgctcactcactgagagttacggttatcacaggggttgggcccccagcccctcccaggtcatctgctctaccactagctggtaggaaagagcctcctgccctcccaacccccgtcacctacttggcccaaatttggctgcaggctccccgagtgcctgggcttctctacccagggtcctgtctgtcggctgcaccatacgtccctgaccacaaggcatccacgtgcacaggagtatgcgcccagcagctgggaaggaggctgacctcagacggtggcctgtggatcccagctctgtcatttcctggctgggtgacctcaacctagtcaccctttttgagtcttgttttctcagattatgaaataggaaaaatttccttcctcgtgagataagcacgtgccattagctattaaggacacgcacataaatgagctgcatgtgaatccacacatgccattccatgaagacagaggatcatgtggatctttggtgccttccggttggcccctccctaggtctgtgagggtcagacctgtcctgaggcttttacaaattggcccagaactcatttaaccacagcatcatttcattagagggctgttattagagactgaatgtttgtgtcccccccaaattcctgtgttgaaaggctcacccccactatggtagtgttaggacgtggggcctttgggaggtgatggggttatgagggtggagccccagagagctctcacgccctttccaccatgtgaggttatggtgagaagatggtctctgaggaagctggcccttgccacacaccacatttgccagcgccttcatcttggatgtctatagcctccagaactgtgagaaataaacacttgttgtttaagccacccaggctattatatttttgttatagcagcctgaacaaagacagctttgattcttaacatatttaatgaaactcgagcttcataaaccagtgaaatgcctacccctatggagatggggagctggtcatgggacccaggtgcctggaggacatcccagtggctttgaaggctccagccagtcaagacggtcaatattagcccttctgccaacatctggcaatgtgaggctggggtggacgttggcctgatgttgccaggagtaggatgctgatgctgccagagagtaggtgggctccaaaccccaggcttctcacttgcttactaagcacagcagtctgaagcttgggacctggcagtgcgtctttggagaaggcaaaaaagccacagcagcaacacttaggagcaagacccttcccgctctccaccctatttcctcccctgaagaagagcaacagctcaagctctagcatggcacagaacgct

SEQ ID NO: 2367 - DNA, 1999 bp, Homo sapiens
gggctggtggggtgaacccttcatcctgggtcttttaatttctcaggcggaacgagtggcggcggacagaggcttttggctgcgctgtctgtgggttgtctgggcttggggaactgggcacggagaccgtggcgccggccgccggtcatacagctctgcttccagtcgtcgggcaaaaagctgaggcgcttctcctttaattgcggtgggcggggcgtgccgacgcggcccgcgttgctattggtggccgttgggggcgcggaaactgaacgggccgcaacggccaccgcagctgccttcggcgccgccagccccgccatggctgcgccctgcgcggaggacccctcgctggaaaggcattttaagggccaccgagatgcagttacctgtgtggacttcagtatcaacacaaagcagctggccagtggctccatggactcatgcctcatggtctggcacatgaagccgcagtcacgcgcctaccgcttcactggccacaaggatgccgtcacctgtgtgaacttctctccttcgggacacctgcttgcttccggctcccgagacaagactgtccgcatctgggtacccaatgtcaaaggtgagtccactgtgtttcgtgcacacacagccacagtgaggagtgtccacttctgcagtgatggccagtccttcgtgacagcctctgacgacaagacagtcaaagtgtgggcaactcatcgccagaaattcctgttctccctgagccagcatatcaactgggtccgctgtgccaagttctcccccgacgggcggctcatcgtgtctgccagtgatgacaagactgttaagctgtgggacaagagcagccgggaatgtgtccactcgtattgtgagcatggcggctttgtcacctatgtggacttccaccccagtgggacgtgcattgccgctgccggcatggacaacacagtgaaggtgtgggacgtgcggactcaccggctgctgcagcattatcagttgcacagtgcagcagtgaacgggctctctttccacccgtcgggaaactacctgatcacagcctccagtgactcaaccctgaagatcctggacctgatggagggccggctgctctacacactccacgggcatcagggaccagccaccactgttgccttttcaagaacgggggagtattttgcttctggaggctctgatgaacaagtgatggtttggaagagtaactttgatattgttgatcatggagaagtcacgaaagtgccgaggcccccagccacactggccagctccatggggaatctgacagtctccattctggagcagcggttgacactgacagaagacaagctgaagcagtgtctggagaaccagcagctaatcatgcagagagcaacaccatgatcaggggagcaggaatcaggagctcggtggatttgcaggtggcaggccagggatttgtaccatgggacttgggtaaataaaggggactgaactctgtgggaatcacatccatactggagccctggatttttgcagttctgccctccaccttgctatctgcaccaggaggctctccacctggcagccagaggtccccagtgggccgggctcacacacaaatgatgcttcagacccgaatgagaggaccacattttgcttaatgtaaaggagccacttgaaaatgtctgctccttcggggtcctgagattgtggctccccctctggaggaggtggctccacgatgccttgattttcactcatcatttggacatgtgactggcttttcctacctctgccatggtgtagaaattgattgcacattgattggatgagccgggggttttctctaaatctgactaaaggcccaaagtgggcccatctgagtcaggtttgttgagaacaagccctctcaagtgggtggtggcttttcagtggccctgatttctgttccacacgtgttcactggagccaggtgacttcctccttgcgtgagtgagggcac

SEQ ID NO: 2368 - DNA, 1818 bp, Homo sapiens
ctccggccccaggtcaccgccagcacgcgcctgcttcccgtctgcgcgagtccacgcagctccccagatcaagaagctgaggccccaggttacacactaaagtaaatggcagaggcagaaataacacctatgtcctcctgaccccaaggcatgttcttaaagttctggaaacctcctggaggcttccttgctgctcctctgggactgccaccctgggcagggtgttctgtggcccctcatcatcgtggttttgaaccacaggcccttcaccagcacagcagcagcaggcatggcagcaagcgtggagcagcgcgagggcaccatccaggtgcagggccaggccctcttcttccgagaggccctgcccggcagtgggcaggctcgcttctctgtactgctgctgcatggtattcgcttctcctccgagacctggcagaacctgggtacactgcacaggctggcccaggctggctaccgggctgtggccattgacctgccaggtctggggcactccaaggaagcagcagcccctgcccctattggggagctggcccctggcagcttcctggcggctgtggtggatgccttggagctgggccccccggttgtgatcagtccatcactgagtggcatgtactccctgcccttcctcacggcccctggctcccagctcccgggctttgtgccagtggcccccatctgcactgacaaaatcaatgctgccaactatgccagtgtgaagactccagctctgattgtatatggagaccaggaccccatgggtcagaccagctttgagcacctgaagcagctgcccaaccaccgggtgctgatcatgaagggggcggggcacccctgttacctggacaaaccagaggagtggcatacagggctgctggacttcctgcaggggctccagtgaagcccagcactgctgcagggggtgggctgcctgcctgctctgagctctctcttgcacgctctctcttctctcccaggctctggctcatgcacatgcaacaggtgcgtctgtctatatgtctgggttcttgtcttttgtggtctgtttgtcttttctacctctttctcttgcagtgatagactgagggggtaaaatcaagagaaaaaactctcaggaatcaaggaacataatcctgtggagggtaatccattacatgagcttctcctgttcttccactttcctgcctggctttcactccttcccctgctctgcccagcctttccctcccacccactcctccttctgcaaatgccctgaaggccagcccttaccccaacacccacttccccacctccttaggccccagatacatacatgcccacatgcacgcttacatgtttagagccatccttgtttccaaatatgacccttcgcttgagggcaactgcataggtacatctaactctggactggcatgcacattgtcatgtgcagctttgcatatacacacatgcatacatgagcctccacacaagcacttgcacacatgtggactcctaaccatgctaacctcactggctgggaaggtggggaccccatgggccagcccttgcaggaggcccttttgcaaggcttagggtgtggccagccctgaaagctacttggacacaggtttcagctggccccagcccagaagtgacccccagaaagggagggccaccgctttgccccctgcttttacccttccttctgggtgctctacacctcaggttaccaggcctgaggcatctcagccaagcttgtttcctgctctgaggcttgtggggtgggagccagagtggaggtcggtgaaataa

SEQ ID NO: 2369 - DNA, 3446 bp, Homo sapiens
gctaaccttgccgcgggccgagccctgcctcgccatggaccaggactatgagcggcgcctgcttcgccagatcgtcatccagaatgagaacacgatgccacgcgtcacagagatgcggcggaccctgacgcctgccagctccccagtgtcctcgcccagcaagcacggagaccgcttcatcccctccagagccggagccaactggagcgtgaacttccacaggattaacgagaatgagaagtctcccagtcagaaccggaaagccaaggacgccacctcagacaacggcaaagacggcctggcctactctgccctgctcaagaatgagctgctgggtgccggcatcgagaaggtgcaggacccgcagactgaggaccgcaggctgcagccctccacgcctgagaagaagggtctgttcacgtattcccttagcaccaagcgctccagccccgatgacggcaacgatgtgtctccctactccctgtctcccgtcagcaacaagagccagaagctgctccggtccccccggaaacccacccgcaagatctccaagatccccttcaaggtgctggacgcgcccgagctgcaggacgacttctacctcaatctggtggactggtcgtccctcaatgtgctcagcgtggggctaggcacctgcgtgtacctgtggagtgcctgtaccagccaggtgacgcggctctgtgacctctcagtggaaggggactcagtgacctccgtgggctggtctgagcgggggaacctggtggcggtgggcacacacaagggcttcgtgcagatctgggacgcagccgcagggaagaagctgtccatgttggagggccacacggcacgcgtcggggcgctggcctggaatgctgagcagctgtcgtccgggagccgcgaccgcatgatcctgcagagggacatccgcaccccgccactgcagtcggagcggcggctgcagggccaccggcaggaggtgtgcgggctcaagtggtccacagaccaccagctcctcgcctcggggggcaacgacaacaagctgctggtctggaatcactcgagcctgagccccgtgcagcagtacacggagcacctggcggccgtgaaggccatcgcctggtccccacatcagcacgggctgctggcctcggggggcggcacagctgaccgctgtatccgcttctggaacacgctgacaggacaaccactgcagtgtatcgacacgggctcccaagtgtgcaatctggcctggtccaagcacgccaacgagctggtgagcacgcacggctactcacagaaccagatccttgtctggaagtacccctccctgacccaggtggccaagctgaccgggcactcctaccgcgtgctgtacctggcaatgtcccctgatggggaggccatcgtcactggtgctggagacgagaccctgaggttctggaacgtctttagcaaaacccgttcgacaaaggtaaagtgggagtctgtgtctgtgctcaacctcttcaccaggatccggtaaacctgccgggcaggaccgtgccacaccagctgtccagagtcggaggaccccagctcctcagcttgcatggactctgccttcccagcgcttgtcccccgaggaaggcggctgggcgggcggggagctgggcctggaggatcctggagtctcattaaatgcctgattgtgaaccatgtccaccagtatctggggtgggcacgtggtcggggaccctcagcagcaggggctctgtctcccttcccaaagggcgagaaccacattggacggtcccggctcagaccgtctgtactcagagcgacggatgccccctgggaccctcactgcctccgtctgttcatcacctgcccaccggagccgcatgctcttcctggaactgcccacgtctgcacagaacagaccaccagacgccagggctgattggtgggggcctgagaccccggttgcccattcatggctgcaccccaccatgtcaaacccaagaccagccccaaggccagaccaaggcatgtaggcctgggcaggtggctcggggccactggcggagccagcctgtggatccaagagacagtccccacctgggcttcacggcatccttgcagccacctctgctgtcactgctcgaagcagcagtctctctggaagcatctgtgtcatggccatcgcccggcggtcagtgggcttcagatgggcctgtgcatcctggccaagcgtcaccctcacactggaggaggatgtctgctctggacttatcaccccaggagaactgaacccggacctgctcactgccctggctggagaggagcacaacagatgccacgtcttcgtgcattcgccaacacgtgccctcacagggccagcgtcctccttccctgcgcaagacttgcgtcccccatgcctgctgggtggctgggtcctgtggaggccagcagcggtgtggcccccgcccccaggctgcctgtgtcttcacctgtcctgtccaccagcgccaacagccgtggggaagccaaggagacccaaggggtccaggaggtgggcgccctccatccttcgagaagcttcccaggctcctctgcttctctgtctcatgctcccaggctgcacagcaggcagggagggaggcaaggcaggggagtggggcctgagctgagcactgccccctcacccccccaccaccccttcccatttcatcggtggggacgtggagagggtggggcgggctggggttggagggtcccacccaccaccctgctgtgcttgggaacccccactccccactccccacatcccaacatcctggtgtctgtccccagtggggttggcgtgcatgtgtacatatgtatttgtgacttttctttggatttgttttgtgtttttgttgactagtcctggaaatgtttgaggctagacggggaggggccaggacccacccactgctcctgggggatgaggtcctggttttaaagccccgtcatttcaagcgggtcgatcttccacattcactggagagactctccccacctctgtctgggtggggcgcggacccctcactgtgcgcctgtgcagggggtgctggtgcacgtggcagtgtggatttccagtggtcacggtcttactgtttcaaggtttttaaataagaaaaccaaccctgccttcgcccatgcccgcccctgcccgcagttgccaaagagccgccttgtcgctgtgggcgtcagggcttggctggctcagtgcacaacccacagtggccttcagaggctcctcctgggactgggaaccgccgcagggccaggcggacggcgtgaggtttgtgttggggctggttctgcccatgctagggggtgggggagctcccaggacagaccagccttgtttctcatgtaatgcagtgacgctgtcattaaacacgtggattcatgtgtgg

SEQ ID NO: 2370 - DNA, 884 bp, Homo sapiens
atcttgagtgagggcacgctctccttagaggggcggaacagtttttggcaccttatcgcgagcggcagcttatgcaagagtgatttaaaaaagaaaggcaggtccggagccaggggctaagtagcggtgcggtttctttttctggattagtttccccatcttgcctaaaaatgtcctagtctagtctttttagcagaactccactccctaaacatgtcagaactacacttcccatcaagggtcagaaagaaacttccggcacagtcttttcccagcattccttgtttacttccgggtttattactactgaaggaagaacgccagatcagaaaagggagctcaggtaccttccagagagtgagacccagcgcccttgtctcgcacccagtaggctttcatccccgccatggcggagctgatccagaagaagctacagggagaagtggagaaatatcaacagctacagaaggacttaagtaaatccatgtcggggaggcagaaacttgaagcacaactaacagaaaataatatcgtgaaagaggaactggccctgctggatgggtccaacgtggtctttaaacttctgggtccggtgctagtcaaacaggagctgggggaggctcgggccacagtagggaagaggctggactatatcacagctgaaattaagcgatacgaatcccagcttcgggatcttgagcggcagtcagagcaacagagggagacccttgctcagctgcagcaggagttccagcgggcccaggcagcaaaggcaggggctcctggcaaggcctgaccccatggtggggggaggggaggggaggggagggaatgaggcagctctaggatctatactgtagctaataaaatgtaaaaacacctgg

SEQ ID NO: 2371 - DNA, 2682 bp, Homo sapiens
tttttttttttagacagagtcttgctctgttgcggaggctggagtgcagtgatctcagctcactggaagctccgcctcctgggttcaagcgattctcctatctcaacctcccaagtgtgccaccacacctgccgaatgtttgtgtttttagtagggatggggttcgccatgttgggcaggctggtctcaaactcctgacctcaagtgatctgcccgcctcggcctcccagagtgctgggattataggcgtgagccaccatgcctggacatgaccctgtctctaaaacaatgtaatgaactgcagctcattcttgtgtgcacttttctgcaccccctttcccttaacacttactattgtctggcatgctacgtgttttcttgatctcattagcctctcccaccccaactgccacactgcactatcagagggcagcacttatcactgctgtagaacaaagtcctgcactgagccgatggcccagaaattttctttttatttatttatttattttttttttgagacagagtcttactctgtcgctcaggctggagtgtagtggcgcgatctcagctcactgcaacctctgcctcctggtttcaagcaattctccttcctcagcctccagagtagctgggattacacgcgcctgccaccgcgcctggctaatttttgtatttttagtagagatggggtttcaaccatgttggccaggctggtctcaaactcctgacctcaggtgatcctgcccacctaagcctcccaaaatgctggtattacaggcatgagccaccgtgcccggcctaaatatttaataaaataatggacgatgggtgccttctactgagctcccggtaattgtgagtgagtagaggacttgccctggggacattcagtgacctgctgggtgttgctgagctgtgaggaagttcaggtctggctgcagtggtgaggctgtgactcaatcaatcactgctgatgctcccaggacctgcaccagcttagtcctaggggcaaggattttaactgtccacctcagtttcttcatttgtaagatgcaaataacagtcacccctgcctcatgggatggagctgtgtaatgcccgcaacagtgcctgctgcatagaggggttgctgccagctgcctctccctccttgtctcttacctgcctgctgcctgggtcaggatgaagaggggcccttgtgttgcccccaccctggctgcctgctaagggcccatgtgatctgcctggcagaggagtttcttcaggaagaaccagggcagcttctgcccctagagggccaatgcccttgctgtgagaagtcactgctttggggagacctgatctggctgtgccagatggacactgagaaagaagtagaagactcagaattagaagaggaacatggagctgatccaggacacctcccgcccgccactggagtacgtgaagggggtcccgctcatcaagtactttgcagaggcactggggcccctgcagagcttccaagcccgacctgatgacctgctcatcaacacctaccccaagtctggcaccacctgggtgagccagatactggacatgatctaccagggcggcgacctagagaagtgtaaccgggctcccatctacgtacgggtgcccttccttgaggtcaatgatccaggggaaccctcagggctggagactctgaaagacacaccgcccccacggctcatcaagtcacacctgcccctggctctgctccctcagactctgttggatcagaaggtcaaggtggtctatgttgcccgaaacccaaaggacgtggcggtctcctactaccatttccaccgtatggaaaaggcgcaccctgagcctgggacctgggacagcttcctggaaaagttcatggctggagaagtgtcctacgggtcctggtaccagcacgtgcaggagtggtgggagctgagccgcacccaccctgttctctacctcttctatgaagacatgaaggagaaccccaaaagggagattcaaaagatcctggagtttgtggggcgctccctgccagaggagaccatggacttcatggttcagcacacgtcgttcaaggagatgaagaagaaccctatgaccaactacaccaccgtcccccaggagctcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatctaccctgaccaatgggctcaagaataaagtatgatttttgagtcaggcacagtggctcatgtctgcaatcccagcgatttgggaggttgagctggtaggatcacaataggccacgaatttgagaccagcctggtaaaatagtgagacctcatctctacaaagatgtaaaaaaattagccacatgtgctggcacttacctgtagtcccagctacttgggaagcagaggctggaggatcatttcagcccaggaggttgtggatacagtgagttatgacatgcccattcactacagcctggatgacaagcaagaccctccctccaaagaaaataaagctcaattaaaataaaa

SEQ ID NO: 2372 - DNA, 1413 bp, Homo sapiens
acactggaccttcaaaaccctcagggcagagagcagccctacactccctacaccacacccatactcagcccctgcaggcaaggagagaacaggtcaggttcccgagagctcaggaacatggagctgatccaggacacctcccgcccgccactggagtacgtgaagggggtcccgctcatcaagtactttgcagaggcactggggcccctgcagagcttccaagcccgacctgatgacctgctcatcaacacctaccccaagtctggcaccacctgggtgagccagatactggacatgatctaccagggcggcgacctagagaagtgtaaccgggctcccatctacgtacgggtgcccttccttgaggtcaatgatccaggggaaccctcagggctggagactctgaaagacacaccgcccccacggctcatcaagtcacacctgcccctggctctgctccctcagactctgttggatcagaaggtcaaggtggtctatgttgcccgaaacccaaaggacgtggcggtctcctactaccatttccaccgtatggaaaaggcgcaccctgagcctgggacctgggacagcttcctggaaaagttcatggctggagaagtgtcctacgggtcctggtaccagcacgtgcaggagtggtgggagctgagccgcacccaccctgttctctacctcttctatgaagacatgaaggagaaccccaaaagggagattcaaaagatcctggagtttgtggggcgctccctgccagaggagaccatggacttcatggttcagcacacgtcgttcaaggagatgaagaagaaccctatgaccaactacaccaccgtcccccaggagctcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatctaccctgaccaatgggctcaagaataaagtatgatttttgagtcaggcacagtggctcatgtctgcaatcccagcgatttgggaggttgagctggtaggatcacaataggccacgaatttgagaccagcctggtaaaatagtgagacctcatctctacaaagatgtaaaaaaattagccacatgtgctggcacttacctgtagtcccagctacttgggaagcagaggctggaggatcatttcagcccaggaggttgtggatacagtgagttatgacatgcccattcactacagcctggatgacaagcaagaccctccctccaaagaaaataaagctcaattaaaataaaatatgatttgtgttcatgt

SEQ ID NO: 2373 - DNA, 3113 bp, Homo sapiens
cttccccgcccgctccatccgggtcgctgacggctgtctctggactggacagcagtggcgtccgcttttctctaaggaacccgataagaactccattttctgttgatgtggagacatagggtacctccaactttccggggtttcagaagagaattttttattgaaactggaagaccaaaataattacaagcatgttgtgctggggaaatgcatcctttgggcagctaggtttgggtggaattgatgaagaaattgtactagagcccagaaaaagtgacttctttataaataaaagggtccgagatgtaggatgtggactcagacatactgtgtttgttctggatgatggaacagtgtacacatgtggatgtaatgatctaggacagctaggtcatgaaaaatccagaaagaaaccagaaatattaaaagtttgtcagatatccagattgtacaggttgcttgtggttactatcattcacttgcactttctaaagcaagtgaagtcttctgttggggacagaataaatatggccaattgggtttaggtactgactgtaaaaagcaaacttcaccgcagctgcttaagtctttgcttggaatccctttcatgcaagttgcagcaggaggagcccatagttttgtactcaccctttctggagctatctttggatggggacgcaacaagtttggtcagctaggtcttaatgatgaaaatgataggtatgttcctaatttactaaagtcactaagatctcagaaaatagtttatatttgttgtggagaagatcatactgctgctctaaccaaggaaggtggagtgtttacttttggagctggagggtatggtcagttgggccataattctaccagtcatgaaataaacccaaggaaagtttttgaacttatgggaagcattgtcactgagattgcttgtggacggcagcacacttctgcttttgttccttcatcaggacgaatttactcttttgggcttggtggtaatgggcagctgggaaccggttcaacaagcaacaggaaaagcccctttactgtaaaaggaaattggtacccctataatgggcagtgtctaccagatattgattctgaagaatatttctgtgtaaaaagaattttctcagggggagatcaaagcttttcacattactctagtccccagaactgtgggccaccagatgacttcagatgtcccaatccgacaaagcagatctggacagtgaatgaagctctaattcagaaatggctgagctatccttctggaaggtttcctgtggagatagccaatgagatagatggaacgttttcttcctctggttgcctaaatggaagttttttagctgttagcaatgatgatcactatagaacaggtaccagattttcaggggttgatatgaatgctgctaggcttttattccacaaacttatacaacctgatcatccgcagatatctcagcaggtggcagctagtttggaaaagaatcttattcctaaactgactagctccttacctgatgttgaagcattgaggttttatcttactctaccagaatgtcccctgatgagtgattccaacaatttcacaacaatagcaattccctttggtacagctcttgtgaacctagaaaaggcaccactgaaagtacttgaaaactggtggtcagtacttgaacctccactattcctcaagatagtagaactttttaaggaagttgtggtacatcttttgaaactctacaagatcggtattcccccttctgaaagaagaattttcaacagttttcttcatactgcattaaaggttttagaaatactacatagggtaaatgagaaaatgggacagattatacagtatgataaattttatatacatgaagtacaagaattgatagacataagaaatgattatatcaactgggtccaacagcaggcctatggaatgttggcagatatccctgttacaatctgtacatatccatttgtatttgatgcccaagcaaaaactactctgttacagaccgatgcagtcttacagatgcagatggctattgatcaggcccacaggcagaatgtctcctctctttttctcccagtgattgaatctgtgaatccctgcttaattctagtggtgcgtagagaaaatattgtaggagatgcaatggaagtccttaggaaaacaaagaacatagattacaagaagccactcaaggttatatttgttggagaagatgctgtggatgcaggaggggtgcgcaaagaatttttcttgctcatcatgagggaattattggatcctaaatacggcatgtttaggtattatgaagattccaggctcatttggttttctgataagacatttgaagacagtgatttgttccatttgattggtgttatctgtggcttagcaatttataattgtaccattgtggacctccattttcctttggctttatataagaaactactgaaaaagaagccatccttggatgatttgaaagaactaatgcctgatgttgggagaagcatgcaacagttactggattatccagaagatgacatagaggaaacattttgtcttaattttacgatcacagttgaaaactttggtgcaacagaagtgaaagagctggttctaaatggtgcagacacagctgttaacaaacaaaatcggcaagagtttgtcgatgcttatgtggattacatattcaataaatcagtggcttccttatttgatgcttttcatgcgggctttcataaggtctgtggaggaaaagtccttctgctctttcagcctaatgaactacaagcaatggtcattggaaatacaaattatgattggaaggaactggaaaagaatacagaatacaaaggggaatattgggcagaacatcctacgataaaaattttttgggaagtatttcacgaattaccattggaaaagaagaaacagtttctgttatttttgacaggtagtgatcgcattcctattcttggtatgaagagtctgaaactagtcatccagtccacaggaggtggtgaggagtatctcccagtttcccatacttgttttaatcttctggatcttccaaaatatacag

SEQ ID NO: 2374 - DNA, 4445 bp, Homo sapiens
agtctcttccccaactctccccacccctggtgctctccgccccgcttgcctcccgttcttccccgcccgctccatccgggtcgctgacggctgtctctggactggacagcagtggcgtccgcttttctctaaggaacccgataagaactccattttctgttgatgtggagacatagggtacctccaactttccggggtttcagaagagaattttttattgaaactggaagaccaaaataattacaagcatgttgtgctggggaaatgcatcctttgggcagctaggtttgggtggaattgatgaagaaattgtactagagcccagaaaaagtgacttctttataaataaaagggtccgagatgtaggatgtggactcagacatactgtgtttgttctggatgatggaacagtgtacacatgtggatgtaatgatctaggacagctaggtcatgaaaaatccagaaagaaaccagagcaggttgttgccctggatgcccaaaatattgtagctgtttcatgtggagaagctcatacgttagcgctaaatgacaaaggccaggtgtatgcttggggtctcgattctgatggacagcttggcctggtaggatcagaggaatgcatcagagtacccagaaatattaaaagtttgtcagatatccagattgtacaggttgcttgtggttactatcattcacttgcactttctaaagcaagtgaagtcttctgttggggacagaataaatatggccaattgggtttaggtactgactgtaaaaagcaaacttcaccgcagctgcttaagtctttgcttggaatccctttcatgcaagttgcagcaggaggagcccatagttttgtactcaccctttctggagctatctttggatggggacgcaacaagtttggtcagctaggtcttaatgatgaaaatgataggtatgttcctaatttactaaagtcactaagatctcagaaaatagtttatatttgttgtggagaagatcatactgctgctctaaccaaggaaggtggagtgtttacttttggagctggagggtatggtcagttgggccataattctaccagtcatgaaataaacccaaggaaagtttttgaacttatgggaagcattgtcactgagattgcttgtggacggcagcacacttctgcttttgttccttcatcaggacgaatttactcttttgggcttggtggtaatgggcagctgggaaccggttcaacaagcaacaggaaaagcccctttactgtaaaaggaaattggtacccctataatgggcagtgtctaccagatattgattctgaagaatatttctgtgtaaaaagaattttctcagggggagatcaaagcttttcacattactctagtccccagaactgtgggccaccagatgacttcagatgtcccaatccgacaaagcagatctggacagtgaatgaagctctaattcagaaatggctgagctatccttctggaaggtttcctgtggagatagccaatgagatagatggaacgttttcttcctctggttgcctaaatggaagttttttagctgttagcaatgatgatcactatagaacaggtaccagattttcaggggttgatatgaatgctgctaggcttttattccacaaacttatacaacctgatcatccgcagatatctcagcaggtggcagctagtttggaaaagaatcttattcctaaactgactagctccttacctgatgttgaagcattgaggttttatcttactctaccagaatgtcccctgatgagtgattccaacaatttcacaacaatagcaattccctttggtacagctcttgtgaacctagaaaaggcaccactgaaagtacttgaaaactggtggtcagtacttgaacctccactattcctcaagatagtagaactttttaaggaagttgtggtacatcttttgaaactctacaagatcggtattcccccttctgaaagaagaattttcaacagttttcttcatactgcattaaaggttttagaaatactacatagggtaaatgagaaaatgggacagattatacagtatgataaattttatatacatgaagtacaagaattgatagacataagaaatgattatatcaactgggtccaacagcaggcctatggaatggatgtcaaccatggattaactgagttggcagatatccctgttacaatctgtacatatccatttgtatttgatgcccaagcaaaaactactctgttacagaccgatgcagtcttacagatgcagatggctattgatcaggcccacaggcagaatgtctcctctctttttctcccagtgattgaatctgtgaatccctgcttaattctagtggtgcgtagagaaaatattgtaggagatgcaatggaagtccttaggaaaacaaagaacatagattacaagaagccactcaaggttatatttgttggagaagatgctgtggatgcaggaggggtgcgcaaagaatttttcttgctcatcatgagggaattattggatcctaaatacggcatgtttaggtattatgaagattccaggctcatttggttttctgataagacatttgaagacagtgatttgttccatttgattggtgttatctgtggcttagcaatttataattgtaccattgtggacctccattttcctttggctttatataagaaactactgaaaaagaagccatccttggatgatttgaaagaactaatgcctgatgttgggagaagcatgcaacagttactggattatccagaagatgacatagaggaaacattttgtcttaattttacgatcacagttgaaaactttggtgcaacagaagtgaaagagctggttctaaatggtgcagacacagctgttaacaaacaaaatcggcaagagtttgtcgatgcttatgtggattacatattcaataaatcagtggcttccttatttgatgcttttcatgcgggctttcataaggtctgtggaggaaaagtccttctgctctttcagcctaatgaactacaagcaatggtcattggaaatacaaattatgattggaaggaactggaaaagaatacagaatacaaaggggaatattgggcagaacatcctacgataaaaattttttgggaagtatttcacgaattaccattggaaaagaagaaacagtttctgttatttttgacaggtagtgatcgcattcctattcttggtatgaagagtctgaaactagtcatccagtccacaggaggtggtgaggagtatctcccagtttcccatacttgttttaatcttctggatcttccaaaatatacagaaaaagaaactctacgctctaaactgatccaagctattgatcacaatgaaggcttcagtttaatataactttggagttataactattcagtttagtgcaaaagcattaaactatttgtgtttttcttgtggtgatgaattcagcaaggtgacagaggtactattataattcttacttgcagaatgttcaatctacgagtgttcatggaagccaaaaaatattaaaggaaaatgaacaaactgttaatattattgtacagaaccatggattttttttgaccatcttctaataaacatagcaagtattatgaatacattaaagttttactaacatgaattttaagagtttgcatatttcagaaatgatctggtgtgagtgcatggaaatattgcttaatttttcttcaatcattgagtgaaaaacctttaactttggcctgcaatagtcatttgattattttttcattttgtaaataatgttaagttttgtaataaaatagttatgttctgataccagtacagtttctatggttgtaattgaacttgaacagacttttaaaggttaaaaattatgatttaaatcttactctgagactctataaaaagaaaaaaaaggtagcatggtggaaacactatcttttcttttttgctagaataagtgtctttgtgcaaacctaaatcacagatagggaatatactacataacctgcagttcttttctttgtgaatcctgacacactgatagatgggggattgtcgatcagagaacttattaatatttagtactggaagaactctgtctccacagttgccagtaataaaaagaaacattggctactatgagcaccaatcactgggttatagctttcaaaattattgatgctgcagtgctttagagctatttccttgaatttaagaaacaaatcttaacagttttatggtgctgatgcttagttgtctcatgccattaaattgtaaaagtgagttgatgcaatacatgtgactttctgctataatgcaaatatttattttttaaatttattttaaaatgccgtgaaaactgtttaataaagatttattgttttaatattt

SEQ ID NO: 2375 - DNA, 3259 bp, Homo sapiens
agacaaaacgatcgcggttaaagcttgcggctcagagcccacctggccgcgctgctgggaaacggacggagcggcgcttcaatcagaggtattactcagcacagaaattcaggagacacagacaagttcttccacgatgtcgtacagacgagaactagagaaataccgtgacctggatgaagatgaaatccttggagccctaacagaggaagagctgaggaccctggaaaatgagctggatgagctggaccctgataatgcactgctgcctgcaggcctgaggcagaaggatcagaccaccaaggcgcccacgggcccctttaaaagagaggagctcttggatcacttggaaaagcaagcaaaggagtttaaggaccgagaagatctggtcccctacacaggggaaaaacgaggaaaggtctgggttcctaagcagaagccactggatcctgtgctggaaagtgtgacgctggaaccggagctggaggaagccttggcaaatgcttcagatgcagaactctgtgacattgcagcgatcctgggcatgcacacgctcatgagtaaccagcagtactaccaggccctgagcagcagctccatcatgaacaaggaggggctcaacagcgtgattaaacccacacaatacaagcctgtgcccgacgaagaaccaaattcaacagacgtagaggaaacgctggaacggataaagaacaacgacccaaaacttgaagaagttaacctcaataatatccggaatatccccatccccaccctcaaggcatatgcagaagccctgaaagaaaactcatatgtgaagaagttcagcatcgtggggacacggagtaatgaccccgtggcgtatgcccttgctgagatgctcaaggagaacaaggtgttgaagacactgaatgtggaatccaacttcatttctggagctgggattctgcgcctggtagaagccctcccatacaacacttctctggtggaaatgaaaattgacaaccagagccagcccctgggcaacaaagtggaaatggagattgtgagcatgttggaaaaaaacgcaacacttctcaaattcggctaccactttacccagcaaggaccccggcttcgggcatccaacgcaatgatgaacaacaatgaccttgtgaggaagaggaggcttgcggacctgactgggcccatcattcccaagtgccggagtggtgtctagtgtgtggcggtggagtccatgcctttgaactggatgtgttctattgatgacctgtgctctgcaggggaaaccagaaggcaaaatgctggcagcatgaaacccttttgtggttcagttctttatgcactaaggttttaggttgactagtggttgtagttgaaaattttataaaataccgttaatgtgaagtttttctttagtcacagaagttgaatctggttattatttaaaaactagaagcccccaaaccagcagatcttactgaagatgatgttccagcagcagcgacttagccccaggagcccagtttcaatggccttgctgtgtggtgtttcaagtgcatttaaaatgtgtgacacagaaacggcacactcttccacatgcttttgaagtattataaaacactttattacaaatttgtcttagctattagcaaataaaactgattatcattctttattaaccctccttggaattttgaaaacctcgattaaagttgccaaattgattactggatccagaacacaattttcccctcagaacagatagacagactgaagccactgaactctgccaggagtcaacatgagattccttttgctggatatgcagaaatgataggaaaaaaaccaatggtgaaatttcaagtttcaaaaaccaacctttcattaccaatcccaggcaacaaacatgtccctgagtgttctttaagaacatttgggatttatgtacaatttaatactggagttagaactttttccttattgaatgccaaccttatgatggatgtgaaaatctacggccaaatacttttgaaaacacctttctatattgcacagtgggcaaatggcttatgtgaggtaagacactagagggataaatttccagatcaacatggctatggtatttagtaatggcccagcttagagacttcagctactgatctcatcacttattagacaaattgctgctgaccttacgcctgtatattaagcctccgcaggatgccggacaatggtgaagaaactccagatatcaaggaattgggaaatcctggccaaaccaccccaagatgattacactgaaatgtagtattagtactgctgccagatctctttttaacatcatgtgcgtctcttgggatccagcaaaagtgttaagccacaatgcccttgtgccttttaatataccacagtgccagttaaactaatatttttgtttgttgcttttgggagttattttcattagtgatttcagcaaatctcatgataaaggacaaggtcaagaactccagagcactgagcagagaggctggtgatgaaaaggtgaaggcctgcgcactgaactgtaaggcagtgggcagtacagggtaactggaggcggggccagggcctcagcgctatggaagagtgtccactgaggctgcacatggcccaggagtggcaccatgttgcagggacaaccatccccatttggcttctccttaaaacacaattgcagctgcattctgcatcgctgaaaactgcaatataatattaaatctgttggtctatgcatggctgcgtatgtgtttcttggaacctgtgtgacagggacatgtgcctggcacactggccagaagactgggcagccaccatggcagtgctggatgacctcagtaagaatgtgtcatgtattccaggtgctgatctaaaaactgtggctcaaatgtcaccgagcttatatgaagctcccagagagaacatttaaaagctcagagagtaagtgctggggaaagcagagctatcagaggaaatctctcatagaaacgaaaccaaaccaacagaaaatgaagaaggccacatctttaaggccacctctgcctctatcagatgagctgctggtctagatcaggggctggcaaacttttctgtaaaaggccagacagtaaaaatttccgattttgcaggccacatagtgtctgttgcaactattcaactctgccatagatcatgtgtaaaggaatgggtgtggctgttcaataaactatacagttgacccttg

SEQ ID NO: 2376 - DNA, 895 bp, Homo sapiens
cgcggcgcggcgccggaggaggaagtggtgaggttgttgctccttcagcgcctatcgctggctcttggggcgcagagaggggccgcagtctccgcggctgcgtcgagctcccttgcagtcccctccatgttccccggcgccactactccccttcctaaggccgccgcttaccccggggtctatggaagtaatggaaggacccctcaacctggctcatcaacagagcagacgagcagaccgtttattagctgcaggcaaatacgaagaggctatttcttgtcacaaaaaggctgcagcatatctttctgaagccatgaagctgacacagtcagagcaggctcatctttcactggaattgcaaagggatagccatatgaaacagctcctcctcatccaagagagatggaaaagggcccagcgtgaagaaagattgaaagcccagcagaacacagtactttatttacttcagcaaaagagtgagccagcagagccatgtattggaagcaaagccccaaaagatgataaaacaattatagaggagcaggcaaccaaaattgcagatttgaagaggcatgtggaattccttgtggctgagaatgaaagattaaggaaagaaaataaacaactaaaggctgaaaaggccagacttctaaaaggtccaatagaaaaggagctggatgtagatgctgattttgtagaaacgtcagagttatggagcttgccaccacatgcagaaactgctacagcctcctcaacctggcagaagttcgcagcaaatactgggaaagccaaggacattccaatccccaatcttcctcccttggattttccatctccagaacttcctcttatggagctctctgaggatattctgaaaggatttatgaataattaa

SEQ ID NO: 2377 - DNA, 7666 bp, Homo sapiens
ctcaaagaaaatgaacggcaccctggaccacccagaccaaccagatcttgatgctatcaagatgtttgtgggccaggttccaaggacctggtctgaaaaggacttgcgggaactcttcgaacagtatggtgctgtgtatgaaatcaacgtcctaagggataggagccaaaacccgcctcagagcaaagggtgctgttttgttacattttacacccgtaaagctgcattagaagctcagaatgctcttcacaacatgaaagtcctcccagggatgcatcaccctatacagatgaaacctgctgacagtgagaagaacaatgtggaagacaggaagctgtttattggtatgatttccaagaagtgcactgaaaatgacatccgagtcatgttctcttcgtttggacagattgaagaatgccggatattgcggggacctgatggcctgagccgaggttgtgcatttgtgacttttacaacaagagccatggcacagacggctatcaaggcaatgcaccaagcacagaccatggagggttgctcatcacccatggtggtaaaatttgctgatacacagaaggacaaagaacagaagagaatggcccagcagctccagcagcagatgcagcaaatcagcgcagcatctgtgtggggaaaccttgctggtctaaatactcttggaccccagtatttagcactttatttgcagctccttcagcagactgcctcctctgggaacctcaacaccctgagcagcctccacccaatgggagggttgaatgcaatgcagttacagaatttggctgcactagctgctgcagctagtgcagctcagaacacaccaagtggtaccaatgctctcactacatccagcagtcccctcagcgtgctcactagttcagggtcctcacctagctctagcagcagtaattctgtcaaccccatagcctcacttggagccctgcagacattagctggagcaacggctggcctcaatgttggctctttggcaggaatggctgctttaaatggtggcctgggcagcagtggcctttccaatggcaccgggagcaccatggaggccctcactcaggcctactcgggtatccagcaatatgctgctgctgcgctccccactctgtacaaccagaatcttctgacacagcagagtattggtgctgctggaagccagaaggaaggtccagagggagccaacctgttcatctaccacctgccccaggagtttggtgatcaggacctgctgcagatgtttatgccctttgggaatgtcgtgtctgccaaggttttcatagacaagcagacaaacctgagcaagtgttttggttttgtaagttacgacaatcctgtttcggcccaagctgccatccagtccatgaacggctttcagattggcatgaagcggcttaaagtgcagctcaaacgttcgaagaatgacagcaagccctactgagcgtgctcccctctgagactggagtgagagggtcttctggcacagcttgccctgaagactcggctactgccttctgtgggagtttcgcttcgtacagaggacaagtttgtgctttggtttccagtgttttactttggagtttaggtgccatatcctgaggttttttttgtttttgtttttgtttctcctttatttaaagtttgctgtgtttgtaaccagtgtgtgttgagaaggaccaacaccaaaccaccctggggaagggggacagggaaacatttaacacagacgatgatcaggatttgccccaaaccaccccaagagagaggactgagtggaacaaaaaagtgacccccagaacctctcttagtgtgagggtgggtagaatgagaactgacacctgggagctgtggggagcagagcggctttggggaagagtggagtgactagacacctaatgccctggcagctggagactcaaactcctgtacagctaccttctgggaaatagtttttgacacctatttttcagattcttgtccggaatttctgctgctcttttcaaaaaagggcattaacaattctctggaaataaagcacctgttagcctgacatatgcaaaaagcagggcggcatcacccattacgagctcccccagccagcagtcagtattggattggccttgcctggctggtggcagtttgggagaaacagccaaagaggttagtttatttcaacaccaaattagaccatggcccatttccaacgggtctctttaaaggcctctatggaatacattgcctggtttccttctttgcagttcaccacagcaaggaatgtcacctccatcccaagccaccattttctcatgaaggcaaatccaagaagggcttgcagttcttgctgaagggggtaccatttgtgggcagagtgatcaataccatctagttgggggaggaggagcttatttcttggtgtacttgaatcagaaggtccctgcaagccagtatgcttcatttgccagtggccagaaattctcccttgcctccttgattgaggtgtcccagatgtagtattcccacaggggtctggcaggcccctcctgtaaccactccagtcacattttctgctcttgaggcagaggtgacatcaggacgtttacagcctccacatgaattgagtgttcatttacctcagtattaccgtgttcatttttgtcctcgtgctacagttagctccctgccgcctcttgcaggtcttacttcagctcttgcctgtgacccacacagcttctgggctctgcctctgctctaagaagtgctgtgggggtagagaaccaggaaggacatgctgttgggaatgtacacctgggcagaggtggccctgttaagatgtgactgtagccacagccagggatgggatccctgggtctctggaatctgaaacctcaacaaataccagtcttgacccctagcagcagagataagaataaaggggttggtttgctattaagtcagatgggggctctctccttgtcatgctgtccctgtgggtaacagacagggattgaccatcttactgttgtacaggtagctggtggtgttggattatcccattgaagctgggacagctgttcctttctcatagtgataacttgggtctgttgtcctctaaggaacgtgaaacatacacttcttaagctgaaccacgtaaacttgaaattctgcgcactgggagaaatgtgtcctgtgtttcaaaggataaaactgttctaaaggcttccagggtcatgatgggattttttaaataaatgcaaaaaataaaaataaaaaagaaaaaagaaaacaaaaaaaaaaaagaaaaaaatgctaggttggggaggcgctgttctgaatcccaaccggctggaaccaagaatgtcgtttctatttttatagaagttttatacagctccggggtggagaatatttattacctaaattatatctctggaaaaggccaggattttgtagaatccagaatgtgattgttatacacacagggtgctgtgtatgattgaaactactgactttctgtggcccgtttgcagcccagctaacctgcccaaggggaaggtgttaatgctgtgaattggcagaggagagagctgtgctccatagggtgctgccggtgctgtgctccctagccttctgttctgtcttcctccttagccagaacgccactcccttcccacatccccttcttctctccgccttcccccatctcaccattatttgtccatggatttgtcctgggctctgggaccttatgaaacccctttcctaatgacataagaggccaaggtgcaatccacccacctttgataccagaccctgagggcttcatacctgctgatgggttttcttttctaaaaggaatgctcgccccagcagggtcctgggctgcttgagcagccagctggtgagaccatgcacttctctgttctctcctccccctgcccagtgagttagcacagcagtagcactgcccttgagcacagttctttccccaggccaaagatggttttgtgaagaagctgctcccctacaagtctcacgtgtgaaagggctcagctcagagtggagactcgctgtcaagtcttaagcaatccttttctgttgtgtgaaggtttcacttacaatgtgttttctgctgtagttttgtttcttacttgggttacatcatgaaattgatttgccttgaatgcagccagaccactgtctcctgggttccccttgagtggccagggcctggatggaagctaagagcttggatttctgggaacaaagggccatccccataagattgagcagaaattctggtcctcttccctgaaaaattttccccaccccagccagcatcttctgcttccccttgggttgtgaccagggagtggggagagaggctgaggctctgctcccctggagaccttctcttaggagttgggtgcttcatggaaaatccaagccttaggttcccttctgtctctggcaattagatgtgttcttggtgtcctccatgtcctttttgacttttccctgtgtccattgttagcatgtgcaaaagttccctgtcattacccaacccctgcccgcccacctcatttcagggctgtacacacagtgagtgttcctgttctctctctctttgtttggatgtattgctctgtgtaactcagtgggtctccctctttctggtttgtttttttttctagattcctgccgtttgttcatcgttgtgcctaaagcatgtcgatgtggcgtcaagtacatcgtccaaatccctgtctcttcagcttctctgatgcttgaactctcacctttgaccttgtgttgacctttgatgctgatgtgtatttttattatgtttgtttctttcttcgtttttttttctttttttctttcctttttttttccttttgtgctgccaaattggttttgctagaacgactgctgaaggggaaatatttaaacttgcatttgaatataaaaaaaatctatttttctagaacttcataagataaccacttgattttgtgattccaattctttgtaattgtcttcagagcagccctactagcacataccgcgtggtgtttgtatttctgtgaacacacagccagtccgtttctaggctttgtttctctgtgtgcttagttttaaagacaactttgaagtaaacaatgaaataaaagatgtcactaaaacctctgaggctcctgagcacattttgctgatacagtctgtggggcttgaggagaccgcatgtattgttctttcttttgtttttcttctgagttctcaactgcggagagcacctgaaccccctttcctttttgaccgcaggctgcactttgggccccagccagccctttttctttttctttttcttttgtggttcttccctggagcgactctggggagtcctggatatcccgcctgccccttcccctcagccccatgcttgttccaacagtctccacagcaaaatgtgatgctttgatttttttgttgttgtttttgtttttgtattgtttttgtgtttttgttttgaattttttcctttcctactaagattatgcccagaaaaaagttttgcatgtttcctgctgtttcttcacaccttcgtatatatcaccttcacctctctgttttctatagtttgtgcaaaaactgatcgatttaaaagggtttcaaagaagctgttttaaattgttgtagggttgattatttttttcaagattgtattgtttaattttgaagtggcaactttctcctctattgcccttagagcgtttgcctgtgcacttagactgtcacttcgtgtggcctccaggtcttaccggggcttccgggaggctggctgctttgctcagagagggtgggaagggggcctggagagacacgagaagcagaggtagagcctagaaggtggcagcaggtgggtaagaggcttatttagcacattaggggcagtgagcacctggaggaaggagggcgctcccaatcacccgtaggaggccatctgcacaccaagcggcaattcacctgctggcgcttttcctaggtgacaagcacaatactacagtcttcacactgtttacagccctgggcaccagccacccggcactggctcttcatcacagctctgctcttgcttagctagtggggtgggggaaagggcagggatttgtttttttaattgggtggagagccaaacagctactgtccctgggtgccaagcaagccagttttttggttccctgagggaaactgaccctcctctcttgtggcaccatccagcctcagggtcttggagacttgagtaagaatgtgagtggagggggagaggtgaggagaggagcacagggtggatctgtggagggaagaggttacagggggaggagctgatgatagatcccacccagacttaagctgctggtgggtgggtgagctgggaagtaggactgtccagggaagggtggagagatgtagctaggggctggggagggggaggtggaagcgctattgagcatcctccacaccaaggttgatgaaggaagggatcccagcagggtttctgctctggggctggcaggttgcctggtattatgcccaaggccgctctgcctgggggaaagggcagccaggcagaggcccagtgtctggtaggctgctgaatttcctggaaggggtgattggatggaaagaggccagaaaccccagcctgagagactgctgtgcaccccacagtctgactgcacagagccgcctctgttggcaggaggcactgaggctccccttcctgtgtattgagaagcagtgtttgccaatatattttgctttcaattccaagaggagctctgggaaaacctgtggataaaaccaaatgccaaatgttggacgttgtttccttttccttttctctctctgattgttttaattgttctgtggtggttttaatggatttgagaccctggagcggcagctgcctttctgatttccagctgctttttgtgaataatttaaaaagaaaaaaaaaaagaaactttacattttggagacaaacctgtgtgagttttttattggtacaaacgttgtatttaacactaggggttttgtacagttttttgccttttctactagaaaacaatgtaaagtgatttcacaatgtgaagagaaaaaaaaattgccactatgaccaaacgcacagtctgttctgcagcaacaacgggattcaatcaactcagtcgtgattcagccgtagaaatgcttttcctttatcttgtttgagcttttcctttctttcctgttttgatttgcaaaagaaaatgtcttttttgtgtgaacttgtgttgtactctgtagaaaattatggattttactttaatggtttaaaaaaaggcaaggagagccctcgtcgcttttcttacctaatcacagagtttgtgtagtgaatttaaaaagaaaaaaaaattgttataagtttggagcaagggagtatgtgtttcaaaggaatctccttcctttttttgtgtgtttttccttttgtcccaatggggaacctaaatctgttttaattgcacagacacatggacaaaaagtcattttgtatctgccaagtgtggtaccttcctttgtttatttgctattaaactgtttg

SEQ ID NO: 2378 - DNA, 2191 bp, Homo sapiens
atactttgaaaataacagctcttttttgttccctcgtgtgtctcttcccaattgtatccctattgtattttctcatagtatgtttcagcagaaatcaaggtagacgaagtaacctcttgtcctgaattttcatagttgctcattcttaataatggcagcagaagcaacaatgagagtaactacctcctcagctcaaagaaaatgaacggcaccctggaccacccagaccaaccagatcttgatgctatcaagatgtttgtgggccaggttccaaggacctggtctgaaaaggacttgcgggaactcttcgaacagtatggtgctgtgtatgaaatcaacgtcctaagggataggagccaaaacccgcctcagagcaaagggtgctgttttgttacattttacacccgtaaagctgcattagaagctcagaatgctcttcacaacatgaaagtcctcccagggatgcatcaccctatacagatgaaacctgctgacagtgagaagaacaatgcagtggaagacaggaagctgtttattggtatgatttccaagaagtgcactgaaaatgacatccgagtcatgttctcttcgtttggacagattgaagaatgccggatattgcggggacctgatggcctgagccgaggttgtgcatttgtgacttttacaacaagagccatggcacagacggctatcaaggcaatgcaccaagcacagaccatggagggttgctcatcacccatggtggtaaaatttgctgatacacagaaggacaaagaacagaagagaatggcccagcagctccagcagcagatgcagcaaatcagcgcagcatctgtgtggggaaaccttgctggtctaaatactcttggaccccagtatttagcactccttcagcagactgcctcctctgggaacctcaacaccctgagcagcctccacccaatgggagggttgaatgcaatgcagttacagaatttggctgcactagctgctgcagctagtgcagctcagaacacaccaagtggtaccaatgctctcactacatccagcagtcccctcagcgtgctcactagttcagcagggtcctcacctagctctagcagcagtaattctgtcaaccccatagcctcacttggagccctgcagacattagctggagcaacggctggcctcaatgttggctctttggcaggaatggctgctttaaatggtggcctgggcagcagtggcctttccaatggcaccgggagcaccatggaggccctcactcaggcctactcgggtatccagcaatatgctgctgctgcgctccccactctgtacaaccagaatcttctgacacagcagagtattggtgctgctggaagccagaaggaaggtccagagggagccaacctgttcatctaccacctgccccaggagtttggtgatcaggacctgctgcagatgtttatgccctttgggaatgtcgtgtctgccaaggttttcatagacaagcagacaaacctgagcaagtgttttggttttgtaagttacgacaatcctgtttcggcccaagctgccatccagtccatgaacggctttcagattggcatgaagcggcttaaagtgcagctcaaacgttcgaagaatgacagcaagccctactgagcgtgctcccctctgagactggagtgagagggtcttctgattcctgccgtttgttcatcgttgtgcctaaagcatgtcgatgtggcgtcaagtacatcgtccaaatccctgtctcttcagcttctctgatgcttgaactctcacctttgaccttgtgttgacctttgatgctgatgtgtatttttattatgtttgtttctttcttcgtttttttttctttttttctttcctttttttttccttttgtgctgccaaattggttttgctagaacgactgctgaaggggaaatatttaaacttgcatttgaatataaaaaaaatctatttttctagaacttcataagataaccacttgattttgtgattccaattctttgtaattgtcttcagagcagccctactagcacataccgcgtggtgtttgtatttctgtgaacacacagccagtccgtttctaggctttgtttctctgtgtgcttagttttaaagacaactttgaagtaaacaatgaaataaaagatgtcactaaaacctctga

SEQ ID NO: 2379 - DNA, 7610 bp, Homo sapiens
cacgcactacgggttggcgccagagtcaaaaggcgtcggccctctggcaagatggctgctgcggaggcgttggagcgcggaaatctggaaccgggatggcgacgtctacactgagtcggaggcgaaggagcttactccacgggaacagcctctagataatctgagttgttgaaaatacgaagcctgttactcgtgaacagtggctgacaacagtgttgttgtgagcctggctgtctgcttggacccagaggtttcgtctgccagggtttttggttgtatttaggatttcagggaaaagtgtccaagctttcagtgttggagcaggtatggacgacaaaggcgacccgagcaatgaggaggcacctaaggccatcaaacccaccagcaaagagttcaggaaaacatggggttttcgaaggaccactatcgccaagcgagagggcgcaggggacgcggaggctgacccactggagccgccacccccacagcagcagctgggcctgtccctgcggcgcagtgggaggcagcccaagcgcactgagcgcgtggagcagttcctgaccattgcgcggcgccgcggcaggaggagcatgcctgtctccctggaggattctggtgagcccacgtcctgccccgccacagacgccgagacagcctccgagggcagcgtggaaagcgcttctgagaccagaagcggcccccagtctgcttccacagctgtgaaggaacgaccagcctcttctgaaaaggtgaaaggaggggatgaccacgatgacacctccgatagtgacagcgatggcctgaccttgaaagagcttcagaatcgccttcgcaggaagcgggaacaggagcccactgagaggcccctgaaagggatccagagtcgcctgcggaagaagcgccgggaggagggtcccgccgagactgtgggctccgaggccagtgacactgtggagggcgtcctgcccagtaagcaggagcccgagaacgatcagggggttgtgtcccaggctgggaaagatgacagagagagtaagttggagggaaaggcggctcaggacatcaaagatgaggagcctggagacttgggccgaccgaagcctgaatgtgagggttacgaccccaacgccctgtattgcatttgccgccagcctcacaacaacaggtttatgatttgctgtgaccgctgtgaagaatggtttcatggcgattgtgtgggcatttctgaggctcgagggaggcttttggaaaggaatggggaagactatatctgcccaaactgcaccattctgcaagtgcaggatgagactcattcagaaacggcagatcagcaggaagctaaatggagacctggagatgctgatggcaccgattgtacaagtataggaacaatagagcagaagtctagcgaagaccaagggataaagggtagaattgagaaagctgcaaatccaagtggcaagaagaaactcaagatcttccagcctgtgatagaggcgcctggtgcctcaaaatgtattggccccgggtgctgtcacgtggcgcagcccgactcggtgtactgcagtaatgactgtatcctcaaacacgccgcagcgacaatgaagtttctaagctcaggtaaagaacagaagccaaagcctaaagaaaagatgaagatgaagccagagaagcccagtcttccgaaatgcggtgctcaggcaggtattaaaatctcttctgtgcacaagagaccagctccagaaaaaaaagagaccacagtgaagaaggcagtggtggtccctgcgcggagtgaagcactcgggaaggaagcagcttgtgagagcagcacgccgtcgtgggcgagcgatcacaattacaatgcagtaaagccagaaaagactgctgctccctcgccgtcactgttgtataaatccacgaaggaagacaggaggtccgaggagaaagcggcagccatggcagcctcaaagaaaacagcccctccaggctccgcggtgggcaagcagcctgcacctagaaacctcgtgccaaagaagtcttcttttgctaatgtggcagcagccacaccagccattaaaaagccaccctcaggtttcaagggcaccatccccaagaggccatggctctccgctaccccatcgagtggtgcttcagctgccaggcaggccggaccggcacctgcagcggcaacggctgcctccaagaagttccctggctccgctgctttggtgggagccgtaaggaagccagtggtaccttctgttccaatggcctcgccagccccaggacgccttggggctatgagtgctgcaccatcgcagccaaattcacaaattcggcaaaatatcagacgctccttaaaagagattttgtggaaaagagtcaatgacagcgatgacttaatcatgacagaaaacgaagtaggaaaaattgccctccatattgagaaggagatgtttaacttgtttcaagttacagataatcgctacaagagtaaatatcgcagcatcatgttcaacctgaaggaccctaaaaatcagggactcttccatcgtgttctgcgtgaggaaatctctttggcgaaacttgtgagactgaagccagaagaacttgtatctaaagagctttccacgtggaaagagaggccagcgagatctgtgatggagtccagaactaaactgcacaatgaaagcaagaagacggcccccaggcaggaggccatccccgatctggaggactctccgccagtgtcggattcagaggaacagcaagagtcagcacgtgctgtccctgagaagagcacagcgccgcttctcgacgtcttcagcagcatgttgaaagacaccaccagtcagcaccgcgcacacctcttcgatctcaactgtaaaatttgcacaggccaggttccctccgcagaagatgagccagctccgaaaaaacaaaaattgtcagcttctgttaagaaagaagacttaaaatcaaagcatgacagctctgcacctgacccagctccggattcagctgatgaggtgatgccggaggctgtgcctgaagttgcctctgagccaggcctagaaagtgcttctcatccaaatgtggacagaacgtatttccctgggcctccaggagatggccatcccgagccctccccgctggaagacctgtccccctgcccagcctcctgtgggagcggggtggtcaccaccgtcacagtgtccggccgggaccccaggaccgctccaagcagttcatgcacagccgtggcctccgcagcatcccgcccagacagcacccacatggtggaagccagacaggatgtgccgaagcctgtcttgacttctgtgatggtgcccaagtccatactagctaagccatcctcatctcctgacccaagatacctgtcagttcctccgtcaccaaatatcagcacttcagaatcacgttcccctccagagggagacacgaccctctttttgtctcgactcagcaccatttggaaaggatttattaacatgcagagtgtggcaaaatttgtcactaaggcgtatcctgtctctgggtgttttgattacctcagtgaggatttgcctgacacaattcacattggtgggaggatcgcaccgaagacagtttgggattatgttggcaaactcaagtcttctgtgtctaaggagctctgtctgatccgcttccaccccgccacagaggaagaggaggtcgcctatatctctctctactcctatttcagcagccgtggccgctttggtgttgtagctaataacaacaggcacgtcaaggacctctacctgatcccgctgagcgcccaggaccctgttccatccaaactcttgccctttgagggaccaggtaagcgccggctttctgggtggaggtgaggcccacctgcacctgcacccctcctcccactgacatgccctgctgagtcctgaccagcccagggctctctgggagcaggagttaggagcacagacgcagcggttagcaataggattcatctttgagggcgtaggactgtggcacgagaagtacccctgattcacagcataaattgtcttaggagagttttttagagagggaaaaacccacagcctgcaaccagctcatcttggcctcaggtcagagaagactcagtgcccagaagcccaaggctcagccagaaagggaggtgacactcccagcggccctgctctttcctctagacagactcgggagccagcacacaccgggaagtggctccatcagggatcacttctctaacagggatggatttccaggagacttaacaataatgacatagaaaactatttctagaaataattattttaaaatctgcagctcaaattgtaataggttcattcatctttggcaagctattttgtgtttgcacgttccttggaaagtactgtatttaaacgattatttacaaatagcctaaaatacatctttgtcaagggttgagggtgattccaggggccacgtgctctgttagtgaccagctctttcatagccccttagaagaagctgatgtgacttcagttaggggttagtatctgatgcccaactgaagtgtctccgtggccatgcagtccccagaggattggtgttctctcaaagcgggtgtgtggatcacacagtgtcctctgaagtgcttcgtcataaaggcaggtgctgtctggaccctgtgcctcagtgccctctgtccctgtcaccaggcctcggcgggtgttcctgccatagctgtgcagggtgttcccacccacacccctcatgccgcaccctagctagctggggtcctgtaggggccactccacatcttgggcgggacttctgtcgccccaggcacagcccacgttcctactggagcccattcttcacagctggagtgggctcagcctatgcctgtgttgtggaattatatgtccataaagggattggttggtatcagtaatttcagggttaaatatttgctggcgtggtgcattaaattattttagtgccagataaatttttaaaagcaaagtgctttagtgtgtcccctcaaatcctacttgggataaagagatgccacctaatgggtggcagaaaggaccctggtagaggttcttggtgttgcttgtgaagagctctggccagctccacgtgaccagggagaggaaaagcccggccctcctggaggtgaagaccgagaagctggcctctccgcacctgtgaagacccactggtcagttgcaagtgcgacagtgtgtgcactcagtgcagacactgcagcacctcagcacctccctaccggggtggaaagagcactttttctttacagaaacatgattcttagatagcgagcctcccctttttaaaacaattgaggcgatatttcatcctttcttgagcttctctccctgctcatctccaaacttggagctgtcaggtgagcacggttgtagggtgttgagcgagccccggcgcatgccgggcaccgggttccccacactgggcagtgacggggcccagggaggccaccagaggagcggcgcctccattctccccacagcaagggctggctgtgcaggtgcagccccggggcagagggaaaggacaggtctcccagcacctcccggatggcaccgggacaaggagggctgggctggggtcactcaccttgtctgctgagtgcgatggcaccaaccacccacactgtcagctccgcgaccagctgggggaacgtcacactcgcccaccaaggcacttgctgaggccacgacgccgcctgacggggacacacaaaagccccagggactttgatccacgataaagagcagaggcgtctgggtaaagtaacacagggcaagggactttagaaaagtaacagctagtgaaacctttccatacacttcagaaatgttttaacttaagacttcagtataatgttaacttctcctgatgtccttgttgacatgaatgcgtgtgcgtgaaatctcacacacttccatggtcactaaacagccttcaccccgggccaggccatcgggtactcggcccgcttcacgtactgattacttgacttggcgttttctagatataaacatgtacatgtgtgtcctggctttgtggtgtaaatgtgtagtgcgtgtgcatgtgcgcgcgtgtgtgtgtgtaaggctaggtcctggcatgtttcccctgtctcagcggaccctgtcctcacggagatagcccagaagcccttggacagcacaggccacacctgagggtgctgatggtggtgactccacagagctgtggtcaggggtgagcgtgtgctgcgcagcttggagtcacgcccccagaagtgctgggtgagggtctgcaggacccagctccattccacagcctcagttctctgcggcacatgcagcacaggcctgaaggagacctggcgccccagccttgagctgcccgtctgcatcagggcactgatgtgggagcatcttcccctggggatgttaaggagaaggtcctgttgggggtagagattcacgcagaaaagagtgactgactcgtccatgtgcctcagtttataccacacaattgcaggtgtccatgcctcccacacatggggacctagtgggttttgacagcgtggtgtccagtcctagccccctcagtgcttgctgttcacacttaagcaagtgaaggcctgaaggtgcccagctgtgccctcaggggaaacttaagtcacccgccctgtcagcacttggcccttgtcgggcagtgagagtggagctgcccccgcagcaccctcaggagccatgcagttcacagcagtagctggatctccctgaggacatttgtccttgcatatcttaatgatttgtccacagaaacaccgggttgtcttcctctgcccctctgccccgcagtgggggcactctctgtaactcagcatcacggtggggggcagctgggaggcctggttccaggtgaccttctccacctagatgttcaccccactcagttccagctttaccaacagggccccccgcagggacttggggtcgcagagtcccggcctgtctcagggccttgttcatggaagggagatgagtcaggttgaaagctcatcgtgtagggttctgtgcagggcccttacaggactggaccgcagccaagatgcctgcctgttaaccatgcccagcccccgtcatttccgcgtgaagccgcaggcctcggagccttggtctgaaatgcctgtggagtaacctcggtccataaacatgggtgcacagtctgttctccccaagtacagggcaggaggaaacaccgccctctgtagctgctcgaatggaaagggctcttttctctgaggtctttatacattagaaagctcttctgggaagaatgtttgaatccatagtgtctttctgtattcacttttaattgctttctaaattagctgagaaattctgacttgaaatattgtcaggtaagcatttcttcagttttcatgtgtgtatgtaacagtagctttgcatggaaattgtaatcagagtcaaatacagtattgaatggaatgtactgccttctcctcctaaatcaataaacatctttcatgg

SEQ ID NO: 2380 - DNA, 7551 bp, Homo sapiens
ctcggtggccgtccgcccactccgcggcgttcggggaaatggctgcgagaccctagaggcctgcggagcttactccacgggaacagcctctagataatctgagttgttgaaaatacgaagcctgttactcgtgaacagtggctgacaacagtgttgttgtgagcctggctgtctgcttggacccagaggtttcgtctgccagggtttttggttgtatttaggatttcagggaaaagtgtccaagctttcagtgttggagcaggtatggacgacaaaggcgacccgagcaatgaggaggcacctaaggccatcaaacccaccagcaaagagttcaggaaaacatggggttttcgaaggaccactatcgccaagcgagagggcgcaggggacgcggaggctgacccactggagccgccacccccacagcagcagctgggcctgtccctgcggcgcagtgggaggcagcccaagcgcactgagcgcgtggagcagttcctgaccattgcgcggcgccgcggcaggaggagcatgcctgtctccctggaggattctggtgagcccacgtcctgccccgccacagacgccgagacagcctccgagggcagcgtggaaagcgcttctgagaccagaagcggcccccagtctgcttccacagctgtgaaggaacgaccagcctcttctgaaaaggtgaaaggaggggatgaccacgatgacacctccgatagtgacagcgatggcctgaccttgaaagagcttcagaatcgccttcgcaggaagcgggaacaggagcccactgagaggcccctgaaagggatccagagtcgcctgcggaagaagcgccgggaggagggtcccgccgagactgtgggctccgaggccagtgacactgtggagggcgtcctgcccagtaagcaggagcccgagaacgatcagggggttgtgtcccaggctgggaaagatgacagagagagtaagttggagggaaaggcggctcaggacatcaaagatgaggagcctggagacttgggccgaccgaagcctgaatgtgagggttacgaccccaacgccctgtattgcatttgccgccagcctcacaacaacaggtttatgatttgctgtgaccgctgtgaagaatggtttcatggcgattgtgtgggcatttctgaggctcgagggaggcttttggaaaggaatggggaagactatatctgcccaaactgcaccattctgcaagtgcaggatgagactcattcagaaacggcagatcagcaggaagctaaatggagacctggagatgctgatggcaccgattgtacaagtataggaacaatagagcagaagtctagcgaagaccaagggataaagggtagaattgagaaagctgcaaatccaagtggcaagaagaaactcaagatcttccagcctgtgatagaggcgcctggtgcctcaaaatgtattggccccgggtgctgtcacgtggcgcagcccgactcggtgtactgcagtaatgactgtatcctcaaacacgccgcagcgacaatgaagtttctaagctcaggtaaagaacagaagccaaagcctaaagaaaagatgaagatgaagccagagaagcccagtcttccgaaatgcggtgctcaggcaggtattaaaatctcttctgtgcacaagagaccagctccagaaaaaaaagagaccacagtgaagaaggcagtggtggtccctgcgcggagtgaagcactcgggaaggaagcagcttgtgagagcagcacgccgtcgtgggcgagcgatcacaattacaatgcagtaaagccagaaaagactgctgctccctcgccgtcactgttgtataaatccacgaaggaagacaggaggtccgaggagaaagcggcagccatggcagcctcaaagaaaacagcccctccaggctccgcggtgggcaagcagcctgcacctagaaacctcgtgccaaagaagtcttcttttgctaatgtggcagcagccacaccagccattaaaaagccaccctcaggtttcaagggcaccatccccaagaggccatggctctccgctaccccatcgagtggtgcttcagctgccaggcaggccggaccggcacctgcagcggcaacggctgcctccaagaagttccctggctccgctgctttggtgggagccgtaaggaagccagtggtaccttctgttccaatggcctcgccagccccaggacgccttggggctatgagtgctgcaccatcgcagccaaattcacaaattcggcaaaatatcagacgctccttaaaagagattttgtggaaaagagtcaatgacagcgatgacttaatcatgacagaaaacgaagtaggaaaaattgccctccatattgagaaggagatgtttaacttgtttcaagttacagataatcgctacaagagtaaatatcgcagcatcatgttcaacctgaaggaccctaaaaatcagggactcttccatcgtgttctgcgtgaggaaatctctttggcgaaacttgtgagactgaagccagaagaacttgtatctaaagagctttccacgtggaaagagaggccagcgagatctgtgatggagtccagaactaaactgcacaatgaaagcaagaagacggcccccaggcaggaggccatccccgatctggaggactctccgccagtgtcggattcagaggaacagcaagagtcagcacgtgctgtccctgagaagagcacagcgccgcttctcgacgtcttcagcagcatgttgaaagacaccaccagtcagcaccgcgcacacctcttcgatctcaactgtaaaatttgcacaggccaggttccctccgcagaagatgagccagctccgaaaaaacaaaaattgtcagcttctgttaagaaagaagacttaaaatcaaagcatgacagctctgcacctgacccagctccggattcagctgatgaggtgatgccggaggctgtgcctgaagttgcctctgagccaggcctagaaagtgcttctcatccaaatgtggacagaacgtatttccctgggcctccaggagatggccatcccgagccctccccgctggaagacctgtccccctgcccagcctcctgtgggagcggggtggtcaccaccgtcacagtgtccggccgggaccccaggaccgctccaagcagttcatgcacagccgtggcctccgcagcatcccgcccagacagcacccacatggtggaagccagacaggatgtgccgaagcctgtcttgacttctgtgatggtgcccaagtccatactagctaagccatcctcatctcctgacccaagatacctgtcagttcctccgtcaccaaatatcagcacttcagaatcacgttcccctccagagggagacacgaccctctttttgtctcgactcagcaccatttggaaaggatttattaacatgcagagtgtggcaaaatttgtcactaaggcgtatcctgtctctgggtgttttgattacctcagtgaggatttgcctgacacaattcacattggtgggaggatcgcaccgaagacagtttgggattatgttggcaaactcaagtcttctgtgtctaaggagctctgtctgatccgcttccaccccgccacagaggaagaggaggtcgcctatatctctctctactcctatttcagcagccgtggccgctttggtgttgtagctaataacaacaggcacgtcaaggacctctacctgatcccgctgagcgcccaggaccctgttccatccaaactcttgccctttgagggaccaggtaagcgccggctttctgggtggaggtgaggcccacctgcacctgcacccctcctcccactgacatgccctgctgagtcctgaccagcccagggctctctgggagcaggagttaggagcacagacgcagcggttagcaataggattcatctttgagggcgtaggactgtggcacgagaagtacccctgattcacagcataaattgtcttaggagagttttttagagagggaaaaacccacagcctgcaaccagctcatcttggcctcaggtcagagaagactcagtgcccagaagcccaaggctcagccagaaagggaggtgacactcccagcggccctgctctttcctctagacagactcgggagccagcacacaccgggaagtggctccatcagggatcacttctctaacagggatggatttccaggagacttaacaataatgacatagaaaactatttctagaaataattattttaaaatctgcagctcaaattgtaataggttcattcatctttggcaagctattttgtgtttgcacgttccttggaaagtactgtatttaaacgattatttacaaatagcctaaaatacatctttgtcaagggttgagggtgattccaggggccacgtgctctgttagtgaccagctctttcatagccccttagaagaagctgatgtgacttcagttaggggttagtatctgatgcccaactgaagtgtctccgtggccatgcagtccccagaggattggtgttctctcaaagcgggtgtgtggatcacacagtgtcctctgaagtgcttcgtcataaaggcaggtgctgtctggaccctgtgcctcagtgccctctgtccctgtcaccaggcctcggcgggtgttcctgccatagctgtgcagggtgttcccacccacacccctcatgccgcaccctagctagctggggtcctgtaggggccactccacatcttgggcgggacttctgtcgccccaggcacagcccacgttcctactggagcccattcttcacagctggagtgggctcagcctatgcctgtgttgtggaattatatgtccataaagggattggttggtatcagtaatttcagggttaaatatttgctggcgtggtgcattaaattattttagtgccagataaatttttaaaagcaaagtgctttagtgtgtcccctcaaatcctacttgggataaagagatgccacctaatgggtggcagaaaggaccctggtagaggttcttggtgttgcttgtgaagagctctggccagctccacgtgaccagggagaggaaaagcccggccctcctggaggtgaagaccgagaagctggcctctccgcacctgtgaagacccactggtcagttgcaagtgcgacagtgtgtgcactcagtgcagacactgcagcacctcagcacctccctaccggggtggaaagagcactttttctttacagaaacatgattcttagatagcgagcctcccctttttaaaacaattgaggcgatatttcatcctttcttgagcttctctccctgctcatctccaaacttggagctgtcaggtgagcacggttgtagggtgttgagcgagccccggcgcatgccgggcaccgggttccccacactgggcagtgacggggcccagggaggccaccagaggagcggcgcctccattctccccacagcaagggctggctgtgcaggtgcagccccggggcagagggaaaggacaggtctcccagcacctcccggatggcaccgggacaaggagggctgggctggggtcactcaccttgtctgctgagtgcgatggcaccaaccacccacactgtcagctccgcgaccagctgggggaacgtcacactcgcccaccaaggcacttgctgaggccacgacgccgcctgacggggacacacaaaagccccagggactttgatccacgataaagagcagaggcgtctgggtaaagtaacacagggcaagggactttagaaaagtaacagctagtgaaacctttccatacacttcagaaatgttttaacttaagacttcagtataatgttaacttctcctgatgtccttgttgacatgaatgcgtgtgcgtgaaatctcacacacttccatggtcactaaacagccttcaccccgggccaggccatcgggtactcggcccgcttcacgtactgattacttgacttggcgttttctagatataaacatgtacatgtgtgtcctggctttgtggtgtaaatgtgtagtgcgtgtgcatgtgcgcgcgtgtgtgtgtgtaaggctaggtcctggcatgtttcccctgtctcagcggaccctgtcctcacggagatagcccagaagcccttggacagcacaggccacacctgagggtgctgatggtggtgactccacagagctgtggtcaggggtgagcgtgtgctgcgcagcttggagtcacgcccccagaagtgctgggtgagggtctgcaggacccagctccattccacagcctcagttctctgcggcacatgcagcacaggcctgaaggagacctggcgccccagccttgagctgcccgtctgcatcagggcactgatgtgggagcatcttcccctggggatgttaaggagaaggtcctgttgggggtagagattcacgcagaaaagagtgactgactcgtccatgtgcctcagtttataccacacaattgcaggtgtccatgcctcccacacatggggacctagtgggttttgacagcgtggtgtccagtcctagccccctcagtgcttgctgttcacacttaagcaagtgaaggcctgaaggtgcccagctgtgccctcaggggaaacttaagtcacccgccctgtcagcacttggcccttgtcgggcagtgagagtggagctgcccccgcagcaccctcaggagccatgcagttcacagcagtagctggatctccctgaggacatttgtccttgcatatcttaatgatttgtccacagaaacaccgggttgtcttcctctgcccctctgccccgcagtgggggcactctctgtaactcagcatcacggtggggggcagctgggaggcctggttccaggtgaccttctccacctagatgttcaccccactcagttccagctttaccaacagggccccccgcagggacttggggtcgcagagtcccggcctgtctcagggccttgttcatggaagggagatgagtcaggttgaaagctcatcgtgtagggttctgtgcagggcccttacaggactggaccgcagccaagatgcctgcctgttaaccatgcccagcccccgtcatttccgcgtgaagccgcaggcctcggagccttggtctgaaatgcctgtggagtaacctcggtccataaacatgggtgcacagtctgttctccccaagtacagggcaggaggaaacaccgccctctgtagctgctcgaatggaaagggctcttttctctgaggtctttatacattagaaagctcttctgggaagaatgtttgaatccatagtgtctttctgtattcacttttaattgctttctaaattagctgagaaattctgacttgaaatattgtcaggtaagcatttcttcagttttcatgtgtgtatgtaacagtagctttgcatggaaattgtaatcagagtcaaatacagtattgaatggaatgtactgccttctcctcctaaatcaataaacatctttcatggaaa

SEQ ID NO: 2381 - DNA, 8477 bp, Homo sapiens
ctcggtggccgtccgcccactccgcggcgttcggggaaatggctgcgagaccctagaggcctgcggagcttactccacgggaacagcctctagataatctgagttgttgaaaatacgaagcctgttactcgtgaacagtggctgacaacagtgttgttgtgagcctggctgtctgcttggacccagaggtttcgtctgccagggtttttggttgtatttaggatttcagggaaaagtgtccaagctttcagtgttggagcaggtatggacgacaaaggcgacccgagcaatgaggaggcacctaaggccatcaaacccaccagcaaagagttcaggaaaacatggggttttcgaaggaccactatcgccaagcgagagggcgcaggggacgcggaggctgacccactggagccgccacccccacagcagcagctgggcctgtccctgcggcgcagtgggaggcagcccaagcgcactgagcgcgtggagcagttcctgaccattgcgcggcgccgcggcaggaggagcatgcctgtctccctggaggattctggtgagcccacgtcctgccccgccacagacgccgagacagcctccgagggcagcgtggaaagcgcttctgagaccagaagcggcccccagtctgcttccacagctgtgaaggaacgaccagcctcttctgaaaaggtgaaaggaggggatgaccacgatgacacctccgatagtgacagcgatggcctgaccttgaaagagcttcagaatcgccttcgcaggaagcgggaacaggagcccactgagaggcccctgaaagggatccagagtcgcctgcggaagaagcgccgggaggagggtcccgccgagactgtgggctccgaggccagtgacactgtggagggcgtcctgcccagtaagcaggagcccgagaacgatcagggggttgtgtcccaggctgggaaagatgacagagagagtaagttggagggaaaggcggctcaggacatcaaagatgaggagcctggagacttgggccgaccgaagcctgaatgtgagggttacgaccccaacgccctgtattgcatttgccgccagcctcacaacaacaggtttatgatttgctgtgaccgctgtgaagaatggtttcatggcgattgtgtgggcatttctgaggctcgagggaggcttttggaaaggaatggggaagactatatctgcccaaactgcaccattctgcaagtgcaggatgagactcattcagaaacggcagatcagcaggaagctaaatggagacctggagatgctgatggcaccgattgtacaagtataggaacaatagagcagaagtctagcgaagaccaagggataaagggtagaattgagaaagctgcaaatccaagtggcaagaagaaactcaagatcttccagcctgtgatagaggcgcctggtgcctcaaaatgtattggccccgggtgctgtcacgtggcgcagcccgactcggtgtactgcagtaatgactgtatcctcaaacacgccgcagcgacaatgaagtttctaagctcaggtaaagaacagaagccaaagcctaaagaaaagatgaagatgaagccagagaagcccagtcttccgaaatgcggtgctcaggcaggtattaaaatctcttctgtgcacaagagaccagctccagaaaaaaaagagaccacagtgaagaaggcagtggtggtccctgcgcggagtgaagcactcgggaaggaagcagcttgtgagagcagcacgccgtcgtgggcgagcgatcacaattacaatgcagtaaagccagaaaagactgctgctccctcgccgtcactgttgtataaatccacgaaggaagacaggaggtccgaggagaaagcggcagccatggcagcctcaaagaaaacagcccctccaggctccgcggtgggcaagcagcctgcacctagaaacctcgtgccaaagaagtcttcttttgctaatgtggcagcagccacaccagccattaaaaagccaccctcaggtttcaagggcaccatccccaagaggccatggctctccgctaccccatcgagtggtgcttcagctgccaggcaggccggaccggcacctgcagcggcaacggctgcctccaagaagttccctggctccgctgctttggtgggagccgtaaggaagccagtggtaccttctgttccaatggcctcgccagccccaggacgccttggggctatgagtgctgcaccatcgcagccaaattcacaaattcggcaaaatatcagacgctccttaaaagagattttgtggaaaagagtcaatgacagcgatgacttaatcatgacagaaaacgaagtaggaaaaattgccctccatattgagaaggagatgtttaacttgtttcaagttacagataatcgctacaagagtaaatatcgcagcatcatgttcaacctgaaggaccctaaaaatcagggactcttccatcgtgttctgcgtgaggaaatctctttggcgaaacttgtgagactgaagccagaagaacttgtatctaaagagctttccacgtggaaagagaggccagcgagatctgtgatggagtccagaactaaactgcacaatgaaagcaagaagacggcccccaggcaggaggccatccccgatctggaggactctccgccagtgtcggattcagaggaacagcaagagtcagcacgtgctgtccctgagaagagcacagcgccgcttctcgacgtcttcagcagcatgttgaaagacaccaccagtcagcaccgcgcacacctcttcgatctcaactgtaaaatttgcacaggccaggttccctccgcagaagatgagccagctccgaaaaaacaaaaattgtcagcttctgttaagaaagaagacttaaaatcaaagcatgacagctctgcacctgacccagctccggattcagctgatgaggtgatgccggaggctgtgcctgaagttgcctctgagccaggcctagaaagtgcttctcatccaaatgtggacagaacgtatttccctgggcctccaggagatggccatcccgagccctccccgctggaagacctgtccccctgcccagcctcctgtgggagcggggtggtcaccaccgtcacagtgtccggccgggaccccaggaccgctccaagcagttcatgcacagccgtggcctccgcagcatcccgcccagacagcacccacatggtggaagccagacaggatgtgccgaagcctgtcttgacttctgtgatggtgcccaagtccatactagctaagccatcctcatctcctgacccaagatacctgtcagttcctccgtcaccaaatatcagcacttcagaatcacgttcccctccagagggagacacgaccctctttttgtctcgactcagcaccatttggaaaggatttattaacatgcagagtgtggcaaaatttgtcactaaggcgtatcctgtctctgggtgttttgattacctcagtgaggatttgcctgacacaattcacattggtgggaggatcgcaccgaagacagtttgggattatgttggcaaactcaagtcttctgtgtctaaggagctctgtctgatccgcttccaccccgccacagaggaagaggaggtcgcctatatctctctctactcctatttcagcagccgtggccgctttggtgttgtagctaataacaacaggcacgtcaaggacctctacctgatcccgctgagcgcccaggaccctgttccatccaaactcttgccctttgagggaccaggtcttgagtcaccacgtccgaatataattcttgggttagtaatctgccaaaaaatcaaacgtcccgcaaacagtggagagttagacaagatggacgaaaagcggacccgacttcaaccggaagaagcggacgttccggcctatccaaaagtagccacagtcccgcagtcggaaaagaagccctccaagtatccactctgctctgcagacgcggctgtcagcaccacacctcctgggtcgccgccgcctccgccccctcttccagaaccaccggtgctaaaagtgctgtcatccctcaaacctgcagcccccagcccagccacagcagccacaacagcagcggcagcctccacggcagcttcctccaccgcttcgtctgcttccaaaacagcatcaccgctggagcacatcctgcagactctctttggaaagaagaaatcattcgacccgtccgccagagagcctcccgggtccaccgcaggtctcccccaggagcccaaaaccacagcagaggacggggtgccggcacctccgttgttagatccgatcgtccagcagttcggtcagttctcaaaagataaggctctagaggaagaggaggacgacaggccatacgaccctgaggaggagtacgacccggagagggccttcgacactcagcttgtggagcgagggcggcgccacgaggtggaaagggctcctgaagcagctgcagccgagcgggaagaggtggcctatgaccccgaggatgagaccatcttagaagaagcgaaagtgactgttgatgacctgcccaacaggatgtgtgccgacgtgagaaggaactccgtggagaggcctgccgagccggtggccggggctgcgacgccctccctggtggagcaacagaagatgctagaagagctgaacaaacagatcgaggagcagaagagacagctggaggagcaagaagaagctctcaggcagcagagggccgccgtcggggtctccatggcccacttctcggtgtcggacgccttgatgtctccaccaccaaagtcgtccttgcccaaggcagagctgttccagcaagagcagcagtctgcagacaagcccgcctcactgccccccgccagccaggcgtcaaaccacagggacccccggcaggcgaggcgcctggccactgagaccggtgagggggagggggagcctctctccaggctctcggcacgtggtgcccagggtgccctgcccgagagagatgcttccaggggtggcctcgtgggccaggcgcccatgccagtcccggaggaaaaagagccagcctcttccccctgggcttcgggcgaaaagcccccagcggggtccgagcaggacggctggaaggcagagcctggggagggcacccgccccgccacggttggagacagctcggccaggcctgcccggagggtgctgctgcccacaccgccttgcggcgccctgcagcccggcttcccgctgcagcacgacggtgagagggaccctttcacctgcccggggttcgcgtcgcaggacaaggctctcggctcagcccagtatgaggacccaagaaatcttcattctgctggaaggagcagcagccctgcaggtgaaacagagggggacagagagccacaggccagacccggcgagggcaccgccccgctccccccaccaggacagaaagtggggggctctcagcccccgtttcagggtcagcgggaacctggacctcatgctttggggatgtcagggcttcacggccccaatttcccgggaccaagggggccagcccctccgtttccagaagagaatatcgcttctaacgatgggccacgagggcctccgccagccagattcggagcccagaaggggcccatcccttccttattctcggggcaacatgggccacctccttatggggacagcagaggcccctcaccctcttaccttggtggaccacgaggagtggcaccatcccaatttgaagaacgcaaggatccccatggggagaagagggagttccaggacgccccgtataacgaggtgacgggcgcccccgcccagtttgaagggacagagcaagccccatttctgggaagcagaggcggcgcgcctttccagttcggaggccagagaaggccactgctgtctcagctgaaaggcccccgaggcggcccccctccctctcagtttggaggtcagagaggaccaccccctggtcatttcgtgggcccaagagggccccatcctagtcagtttgaaactgcccggggccctcatcccaaccagtttgaaggacccagaggccaagcgcctaactttatgccaggtcccaggggcattcagcctcagcagttcgaagaccagagggtccattcaccaccaagattcacaaaccaaagggcgcctgcacccctgcagtttggtggactacgggggtccgcacccttttctgaaaaaaatgagcagaccccttcgcgatttcacttccagggccaggccccgcaggtgatgaagccgggccccaggcccctgctggagcttcccagccaccccccgcagcaccggaaggaccgctgggaggaggccgggccgccctccgcgctctcctccagtgcgcccggacagggccccgaggccgacggacagtgggcatcggccgacttccgagaggggaaaggccacgaatacagaaaccagactttcgaagggaggcagagagagcggtttgacgtggggcccaaagagaagccgctggaggagcccgacgcccagggccgggcgtccgaggacaggaggagagagcgcgagcgcggccgaaactggagccgagagcgggactgggaccggccccgggagtgggaccgacaccgggacaaggactccagccgggactgggacagaaaccgggagaggagcgccaaccgcgaccgagagcgcgaggccgaccggggcaaggagtgggaccgcagccgggagcggagcaggaaccgagagcgcgagcgagaccggaggcgcgaccgggaccggtcccggagcagagagcgggaccgagacaaggccagggacagggagcggggccgcgaccgcaaggaccggagcaagagcaaagagagcgctcgggacccgaagcccgaggcctcgagggcctccgacgctggcaccgcctcgcaggcctagacgccccggccgggcagagaccctttttaaagccacgttcgtaagatgcgttgaacaaatagcttttgaaatagccacgatcttagattcaggatagaatattctggacttaaacattactgtaattttgtgtaaatggtttcttacaagatttcacatctttacaattctgatgcttttttaaaaaaactaaactttaatatttccatttaaaattaaaagaaatgggaaattgcctacggagcatattgcttttcagatcatagttatcttttccaataactttattgtaaattttaagggagtttcgttggaccctagagccataccttcactgacatctcatccgtttgtgtttccaaaagctgcttttacaggtcttagccgccgccccggaggccggtgtgggcgtgacctgcaggcgtccaccctgcggctacgggagaagtcttagtagcttgtatctggagtcttgagaaacacaaaccttacaaatgcatctttcttttgtcataaaattggaattacaattttcaactgggaaacagaaacacatttcttagcgtgctcagattttatatatcaccttatcaattttttccaaaacatgatttaaagcaacatctgtcctagtataattgttgcattttaaataacaatttattgaaaaatgttaagttttaccagcctaaaaaaagtaacaaaccaattaagtgtactttgggggcagggaggagtccttgatttgaataatcaggagttttgttggtccagtttcgccttctgagcagttcttctgtatcccgggaaaagtacgctcggccccaaactggtatttgtcagacgatacatgtaaaagtttgtccttgaacgtggaacaagacttgtgtaaagtctgagacgggaactagtgatcactagctcaagaactgcaaatgagacaggaagctgttcactgtgaaacagtctcttgcttgtcgtgtatttttcgagtacttctgaagtgtgaagtaaaaaaatctggctaatttatttgtacaaatacactttgataattttttatattttcataaacttttacagatgtaaaattaaagaacttcacttgttctttggagtctgttattccattgtacgtcactacagatttttcactttatagcacagattttttaagttaagaaaacattgagaatgtatcagtttgagatgtttggtgttgaaagccaagtgtccataggttaaattacattaaagtaggtgtcacgttccaacatctagtacgatgagaaggttttgtttgtttaacatataaagcaaatttttctaatttaaatacacaaatgtaaaaatcaagtgtgtttctttagtttacttgatagagattcctgtacattgtattttatattgcggaggcttatatcactgtacatgagaacatggaacgacctaggttttgttactcgcagtagaataaacagctacaggaa

SEQ ID NO: 2382 - DNA, 2369 bp, Homo sapiens
agacagagtcttgctctgttgcggaggctggagtgcagtgatctcagctcactggaagctccgcctcctgggttcaagcgattctcctatctcaacctcccaagtgtgccaccacacctgccgaatgtttgtgtttttagtagggatggggttcgccatgttgggcaggctggtctcaaactcctgacctcaagtgatctgcccgcctcggcctcccagagtgctgggattataggcgtgagccaccatgcctggacatgaccctgtctctaaaacaatgtaatgaactgcagctcattcttgtgtgcacttttctgcaccccctttcccttaacacttactattgtctggcatgctacgtgttttcttgatctcattagcctctcccaccccaactgccacactgcactatcagagggcagcacttatcactgctgtagaacaaagtcctgcactgagccgatggcccagaaattttctttttatttatttatttattttttttttgagacagagtcttactctgtcgctcaggctggagtgtagtggcgcgatctcagctcactgcaacctctgcctcctggtttcaagcaattctccttcctcagcctccagagtagctgggattacacgcgcctgccaccgcgcctggctaatttttgtatttttagtagagatggggtttcaaccatgttggccaggctggtctcaaactcctgacctcaggtgatcctgcccacctaagcctcccaaaatgctggtattacaggcatgagccaccgtgcccggcctaaatatttaataaaataatggacgatgggtgccttctactgagctcccggtaattgtgagtgagtagaggacttgccctggggacattcagtgacctgctgggtgttgctgagctgtgaggaagttcaggtctggctgcagtggtgaggctgtgactcaatcaatcactgctgatgctcccaggacctgcaccagcttagtcctaggggcaaggattttaactgtccacctcagtttcttcatttgtaagatgcaaataacagtcacccctgcctcatgggatggagctgtgtaatgcccgcaacagtgcctgctgcatagaggggttgctgccagctgcctctccctccttgtctcttacctgcctgctgcctgggtcaggatgaagaggggcccttgtgttgcccccaccctggctgcctgctaagggcccatgtgatctgcctggcagaggagtttcttcaggaagaaccagggcagcttctgcccctagagggccaatgcccttgctgtgagaagtcactgctttggggagacctgatctggctgtgccagatggacactgagaaagaagtagaagactcagaattagaagaggaacatggagctgatccaggacacctcccgcccgccactggagtacgtgaagggggtcccgctcatcaagtactttgcagaggcactggggcccctgcagagcttccaagcccgacctgatgacctgctcatcaacacctaccccaagtctggcaccacctgggtgagccagatactggacatgatctaccagggcggcgacctagagaagtgtaaccgggctcccatctacgtacgggtgcccttccttgaggtcaatgatccaggggaaccctcagggctggagactctgaaagacacaccgcccccacggctcatcaagtcacacctgcccctggctctgctccctcagactctgttggatcagaaggtcaaggtggtctatgttgcccgaaacccaaaggacgtggcggtctcctactaccatttccaccgtatggaaaaggcgcaccctgagcctgggacctgggacagcttcctggaaaagttcatggctggagaagtgtcctacgggtcctggtaccagcacgtgcaggagtggtgggagctgagccgcacccaccctgttctctacctcttctatgaagacatgaaggagaaccccaaaagggagattcaaaagatcctggagtttgtggggcgctccctgccagaggagaccatggacttcatggttcagcacacgtcgttcaaggagatgaagaagaaccctatgaccaactacaccaccgtcccccaggagctcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatctaccctgaccaatgggctcaagaataaagtatgatttttgagtcaggc

SEQ ID NO: 2383 - DNA, 1851 bp, Homo sapiens
gattgtgggaaggcagctgaactcggcgcctggaaagatggaggcagcggagacagaggcggaagctgcagccctagaggtcctggctgaggtggcaggcatcttggaacctgtaggcctgcaggaggaggcagaactgccagccaagatcctggttgagtttgtggtggactctcagaagaaagacaagctgctctgcagccagcttcaggtagcggatttcctgcagaacatcctggctcaggaggacactgctaagggtctcgaccccttggcttctgaagacacgagccgacagaaggcaattgcagctaaggaacaatggaaagagctgaaggccacctacagggagcacgtagaggccatcaaaattggcctcaccaaggccctgactcagatggaggaagcccagaggaaacggacacaactccgggaagcctttgagcagctccaggccaagaaacaaatggccatggagaaacgcagagcagtccagaaccagtggcagctacaacaggagaagcatctgcagcatctggcggaggtttctgcagaggtgagggagcgtaagacagggactcagcaggagcttgacagggtgtttcagaaacttggaaacctgaagcagcaggcagaacaggagcgggacaagctgcagaggtatcagaccttcctccagcttctgtataccctgcagggtaagctgttgttccctgaggctgaggctgaggcagagaatcttccagatgataaaccccagcagccgactcgaccccaggagcagagtacaggagacaccatggggagagaccctggtgtgtccttcaaggctgttggtctacaacctgctggagatgtaaatttgccatgacttcctggaggacagcagcatggagaaagatcctagaaaaggtcagacccaactcaggccttggtgtccctggactgcaagtgtggaaggagggaaagcctggtttacctctctctgcatctgagctctgctacccatggagcagatggatggtgggaacaggaaagagcttatgttacacctcattcccatgcttagcccacccagagctaacccctgtcttcttccccaggcctctgacttccctcacctcccaaccatcattacaggaaagactgtgaactcctgagttcagcttgatttctgactacatcccagcaagctctggcatctgtggattaaaatccctggatctctctcagttgtgtatttgttcatcttcatatgctggcaggaacaactattaatacagatactcagaagccaataacatgacaggagctgggactggtttgaacacagggtgtgcagatggggagggggtactggccttgggcctcctatgatgcagacatggtgaatttaattcaaggaggaggagaatgttttaggcaggtggttatatgtgggaagataattttattcatggatccaaatgtttgttgagtcctttctttgtgctaaggttcttgcggtgaaccagaattataacagtgagctcatctgactgttttaggatgtacagcctagtgttaacattcttggtatctttttgtgccttatctaaaacatttctcgatcactggtttcagatgttcatttattatattcttttcaaagattcagagattggcttttgtcatccactattgtatgttttgtttcattgacctctagtgataccttgatctttcccactttctgttttcggattggagaagatgtaccttttttgtcaactcttacttttatcagatgatcaactcacgtatttggatctttatttgttttctcaaataaatatttaaggttatacattt

SEQ ID NO: 2384 - DNA, 1615 bp, Homo sapiens
atggggacagtcacagaagatcttattagacggaatgctgaacacaacgactgtgtcattttttccctggaggaactctcgttgcatcagcaagaaatagaaagactagaacacattgataaatggtgccgggatttaaaaattctctatcttcaaaataatcttattgggaaaattgaaaatgttagcaaactcaagaaacttgaatatttgaatttagctttaaacaacattgaaaaaatagaaaacttggaaggatgtgaagagctggcaaaacttgacctgactgtgaatttcattggagagctgagcagcattaaaaacttgcagcacaatatccatctgaaggagctctttctcatggggaacccatgtgcttcctttgaccactatagggagttcgtggtagcaactcttccacaattaaagtggttggatggtaaagaaatagagccttcagaaaggattaaggcattgcaggactattcagtaattgaaccacaaatcagagagcaggaaaaagatcactgtcttaaacgagccaaactcaaggaagaggctcagaggaaacaccaagaagaggataaaaatgaagacaagagaagtaacgcaggctttgatggacgttggtacacagacatcaatgctactctttcctctttagagagcaaagaccacctacaggcaccagacacagaggaacacaacacaaagaaattagacaacagtgaagatgacttggaattctggaataagccctgtttgtttactcctgaatcaagattggaaactcttagacacatggaaaaacaacggaagaaacaggaaaaattaagtgaaaaaaagaagaaagtgaaaccacccaggactttgatcactgaagatgggaaagccctaaatgtgaatgagcccaaaattgacttctctttgaaagataacgaaaagcagatcatcctggaccttgctgtctataggtatatggatacctctttaatcgatgttgatgtgcaaccaacttacgtgcgagtaatgatcaaaggaaagccatttcagcttgtccttcctgcagaagtgaaacccgatagtagttctgctaaaagatctcagacaacgggtcatttggtcatctgcatgcccaaggtaggagaagtaatcacaggtggtcagcgagcattcaaatctatgaaaactacctcggacaggagcagagaacaaacaaatacaagctattctactggattctagaggtgatgtttctgacagtcaggtcgtgggtaagaccagtgatgggcgtccgtcctagaggcctctgacattaaggcggggaaagcaaagaagcaagcacatggagaaactagaagtagaccctagcaagcactcattccctgatgtgactaacatagttcaagagaaaaaacacacacccagaagacgacctgaacccaaaattataccaagtgaggaagacccaacctttgaagacaaccctgaagtgcctccgctgatttgaaacatctggctgcgttgccattggctgagacccaccaggtccagttttggttggtgtagagaccatatgcatattattcctgggataaacacagagttatttgtc

SEQ ID NO: 2385 - DNA, 2954 bp, Homo sapiens
cttcggagtcggcggtggtcgtccagaccgagtgttctttactttttgtttggttgaggtttcacgctagaaggtggctcaggatgtcttcatcacattttgccagtcgacacaggaaggatataagtactgaaatgattagaactaaaattgctcataggaaatcactgtctcagaaagaaaatagacataaggaatacgaacgaaatagacactttggtttgaaagatgtaaacattccaaccttggaaggtagaattcttgttgaattagatgagacatctcaagggcttgttccagaaaagaccaatgttaagccaagggcaatgaaaactattctaggtgatcaacgaaaacagatgctccaaaaatacaaagaagaaaagcaacttcaaaaattgaaagagcagagagagaaagctaaacgaggaatatttaaagtgggtcgttatagacctgatatgccttgttttcttttatcaaaccagaatgctgtgaaagctgagccaaaaaaggctattccatcttctgtacggattacaaggtcaaaggccaaagaccaaatggagcagactaagattgataacgagagtgatgttcgagcaatccgacctggtccaagacaaacttctgaaaagaaagtgtcagacaaagagaaaaaagttgtgcagcctgtaatgcccacgtcgttgagaatgactcgatcagctactcaagcagcaaagcaggttcccagaacagtctcatctaccacagcaagaaagccagtcacaagagctgctaatgaaaacgaaccagaaggaaaggtgccaagtaaaggaagacctgccaaaaatgtagaaacaaaacccgacaagggtatttcttgtaaagtcgatagtgaagaaaatactttgaattcacaaactaatgcaacaagtggaatgaatccagatggagtcttatcaaaaatggaaaacttacctgagataaatactgcaaaaataaaagggaagaattcctttgcacctaaggattttatgtttcagccactggatggtctgaagacctatcaagtaacacctatgactcccagaagtgccaatgcttttttgacacccagttacacctggactcctttaaaaacagaagttgatgagtctcaagcaacaaaagaaattttggcacaaaaatgtaaaacttactctaccaagacaatacagcaagattcaaataaattgccatgtcctttgggtcctctaactgtttggcatgaagaacatgttttaaataaaaatgaagctactactaaaaatttaaatggccttccaataaaagaagtcccatcacttgaaagaaatgaaggtcgaattgctcagccccaccatggtgtgccatatttcagaaatatcctccagtcagaaactgagaaattaacttcacattgcttcgagtgggacaggaaacttgaattggacattccagatgatgctaaagatcttattcgcacagcagttggtcaaacaagactccttatgaaggaaaggtttaaacagtttgaaggactggttgatgattgtgaatataaacgaggtataaaggagactacctgtacagatctggatggattttgggatatggttagttttcagatagaagatgtaatccacaaattcaacaatctgatcaaacttgaggaatctgggtggcaagtcaataataatatgaatcataatatgaacaaaaatgtctttaggaaaaaagttgtctcaggtatagcaagtaaaccaaaacaggatgatgctggaagaattgcagcgagaaatcgcctagctgccataaaaaatgcaatgagagagagaattaggcaggaagaatgtgctgaaacagcagtttctgtgataccaaaggaagttgataaaatagtgttcgatgctggatttttcagagttgaaagtcctgttaaattattctcaggactttctgtctcttctgaaggcccttctcaaagacttggaacacctaagtctgtcaacaaagctgtatctcagagtagaaatgagatgggcattccacaacaaactacatcaccagaaaatgccggtcctcagaatacgaaaagtgaacatgtgaagaagactttgtttttgagtattcctgaaagcaggagcagcatagaagatgctcagtgtcctggattaccagatttaattgaagaaaatcatgttgtaaataagacagacttgaaggtggattgtttatccagtgagagaatgagtttgcctcttcttgctggtggagtagcagatgatattaatactaacaaaaaagaaggaatttcagatgttgtggaaggaatggaactgaattcttcaattacatcacaggatgttttgatgagtagccctgaaaaaaatacagcttcacaaaatagcatcttagaagaaggggaaactaaaatttctcagtcagaactatttgataataaaagtctcactactgaatgccaccttcttgattcagtgggatcttgctatgttgctcgggctggtcttgaagtcctgggttcaagtgatcctaccacctcagcctcccgagtagctgggactacagccaggtctaaactgcagtaatccatttactcagctggagaggagacatcaagaacatgccagacacatttcttttggtggtaacctgattactttttcacctctacaaccaggagaattttgaatttaaaaataaatccaaacattttccttcatattatcaatgcttatatattccttagactattgaaattttggagaaaatgtatttgtgttcacttctatagcatataatgttttaatattctgtgttcatcaaagtgtattttagatatactctttctcaagggaagtggggatattttgtacattttcaacacagaataaaaaatgtactgtgccttgcctctcttgtttaaaagg

SEQ ID NO: 2386 - DNA, 1872 bp, Homo sapiens
atgctttgcagtccatcattttgcaaactttgctggaaaaggcagagggaaaatggacaaagaaaatatggtggccctccacctggttgggatgctgcaccccctgaaaggggctgtgaaatttttattggaaaacttccccgagacctttttgaggatgagcttataccattatgtgaaaaaatcggtaaaatttatgaaatgagaatgatgatggattttaatggcaacaatagaggatatgcatttgtaacattttcaaataaagtggaagccaagaatgcaatcaagcaacttaataattatgaaattagaaatgggcgcctcttaggggtttgtgccagtgtggacaactgccgattatttgttgggggcatcccaaaaaccaaaaagagagaagaaatcttatcggagatgaaaaaggttactgaaggtgttgtcgatgtcatcgtctacccaagcgctgcagataaaaccaaaaaccgaggctttgccttcgtggagtatgagagtcatcgagcagctgccatggcgaggaggaaactgctaccaggaagaattcagttatggggacatggtattgcagtagactgggcagagccagaagtagaagttgatgaagatacaatgtcttcagtgaaaatcctatatgtaagaaatcttatgctgtctacctctgaagagatgattgaaaaggaattcaacaatatcaaaccaggtgctgtggagagggtgaagaaaattcgagactatgcttttgtgcacttcagtaaccgagaagatgcagttgaggctatgaaagctttaaatggcaaggtgctggatggttcccccattgaagtcaccctagcaaaaccagtggacaaggacagttatgttaggtatacccgaggcacaggtggaaggggcaccatgctgcaaggagagtatacctactctttgggccaagtttatgatcccaccacaacctaccttggagctcctgtcttctatgccccccagacctatgcagcaattcccagtcttcatttcccagccaccaaaggacatctcagcaacagagccattatccgagccccttctgttagaggggctgcgggagtgagaggactgggcggccgtggctatttggcatacacaggcctgggtcgaggataccaggtcaaaggagacaaaagagaagacaaactctatgacattttacctgggatggagctcaccccaatgaatcctgtcacattaaaaccccaaggaattaaactcgctccccagatattagaagagatttgtcagaaaaataactggggacagccagtgtaccagctgcactctgctattggacaagaccaaagacagctattcttgtacaaaataactattcctgctctagccagccagaatcctgcaatccaccctttcacacctccaaagctgagtgcctttgtggatgaagcaaagacgtatgcagccgaatacaccctgcagaccctgggcatccccactgatggaggcgatggcaccatggctactgctgctgctgctgctactgctttcccaggatatgctgtccctaatgcaactgcacccgtgtctgcagcccagctcaagcaagcggtaacccttggacaagacttagcagcatatacaacctatgaggtctacccaacttttgcagtgactgcccgaggggatggatatggcaccttctgaagatgcttttttaaatttaagaataagacacacaaaactctattaaaaaaaaaaaagaaataaacctctaactcggtccccaatgatcataaataatatgtttcctaaagaaatgcctttccagagactgtatagcttataccaattatagaatcatgaagt

SEQ ID NO: 2387 - DNA, 2230 bp, Homo sapiens
ataatcaaggaaaccttttccgggtggggatctctgaaattactcagataacagtgctgtgccaaaaacctgtggattttctctacaaaaattatcatgactgttatctttttgatggaaaagatgaagttcagcgaagaacaaatctacaacttggccagaagactgtagactttgccttcaaagagtgagcaaccctaattaacctgattttttgctgataatcactctcaatggaatcaaatcacaaatccggggatggattgagcggcactcagaaggaagcagccctccgcgcactggtccagcgcacaggatatagcttggtccaggaatttagaggttcctatagatggaagcagtgtgtctgggcacatgcccagagccagaagcgagcatgagcacagcaattcctggcctcaaaaaaggaaataatgctttgcagtccatcattttgcaaactttgctggaaaaggaaaatggacaaagaaaatatggtggccctccacctggttgggatgctgcaccccctgaaaggggctgtgaaatttttattggaaaacttccccgagacctttttgaggatgagcttataccattatgtgaaaaaatcggtaaaatttatgaaatgagaatgatgatggattttaatggcaacaatagaggatatgcatttgtaacattttcaaataaagtggaagccaagaatgcaatcaagcaacttaataattatgaaattagaaatgggcgcctcttaggggtttgtgccagtgtggacaactgccgattatttgttgggggcatcccaaaaaccaaaaagagagaagaaatcttatcggagatgaaaaaggttactgaaggtgttgtcgatgtcatcgtctacccaagcgctgcagataaaaccaaaaaccgaggctttgccttcgtggagtatgagagtcatcgagcagctgccatggcgaggaggaaactgctaccaggaagaattcagttatggggacatggtattgcagtagactgggcagagccagaagtagaagttgatgaagatacaatgtcttcagtgaaaatcctatatgtaagaaatcttatgctgtctacctctgaagagatgattgaaaaggaattcaacaatatcaaaccaggtgctgtggagagggtgaagaaaattcgagactatgcttttgtgcacttcagtaaccgagaagatgcagttgaggctatgaaagctttaaatggcaaggtgctggatggttcccccattgaagtcaccctagcaaaaccagtggacaaggacagttatgttaggtatacccgaggcacaggtggaaggggcaccatgctgcaaggagagtatacctactctttgggccaagtttatgatcccaccacaacctaccttggagctcctgtcttctatgccccccagacctatgcagcaattcccagtcttcatttcccagccaccaaaggacatctcagcaacagagccattatccgagccccttctgttagagaaatttacatgaatgtacctgtaggggctgcgggagtgagaggactgggcggccgtggctatttggcatacacaggcctgggtcgaggataccaggtcaaaggagacaaaagagaagacaaactctatgacattttacctgggatggagctcaccccaatgaatcctgtcacattaaaaccccaaggaattaaactcgctccccagatattagaagagatttgtcagaaaaataactggggacagccagtgtaccagctgcactctgctattggacaagaccaaagacagctattcttgtacaaaataactattcctgctctagccagccagaatcctgcaatccaccctttcacacctccaaagctgagtgcctttgtggatgaagcaaagacgtatgcagccgaatacaccctgcagaccctgggcatccccactgatggaggcgatggcaccatggctactgctgctgctgctgctactgctttcccaggatatgctgtccctaatgcaactgcacccgtgtctgcagcccagctcaagcaagcggtaacccttggacaagacttagcagcatatacaacctatgaggtctacccaacttttgcagtgactgcccgaggggatggatatggcaccttctgaagatgcttttttaaatttaagaataagacacacaaaactctattaaaaaaaaaaaagaaataaacctct

SEQ ID NO: 2388 - DNA, 1970 bp, Homo sapiens
tttgatatgacgattagagcataacccgagtgacacgttgaattcgccataatcaaggaaaccttttccgggtggggatctctgaaattactcagataacagtgctgtgccaaaaacctgtggattttctctacaaaaattattgagcaaccctaattaacctgattttttgctgataatcactctcaatggaatcaaatcacaaatccggggatggattgagcggcactcagaaggaagcagccctccgcgcactggtccagcgcacaggatatagcttggtccaggaaaatggacaaagaaaatatggtggccctccacctggttgggatgctgcaccccctgaaaggggctgtgaaatttttattggaaaacttccccgagacctttttgaggatgagcttataccattatgtgaaaaaatcggtaaaatttatgaaatgagaatgatgatggattttaatggcaacaatagaggatatgcatttgtaacattttcaaataaagtggaagccaagaatgcaatcaagcaacttaataattatgaaattagaaatgggcgcctcttaggggtttgtgccagtgtggacaactgccgattatttgttgggggcatcccaaaaaccaaaaagagagaagaaatcttatcggagatgaaaaaggttactgaaggtgttgtcgatgtcatcgtctacccaagcgctgcagataaaaccaaaaaccgaggctttgccttcgtggagtatgagagtcatcgagcagctgccatggcgaggaggaaactgctaccaggtgctgtggagagggtgaagaaaattcgagactatgcttttgtgcacttcagtaaccgagaagatgcagttgaggctatgaaagctttaaatggcaaggtgctggatggttcccccattgaagtcaccctagcaaaaccagtggacaaggacagttatgttaggtatacccgaggcacaggtggaaggggcaccatgctgcaaggagagtatacctactctttgggccaagtttatgatcccaccacaacctaccttggagctcctgtcttctatgccccccagacctatgcagcaattcccagtcttcatttcccagccaccaaaggacatctcagcaacagagccattatccgagccccttctgttagagaaatttacatgaatgtacctgtaggggctgcgggagtgagaggactgggcggccgtggctatttggcatacacaggcctgggtcgaggataccaggtcaaaggagacaaaagagaagacaaactctatgacattttacctgggatggagctcaccccaatgaatcctgtcacattaaaaccccaaggaattaaactcgctccccagatattagaagagatttgtcagaaaaataactggggacagccagtgtaccagctgcactctgctattggacaagaccaaagacagctattcttgtacaaaataactattcctgctctagccagccagaatcctgcaatccaccctttcacacctccaaagctgagtgcctttgtggatgaagcaaagacgtatgcagccgaatacaccctgcagaccctgggcatccccactgatggaggcgatggcaccatggctactgctgctgctgctgctactgctttcccaggatatgctgtccctaatgcaactgcacccgtgtctgcagcccagctcaagcaagcggtaacccttggacaagacttagcagcatatacaacctatgaggtctacccaacttttgcagtgactgcccgaggggatggatatggcaccttctgaagatgcttttttaaatttaagaataagacacacaaaactctattaaaaaaaaaaaagaaataaacctctaactcggtccccaatgatcataaataatatgtttcctaaagaaatgcctttccagagactgtatagcttataccaattatagaatcatgaagt

SEQ ID NO: 2389 - DNA, 1442 bp, Homo sapiens
tttagcctcttccctgcagtggacaatgaggaggctgcactgctgcatgaagaggctaccatgactattgaagagctgctgacacgctacgggcagaactgtcacaagggccctccccacagcaaatctggagcctctgacaagctgcctcgagttgctaagtccaagttctttgaggacagtgaggatgagtcagatgaggcggaggaagaagaggaagacagtgaggaatgcagcgaggaagaggatggctacagcagtgaggaggcagagaatgaggaagatgaggatgacaccgaggaggctgaagaggacgatgaagaagaagaagaagagatgatggtgccagggatggaaggcaaagaggagcctggctctgacagtggtacaacagcggtggtggccctgatacgagggaagcagttgattgtagccaacgcaggagactctcgctgtgtggtatctgaggctggcaaagctttagacatgtcctatgatcacaaaccagaggatgaagtagaactagcacgcatcaagaatgctggtggcaaggtcaccatggatgggcgagtcaacgggggcctcaacctctccagagccattggggaccacttctataagagaaacaagaacctgccacctgaggaacagatgatttcagcccttcctgacatcaaggtgctgactctcactgacgaccatgaattcatggtcattgcctgtgatggcatctggaatgtgatgagcagccaggaagttgtagatttcattcaatcaaagatcagccagcgtgatgaaaatggggagcttcggttattgtcatccattgtggaagagctgctggatcagtgcctggcaccagacacttctggggatggtacagggtgtgacaacatgacctgcatcatcatttgcttcaagccccgaaacacagcagagctccagccagagagtggcaagcgaaaactagaggaggtgctctctactgagggggctgaagaaaatggcaacagcgacaagaagaagaaggccaagcgagactagcagtcatccagacccctgcccacctagactgttttctgagccctccggacctgagactgagttttgtctttttcctttagccttagcagtgggtatgaggtgtgcagggggagctgggtggcttcactccgcccattccaaagagggctctccctccacactgcagccgggagcctctgctgtccttcccagccgcctctgctcctcgggctcatcaccggttctgtgcctgtgctctgttgtgttggagggaaggactggcggttctggtttttactctgtgaactttatttaaggacattcttttttattggcggctccatggccctcggccgcttgcacccgctctctgttgtacactttcaatcaacactttttcagactaaaggccaaaacct

SEQ ID NO: 2390 - DNA, 1902 bp, Homo sapiens
actgccgctgccgcggctacctgcggttcatctccgcacattccacacgcggcccaaacggtctctctctctctctctcaaacaccgcctttccgtctttgttttatcttgagtagcttagaaagattggagaagaaagcttacgtggaatgaaaatcaacttttatggatattttgaggactaaaagaataaatagggcgtccgtactgtagcgaaagtgcgactaaggttaggcatctggatttcccccgtagccctctttcaccccccccccccggccattaccgaagcggatgaaaacaaacactaacgatggcggcgccgggaagcgaccggctgctgggcttaaggcgggagtgaccgcttaaccagtgagggaagcactgaagagcgccagtcgacgtgggtgcgacaactcgcggagtcttaggagcaaaacgtctggggcctgcgagccaggacccttctgaagccttaggtgtctatcggcgacgtgtacggtcactgcagctccggagcgcggaaccctcagccaggaggcgcggctggtcggtcccaggtcccggcctccgtaatgagagcccggaaccactctttgtgccgcagcttcgcagcatcttggactcaagtgattctcctgcctcagcctcctgagtagctgggactacagattcctataggcaatggaaactgatctcaattcccaggacagaaaggacctggacaagtttattaaattttttgccctcaagactgtccaagtgattgtccaggctcggcttggtgaaaagatttgcactcgttcatcatcttctccaacgggttcagattggttcaacttagcaatcaaagacatcccagaggttacacatgaagcaaagaaggcactggcaggacagctgcctgcagtcgggaggtccatgtgtgtggagatttcacttaagacttctgagggagattccatggagctggaaatatggtgtcttgaaatgaatgaaaagtgtgataaagaaatcaaagtttcctacacggtgtacaacagactgtcattgctgctgaagtcccttcttgctataactagggtgacaccagcctataggctctccaggaaacaagggcatgaatatgtcatattatacaggatatattttggagaagttcagctgagtggcttaggagaaggcttccagacagttcgtgttgggacagtgggcacccctgtgggcaccatcactctttcttgtgcttacagaattaacttggcattcatgtctaccaggcaatttgagaggaccccacctatcatggggattattattgatcactttgtggaccgtccctatcccagctcctctcccatgcacccctgcaattacagaactgctggtgaggacactggagtaatatacccgtctgtagaagactctcaagaagtgtgtaccacctctttttccacctccccaccatcccagctgatggttcctgggaaggaaggtggggtaccccttgctcccaaccagcctgtccatggtacccaggctgaccaggagagactggcaacctgcaccccttctgacagaacccactgtgctgccacaccctccagtagtgaggatactgaaaccgtatcaaacagcagtgagggacgggcctcccctcacgatgtcttggagaccatctttgtccgaaaagtgggggcttttgtcaacaaacccattaaccaggtgaccctgacgagtttggatataccctttgccatgtttgctcccaagaatttggagctggaggataccgatccaatggtgaatcctccagattccccagagactgaatctcctctccagggcagcctgccttgcagctggccccttccctgcctgctgtcaccatccactgtttga

SEQ ID NO: 2391 - DNA, 3485 bp, Homo sapiens
gtcagtccccgcgcttttcggaggctgccagcgtcccacaccagccgcaggtgaaaaccggcagaaagacattaagagattttcctgcagtcactgctggcagatgatagagccaggatttgaaagcaggcagcctggctccagaccctgtgctcttaactcccgttttgcatcaagaacagaatcctatgaaaggcttgcacagtgcttggatagcagcatcaaggagcattgtgtacatgcagaagtgcacagtacctggagtgaaactgcttgtgttcgatttctgataccattcataactggctgtgtgatctcaaaacctctaaaatgcagacctccagctctagatctgtgcacctgagtgaatggcagaagaattacttcgcaattacatctggcatatgtaccggaccgaaggcagatgcataccgtgcacagatattacgcattcagtatgcatgggcaaactctgagatttcccaggtctgtgctaccaaactgttcaaaaaatatgcagagaaatattctgcaattattgattctgacaatgttgaatctgggttgaataattatgcagaaaacattttaactttggcaggatctcaacaaacagatagtgacaagtggcagtctggattgtcaataaataatgttttcaaaatgagtagtgtacagaagatgatgcaagctggcaaaaaattcaaagactctctgttggaacctgctcttgcatcagtggtaatccataaggaggccactgtctttgatcttcctaaatttagtgtttgtggtagttctcaagagagtgactcattacctaactcagctcatgatcgagaccggacccaagacttcccggagagcaatcgtttgaaactccttcagaatgcccagccacctatggtgactaacactgctaggacttgtcctacattctcagcacctgtaggtgagtcagctactgcaaaattccatgtcacaccattgtttggaaatgtcaaaaaggaaaatcacagctctgcaaaagaaaacataggacttaatgtgttcttatctaaccagtcttgttttcctgctgcctgtgaaaatccacagaggaagtctttttatggttctggcaccattgatgcactttccaatccaatactgaataaggcttgtagtaaaacagaagataatggcccaaaggaggatagcagcctgcctacatttaaaactgcaaaagaacaattatgggtagatcagcaaaaaaagtaccaccaacctcagcgtgcatcagggtcttcatatggtggtgtaaaaaagtctctaggagctagtagatcccgagggatacttggaaagtttgttcctcctatacccaagcaagatgggggagagcagaatggaggaatgcaatgtaagccttatggggcaggacctacagaaccagcacatccagttgatgagcgtctgaagaacttggagccaaagatgattgaacttattatgaatgagattatggatcatggacctccagtaaattgggaagatattgcaggagtagaatttgctaaagccaccataaaggaaatagttgtgtggcccatgttgaggccagacatctttactggtttaaggggaccccctaaaggaattttgctctttggtcctcctgggactggtaaaactctaattggcaagtgcattgctagtcagtctggggcaacattctttagcatctctgcttcatccttaacttctaaatgggtaggtgagggggagaaaatggtccgtgcattgtttgctgttgcaaggtgtcagcaaccagctgtgatatttattgacgaaattgattccttgttatctcaacggggagatggtgagcatgaatcttctagaaggataaaaacagaatttttagttcaattagatggagcaacaacatcttctgaagatcgtatcctagtggtgggagcaacaaatcggccacaagaaattgatgaggctgcccggagaagattggtgaaaaggctttatattcccctcccagaagcttcagccaggaaacagatagtaattaatctaatgtccaaagagcagtgttgcctcagtgaagaagaaattgaacagattgtacagcagtctgatgcgttttcaggagcagacatgacacagctttgcagggaggcttctcttggtcctattcgcagtttacaaactgctgacattgctaccataacaccggatcaagttcgacccatagcttacattgattttgaaaatgcttttagaactgtgcgacctagtgtttctccaaaagatttagagctttatgaaaactggaacaaaacttttggttgtggaaagtaagtgggatacttggaatcaaggcatctctgtagtacagtcttctttattttttagcatagaaagttggggatgtgttaattgtatttttaagaatatattctaagttctgtacttcaaataatagcacagattttacatctgattgacatagtgtatgttaatgtaagttttgctttccagtgattacctgatacgtaagcctatttgaacaaagtgagaatgaacttttgtttctaagaagtctttatcttgaagctatataacatgaaaagtgagctcaaattttttttagttgaagattacatataaagttgtgtctgattaatattcatcttttattgaagaaagtgccttctgatggccacataattcttaatgtcagctagtataatggtttacatttggacaaagtattgcttagtgttatttaagtagatttaagatctcaaagctaaagtgccaatttttactttcttcagccaatttgttacctcttttatggtttttaatttttatcaggactaacattttcagaaatagcaaggtgtgatctagtattagattcacagaactgaaaggttaattaagaatgttggttattttcacgggagcgtgtgatatttaacattaatattttatttgacactacagcctgtaatactgctctctttcaaaaacaagttttcagatttttataacagacccattttgttttatgaaacatgttcattacagaaacatgagaaaatagagataagtaaaaagaataaaagtcactattatcctaccactttgcgggacacactattaatatttaagcatagattcttccagatgttttgttttatacagcagtaggattgtgtaatgtattctctcttgtagcctattcttcaaagcgtatcttcactttccatgttaacataaatgtccttttatgattgtctaggattccatggatggatggaatataattgagtcatctggtagagcgcatataggacaggacgctaggttgtttatcttttgtttattgtaaaggaactatgtgggatgcatttggtgatctttttaaaaaatgtataaatttcttgagtaattcctggattaaagaatatgcactttttaaa

SEQ ID NO: 2392 - DNA, 5546 bp, Homo sapiens
agattagaaacttcgggtggagagggcggcggcgttgaatgtgtggcggaagcgctgggggtcacggctccgcgcgccgccggacagccggcggcgtctccacagcatgaattacccgggccgcgggtccccacggagccccgagcataacggccgaggcggcggcggcggcgcctgggagctgggctcagacgcgaggccagcgttcggcggcggcgtctgctgcttcgagcacctgcccggcggggacccggacgacggcgacgtgcccctggccctgctgcgcggggaacccgggctgcatttggcgccgggcaccgacgaccacaaccaccacctcgcgctggacccctgcctcagtgacgagaactatgacttcagctccgccgagtcgggctcctcgctgcgctactacagcgagggtgagagcggcggcggcggcagctccttgtcgctgcacccgccgcagcagcctccgctggtcccgacgaactcggggggcggcggcgcgacaggagggtcccccggggaaaggaaacgtacccggcttggcggcccggcggcccggcaccgctatgaggtagtgacggagctgggcccggaggaggtacgctggttctacaaggaggacaagaagacctggaagcccttcatcggctacgactcgctccgcatcgagctcgccttccggaccctgctgcagaccacgggtgcccggccccagggcggggaccgggacggcgaccatgtgtgctcccccacgggcccagcctccagttccggagaagatgacgatgaggaccgcgcctgcggcttctgccagagtacgacggggcacgagccggagatggtggagcttgtgaacatcgagcctgtgtgcgtgcggggcggcctctacgaggtggatgtgacccaaggagagtgctacccggtgtactggaaccaggctgataaaataccagtaatgcgtggacagtggtttattgacggcacttggcagcctctagaagaggaagaaagtaatttaattgagcaagaacatctcaattgttttaggggccagcagatgcaggaaaatttcgatattgaagtgtcaaaatccatagatggaaaagatggcagtgggatcaactattctgctgttcatagtttcaagttgagtcgaaaccatgtggactggcacagtgtggatgaagtatatctttatagtgatgcaacaacatctaaaattgcaagaacagttacccaaaaactgggattttctaaagcatcaagtagtggtaccagacttcatagaggttatgtagaagaagccacattagaagacaagccatcacagactacccatattgtatttgttgtgcatggcattgggcagaaaatggaccaaggaagaattatcaaaaatacagctatgatgagagaagctgcaagaaaaatagaagaaaggcatttttccaaccatgcaacacatgttgaatttctgcctgttgagtggcggtcaaaacttactcttgatggagacactgttgattccattactcctgacaaagtacgaggtttaagggatatgctgaacagcagtgcaatggacataatgtattatactagtccactttatagagatgaactagttaaaggccttcagcaagagctgaatcgattgtattcccttttctgttctcggaatccagactttgaagaaaaagggggtaaagtctcaatagtatcacattccttgggatgtgtaattacttatgacataatgactggctggaatccagttcggctgtatgaacagttgctgcaaaaggaagaagagttgcctgatgaacgatggatgagctatgaagaacgacatcttcttgatgaactctatataactaaacgacggctgaaggaaatagaagaacggcttcacggattgaaagcatcatctatgacacaaacacctgccttaaaatttaaggttgagaatttcttctgtatgggatccccattagcagttttcttggcgttgcgtggcatccgcccaggaaatactggaagtcaagaccatattttgcctagagagatttgtaaccggttactaaatatttttcatcctacagatccagtggcttatagattagaaccattaatactgaaacactacagcaacatttcacctgtccagatccactggtacaatacttcaaatcctttaccttatgaacatatgaagccaagctttctcaacccagctaaagaacctacctcagtttcagagaatgaaggcatttcaaccataccaagccctgtgacctcaccagttttgtcccgccgacactatggagaatctataacaaatataggcaaagcaagcatattaggggctgctagcattggaaagggacttggaggaatgttgttctcaagatttggacgttcatctacaacacagtcatctgaaacatcaaaagactcaatggaagatgagaagaagccagttgcctcaccttctgctaccaccgtagggacacagacccttccacatagcagttctggcttcctcgattctgcattggagttggatcacaggattgattttgaactcagagaaggccttgtggagagccgctattggtcagctgtcacgtcgcatactgcctattggtcatccttggatgttgccctttttcttttaaccttcatgtataaacatgagcacgatgatgatgcaaaacccaatttagatccaatctgaactctcttgaaggacatgaatggcctaaaactgattttttttttttccgttaaaatgtgtgtgtcaagatacggagatttcagggttaaagtatatttcagttttctttagggcaacatatatttgaatttaaaagcactttatttaaaaaaaaaagaagttttcagttctgaagaagtcatttacagtttgcatcattttaattatgagtctgacaaaaccttctccagagaatcaagcaagacctggatgtgaagaaggtttgggtaaactgcatgtaaaggctacaaatcacaatctgattcctcccaaatataaaggcatatggaacataatgtattaaccaaagtatgttataaatcaaaaatggtcaaggttcagcatattctatatgaagatcacaaggtggtatcgttttagatttctatgaaggctttcatttgtacatccctttgaaaaaatataacagatttaaaatgttttgaatttaacttgtttagaaaaactaatgcttaaaacaatatttgaactactgtatttataatttattacctctaattgctttatttcagtgtatgagacattactgttttaatgtttgctttgaacataatttaagaaccagatttattttctatagtgataaacccttttttctcagaactccatctttgtactcttcagatgaatatatagacactgtggcatacattttttttcattaaaaacttatggcttcatacaacactagttcaattttttaaataaactttttattatgttacatgtacttcagagaaagctaaagtttctctaaacttgacacggagtactccataatgggtacatttcattagctttattagaaaactagtaaatgcttttgaataggtagtatgacagctattttaaatgtataaacatttgtgtgccaaacaacatatatgaagggatgtgatgccactaactagtgcacattgtttctcaatgtgccattgagacacaaggcacagtaagtcaggattctgaggcattggaagggttttcttcagctgtaattgtttccacagtgcttttcatctgaggggctcaaagtttaagagtgcattcaataacccatgtactagcttcttgaggtaagtaaataaatcttgttctcatgttacatgttaatacaccaaggcaccaaaacatttaaagtgccatgaattagattacatcagaaatcagaaaagcttggattgagctagtcaccgtggttcacgcctgtaatcccaacacttcgggaggccaagatgggaggatctcttgagcccaggatttcaagaccagcttgggcaacatagtgagaccctcttctctgcaaaaactgacaaaaattagccacttgtagtggtgtacacctgtagtcccagctactcaagaggctgaggtgggaggatcacccgagcccagaagttcaaagctgcagtgagctctgatcacaccaatgcactccagcctgggtgacagagccagaccctgtctctaaaaaacaaaaaagaaaagcttgggttgaagccaggccatattcttttatatgctgttcaatgacttgattcacatgtgaccttttagtagtttgcaaacaataataacagaagttgcaattcataattcagagaaatgaccatgaagccggtgtttccctgcttgatttctatgttcttggattctcacacaaaagaggagttacctagaggggatcagtagccatccctgttgcacacaaccctcacttctgagtggtttccactaggttccacttaaggtgctgtcttttcttaacttgcaaggaattgcttagcttcccaataatcattgtcaaactgggagcaaagttggtcagctgtatctctcacctcctcctttcttcataagatagtagaatctgtggcttacttgtaggttttacttagtgcttcagtactgttggctgttttggccttttgctgaatttgcacaacaacataaagcacttctttttaatgtttaaaaaaaattccaaggctccatgaccaagtatgtgactcactaagaaacccttgctataaaaggcttttgatgaaatcttagcaaagctaaattatctctaacttagagattcctatgaactcaggtcattttcatagcctgtttattttgtaggtctaatttagttctcaggaaaattaaactcatgctatatgactgtatcgttaaaggtacttgagcgtatgttgctgtaggtggtatgacactcaaatgcataagaacttgaagggatttattcttaaccactagaatatgaagagccctttttacctgagaagagtgaaattatgtcagaccttttaatttgatatcactgagtaaaaggtatgttcctatagccataggaatatgtctgcttcctttttttcatgttgagaaaacagtcaaatttaaccatttggagtttatttgaattcttggaaagagcaatattcaaaaccttttcaaaaataagatattctggactactggatggatgttttgttttcagttcatttttcatcagtagagatggtgatttcggttttgtagtatccttgtttctatgtctgtgcatgttaacattggatgtatttgtatatacttaattaatatacagactgtgtgtcattctggcttgattagaagctaagtcagttactgagtaacattttgcaactttattccagcaagtactaaatcggccaaaaaaagttttgtttttgataccattaaaattttattctct

SEQ ID NO: 2393 - DNA, 2929 bp, Homo sapiens
ctcgggtcgggatttgaaagattagaaacttcgggtggagagggcggcggcgttgaatgtgtggcggaagcgctgggggtcacggctccgcgcgccgccggacagccggcggcgtctccacagcatgaattacccgggccgcgggtccccacggagccccgagcataacggccgaggcggcggcggcggcgcctgggagctgggctcagacgcgaggccagcgttcggcggcggcgtctgctgcttcgagcacctgcccggcggggacccggacgacggcgacgtgcccctggccctgctgcgcggggaacccgggctgcatttggcgccgggcaccgacgaccacaaccaccacctcgcgctggacccctgcctcagtgacgagaactatgacttcagctccgccgagtcgggctcctcgctgcgctactacagcgagggtgagagcggcggcggcggcagctccttgtcgctgcacccgccgcagcagcctccgctggtcccgacgaactcggggggcggcctctacgaggtggatgtgacccaaggagagtgctacccggtgtactggaaccaggctgataaaataccagtaatgcgtggacagtggtttattgacggcacttggcagcctctagaagaggaagaaagtaatttaattgagcaagaacatctcaattgttttaggggccagcagatgcaggaaaatttcgatattgaagtgtcaaaatccatagatggaaaagatgctgttcatagtttcaagttgagtcgaaaccatgtggactggcacagtgtggatgaagtatatctttatagtgatgcaacaacatctaaaattgcaagaacagttacccaaaaactgggattttctaaagcatcaagtagtggtaccagacttcatagaggttatgtagaagaagccacattagaagacaagccatcacagactacccatattgtatttgttgtgcatggcattgggcagaaaatggaccaaggaagaattatcaaaaatacagctatgatgagagaagctgcaagaaaaatagaagaaaggcatttttccaaccatgcaacacatgttgaatttctgcctgttgagtggcggtcaaaacttactcttgatggagacactgttgattccattactcctgacaaagtacgaggtttaagggatatgctgaacagcagtgcaatggacataatgtattatactagtccactttatagagatgaactagttaaaggccttcagcaagagctgaatcgattgtattcccttttctgttctcggaatccagactttgaagaaaaagggggtaaagtctcaatagtatcacattccttgggatgtgtaattacttatgacataatgactggctggaatccagttcggctgtatgaacagttgctgcaaaaggaagaagagttgcctgatgaacgatggatgagctatgaagaacgacatcttcttgatgaactctatataactaaacgacggctgaaggaaatagaagaacggcttcacggattgaaagcatcatctatgacacaaacacctgccttaaaatttaaggttgagaatttcttctgtatgggatccccattagcagttttcttggcgttgcgtggcatccgcccaggaaatactggaagtcaagaccatattttgcctagagagatttgtaaccggttactaaatatttttcatcctacagatccagtggcttatagattagaaccattaatactgaaacactacagcaacatttcacctgtccagatccactggtacaatacttcaaatcctttaccttatgaacatatgaagccaagctttctcaacccagctaaagaacctacctcagtttcagagaatgaaggcatttcaaccataccaagccctgtgacctcaccagttttgtcccgccgacactatggagaatctataacaaatataggcaaagcaagcatattaggggctgctagcattggaaagggacttggaggaatgttgttctcaagatttggacgttcatctacaacacagtcatctgaaacatcaaaagactcaatggaagatgagaagaagccagttgcctcaccttctgctaccaccgtagggacacagacccttccacatagcagttctggcttcctcgattctgcatatttcagacttcaagaatcgttctttaatctcccacaacttctttttccggaaaatgtaatgcagaataaagataatgccctcgtggagttggatcacaggattgattttgaactcagagaaggccttgtggagagccgctattggtcagctgtcacgtcgcatactgcctattggtcatccttggatgttgccctttttcttttaaccttcatgtataaacatgagcacgatgatgatgcaaaacccaatttagatccaatctgaactctcttgaaggacatgaatggcctaaaactgattttttttttttccgttaaaatgtgtgtgtcaagatacggagatttcagggttaaagtatatttcagttttctttagggcaacatatatttgaatttaaaagcactttatttaaaaaaaaaagaagttttcagttctgaagaagtcatttacagtttgcatcattttaattatgagtctgacaaaaccttctccagagaatcaagcaagacctggatgtgaagaaggtttgggtaaactgcatgtaaaggctacaaatcacaatctgattcctcccaaatataaaggcatatggaacataatgtattaaccaaagtatgttataaatcaaaaatggtcaaggttcagcatattctatatgaagatcacaaggtggtatcgttttagatttctatgaaggctttcatttgtacatccctttgaaaaaatataacagatttaaaatgttttgaattt

SEQ ID NO: 2394 - DNA, 2870 bp, Homo sapiens
gtgaacaaaaattgtttgctggcccccaggatactaactagacctttggcctgactcacaggacactaaggctccttttctgaagaagccttttaccagtctcatttaggggatgggaacaacatgtcttcacctagggactttagagcagagcctggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatggctttagaacttaagaatctgcctggtgagttcaactctgggaatcaaccaagcaacagagaaaaaaatagataccgagatattcttccatatgattcaacacgcgttcctcttggaaaaagcaaggactacatcaatgctagttatattagaatagtcaattgtggagaagagtatttttatatcgctactcaaggaccactgctgagcaccatagatgacttttggcaaatggtgttggaaaataattcaaatgttattgccatgataaccagagagatagaaggtggaattatcaaatgctaccattactggcccatttctctgaagaagccattggaattgaaacacttccgtgtattcctggagaactaccagatacttcaatatttcatcattcgaatgtttcaagttgtggagaagtccacgggaactagtcactctgtaaaacagttgcagttcaccaagtggccagaccatggcactcctgcctcagcagatagcttcataaaatatattcgttatgcaaggaagagccaccttacaggacccatggttgttcactgcagtgccggcataggccggacaggggtgttcctatgtgtggatgtcgtgttctgtgccatcgtaaagaactgttcattcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcacctcctcataaagaacatgtttgcactgtgctgaagggctttgctatgcatacaatctgctttcttggtttatcagtttattttctttctaaaagctccctgaagggcaatatcatttggcttggggtgatcagtgtttacttattgatcttgctagacaatatcaaaataacttcccacattttccagtgaaacagatgttacataaaacgattgcagcttggctatttggttgaagggattacagagcccaataaaggatttaaaatatattcattaagattttatttggaaaggtggctggagagagctgaggatttccaggactttgtaagttcttattctgggagaacataaggccaataatcatgacctcttccaggcatttttaagacagatgtctattcatgttctttagctagagcctgtactttttgctggcatttgaataacccagtttaaaaagagtccagttagggtggactaactttggacacaaattggcttccatttcctacattttcatactgctgccttcctacagctgctagaccaagacctgttggtctgggaagcatttcatggatagggagagctcctctcggtgaacagtccaaaactaaaatagatgtttatatagaaagcccaagaggagacttttgccatgcctgagttctttcctatcccaccctaacacttaacatattacttagtctgctttgttaaaagcaagtattacctttaacttgcctcttactctttgccctttagctaactaataaagtttgatataggcattattatataattctgagtcattcatggtatctctcatgtttgatgtatttttcaaactaagatctatgatagttttttttccagagttccattaaatcatttatttcctttactttctcacctctgttgaaacatttagaaactggatttgggaacccaattttggaaaaccagattcatagtcatgaaaatggaaacttccatattctgtttttgaaaagatgtggccattattacagtaattttattataggactttgcctcgtacaattaatagtgatattttggacaaggagttctggtgacaagctatacctaattataagctataaaacaatagatatgagtgtttgtacagtttaactcaatggagatcagaatattctatgtattgagaaaatgtttaatatcaatctataaatcttgaatttctaagaggcttattttgttcttttggctgaatgagtatatttgaattggttgaataattaataattctcattgtaaaaataattatatgccaaaaatatatttgatgttaaatcaaatagatgattctgtttacattgttcatatgaataataatctgtgttaatttcattttgataattggcctttaatatttgtatctctaattttattttctctctgttactgtaaaataatagctataatgtataacaattttcttcagaagaattctatgctattattaaaataaaatatttactgtg

SEQ ID NO: 2395 - DNA, 2323 bp, Homo sapiens
gtgaacaaaaattgtttgctggcccccaggatactaactagacctttggcctgactcacaggacactaaggctccttttctgaagaagccttttaccagtctcatttaggggatgggaacaacatgtcttcacctagggactttagagcagagcctgtaaacgattatgagggaaatgactctgaagcagaagacttgaatttcagggagactttgccttcatcaagtcaggaaaacacacctagatcaaaggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatgttcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcacctcctcataaagaacatgtttgcactgtgctgaagggctttgctatgcatacaatctgctttcttggtttatcagtttattttctttctaaaagctccctgaagggcaatatcatttggcttggggtgatcagtgtttacttattgatcttgctagacaatatcaaaataacttcccacattttccagtgaaacagatgttacataaaacgattgcagcttggctatttggttgaagggattacagagcccaataaaggatttaaaatatattcattaagattttatttggaaaggtggctggagagagctgaggatttccaggactttgtaagttcttattctgggagaacataaggccaataatcatgacctcttccaggcatttttaagacagatgtctattcatgttctttagctagagcctgtactttttgctggcatttgaataacccagtttaaaaagagtccagttagggtggactaactttggacacaaattggcttccatttcctacattttcatactgctgccttcctacagctgctagaccaagacctgttggtctgggaagcatttcatggatagggagagctcctctcggtgaacagtccaaaactaaaatagatgtttatatagaaagcccaagaggagacttttgccatgcctgagttctttcctatcccaccctaacacttaacatattacttagtctgctttgttaaaagcaagtattacctttaacttgcctcttactctttgccctttagctaactaataaagtttgatataggcattattatataattctgagtcattcatggtatctctcatgtttgatgtatttttcaaactaagatctatgatagttttttttccagagttccattaaatcatttatttcctttactttctcacctctgttgaaacatttagaaactggatttgggaacccaattttggaaaaccagattcatagtcatgaaaatggaaacttccatattctgtttttgaaaagatgtggccattattacagtaattttattataggactttgcctcgtacaattaatagtgatattttggacaaggagttctggtgacaagctatacctaattataagctataaaacaatagatatgagtgtttgtacagtttaactcaatggagatcagaatattctatgtattgagaaaatgtttaatatcaatctataaatcttgaatttctaagaggcttattttgttcttttggctgaatgagtatatttgaattggttgaataattaataattctcattgtaaaaataattatatgccaaaaatatatttgatgttaaatcaaatagatgattctgtttacattgttcatatgaataataatctgtgttaatttcattttgataattggcctttaatatttgtatctctaattttattttctctctgttactgtaaaataatagctataatgtataacaattttcttcagaagaattctatgctattattaaaataaaatatttactgtg

SEQ ID NO: 2396 - DNA, 2226 bp, Homo sapiens
tggacccaactggcgaggctgctggggttgcagcgggacagttggggcggccccgcaggcccaggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatggctttagaacttaagaatctgcctggtgagttcaactctgggaatcaaccaagcaacagagaaaaaaatagataccgagatattcttccatttcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcacctcctcataaagaacatgtttgcactgtgctgaagggctttgctatgcatacaatctgctttcttggtttatcagtttattttctttctaaaagctccctgaagggcaatatcatttggcttggggtgatcagtgtttacttattgatcttgctagacaatatcaaaataacttcccacattttccagtgaaacagatgttacataaaacgattgcagcttggctatttggttgaagggattacagagcccaataaaggatttaaaatatattcattaagattttatttggaaaggtggctggagagagctgaggatttccaggactttgtaagttcttattctgggagaacataaggccaataatcatgacctcttccaggcatttttaagacagatgtctattcatgttctttagctagagcctgtactttttgctggcatttgaataacccagtttaaaaagagtccagttagggtggactaactttggacacaaattggcttccatttcctacattttcatactgctgccttcctacagctgctagaccaagacctgttggtctgggaagcatttcatggatagggagagctcctctcggtgaacagtccaaaactaaaatagatgtttatatagaaagcccaagaggagacttttgccatgcctgagttctttcctatcccaccctaacacttaacatattacttagtctgctttgttaaaagcaagtattacctttaacttgcctcttactctttgccctttagctaactaataaagtttgatataggcattattatataattctgagtcattcatggtatctctcatgtttgatgtatttttcaaactaagatctatgatagttttttttccagagttccattaaatcatttatttcctttactttctcacctctgttgaaacatttagaaactggatttgggaacccaattttggaaaaccagattcatagtcatgaaaatggaaacttccatattctgtttttgaaaagatgtggccattattacagtaattttattataggactttgcctcgtacaattaatagtgatattttggacaaggagttctggtgacaagctatacctaattataagctataaaacaatagatatgagtgtttgtacagtttaactcaatggagatcagaatattctatgtattgagaaaatgtttaatatcaatctataaatcttgaatttctaagaggcttattttgttcttttggctgaatgagtatatttgaattggttgaataattaataattctcattgtaaaaataattatatgccaaaaatatatttgatgttaaatcaaatagatgattctgtttacattgttcatatgaataataatctgtgttaatttcattttgataattggcctttaatatttgtatctctaattttattttctctctgttactgtaaaataatagctataatgtataacaattttcttcagaagaattctatgctattattaaaataaaatatttactgtg

SEQ ID NO: 2397 - DNA, 2872 bp, Homo sapiens
tggacccaactggcgaggctgctggggttgcagcgggacagttggggcggccccgcaggcccagtaaacgattatgagggaaatgactctgaagcagaagacttgaatttcagggagactttgccttcatcaagtcaggaaaacacacctagatcaaaggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatggctttagaacttaagaatctgcctggtgagttcaactctgggaatcaaccaagcaacagagaaaaaaatagataccgagatattcttccatatgattcaacacgcgttcctcttggaaaaagcaaggactacatcaatgctagttatattagaatagtcaattgtggagaagagtatttttatatcgctactcaaggaccactgctgagcaccatagatgacttttggcaaatggtgttggaaaataattcaaatgttattgccatgataaccagagagatagaaggtggaattatcaaatgctaccattactggcccatttctctgaagaagccattggaattgaaacacttccgtgtattcctggagaactaccagatacttcaatatttcatcattcgaatgtttcaagttgtggagaagtccacgggaactagtcactctgtaaaacagttgcagttcaccaagtggccagaccatggcactcctgcctcagcagatagcttcataaaatatattcgttatgcaaggaagagccaccttacaggacccatggttgttcactgcagtgccggcataggccggacaggggtgttcctatgtgtggatgtcgtgttctgtgccatcgtaaagaactgttcattcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcacctcctcataaagaacatgtttgcactgtgctgaagggctttgctatgcatacaatctgctttcttggtttatcagtttattttctttctaaaagctccctgaagggcaatatcatttggcttggggtgatcagtgtttacttattgatcttgctagacaatatcaaaataacttcccacattttccagtgaaacagatgttacataaaacgattgcagcttggctatttggttgaagggattacagagcccaataaaggatttaaaatatattcattaagattttatttggaaaggtggctggagagagctgaggatttccaggactttgtaagttcttattctgggagaacataaggccaataatcatgacctcttccaggcatttttaagacagatgtctattcatgttctttagctagagcctgtactttttgctggcatttgaataacccagtttaaaaagagtccagttagggtggactaactttggacacaaattggcttccatttcctacattttcatactgctgccttcctacagctgctagaccaagacctgttggtctgggaagcatttcatggatagggagagctcctctcggtgaacagtccaaaactaaaatagatgtttatatagaaagcccaagaggagacttttgccatgcctgagttctttcctatcccaccctaacacttaacatattacttagtctgctttgttaaaagcaagtattacctttaacttgcctcttactctttgccctttagctaactaataaagtttgatataggcattattatataattctgagtcattcatggtatctctcatgtttgatgtatttttcaaactaagatctatgatagttttttttccagagttccattaaatcatttatttcctttactttctcacctctgttgaaacatttagaaactggatttgggaacccaattttggaaaaccagattcatagtcatgaaaatggaaacttccatattctgtttttgaaaagatgtggccattattacagtaattttattataggactttgcctcgtacaattaatagtgatattttggacaaggagttctggtgacaagctatacctaattataagctataaaacaatagatatgagtgtttgtacagtttaactcaatggagatcagaatattctatgtattgagaaaatgtttaatatcaatctataaatcttgaatttctaagaggcttattttgttcttttggctgaatgagtatatttgaattggttgaataattaataattctcattgtaaaaataattatatgccaaaaatatatttgatgttaaatcaaatagatgattctgtttacattgttcatatgaataataatctgtgttaatttcattttgataattggcctttaatatttgtatctctaattttattttctctctgttactgtaaaataatagctataatgtataacaattttcttcagaagaattctatgctattattaaaataaaatatttactgtg

SEQ ID NO: 2398 - DNA, 1929 bp, Homo sapiens
gaagaagggcggggatgtcagggctggagagtgcccgtgtccttctgtgtgcattgggctccttcctccttaattctctgctttccacttttaggctgaactccagtgcacccagttagacttggagcggaaactcaagttgaatgaaaatgccatctccaggctccaggctaaccaaaagtctgttctggtgtcggtgtcagaggtcaaagcagtggctgaaatgcagtttggggaactccttgctgctgtgaggaaggcccaggccaatgtgatgctcttcttagaggagaaggagcaagctgcgctgagccaggccaacggtatcaaggcccacctggagtacaggagtgccgagatggagaagagtaagcaggagctggagacgatggcggccatcagcaacactgtccagttcttggaggagtactgcaagtttaagaacactgaagacatcaccttccctagtgtttacatagggctgaaggataaactctcgggcatccgcaaagttatcacggaatccactgtacacttaatccagttgctggagaactataagaaaaagctccaggagttttccaaggaagaggagtatgacatcagaactcaagtgtctgccattgttcagcgcaaatattggacttccaaacctgagcccagcaccagggaacagttcctccaatatgtgcatgacatcacgttcgacccggacacagcacacaagtatctccggctgcaggaggagaaccgcaaggtcaccaacaccacgccctgggagcatccctacccggacctccccagcaggttcctgcactggcggcaggtgctgtcccagcagagtctgtacctgcacaggtactattttgaggtggagatcttcggggcaggcacctatgttggcctgacctgcaaaggcatcgaccagaaaggggaggagcgcagcagttgcatttccggaaacaacttctcctggagcctccaatggaacgggaaggagttcacggcctggtacagtgacatggagaccccactcaaagctggccctttctggaggctcggggtctatattgacttcccaggagggatcctttccttctatggcgtagagtatgattccatgactctggttcacaagtttgcctgcaagttttcagaaccagtctatgctgccttctggctttccaagaaggaaaacgccatccggattgtagatctgggagaggaacccgagaagccagcaccgtccttggtggggactgctccctagactccaggagccatatcccagacctttgccagctacagtgatgggatttgcattttagggtgatttgggggcaaaaataactgctgatggtagctggcttttgaaatcctatggggtctctgaatgaaaacattctccagctgctctcttttgctccatatggtgctgttctctatgtgtttgcagtaattctttttttttttttttttgagacggagtctcgcactgttgcccaggctggagtgcagtggcgtgatcttggctcactgcaagctccgcctcccgagttcaagcaattctcctgcctcagcctcccgagtagctgggattacaggtgcctgccaccacacccagctaacgttttgtatttttagtagagatggggtttcaccatgttggccaggcagatctcaaacttctgacctcgtgatgcactcacctcggcctcccaaagtgctgggattacaggcgtgagccactgcgccctgcctgtttgtagtaatttttaggcaccaaatctccctcatcttctagtgccattctcctctctgttcaggtaaatgtcacactgtgcccagaatggatgaccaggaaccttcaagagtggctgaaaagattgcagagttatcataataaattgctaacttgcgtatttccta

SEQ ID NO: 2399 - DNA, 2023 bp, Homo sapiens
gatcagccacagaagttaaacttctttccagggaagaagggcggggatgtcagggctggagagtgcccgtgtccttctgtgtgcattgggctccttcctccttaattctctgctttccacttttaggctgaactccagtgcacccagttagacttggagcggaaactcaagttgaatgaaaatgccatctccaggctccaggctaaccaaaagtctgttctggctccttgaatgtattgaggcctctcctctctgtactatttctgcttgtcatcattttcgtggtgtcggtgtcagaggtcaaagcagtggctgaaatgcagtttggggaactccttgctgctgtgaggaaggcccaggccaatgtgatgctcttcttagaggagaaggagcaagctgcgctgagccaggccaacggtatcaaggcccacctggagtacaggagtgccgagatggagaagagtaagcaggagctggagacgatggcggccatcagcaacactgtccagttcttggaggagtactgcaagtttaagaacactgaagacatcaccttccctagtgtttacatagggctgaaggataaactctcgggcatccgcaaagttatcacggaatccactgtacacttaatccagttgctggagaactataagaaaaagctccaggagttttccaaggaagaggagtatgacatcagaactcaagtgtctgccattgttcagcgcaaatattggacttccaaacctgagcccagcaccagggaacagttcctccaatatgtgcatgacatcacgttcgacccggacacagcacacaagtatctccggctgcaggaggagaaccgcaaggtcaccaacaccacgccctgggagcatccctacccggacctccccagcaggttcctgcactggcggcaggtgctgtcccagcagagtctgtacctgcacaggtactattttgaggtggagatcttcggggcaggcacctatgttggcctgacctgcaaaggcatcgaccagaaaggggaggagcgcagcagttgcatttccggaaacaacttctcctggagcctccaatggaacgggaaggagttcacggcctggtacagtgacatggagaccccactcaaagctggccctttctggaggctcggggtctatattgacttcccaggagggatcctttccttctatggcgtagagtatgattccatgactctggttcacaagtttgcctgcaagttttcagaaccagtctatgctgccttctggctttccaagaaggaaaacgccatccggattgtagatctgggagaggaacccgagaagccagcaccgtccttggtggggactgctccctagactccaggagccatatcccagacctttgccagctacagtgatgggatttgcattttagggtgatttgggggcaaaaataactgctgatggtagctggcttttgaaatcctatggggtctctgaatgaaaacattctccagctgctctcttttgctccatatggtgctgttctctatgtgtttgcagtaattctttttttttttttttttgagacggagtctcgcactgttgcccaggctggagtgcagtggcgtgatcttggctcactgcaagctccgcctcccgagttcaagcaattctcctgcctcagcctcccgagtagctgggattacaggtgcctgccaccacacccagctaacgttttgtatttttagtagagatggggtttcaccatgttggccaggcagatctcaaacttctgacctcgtgatgcactcacctcggcctcccaaagtgctgggattacaggcgtgagccactgcgccctgcctgtttgtagtaatttttaggcaccaaatctccctcatcttctagtgccattctcctctctgttcaggtaaatgtcacactgtgcccagaatggatgaccaggaaccttcaagagtggctgaaaagattgcagagttatcataataaattgctaacttgcgtatttccta

SEQ ID NO: 2400 - DNA, 790 bp, Homo sapiens
ctgtggctctgtggtaggggaatgccaccaactccctgaggagcagccgtgtggtatgattgatgattcaacacgcgttcctcttggaaaaagcaaggactacatcaatgctagttatattagaatagtcaattgtggagaagagtatttttatatcgctactcaaggaccactgctgagcaccatagatgacttttggcaaatggtgttggaaaataattcaaatgttattgccatgataaccagagagatagaaggtggaattatcaaatgctaccattactggcccatttctctgaagaagccattggaattgaaacacttccgtgtattcctggagaactaccagatacttcaatatttcatcattcgaatgtttcaagttgtggagaagtccacgggaactagtcactctgtaaaacagttgcagttcaccaagtggccagaccatggcactcctgcctcagcagatagcttcataaaatatattcgttatgcaaggaagagccaccttacaggacccatggttgttcactgcagtgccggcataggccggacaggggtgttcctatgtgtggatgtcgtgttctgtgccatcgtaaagaactgttcattcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcac

SEQ ID NO: 2401 - DNA, 4217 bp, Homo sapiens
gagcccgggagccggaggtgtagcggcagagacattgttcttgccggctccctacggtgccgtgtgtgcgtgagagaagaccagtctttcctctagcatttgacattgtgcagcaaagaaatggttatggagaagcccagtccgctgcttgtagggcgggagtttgtgaggcaatattatactttgctgaataaagctccggaatatttacacaggttttatggcaggaattcttcctatgttcatggtggagtagatgctagtggaaagccccaggaagctgtttatggccaaaatgatatacaccacaaagtattatctctgaacttcagtgaatgtcatactaaaattcgtcatgtggatgctcatgcaaccttgagtgatggagtagttgtccaggtcatgggtttgctgtctaacagtggacaaccagaaagaaagtttatgcaaacctttgttctggctcctgaaggatctgttccaaataaattttatgttcacaatgatatgtttcgttatgaagatgaagtgtttggtgattctgagcctgaacttgatgaagaatcagaagatgaagtagaagaggaacaagaagaaagacaaccatctcctgaacctgtgcaagaaaatgctaacagtggttactatgaagctcaccctgtgactaatggcatagaggagcctttggaagaatcctctcatgaacctgaacctgagccagaatctgaaacaaagactgaagagctgaaaccacaagtggaggagaagaacttagaagaactagaggagaaatctactactcctcctccggcagaacctgtttctctgccacaagaaccaccaaaggctttctcctgggcttcagtgaccagtaaaaacctgcctcctagtggtactgtttcttcctctggaattccaccccatgttaaagcaccagtctcacagccaagagtcgaagctaaaccagaagttcaatctcagccacctcgtgtgcgtgaacaacgacctagagaacgacctggttttcctcctagaggaccaagaccaggcagaggagatatggaacagaatgactctgacaaccgtagaataattcgctatccagatagtcatcaactttttgttggtaacttgccacatgatattgatgaaaatgagctaaaggaattcttcatgagttttggaaacgttgtggaacttcgcatcaataccaagggtgttgggggaaagcttccaaattttggttttgtggtttttgatgactctgaaccagttcagagaatcttaattgcaaaaccgattatgtttcgaggggaagtacgtttaaatgtggaagagaaaaaaacaagagctgcaagagagcgagaaaccagaggtggtggtgatgatcgcagggatattaggcgcaatgatcgaggtcccggtggtccacgtggaattgtgggtggtggaatgatgcgtgatcgtgatggaagaggacctcctccaaggggtggcatggcacagaaacttggctctggaagaggaaccgggcaaatggagggccgcttcacaggacagcgtcgctgaagctccactgttggcaaagtcttggcagtggtacattattcatcgtgtttgcattcttgttaattttttttttggctttggaatgtgacacagcctttttgatcatttctttgatgtgaaaagcatctttggttatcagttaaattgaggtggacattatttccccaatttcacaacaggattcacattgttaatttataaatctagacttggagaattaaggactgagaaatgaccatatcttaaactatctacgacaaagtgaacttaaaaggacatgcccactgaattcaggtcctttgagtaaaaaaaaaatcttctgctgcacattttgtttaagtgttactgtttctgcctgttaatgctgggaacacaaatagtgcaatttgtgcaattggagaatcttgccttttttcttggctccccccaaaaatacaaaccaacagaaacttgttatgcactcatcaaaatgtactaatgggtactctgaactcattaacattgacatctgcaacaggaggcaacagggaaaaaatctcatcttcttttccagtagaaaatagtttgtgaaatgatgagggcattttatctgcttgctgtgaccagcgtgtgtacacataaaccttaacaagactacaagtatattccagaaggaaatcattttagttatgaactaaataataaaaattagaacttcaaatgcgatggtcttgactattagaccagatttagtagctccatatctaagatttttctacctgcccctcttcagtacagggatggctggctgctcaacacactcctcctccccttttttcctttctttaagctgtgtacagtgaaaattgtctttactgtatttttgttctctggtaatgtaataagcatgatggtgccttctattaatacatcattccagtcttgctggtaattttgtacagtatagtgtatgaattgctgtgctgcaaagccaaacagctgcaaaatgttgaaaaatcatcgaaatgtataaaaattgcagtatctttaaaatcagtaaaatggactagcatattatttatcttgttcttcagttaacaactttgtgttctctgtgggagggagggagtcctgtgtgtttgtggggagagggaaggaggaagtcagttatttgagtaagcctctagttgacttttctcttagcctgaatgtggacgttgaaacatatcacttcagggcttggaaaagtcagtcaacttgacgtacatttttagtgacattttaaaagcagtcagattctataaatggcaagtaagcctgaagtgaggatactgcaattttcggagaaaagaacagcagctctttaagtgtttgcattttctatttggggggcagggaactgtcattcattttgcacaattcttgaactgatgtcagcacccgagtggctcctgaatttaagtctgggacgacatcttttatttttacatgaatctttaaacaattctgtgagcaaagtttgtagctgctggattattgtctgtctttatagcaagttccagtaaaccacaagtatggcaaagcttatccaattttatgcttggagcagtcagtacataccagtttctgatgtttcaggcaggagtggggtaaataagtgtgaccacttaaagctgctcgttagcatggaagacttctccattctatctttgtaaaacagacaagatatgcacttgacatagtagcaaattggttctgaattatgcaactgtttgctatttagtaaactagcaaatgatgcatgtattttgtttttcatgtactgggcaatatgagtaaaatctgtccctttttccccctttgaatgaggtcttccatgtttgagggaaagtcttgcactattgcatatattttggggacacagattttcatagtttccatttttggggggcttaaggattttttttttttctgtttgaaacagttttatactttctgatatagtacttgaaattcttaccagaaaattactttggagttttgaagcctttattaatactacttttaaagaagcagttgttttattgtcaatgttttttttcccccaagcatattttcttgtatttctgtttccatatatatatatatatatataatttccaattcaggatattgccctgccatccatgaaaactgttctggcaccaaaagtaatgacaaatgttaagtgtaataatagaaaagtagagcaaagagccattcagcttcagtctttacataccatgaataaaacattaaaacatcatatggagaagtttacatggtgattgttcacctgcagtactgtggagttttaacattttgtcctcttttcagtgaaacagagtaaaaatattcatctaccattactgttatttgctgattttgttttattttttgatggtaatattctatccttatgacactattgcaaccaaattggctttaccatcttggctttagtaggtatagaagacaatggattaccatctttattgctgtaatgtgttaagcattatatgctagtagaatctagtttaattgtttcaggtggaaagtattctttgagtttccatattgaatgtgtttggactaaacaaacaataaactactgatgtctgcagcattta

SEQ ID NO: 2402 - DNA, 2779 bp, Homo sapiens
tggacccaactggcgaggctgctggggttgcagcgggacagttggggcggccccgcaggcccaggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatggctttagaacttaagaatctgcctggtgagttcaactctgggaatcaaccaagcaacagagaaaaaaacagataccgagatattcttccatatgattcaacacgcgttcctcttggaaaaagcaaggactacatcaatgctagttatattagaatagtcaattgtggagaagagtatttttatatcgctactcaaggaccactgctgagcaccatagatgacttttggcaaatggtgttggaaaataattcaaatgttattgccatgataaccagagagatagaaggtggaattatcaaatgctaccattactggcccatttctctgaagaagccattggaattgaaacacttccgtgtattcctggagaactaccagatacttcaatatttcatcattcgaatgtttcaagttgtggagaagtccacgggaactagtcactctgtaaaacagttgcagttcaccaagtggccagaccatggcactcctgcctcagcagatagcttcataaaatatattcgttatgcaaggaagagccaccttacaggacccatggttgttcactgcagtgccggcataggccggacaggggtgttcctatgtgtggatgtcgtgttctgtgccatcgtaaagaactgttcattcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcacctcctcataaagaacatgtttgcactgtgctgaagggctttgctatgcatacaatctgctttcttggtttatcagtttattttctttctaaaagctccctgaagggcaatatcatttggcttggggtgatcagtgtttacttattgatcttgctagacaatatcaaaataacttcccacattttccagtgaaacagatgttacataaaacgattgcagcttggctatttggttgaagggattacagagcccaataaaggatttaaaatatattcattaagattttatttggaaaggtggctggagagagctgaggatttccaggactttgtaagttcttattctgggagaacataaggccaataatcatgacctcttccaggcatttttaagacagatgtctattcatgttctttagctagagcctgtactttttgctggcatttgaataacccagtttaaaaagagtccagttagggtggactaactttggacacaaattggcttccatttcctacattttcatactgctgccttcctacagctgctagaccaagacctgttggtctgggaagcatttcatggatagggagagctcctctcggtgaacagtccaaaactaaaatagatgtttatatagaaagcccaagaggagatttttgccatgcctgagttctttcctatcccaccctaacacttaacatattacttagtctgctttgttaaaagcaagtattacctttaacttgcctcttactctttgccctttagctaactaataaagtttgatataggcattattatataattctgagtcattcatggtatatctcatgtttgatgtatttttcaaactaagatctatgatagttttttttccagagttccattaaatcatttatttcctttactttctcacctctgttgaaacatttagaaactggatttgggaacccaattttggaaaaccagattcatagtcatgaaaatggaaacttccatattctgtttttgaaaagatgtggccattattacagtaattttattataggactttgcctcgtacaattaatagtgatattttggacaaggagttctggtgacaagctatacctaattataagctataaaacaatagatatgagtgtttgtacagtttaactcaatggagatcagaatattctatgtattgagaaaatgtttaatatcaatctataaatcttgaatttctaagaggcttattttgttcttttggctgaatgagtatatttgaattggttgaataattaataattctcattgtaaaaataattatatgccaaaaatatatttgatgttaaatcaaatagatgattctgtttacattgttcatatgaataataatctgtgttaatttcattttgataattggcctttaatatttgtatctctaattttattttctctctgttactgtaaaataatagctataatgtataacaattttcttcagaagaattctatgctattattaaaataaaatatttactgtgta

SEQ ID NO: 2403 - DNA, 2323 bp, Homo sapiens
gtgaacaaaaattgtttgctggcccccaggatactaactagacctttggcctgactcacaggacactaaggctccttttctgaagaagccttttaccagtctcatttaggggatgggaacaacatgtcttcacctagggactttagagcagagcctgtaaacgattatgagggaaatgactctgaagcagaagacttgaatttcagggagactttgccttcatcaagtcaggaaaacacacctagatcaaaggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatgttcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcacctcctcataaagaacatgtttgcactgtgctgaagggctttgctatgcatacaatctgctttcttggtttatcagtttattttctttctaaaagctccctgaagggcaatatcatttggcttggggtgatcagtgtttacttattgatcttgctagacaatatcaaaataacttcccacattttccagtgaaacagatgttacataaaacgattgcagcttggctatttggttgaagggattacagagcccaataaaggatttaaaatatattcattaagattttatttggaaaggtggctggagagagctgaggatttccaggactttgtaagttcttattctgggagaacataaggccaataatcatgacctcttccaggcatttttaagacagatgtctattcatgttctttagctagagcctgtactttttgctggcatttgaataacccagtttaaaaagagtccagttagggtggactaactttggacacaaattggcttccatttcctacattttcatactgctgccttcctacagctgctagaccaagacctgttggtctgggaagcatttcatggatagggagagctcctctcggtgaacagtccaaaactaaaatagatgtttatatagaaagcccaagaggagatttttgccatgcctgagttctttcctatcccaccctaacacttaacatattacttagtctgctttgttaaaagcaagtattacctttaacttgcctcttactctttgccctttagctaactaataaagtttgatataggcattattatataattctgagtcattcatggtatatctcatgtttgatgtatttttcaaactaagatctatgatagttttttttccagagttccattaaatcatttatttcctttactttctcacctctgttgaaacatttagaaactggatttgggaacccaattttggaaaaccagattcatagtcatgaaaatggaaacttccatattctgtttttgaaaagatgtggccattattacagtaattttattataggactttgcctcgtacaattaatagtgatattttggacaaggagttctggtgacaagctatacctaattataagctataaaacaatagatatgagtgtttgtacagtttaactcaatggagatcagaatattctatgtattgagaaaatgtttaatatcaatctataaatcttgaatttctaagaggcttattttgttcttttggctgaatgagtatatttgaattggttgaataattaataattctcattgtaaaaataattatatgccaaaaatatatttgatgttaaatcaaatagatgattctgtttacattgttcatatgaataataatctgtgttaatttcattttgataattggcctttaatatttgtatctctaattttattttctctctgttactgtaaaataatagctataatgtataacaattttcttcagaagaattctatgctattattaaaataaaatatttactgtg

SEQ ID NO: 2404 - DNA, 2226 bp, Homo sapiens
tggacccaactggcgaggctgctggggttgcagcgggacagttggggcggccccgcaggcccaggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatggctttagaacttaagaatctgcctggtgagttcaactctgggaatcaaccaagcaacagagaaaaaaacagataccgagatattcttccatttcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcacctcctcataaagaacatgtttgcactgtgctgaagggctttgctatgcatacaatctgctttcttggtttatcagtttattttctttctaaaagctccctgaagggcaatatcatttggcttggggtgatcagtgtttacttattgatcttgctagacaatatcaaaataacttcccacattttccagtgaaacagatgttacataaaacgattgcagcttggctatttggttgaagggattacagagcccaataaaggatttaaaatatattcattaagattttatttggaaaggtggctggagagagctgaggatttccaggactttgtaagttcttattctgggagaacataaggccaataatcatgacctcttccaggcatttttaagacagatgtctattcatgttctttagctagagcctgtactttttgctggcatttgaataacccagtttaaaaagagtccagttagggtggactaactttggacacaaattggcttccatttcctacattttcatactgctgccttcctacagctgctagaccaagacctgttggtctgggaagcatttcatggatagggagagctcctctcggtgaacagtccaaaactaaaatagatgtttatatagaaagcccaagaggagatttttgccatgcctgagttctttcctatcccaccctaacacttaacatattacttagtctgctttgttaaaagcaagtattacctttaacttgcctcttactctttgccctttagctaactaataaagtttgatataggcattattatataattctgagtcattcatggtatatctcatgtttgatgtatttttcaaactaagatctatgatagttttttttccagagttccattaaatcatttatttcctttactttctcacctctgttgaaacatttagaaactggatttgggaacccaattttggaaaaccagattcatagtcatgaaaatggaaacttccatattctgtttttgaaaagatgtggccattattacagtaattttattataggactttgcctcgtacaattaatagtgatattttggacaaggagttctggtgacaagctatacctaattataagctataaaacaatagatatgagtgtttgtacagtttaactcaatggagatcagaatattctatgtattgagaaaatgtttaatatcaatctataaatcttgaatttctaagaggcttattttgttcttttggctgaatgagtatatttgaattggttgaataattaataattctcattgtaaaaataattatatgccaaaaatatatttgatgttaaatcaaatagatgattctgtttacattgttcatatgaataataatctgtgttaatttcattttgataattggcctttaatatttgtatctctaattttattttctctctgttactgtaaaataatagctataatgtataacaattttcttcagaagaattctatgctattattaaaataaaatatttactgtg

SEQ ID NO: 2405 - DNA, 790 bp, Homo sapiens; identical to SEQ ID NO: 2400

SEQ ID NO: 2406 - DNA, 3304 bp, Homo sapiens
cgccgccgccattttggagcgatcggagtgccgcccgcggccccgagtcggtctcgagccgccggccggccgtgccggtgtccgtaggcgctgcgccctcggccgggcccatgtgtgtgcggcccgcccgaggccgcccgggctttgcctccaccagcgccctggcctccgctcgggcctccacacgggcctccgaagagctgccgcgacgcccggcccgcagggcaggtaaagagattataaatcttccactgaatgaaaaaaattttcttaaagctgcatatactccaagaaaaaaaccacaaatgtttttctgttttgcctgaatacatgatttaaacaagagatttccacagaagctctgcggccgtcacgatgttctggaagtttgacttgaacaccacgtcccatgttgacaagctgctggacaaggagcatgtgacgctgcaggagttaatggatgaagatgacatcttgcaggagtgtaaggctcagaaccagaagctgctggacttcctgtgcaggcagcagtgcatggaggagctggtgagcctcatcacacaggatccgcccctggacatggaggagaaggtccgcttcaaatatccaaacacagcctgtgagcttctgacttgtgatgtgccgcagatcagcgaccgcctcggtggggacgagagcctgctgagcctcctgtacgacttcttggaccatgagccgcctctcaatcctctgctcgccagttttttcagcaagaccattggcaatctcattgcaagaaaaaccgaacaggtgattacgtttttgaagaagaaggacaagttcatcagcctggtgttgaagcacatcggcacctcagcgcttatggacctgctgctgcgcctggtcagctgtgtggagccagccgggctccggcaggacgtcctgcactggctgaatgaagagaaggtcatccagaggcttgtggagttgatccacccgagccaggatgaagataggcagtcaaatgcttctcagactctctgtgacatagttaggctgggcagagaccagggcagtcagctgcaagaggctctggagccagacccgctcctcacagcgctggagtccaggcaggactgtgtggagcagcttctgaagaacatgtttgatggagaccggacggagagctgcctcgtcagtgggactcaggtgttactcaccttgctggaaaccaggcgggttgggacagagggcttggtggactccttttctcagggactggaaaggtcatacgctgtcagcagcagcgtactacacggcatcgagcctcggctgaaggacttccaccagctcctgctcaacccgcccaagaagaaagcgatcctgaccaccattggtgtgctggaggagcccctggggaatgcccgtctgcatggcgcccgcctcatggcagcactgctgcacacaaacacacccagcatcaaccaggagctctgccggctcaacacgatggacttactgctggacttgttctttaagtacacctggaataactttttgcacttccaagtggaactatgcatagccgctattctctcccacgctgcccgtgaggagaggacagaagccagcggatccgagagcagggtggagcctccgcatgagaacgggaaccggagcctggagactccccagccggccgccagcctccctgacaacacaatggtgacccacctgttccagaagtgctgcctggtgcagaggatcctggaggcctgggaagccaacgaccacacgcaggcagcgggtggcatgagacgtgggaacatgggccacctcacacggatcgccaacgcggtggtgcagaacctggagcggggccctgtgcagacgcacatcagcgaggtcatccgagggctccctgcggactgccgtggccgctgggagagcttcgtggaggagacgctgacggagacgaaccgcaggaacactgtggacctggccttctctgactaccagatccagcagatgacagccaacttcgtggatcagtttggcttcaatgatgaggagtttgccgaccaggacgacaacatcaatgccccgtttgacaggatcgcagagatcaacttcaacatcgacgctgacgaggacagtcccagcgcagctctgtttgaggcctgctgcagtgaccgcatccagccctttgatgatgatgaggacgaggacatctgggaggacagtgacactcgctgtgctgcccgggtgatggccagacccaggtttggagccccccatgcttcagagagttgctcaaagaatggcccagagcgtggaggccaggatgggaaggcgagcttggaagcacacagagatgcacctggggcaggtgccccaccggcccccgggaagaaggaagcgccccctgtggagggtgactcagaaggcgccatgtggacggcagtgtttgatgagccagcgaactcaacgcccacagccccaggagtggtgagggacgtgggttccagtgtgtgggcagctggcacctcagctccagaggagaaaggctgggccaagttcactgacttccaacctttctgctgctccgagtcagggcccaggtgcagctctccggtggacacagaatgcagccatgctgagggcagccggagccaaggccctgagaaagccttcagcccggcttctccatgtgcctggaacgtgtgtgtcaccaggaaggcccccctgctggcctctgacagtagctcctctgggggctcccacagcgaggatggcgaccagaaggcagcgagtgccatggatgcggtgagcaggggtcccggccgggaggcccccccgctgcccacagtggccaggacagaggaggctgtcggcagggtcgggtgtgctgacagccggctgttaagccctgcctgccccgcgccaaaggaagtgactgctgccccagccgtggctgtgccccccgaggctactgtggccatcaccacagcactgagcaaggctggccccgccatacccaccccagcagtctcttctgcactggccgtggcggtccccctagggcccatcatggcagtcacagcagccccagccatggtggccaccctggggacagtgacaaaggacgggaagacagatgccccgccagaaggagctgccttaaatggcccagtgtgatgctgctgccgcccggccacggcccaccctggtcaggctgcctccttaatcgagaaaactacctggtgatgcaatcttttttttttttaatttaatttaattttaaaataaatgctgcattggtaaa

SEQ ID NO: 2407 - DNA, 3293 bp, Homo sapiens
ccattttggagcgatcggagtgccgcccgcggccccgagtcggtctcgagccgccggccggccgtgccggtgtccgtaggcgctgcgccctcggccgggcccatgtgtgtgcggcccgcccgaggccgcccgggctttgcctccaccagcgccctggcctccgctcgggcctccacacgggcctccgaagagctgccgcgacgcccggcccgcagggcaggtaaagagattataaatcttccactgaatgaaaaaaattttcttaaagctgcatatactccaagaaaaaaaccacaaatgtttttctgttttgcctgaatacatgatttaaacaagagatttccacagaagctctgcggccgtcacgatgttctggaagtttgacttgaacaccacgtcccatgttgacaagctgctggacaaggagcatgtgacgctgcaggagttaatggatgaagatgacatcttgcaggagtgtaaggctcagaaccagaagctgctggacttcctgtgcaggcagcagtgcatggaggagctggtgagcctcatcacacaggatccgcccctggacatggaggagaaggtccgcttcaaatatccaaacacagcctgtgagcttctgacttgtgatgtgccgcagatcagcgaccgcctcggtggggacgagagcctgctgagcctcctgtacgacttcttggaccatgagccgcctctcaatcctctgctcgccagttttttcagcaagaccattggcaatctcattgcaagaaaaaccgaacaggtgattacgtttttgaagaagaaggacaagttcatcagcctggtgttgaagcacatcggcacctcagcgcttatggacctgctgctgcgcctggtcagctgtgtggagccagccgggctccggcaggacgtcctgcactggctgaatgaagagaaggtcatccagaggcttgtggagttgatccacccgagccaggatgaagataggcagtcaaatgcttctcagactctctgtgacatagttaggctgggcagagaccagggcagtcagctgcaagaggctctggagccagacccgctcctcacagcgctggagtcgcaggactgtgtggagcagcttctgaagaacatgtttgatggagaccggacggagagctgcctcgtcagtgggactcaggtgttactcaccttgctggaaaccaggcgggttgggacagagggcttggtggactccttttctcagggactggaaaggtcatacgctgtcagcagcagcgtactacacggcatcgagcctcggctgaaggacttccaccagctcctgctcaacccgcccaagaagaaagcgatcctgaccaccattggtgtgctggaggagcccctggggaatgcccgtctgcatggcgcccgcctcatggcagcactgctgcacacaaacacacccagcatcaaccaggagctctgccggctcaacacgatggacttactgctggacttgttctttaagtacacctggaataactttttgcacttccaagtggaactatgcatagccgctattctctcccacgctgcccgtgaggagaggacagaagccagcggatccgagagcagggtggagcctccgcatgagaacgggaaccggagcctggagactccccagccggccgccagcctccctgacaacacaatggtgacccacctgttccagaagtgctgcctggtgcagaggatcctggaggcctgggaagccaacgaccacacgcaggcagcgggtggcatgagacgtgggaacatgggccacctcacacggatcgccaacgcggtggtgcagaacctggagcggggccctgtgcagacgcacatcagcgaggtcatccgagggctccctgcggactgccgtggccgctgggagagcttcgtggaggagacgctgacggagacgaaccgcaggaacactgtggacctggccttctctgactaccagatccagcagatgacagccaacttcgtggatcagtttggcttcaatgatgaggagtttgccgaccaggacgacaacatcaatgccccgtttgacaggatcgcagagatcaacttcaacatcgacgctgacgaggacagtcccagcgcagctctgtttgaggcctgctgcagtgaccgcatccagccctttgatgatgatgaggacgaggacatctgggaggacagtgacactcgctgtgctgcccgggtgatggccagacccaggtttggagccccccatgcttcagagagttgctcaaagaatggcccagagcgtggaggccaggatgggaaggcgagcttggaagcacacagagatgcacctggggcaggtgccccaccggcccccgggaagaaggaagcgccccctgtggagggtgactcagaaggcgccatgtggacggcagtgtttgatgagccagcgaactcaacgcccacagccccaggagtggtgagggacgtgggttccagtgtgtgggcagctggcacctcagctccagaggagaaaggctgggccaagttcactgacttccaacctttctgctgctccgagtcagggcccaggtgcagctctccggtggacacagaatgcagccatgctgagggcagccggagccaaggccctgagaaagccttcagcccggcttctccatgtgcctggaacgtgtgtgtcaccaggaaggcccccctgctggcctctgacagtagctcctctgggggctcccacagcgaggatggcgaccagaaggcagcgagtgccatggatgcggtgagcaggggtcccggccgggaggcccccccgctgcccacagtggccaggacagaggaggctgtcggcagggtcgggtgtgctgacagccggctgttaagccctgcctgccccgcgccaaaggaagtgactgctgccccagccgtggctgtgccccccgaggctactgtggccatcaccacagcactgagcaaggctggccccgccatacccaccccagcagtctcttctgcactggccgtggcggtccccctagggcccatcatggcagtcacagcagccccagccatggtggccaccctggggacagtgacaaaggacgggaagacagatgccccgccagaaggagctgccttaaatggcccagtgtgatgctgctgccgcccggccacggcccaccctggtcaggctgcctccttaatcgagaaaactacctggtgatgcaatcttttttttttttaatttaatttaattttaaaataaatgctgcattggtaaa

SEQ ID NO: 2408 - DNA, 2055 bp, Homo sapiens
gccgcgaggggccgccgtccgtcccgccccctgccgggccgcggcgctctgctagagcgtggctcagttttggtagcgggaccccggaaatgtaaagcatgagcgggaacagtcgccagggcgagtgacaggcgagccctatgctttacttccgagggcggtgtcagcaaagctagagtcagaggttccggttgagatcaagttgggagacacacccttgttcattctccttgagaagcagctattatcaacagaacattgacagaacctgtgtttggggaaaggactgatggctttgagtctaggttggaaagcacacaggaaccactgtggtctcctcttgcaggctctgcgaagcagtggtcttctcttgtttccctgtggccagtgtccctggagaggagctggaagctttttggaccctgagataaaggctttcctggaggagaacactgaagtcaccagcagtggtagcctcacccctgaaatccagttgcggcttttgacccccagatgcaaattctggtgggagagagctgacctgtggccccacagtgatccttactgggcaatctactggccaggaggccaagccctgtctaggtatcttttggataatcctgatgttgtcagaggaaaatctgtattagatcttgggagtggatgtggagctacagctattgctgctaagatgagtggggcatcaaggatcttggccaatgacatagaccctattgcaggaatggctattacactaaattgtgaattgaacagactgaatccttttcctattttaatccaaaacattttgaatttggaacaagataagtgggaccttgttgttcttggcgatatgttttatgatgaagaccttgcagatagtcttcatcagtggctgaagaagtgcttctggacctatagaactcgagtactgattggtgaccctgggcggccccagttcagtggacacagcattcagcatcacctgcacaaagtggtagaatattcacttttggagtctactaggcaggaaaacagtggactgacaacaagcacagtgtggggttttcagccttgagttgtcaaagtgcttccaagtatgaatatagtaatgtttggatctgactctaaaagttttctctataggagatactctccagtttaatgaatgtaattcttgttaaatggaaaatcttgtttttaaaatatgaaggtttagagttttgtttacttttgtcatgtaactggttctgtatttctatgcatgccaattatacacatctctatctgcatttttttttctattttaaccgctgaaggaatatgattatacaatgccatactcaatggtggcagcatttaatttaagtaatggagaagaattaaacattgtagctggatctgtttctgtagtcgaggacaactgtgatgtaactttgaattaaacaaacaaaacaaaacagaagaagactatatatatattttttctttttttagagacagtctcactttgctcccaggctggaatgcagtggctattcagaggcttaatcattgggcactgcagccttgaactctgggcttttttttttttttgagatggagtctcagctctgtcgtccaggctggagtgcagtgactcatgtctcggctcactgtagcctccacctcccccaatcaagcgattgtcctgtctcagcctccagagtagctgggattttaggtgtgcaccaccatgcctggctaatttttgtatttttagtagagacggggttttgccatgttggccaggccggtctcaaactcctgacctcaggtgatccacccgccttggcctcccaaagtgctaggattacaggtgtgagccaccacgccagcctgacgatgttttttacttctatcacttccttttgattttttcttatagcttctatctctgcttacgtcacccatcattcttgcgtgttgtatgcttttcgcattagagccctttgcatgttaatcagttattttaaatttatgatctggtaattctaaaatgtctgccataactga

SEQ ID NO: 2409 - DNA, 4156 bp, Homo sapiens
tagggcacgggaagggctcgctagaatgagctcttaaactggttgggtgtaagcggttttgggctagtctaaaccaaacaactgagaataaacgcggggttcctgcaggttgagagagtacctgtctgcaaatgtccagtagtgatggattgccttgtaggccccagagcaatcggggaagttagcattcttgttcaagaagctgctggttcacttagagctataaaagaatgttgtgagtttggattttcttccaaacgttcaggattgaggttagggctggtggtgagggatcatgtaaagaggtttgagtggctcagccttaggtcccggtgtggaaagcttattcttttggtgtcatcacgtggccgtgggaattatttagaatgtgatctgccctcatgagaagaaaggagctctgaagccgttgcagttcttcctccctatgtggaaaatcgaatttctggaaacatcctccgtattgggagattttgcctatgtaaaggctatccttattggctagcggcactaattactttaaaagtaggatggaagtacaagtatctcaagcatcattgggtttcgagctcacttctgtggaaaagagtttaagggagtggtctagactttccagggaagttattgcctggctgtgtccctctagtcctaattttatacttaactttcccccacctccttcagcctcatctgtttcaatggtgcaactcttttcatccccttttggttaccagtcaccttcaggccattcagaggaggaaagagaggggaatatgaagtcagccaagccccaagtgaaccacagtcagcatggggaaagccagcgggccttgagccccctgcagtctactctgagttctgctgcatctccttcccaagcgtatgagacctatattgaaaatggactcatatgccttaaacacaaaattagaaacatcgagaaaaagaagctcaaactggaggattataaggatcgcctgaaaagtggagagcatcttaatccagaccagttggaagctgtagagaaatatgaagaagtgctacataatttggaatttgccaaggagcttcaaaaaaccttttctgggttgagcctagatctactaaaagcgcaaaagaaggcccagagaagggagcacatgctaaaacttgaggctgagaagaaaaagcttcgaactatacttcaagttcagtatgtattgcagaacttgacacaggagcacgtacaaaaagacttcaaagggggtttgaatggtgcagtgtatttgccttcaaaagaacttgactacctcattaagttttcaaaactgacctgccctgaaagaaatgaaagtctgagtgttgaagaccagatggagcagtcatccttgtacttttgggaccttttggaaggtagtgagaaagcagtggtaggaacgacatacaaacacttgaaggatctactgtctaaattgctgaactcaggctattttgaaagtatcccagttcccaaaaatgccaaggaaaaggaagtaccactggaggaagaaatgctaatacaatcagagaaaaaaacacaattatcgaagactgaatctgtcaaagagtcagagtctctaatggaatttgcccagccagagatacaaccacaagagtttcttaacagacgctatatgacagaagtagattattcaaacaaacaaggcgaagagcaaccttgggaagcagattatgctagaaaaccaaatctcccaaaacgttgggatatgcttactgaaccagatggtcaagagaagaaacaggagtcctttaagtcctgggaggcttctggtaagcaccaggaggtatccaagcctgcagtttccttagaacagaggaaacaagacacctcaaaactcaggtctactctgccggaagagcagaagaagcaggagatctccaaatccaagccatctcctagccagtggaagcaagatacacctaaatccaaagcagggtatgttcaagaggaacaaaagaaacaggagacaccaaagctgtggccagttcagctgcagaaagaacaagatccaaagaagcaaactccaaagtcttggacaccttccatgcagagcgaacagaacaccaccaagtcatggaccactcccatgtgtgaagaacaggattcaaaacagccagagactccaaaatcctgggaaaacaatgttgagagtcaaaaacactctttaacatcacagtcacagatttctccaaagtcctggggagtagctacagcaagcctcataccaaatgaccagctgctgcccaggaagttgaacacagaacccaaagatgtgcctaagcctgtgcatcagcctgtaggttcttcctctacccttccgaaggatccagtattgaggaaagaaaaactgcaggatctgatgactcagattcaaggaacttgtaactttatgcaagagtctgttcttgactttgacaaaccttcaagtgcaattccaacgtcacaaccgccttcagctactccaggtagccccgtagcatctaaagaacaaaatctgtccagtcaaagtgattttcttcaagagccgttacaggcagcaattcccccaggcaagcaaccgtcttcactagcttctccaaatcctcccatggcaaagggctctgaacagggcttccagtcacctccagcaagtagtagttcagtaaccattaacacagcaccctttcaagccatgcagacagtatttaacgttaatgcacctctgcctccacgaaaagaacaagaaataaaagaatccccttattcacctggctacaatcaaagttttaccacagcaagtacacaaacaccaccccagtgccaactgccatctatacatgtagaacaaactgtccattctcaagagactgcacagacgaatgtgtttcccagacctactcagccatttgtcaatagccggggatctgttagaggatgtactcgtggtgggagattaataaccaattcctatcggtcccctggtggttataaaggttttgatacttatagaggactcccttcaatttccaatggaaattatagccagctgcagttccaagctagagagtattctggagcaccttattcccaaagggataatttccagcagtgttataagcgaggagggacatctggtggtccacgagcaaattcgagagctaactgcttcattatgagaaactcactgttgctaataaaacagcagggtggagtgattcttctcaggtgagcagcccagaaagagacaacgaaacctttaacagtggtgactctggacaaggagactcccgtagcatgacccctgtggatgtgccagtgacaaatccagcagccaccatactgccagtacacgtctaccctctgcctcagcagatgcgagttgccttctcagcagccagaacctctaatctggcccctggaactttagaccaacctattgtgtttgatcttcttctgaacaacttaggagaaacttttgatcttcagcttggtagatttaattgcccagtgaatggcacttacgttttcatttttcacatgctaaagctggcagtgaatgtgccactgtatgtcaacctcatgaagaatgaagaggtcttggtatcagcctatgccaatgatggtgctccagaccatgaaactgctagcaatcatgcaattcttcagctcttccagggagaccagatatggttacgtctgcacaggggagcaatttatggaagtagctggaaatattctacgttttcaggctatcttctttatcaagattgaaagtcagtacagtattgacaataaaaggatggtgttctaattagtgggattgaaggaaaagtagtctttgccctcatgactgattggtttaggaaaatgtttttgttcctagagggaggaggtccttacttttttgttttccttcctgaggtgaaaaatcaagctgaatgacaattagcactaatctggcactttataaattgtgatgtagcctcgctagtcaagctgtgaatgtatattgtttgcacttaatccttaactgtattaacgttcagcttactaaactgactgcctcaagtccaggcaagttacaatgccttgttgtgcctcaataaaaaagttacatgc

SEQ ID NO: 2410 - DNA, 2602 bp, Homo sapiens
gcttcgttactgggccctggaagcgaggtcagagctggaaatggccttaggggtcacctagggcctaatccatcgtttctcttgtgggggaactgagcctctgggaagggtcacattgcgttaatgcagtgtgtgtcgcctctgtccctcccccttacacgtctggcgtctcgtcagatacatgtcagctcctgggagaagctttccctggccgctttgcagaagggcgtccccttttagcctcttccacgtcaacctgctccatttctttcgtagcagttaccagtctctgaaactaagtctgtttctgtcttagcccgccaagtatttattgtatacgtatataggtgccaccgtacaggcagtacttctccaggttcaaaatgagcctgtttggaacaacctcaggttttggaaccagtgggaccagcatgtttggcagtgcaactacagacaatcacaatcccatgaaggatattgaagtaacatcatctcctgatgatagcattggttgtctgtcttttagcccaccaaccttgccggggaactttcttattgcaggatcatgggctaatgatgttcgctgctgggaagttcaagacagtggacagaccattccaaaagcccagcagatgcacactgggcctgtgcttgatgtctgctggagtgacgatgggagcaaagtgtttacggcatcgtgtgataaaactgccaaaatgtgggacctcagcagtaaccaagcgatacagatcgcacagcatgatgctcctgttaaaaccatccattggatcaaagctccaaactacagctgtgtgatgactgggagctgggataagactttaaagttttgggatactcgatcgtcaaatcctatgatggttttgcaactccctgaaaggtgttactgtgctgacgtgatataccccatggctgtggtggcaactgcagagaggggcctgattgtctatcagctagagaatcaaccttctgaattcaggaggatagaatctccactgaaacatcagcatcggtgtgtggctatttttaaagacaaacagaacaagcctactggttttgccctgggaagtatcgaggggagagttgctattcactatatcaaccccccgaaccccgccaaagataacttcacctttaaatgtcatcgatctaatggaaccaacacttcagctcctcaggacatttatgcggtaaatggaatcgcgttccatcctgttcatggcacccttgcaactgtgggatctgatggtagattcagcttctgggacaaagatgccagaacaaaactaaaaacttcggaacagttagatcagcccatctcagcttgctgtttcaatcacaatggaaacatatttgcatacgcttccagctacgactggtcaaagggacatgaattttataatccccagaaaaaaaattacattttcctgcgtaatgcagccgaagagctaaagcccaggaataagaagtagtggctggagactctggctcagccagagttgtttctctccactctgcctcatctctgtacgaatttgggtcccagccttgttgggttgtcagccatggacatggatttcaacccctggagaaaacgatgtcattgttcagcagctgagagcccaggcgtccgcggcgacttgccgtctctccattccactgcctgttgcagagtttttctgtaactaagggggttgaggttattgtagacgttagattgcgggcaccgccagggattttgcagcgcttcagtgtacgtgttagagaatattggaaaagcgtctgtgagccccgtgctgtattttgtaataaagtcttttgcagattgcttcccgagcttcctttgtccttttctccccttgcccaccccgtaacctcaggaacatgcgtcctgcccagcatcagcgtggggttttgagttgagatttcagacaccctctgggaaatgcggcaaccttaggggaaagggagtccccagctgcgctcacttctgctgcgcggaacggcagcctctgtgagccctggtgggcagagtttgaatgtgtttttccttgcttccctcattcccatcttcaaaatccccagtgctttctggccttgctgctcagatttccgagtgactcaaatggggactgttacttgtgctgggtgacaggccatttgtgggtaacctcctaaggcccaagtgggtgacacttgcgtgactttcaagttagaacccaagccccctgcatgggaattgccctgaactcttacccaccccggtcccctgcatgggaattgccctgaaccctcagtagtggttgtttggctgttcttttgtattttgtgtaatttaaaattcctggttggtaagtattcaaaatgaaattcagctgggctgagaaaaagtgtgacttttgggtctgtcactgtatttctcacctgtgatctcaaatgcttcttaggcctttctgtttggactaatgtgtgaagtctgacttgctgagtgtaaaattctagtatcgatagtgttgtaagatgtgtttgcctactcataaaaaacaatgaaaataaaattttctactggaagagaccacctgca

SEQ ID NO: 2411 - DNA, 2639 bp, Homo sapiens
gatcagcccgcctcggcctcccaaagtgctgggattacaggcgtgagccaccgcgcctggccagttgcggatttataaaagcagtcgcttagtaacttgcagcggctacatcaactttggaccaattcgcaaactgctggtgtaaagcgtttttgcgcatgtgctgtcgccttgcgggaaaaggagcctttttcttcgacgatttccgggcgacgcaggaagtggctccagggcgcacgcgcgttgtttccgcggtagtcagggcagtttctaccgcaggcttaaggaggcttcgggctcctgggatttctgtccgcgctcctggccctcgtccttcgcgccagagcaggttcgcaaactcctcagacccttctgctcccggccgccgctttccgccggggcgagacccccaggttcaaaatgagcctgtttggaacaacctcaggttttggaaccagtgggaccagcatgtttggcagtgcaactacagacaatcacaatcccatgaaggatattgaagtaacatcatctcctgatgatagcattggttgtctgtcttttagcccaccaaccttgccggggaactttcttattgcaggatcatgggctaatgatgttcgctgctgggaagttcaagacagtggacagaccattccaaaagcccagcagatgcacactgggcctgtgcttgatgtctgctggagtgacgatgggagcaaagtgtttacggcatcgtgtgataaaactgccaaaatgtgggacctcagcagtaaccaagcgatacagatcgcacagcatgatgctcctgttaaaaccatccattggatcaaagctccaaactacagctgtgtgatgactgggagctgggataagactttaaagttttgggatactcgatcgtcaaatcctatgatggttttgcaactccctgaaaggtgttactgtgctgacgtgatataccccatggctgtggtggcaactgcagagaggggcctgattgtctatcagctagagaatcaaccttctgaattcaggaggatagaatctccactgaaacatcagcatcggtgtgtggctatttttaaagacaaacagaacaagcctactggttttgccctgggaagtatcgaggggagagttgctattcactatatcaaccccccgaaccccgccaaagataacttcacctttaaatgtcatcgatctaatggaaccaacacttcagctcctcaggacatttatgcggtaaatggaatcgcgttccatcctgttcatggcacccttgcaactgtgggatctgatggtagattcagcttctgggacaaagatgccagaacaaaactaaaaacttcggaacagttagatcagcccatctcagcttgctgtttcaatcacaatggaaacatatttgcatacgcttccagctacgactggtcaaagggacatgaattttataatccccagaaaaaaaattacattttcctgcgtaatgcagccgaagagctaaagcccaggaataagaagtagtggctggagactctggctcagccagagttgtttctctccactctgcctcatctctgtacgaatttgggtcccagccttgttgggttgtcagccatggacatggatttcaacccctggagaaaacgatgtcattgttcagcagctgagagcccaggcgtccgcggcgacttgccgtctctccattccactgcctgttgcagagtttttctgtaactaagggggttgaggttattgtagacgttagattgcgggcaccgccagggattttgcagcgcttcagtgtacgtgttagagaatattggaaaagcgtctgtgagccccgtgctgtattttgtaataaagtcttttgcagattgcttcccgagcttcctttgtccttttctccccttgcccaccccgtaacctcaggaacatgcgtcctgcccagcatcagcgtggggttttgagttgagatttcagacaccctctgggaaatgcggcaaccttaggggaaagggagtccccagctgcgctcacttctgctgcgcggaacggcagcctctgtgagccctggtgggcagagtttgaatgtgtttttccttgcttccctcattcccatcttcaaaatccccagtgctttctggccttgctgctcagatttccgagtgactcaaatggggactgttacttgtgctgggtgacaggccatttgtgggtaacctcctaaggcccaagtgggtgacacttgcgtgactttcaagttagaacccaagccccctgcatgggaattgccctgaactcttacccaccccggtcccctgcatgggaattgccctgaaccctcagtagtggttgtttggctgttcttttgtattttgtgtaatttaaaattcctggttggtaagtattcaaaatgaaattcagctgggctgagaaaaagtgtgacttttgggtctgtcactgtatttctcacctgtgatctcaaatgcttcttaggcctttctgtttggactaatgtgtgaagtctgacttgctgagtgtaaaattctagtatcgatagtgttgtaagatgtgtttgcctactcataaaaaacaatgaaaataaaattttctactggaagagaccacctgca

SEQ ID NO: 2412 - DNA, 3106 bp, Homo sapiens
gtggtttcctagaaacatgattgtttattggcattgatctcacagtctggtgaggacttctttactgataatgtcaagttcaggttatcctcccaaccaaggagcattcagcacagaacaaagtcgttatcctcctcactctgtccagtatacatttcccaacacccgccaccagcaggatccagcattcggaggcaaacatgaagctccatcctctccaatttcggggcaaccatgtggagatgatcaaaatgcttcaccttcaaaactctcaaaggaagagttaatacagagtatggatcgtgtagatcgagaaattgcaaaagtagaacagcagatccttaaactgaaaaagaaacaacaacagcttgaagaagaggcagctaaacctcctgagcctgagaagcccgtgtcccctcctcctgtggagcagaaacaccgcagtattgtccaaattatttatgatgagaatcggaaaaaagcagaagaagctcataaaatttttgaaggtcttggcccaaaagttgaactgccactgtataaccagccatcagataccaaggtgtaccatgagaacatcaagacaaaccaggtgatgaggaaaaaactcattttattttttaaaagaagaaatcatgcaagaaaacaaagggaacaaaaaatctgccagcgttatgatcagctcatggaggcatgggagaaaaaagtggacagaatagaaaataatcctcggaggaaagctaaagaaagcaaaacaagggaatactatgaaaagcagtttccagaaattcgaaaacaaagagaacagcaagaaagatttcagcgagttgggcagaggggagctggtctttcagccaccattgctaggagtgagcatgagatttctgaaattattgatgggctctctgagcaggagaataatgagaaacaaatgcggcagctctctgtgattccacctatgatgtttgatgcagaacaaagacgagtcaagttcattaacatgaatgggcttatggaggaccctatgaaagtgtataaagataggcagtttatgaatgtttggactgaccatgaaaaggagatctttaaggacaagtttatccagcatccaaaaaactttggactaattgcatcatacttggagaggaagagtgttcctgattgtgttttgtattactatttaaccaagaaaaatgagaattataaagccctcgtcagaaggaattatgggaaacgcagaggcagaaaccagcaaattgctcgaccctcgcaagaagaaaaagtagaagaaaaagaagaggataaagcagaaaaaacagaaaaaaaagaagaagaaaagaaagatgaagaggaaaaagatgaaaaagaagactccaaagaaaataccaaggaaaaggacaagatagatggtacagcagaagaaactgaggaaagagagcaagccacaccccgggggcgaaagactgccaacagtcagggccgccgtaagggccggatcaccaggtccatgacaaacgaagctgcagctgccagtgctgcagccgcagcggctactgaagagcccccaccacctctgccaccgccaccagaacccatttctacagagcctgtggagacctctcgatggacagaagaagaaatggaagttgctaaaaaaggtctagtagaacatggtcgtaactgggcagcaattgctaaaatggtgggaacgaaaagtgaagctcaatgtaaaaacttctattttaactataaaaggcgacacaatcttgacaacctcttacagcagcataaacagaaaacttcacgaaaacctcgtgaagagcgagatgtgtctcaatgtgaaagtgtcgcttccactgtttctgctcaggaggatgaagatattgaagcctccaatgaagaagaaaatccagaagacagcgaaggtgcagaaaatagttctgatacagaaagtgctccttctccttcaccagttgaagctgtcaagcccagcgaggacagtcctgaaaatgctacttctcgaggaaacacagaacctgcggttgagcttgagcccaccacggaaactgcacccagtacatctccctccttagcagttccaagtacaaaaccagctgaagatgaaagtgtggagacccaggtgaatgacagcatcagtgctgagacagcagagcagatggatgtagatcagcaggagcacagtgctgaagagggttctgtttgtgatcccccacccgctaccaaagctgactctgtggacgttgaagtgagggtgccagaaaaccatgcatctaaagttgaaggtgataataccaaagaaagagacttggatagagccagtgagaaggtggaacctagagatgaagatttggtggtagctcagcaaataaatgcccaaaggcccgagccccagtcagacaatgattccagtgccacgtgcagcgctgatgaggatgtggatggagagccagagaggcagagaatgtttcctatggactcaaagccttcactgttaaaccccactggatctatactcgtctcatctccgttaaaaccaaatccactggatctgccacagcttcagcatcgagctgctgttatcccaccaatggtatcctgcaccccatgtaacataccaattggaaccccagtgagcggctatgctctctaccagcgacacattaaagcaatgcatgagtcagcactcctggaggagcagcggcagagacaagaacagatagatttggaatgtagaagttctacaagtccatgtggcacatccaagagtccaaacagagagtgggaaggtaggtagatagagctatcaccaagagaacttttatgaagggaaataaagctaaacccaaaagcagtgtccattgtgctttgtaagttgtcagcctcccaactgattattatatttgtcctaacagacacagttccttaaattgaccttaaactatgaagaaatgttagtattattaactactaaaggatgccagtaacatttttaatagcattctagttaatgtgaattttctgatattcatctttgtgctggaagacattataaataaagttatgctttatgttccgttcatctgaa

SEQ ID NO: 2413 - DNA, 7994 bp, Homo sapiens
gtggtttcctagaaacatgattgtttattggcattgatctcacagtctggtgaggacttctttactgataatgtcaagttcaggttatcctcccaaccaaggagcattcagcacagaacaaagtcgttatcctcctcactctgtccagtatacatttcccaacacccgccaccagcaggatccagcattcggaggcaaacatgaagctccatcctctccaatttcggggcaaccatgtggagatgatcaaaatgcttcaccttcaaaactctcaaaggaagagttaatacagagtatggatcgtgtagatcgagaaattgcaaaagtagaacagcagatccttaaactgaaaaagaaacaacaacagcttgaagaagaggcagctaaacctcctgagcctgagaagcccgtgtcccctcctcctgtggagcagaaacaccgcagtattgtccaaattatttatgatgagaatcggaaaaaagcagaagaagctcataaaatttttgaaggtcttggcccaaaagttgaactgccactgtataaccagccatcagataccaaggtgtaccatgagaacatcaagacaaaccaggtgatgaggaaaaaactcattttattttttaaaagaagaaatcatgcaagaaaacaaagggaacaaaaaatctgccagcgttatgatcagctcatggaggcatgggagaaaaaagtggacagaatagaaaataatcctcggaggaaagctaaagaaagcaaaacaagggaatactatgaaaagcagtttccagaaattcgaaaacaaagagaacagcaagaaagatttcagcgagttgggcagaggggagctggtctttcagccaccattgctaggagtgagcatgagatttctgaaattattgatgggctctctgagcaggagaataatgagaaacaaatgcggcagctctctgtgattccacctatgatgtttgatgcagaacaaagacgagtcaagttcattaacatgaatgggcttatggaggaccctatgaaagtgtataaagataggcagtttatgaatgtttggactgaccatgaaaaggagatctttaaggacaagtttatccagcatccaaaaaactttggactaattgcatcatacttggagaggaagagtgttcctgattgtgttttgtattactatttaaccaagaaaaatgagaattataaagccctcgtcagaaggaattatgggaaacgcagaggcagaaaccagcaaattgctcgaccctcgcaagaagaaaaagtagaagaaaaagaagaggataaagcagaaaaaacagaaaaaaaagaagaagaaaagaaagatgaagaggaaaaagatgaaaaagaagactccaaagaaaataccaaggaaaaggacaagatagatggtacagcagaagaaactgaggaaagagagcaagccacaccccgggggcgaaagactgccaacagtcagggccgccgtaagggccggatcaccaggtccatgacaaacgaagctgcagctgccagtgctgcagccgcagcggctactgaagagcccccaccacctctgccaccgccaccagaacccatttctacagagcctgtggagacctctcgatggacagaagaagaaatggaagttgctaaaaaaggtctagtagaacatggtcgtaactgggcagcaattgctaaaatggtgggaacgaaaagtgaagctcaatgtaaaaacttctattttaactataaaaggcgacacaatcttgacaacctcttacagcagcataaacagaaaacttcacgaaaacctcgtgaagagcgagatgtgtctcaatgtgaaagtgtcgcttccactgtttctgctcaggaggatgaagatattgaagcctccaatgaagaagaaaatccagaagacagcgaaggtgcagaaaatagttctgatacagaaagtgctccttctccttcaccagttgaagctgtcaagcccagcgaggacagtcctgaaaatgctacttctcgaggaaacacagaacctgcggttgagcttgagcccaccacggaaactgcacccagtacatctccctccttagcagttccaagtacaaaaccagctgaagatgaaagtgtggagacccaggtgaatgacagcatcagtgctgagacagcagagcagatggatgtagatcagcaggagcacagtgctgaagagggttctgtttgtgatcccccacccgctaccaaagctgactctgtggacgttgaagtgagggtgccagaaaaccatgcatctaaagttgaaggtgataataccaaagaaagagacttggatagagccagtgagaaggtggaacctagagatgaagatttggtggtagctcagcaaataaatgcccaaaggcccgagccccagtcagacaatgattccagtgccacgtgcagcgctgatgaggatgtggatggagagccagagaggcagagaatgtttcctatggactcaaagccttcactgttaaaccccactggatctatactcgtctcatctccgttaaaaccaaatccactggatctgccacagcttcagcatcgagctgctgttatcccaccaatggtatcctgcaccccatgtaacataccaattggaaccccagtgagcggctatgctctctaccagcgacacattaaagcaatgcatgagtcagcactcctggaggagcagcggcagagacaagaacagatagatttggaatgtagaagttctacaagtccatgtggcacatccaagagtccaaacagagagtgggaagtccttcagcctgctccacatcaagtgataactaatctccctgaaggcgttcggcttccgacaactcgaccaaccaggccaccgccccctctcatcccgtcatccaaaaccacagtggcttcagaaaaaccatcttttataatgggaggctccatctcacagggaacaccaggcacttatttgacttctcataatcaggcttcctacactcaagaaacacccaagccgtcagtgggatctatctctcttggactgccacggcaacaggaatctgccaaatcagctactttgccctacatcaagcaggaagaattttctccccgaagccaaaactcacaacctgagggtctgttggtcagggcccaacatgaaggtgtagtcagaggtaccgcaggagccatacaagaaggaagtataactcggggaactccaaccagcaaaatttcagtggagagcattccatccctacggggctctatcactcagggcaccccggctctgccccagactggcataccaacagaggctttggtgaaggggtccatttcgagaatgcccattgaagacagcagtcctgagaaaggcagagaggaagctgcatccaaaggccatgttatttatgaaggcaaaagtggacatatcttgtcatatgataatattaagaatgcccgagaagggactaggagtccaagaacagctcatgaaatcagtttaaagagaagctatgaatcagtggaaggaaatataaagcaagggatgtcaatgagggagtctcctgtatcagcaccgttagaggggctgatatgccgagcattacccagggggagtcctcattctgacctcaaagaaaggactgtattgtctggctccataatgcaggggacaccaagagcaacaactgaaagctttgaagatggccttaaatatcccaaacaaattaaaagggaaagtcctcccatacgagcatttgaaggtgccattaccaaaggaaaaccatatgatggcatcaccaccatcaaagaaatggggcgttccattcatgagattccaaggcaagatattttaactcaggaaagtcggaaaactccagaagtggtccagagcacacggccgataattgagggttccatttcccagggcacaccaataaagtttgacaacaactcaggtcaatctgccatcaaacacaatgtcaaatccttaatcacggggcctagcaaactatcccgtggaatgcctccgctggaaattgtgccagagaacataaaagtggtagaacggggaaaatatgaggatgtgaaagcaggcgagaccgtgcgttcccggcacacgtcagtggtaagctctggcccctccgttcttaggtccacactgcatgaagctcccaaagcacaactgagccctgggatttatgatgacaccagtgcacggaggacccctgtgagttatcaaaacaccatgtccagaggctcacccatgatgaacagaacttctgatgtttcttctaacaagtctaccaatcatgaaaggaaatcgacactgacccctacccagagggaaagtatcccagcgaagtctccagtgcctggggtggaccctgtcgtgagccacagtccgtttgatccccatcacagaggcagcactgcaggcgaggtttatcggagccacctgcccacgcacttggatccagccatgccttttcacagggctttggatcctgcggctgcttacctgtttcagagacagctttcaccaactccaggttacccaagtcagtatcagctttacgcaatggagaacacaagacagacaatcttaaatgattacattacctcacaacagatgcaagtgaacttgcgtccagatgtggccagaggactctccccaagagagcagccactgggtctcccatacccagcaacgagaggaatcattgacctgaccaatatgcctccaacaattttagtgcctcatccagggggaacaagcactcctcccatggacagaatcacttatattcctggtacacagattactttccctcccaggccgtacaactctgcttccatgtctccaggacacccaacacaccttgcagctgctgcaagtgctgagagggaacgggaacgggagcgggagaaggagcgggagcgggaacggattgctgcagcttcctccgacctctacctgcggccaggctcagaacagcctggccgacctggcagtcatggatatgttcgctccccttccccttcagtaagaactcaggagaccatgttgcaacagagacccagtgttttccaaggaaccaatggaaccagtgtaatcacacctttggatccaactgctcagctacgaatcatgccactgcctgctgggggcccttcaataagccaaggcctgccagcctcccgttacaacactgctgcggatgccctggctgctcttgtggatgctgcagcttctgcaccccagatggatgtgtccaaaacaaaagagagtaagcatgaagctgccaggttagaagaaaatttgagaagcaggtcagcagcagttagtgaacagcagcagctagagcagaaaaccctggaggtggagaagagatctgttcagtgtttatacacttcttcagcctttccaagtggcaagccccagcctcattcttcagtagtttattctgaggctgggaaagataaagggcctcctccaaaatccagatatgaggaagagctaaggaccagagggaagactaccattactgcagctaacttcatagacgtgatcatcacccggcaaattgcctcggacaaggatgcgagggaacgtggctctcaaagttcagactcttctagtagcttatcttctcacaggtatgaaacacctagcgatgctattgaggtgataagtcctgccagctcacctgcgccaccccaggagaaactgcagacctatcagccagaggttgttaaggcaaatcaagcggaaaatgatcctaccagacaatatgaaggaccattacatcactatcgaccacagcaggaatcaccatctccccaacaacagctgcccccttcttcacaggcagagggaatggggcaagtgcccaggacccatcggctgatcacacttgctgatcacatctgtcaaattatcacacaagattttgctagaaatcaagtttcctcgcagactccccagcagcctcctacttctacattccagaactcaccttctgctttggtatctacacctgtgaggactaaaacatcaaaccgttacagcccagaatcccaggctcagtctgtccatcatcaaagaccaggttcaagggtctctccagaaaatcttgtggacaaatccaggggaagtaggcctggaaaatccccagagaggagtcacgtctcttcggagccctacgagcccatctccccaccccaggttccggttgtgcatgagaaacaggacagcttgctgctcttgtctcagaggggcgcagagcctgcagagcagaggaatgatgcccgctcaccagggagtataagctacttgccttcattcttcaccaagcttgaaaatacatcacccatggttaaatcaaagaagcaggagatttttcgtaagttgaactcctctggtggaggtgactctgatatggcagctgctcagccaggaactgagatctttaatctgccagcagttactacgtcaggctcagttagctctagaggccattcttttgctgatcctgccagtaatcttgggctggaagacattatcaggaaggctctcatgggaagctttgatgacaaagttgaggatcatggagttgtcatgtcccagcctatgggagtagtgcctggtactgccaacacctcagttgtgaccagtggtgagacacgaagagaggaaggggacccatcacctcattcaggagtttgcaaaccaaagctgatcagcaagtcaaacagcaggaaatctaagtctcctatacctgggcaaggctacttaggaacggaacggccctcttcagtctcctctgtacattcagaaggggattaccataggcagacgccagggtgggcctgggaagacaggccctcttcaacaggctcaactcagtttccttataaccctctgactatgcggatgctcagcagtactccaccaacaccgattgcatgtgctccctctgcggtgaaccaagcagctcctcaccaacagaacaggatctgggagcgagagcctgccccactgctctcagcacagtacgagaccctgtcggatagtgatgactgaactgcacaaagtgaggggaacagggtgcaggagagggatctctagtttttgtggtttaatttttagtagcaggtcaaaaacctgccctcctgtgacttattccctgagacttttcaggagagccagcccacagatgatgaagaaatgatggaagttcatttggagagtcaaatgggaaaaaaacaaacaaaaaactgcctttgatacaggcaattcagtggactataataatagtggagggttgagatgtagagtttttaaaaagtgaacagttgctgttcttacatctgtaaagaaaaccataatgtctttaaatcactcttctgtaaatagatgacctttttgcagtgtatatccccttgctgtagtatctggtgtacttatgttcaaatcagcgcatcaactttgggggtgatttttaaaaatctttttgtctatctatctttttaaccctagccttctaaacaacctcatacagcccagttacataatgttggctgtcacgggcattgtacttttatctgatattgtttcctctaaattcagctttccagtgatgtttaaaatcttgtgaaaatgtttagatttttaacacagaccctgtcataaaatctgtacattagggtcaaaaggtaaaagtaacaaattctgccatattgtaaatttccagtgcaggctttaatttttttttttcattagtagcactgaaaaaatattactgcatgggtatgttctagttcagtttataaagttttaaaggcttatttgaggcatacctcactgttacgcacactggtaatttaaccatgcccctaagtattccttttctcctgcatttgatgcagcccaacaaagcttttgttttgaaataaatttgactaccctgtccata

SEQ ID NO: 2414 - DNA, 7950 bp, Homo sapiens
attggcattgatctcacagtctggtgaggacttctttactgataatgtcaagttcaggttatcctcccaaccaaggagcattcagcacagaacaaagtcgttatcctcctcactctgtccagtatacatttcccaacacccgccaccagcaggagttcgcagtccctgattatcgttcctctcatcttgaagtgagtcaggcatcacagcttttgcagcaacagcagcagcaacagcttcgaaggcgaccttccttgctttcagaatttcacccaggttctgacaggcctcaagaaaggagaactagttatgaaccgtttcatccaggcccatccccagtggatcatgattcactggaatcgaagcgaccacgtctggaacaggtttctgattctcattttcagcgtgtcagtgctgcggttttgcctttagtgcacccgctgccagaagggctgagggcttctgcagatgctaagaaggatccagcattcggaggcaaacatgaagctccatcctctccaatttcggggcaaccatgtggagatgatcaaaatgcttcaccttcaaaactctcaaaggaagagttaatacagagtatggatcgtgtagatcgagaaattgcaaaagtagaacagcagatccttaaactgaaaaagaaacaacaacagcttgaagaagaggcagctaaacctcctgagcctgagaagcccgtgtcccctcctcctgtggagcagaaacaccgcagtattgtccaaattatttatgatgagaatcggaaaaaagcagaagaagctcataaaatttttgaaggtcttggcccaaaagttgaactgccactgtataaccagccatcagataccaaggtgtaccatgagaacatcaagacaaaccaggtgatgaggaaaaaactcattttattttttaaaagaagaaatcatgcaagaaaacaaagggaacaaaaaatctgccagcgttatgatcagctcatggaggcatgggagaaaaaagtggacagaatagaaaataatcctcggaggaaagctaaagaaagcaaaacaagggaatactatgaaaagcagtttccagaaattcgaaaacaaagagaacagcaagaaagatttcagcgagttgggcagaggggagctggtctttcagccaccattgctaggagtgagcatgagatttctgaaattattgatgggctctctgagcaggagaataatgagaaacaaatgcggcagctctctgtgattccacctatgatgtttgatgcagaacaaagacgagtcaagttcattaacatgaatgggcttatggaggaccctatgaaagtgtataaagataggcagtttatgaatgtttggactgaccatgaaaaggagatctttaaggacaagtttatccagcatccaaaaaactttggactaattgcatcatacttggagaggaagagtgttcctgattgtgttttgtattactatttaaccaagaaaaatgagaattataaagccctcgtcagaaggaattatgggaaacgcagaggcagaaaccagcaaattgctcgaccctcgcaagaagaaaaagtagaagaaaaagaagaggataaagcagaaaaaacagaaaaaaaagaagaagaaaagaaagatgaagaggaaaaagatgaaaaagaagactccaaagaaaataccaaggaaaaggacaagatagatggtacagcagaagaaactgaggaaagagagcaagccacaccccgggggcgaaagactgccaacagtcagggccgccgtaagggccggatcaccaggtccatgacaaacgaagctgcagctgccagtgctgcagccgcagcggctactgaagagcccccaccacctctgccaccgccaccagaacccatttctacagagcctgtggagacctctcgatggacagaagaagaaatggaagttgctaaaaaaggtctagtagaacatggtcgtaactgggcagcaattgctaaaatggtgggaacgaaaagtgaagctcaatgtaaaaacttctattttaactataaaaggcgacacaatcttgacaacctcttacagcagcataaacagaaaacttcacgaaaacctcgtgaagagcgagatgtgtctcaatgtgaaagtgtcgcttccactgtttctgctcaggaggatgaagatattgaagcctccaatgaagaagaaaatccagaagacagcgaaggtgcagaaaatagttctgatacagaaagtgctccttctccttcaccagttgaagctgtcaagcccagcgaggacagtcctgaaaatgctacttctcgaggaaacacagaacctgcggttgagcttgagcccaccacggaaactgcacccagtacatctccctccttagcagttccaagtacaaaaccagctgaagatgaaagtgtggagacccaggtgaatgacagcatcagtgctgagacagcagagcagatggatgtagatcagcaggagcacagtgctgaagagggttctgtttgtgatcccccacccgctaccaaagctgactctgtggacgttgaagtgagggtgccagaaaaccatgcatctaaagttgaaggtgataataccaaagaaagagacttggatagagccagtgagaaggtggaacctagagatgaagatttggtggtagctcagcaaataaatgcccaaaggcccgagccccagtcagacaatgattccagtgccacgtgcagcgctgatgaggatgtggatggagagccagagaggcagagaatgtttcctatggactcaaagccttcactgttaaaccccactggatctatactcgtctcatctccgttaaaaccaaatccactggatctgccacagcttcagcatcgagctgctgttatcccaccaatggtatcctgcaccccatgtaacataccaattggaaccccagtgagcggctatgctctctaccagcgacacattaaagcaatgcatgagtcagcactcctggaggagcagcggcagagacaagaacagatagatttggaatgtagaagttctacaagtccatgtggcacatccaagagtccaaacagagagtgggaagtccttcagcctgctccacatcaagtgataactaatctccctgaaggcgttcggcttccgacaactcgaccaaccaggccaccgccccctctcatcccgtcatccaaaaccacagtggcttcagaaaaaccatcttttataatgggaggctccatctcacagggaacaccaggcacttatttgacttctcataatcaggcttcctacactcaagaaacacccaagccgtcagtgggatctatctctcttggactgccacggcaacaggaatctgccaaatcagctactttgccctacatcaagcaggaagaattttctccccgaagccaaaactcacaacctgagggtctgttggtcagggcccaacatgaaggtgtagtcagaggtaccgcaggagccatacaagaaggaagtataactcggggaactccaaccagcaaaatttcagtggagagcattccatccctacggggctctatcactcagggcaccccggctctgccccagactggcataccaacagaggctttggtgaaggggtccatttcgagaatgcccattgaagacagcagtcctgagaaaggcagagaggaagctgcatccaaaggccatgttatttatgaaggcaaaagtggacatatcttgtcatatgataatattaagaatgcccgagaagggactaggagtccaagaacagctcatgaaatcagtttaaagagaagctatgaatcagtggaaggaaatataaagcaagggatgtcaatgagggagtctcctgtatcagcaccgttagaggggctgatatgccgagcattacccagggggagtcctcattctgacctcaaagaaaggactgtattgtctggctccataatgcaggggacaccaagagcaacaactgaaagctttgaagatggccttaaatatcccaaacaaattaaaagggaaagtcctcccatacgagcatttgaaggtgccattaccaaaggaaaaccatatgatggcatcaccaccatcaaagaaatggggcgttccattcatgagattccaaggcaagatattttaactcaggaaagtcggaaaactccagaagtggtccagagcacacggccgataattgagggttccatttcccagggcacaccaataaagtttgacaacaactcaggtcaatctgccatcaaacacaatgtcaaatccttaatcacggggcctagcaaactatcccgtggaatgcctccgctggaaattgtgccagagaacataaaagtggtagaacggggaaaatatgaggatgtgaaagcaggcgagaccgtgcgttcccggcacacgtcagtggtaagctctggcccctccgttcttaggtccacactgcatgaagctcccaaagcacaactgagccctgggatttatgatgacaccagtgcacggaggacccctgtgagttatcaaaacaccatgtccagaggctcacccatgatgaacagaacttctgatgttacaatttcttctaacaagtctaccaatcatgaaaggaaatcgacactgacccctacccagagggaaagtatcccagcgaagtctccagtgcctggggtggaccctgtcgtgagccacagtccgtttgatccccatcacagaggcagcactgcaggcgaggtttatcggagccacctgcccacgcacttggatccagccatgccttttcacagggctttggatcctgcagcggctgcttacctgtttcagagacagctttcaccaactccaggttacccaagtcagtatcagctttacgcaatggagaacacaagacagacaatcttaaatgattacattacctcacaacagatgcaagtgaacttgcgtccagatgtggccagaggactctccccaagagagcagccactgggtctcccatacccagcaacgagaggaatcattgacctgaccaatatgcctccaacaattttagtgcctcatccagggggaacaagcactcctcccatggacagaatcacttatattcctggtacacagattactttccctcccaggccgtacaactctgcttccatgtctccaggacacccaacacaccttgcagctgctgcaagtgctgagagggaacgggaacgggagcgggagaaggagcgggagcgggaacggattgctgcagcttcctccgacctctacctgcggccaggctcagaacagcctggccgacctggcagtcatggatatgttcgctccccttccccttcagtaagaactcaggagaccatgttgcaacagagacccagtgttttccaaggaaccaatggaaccagtgtaatcacacctttggatccaactgctcagctacgaatcatgccactgcctgctgggggcccttcaataagccaaggcctgccagcctcccgttacaacactgctgcggatgccctggctgctcttgtggatgctgcagcttctgcaccccagatggatgtgtccaaaacaaaagagatatcttctcacaggtatgaaacacctagcgatgctattgaggtgataagtcctgccagctcacctgcgccaccccaggagaaactgcagacctatcagccagaggttgttaaggcaaatcaagcggaaaatgatcctaccagacaatatgaaggaccattacatcactatcgaccacagcaggaatcaccatctccccaacaacagctgcccccttcttcacaggcagagggaatggggcaagtgcccaggacccatcggctgatcacacttgctgatcacatctgtcaaattatcacacaagattttgctagaaatcaagtttcctcgcagactccccagcagcctcctacttctacattccagaactcaccttctgctttggtatctacacctgtgaggactaaaacatcaaaccgttacagcccagaatcccaggctcagtctgtccatcatcaaagaccaggttcaagggtctctccagaaaatcttgtggacaaatccaggggaagtaggcctggaaaatccccagagaggagtcacgtctcttcggagccctacgagcccatctccccaccccaggttccggttgtgcatgagaaacaggacagcttgctgctcttgtctcagaggggcgcagagcctgcagagcagaggaatgatgcccgctcaccagggagtataagctacttgccttcattcttcaccaagcttgaaaatacatcacccatggttaaatcaaagaagcaggagatttttcgtaagttgaactcctctggtggaggtgactctgatatggcagctgctcagccaggaactgagatctttaatctgccagcagttactacgtcaggctcagttagctctagaggccattcttttgctgatcctgccagtaatcttgggctggaagacattatcaggaaggctctcatgggaagctttgatgacaaagttgaggatcatggagttgtcatgtcccagcctatgggagtagtgcctggtactgccaacacctcagttgtgaccagtggtgagacacgaagagaggaaggggacccatcacctcattcaggaggagtttgcaaaccaaagctgatcagcaagtcaaacagcaggaaatctaagtctcctatacctgggcaaggctacttaggaacggaacggccctcttcagtctcctctgtacattcagaaggggattaccataggcagacgccagggtgggcctgggaagacaggccctcttcaacaggctcaactcagtttccttataaccctctgactatgcggatgctcagcagtactccaccaacaccgattgcatgtgctccctctgcggtgaaccaagcagctcctcaccaacagaacaggatctgggagcgagagcctgccccactgctctcagcacagtacgagaccctgtcggatagtgatgactgaactgcacaaagtgaggggaacagggtgcaggagagggatctctagtttttgtggtttaatttttagtagcaggtcaaaaacctgccctcctgtgacttattccctgagacttttcaggagagccagcccacagatgatgaagaaatgatggaagttcatttggagagtcaaatgggaaaaaaacaaacaaaaaactgcctttgatacaggcaattcagtggactataataatagtggagggttgagatgtagagtttttaaaaagtgaacagttgctgttcttacatctgtaaagaaaaccataatgtctttaaatcactcttctgtaaatagatgacctttttgcagtgtatatccccttgctgtagtatctggtgtacttatgttcaaatcagcgcatcaactttgggggtgatttttaaaaatctttttgtctatctatctttttaaccctagccttctaaacaacctcatacagcccagttacataatgttggctgtcacgggcattgtacttttatctgatattgtttcctctaaattcagctttccagtgatgtttaaaatcttgtgaaaatgtttagatttttaacacagaccctgtcataaaatctgtacattagggtcaaaaggtaaaagtaacaaattctgccatattgtaaatttccagtgcaggctttaatttttttttttcattagtagcactgaaaaaatattactgcatgggtatgttctagttcagtttataaagttttaaaggcttatttgaggcatacctcactgttacgcacactggtaatttaaccatgcccctaagtattccttttctcctgcatttgatgcagcccaacaaagcttttgttttgaaataaatttgactaccctgtccata

SEQ ID NO: 2415 - DNA, 3419 bp, Homo sapiens
tttcagtggagagcattccatccctacggggctctatcactcagggcacaccaataaagtttgacaacaactcaggtcaatctgccatcaaacacaatgtcaaatccttaatcacggggcctagcaaactatcccgtggaatgcctccgctggaaattgtgccagagaacataaaagtggtagaacggggaaaatatgaggatgtgaaagcaggcgagaccgtgcgttcccggcacacgtcagtggtaagctctggcccctccgttcttaggtccacactgcatgaagctcccaaagcacaactgagccctgggatttatgatgacaccagtgcacggaggacccctgtgagttatcaaaacaccatgtccagaggctcacccatgatgaacagaacttctgatgttacaatttcttctaacaagtctaccaatcatgaaaggaaatcgacactgacccctacccagagggaaagtatcccagcgaagtctccagtgcctggggtggaccctgtcgtgagccacagtccgtttgatccccatcacagaggcagcactgcaggcgaggtttatcggagccacctgcccacgcacttggatccagccatgccttttcacagggctttggatcctgcagcggctgcttacctgtttcagagacagctttcaccaactccaggttacccaagtcagtatcagctttacgcaatggagaacacaagacagacaatcttaaatgattacattacctcacaacagatgcaagtgaacttgcgtccagatgtggccagaggactctccccaagagagcagccactgggtctcccatacccagcaacgagaggaatcattgacctgaccaatatgcctccaacaattttagtgcctcatccagggggaacaagcactcctcccatggacagaatcacttatattcctggtacacagattactttccctcccaggccgtacaactctgcttccatgtctccaggacacccaacacaccttgcagctgctgcaagtgctgagagggaacgggaacgggagcgggagaaggagcgggagcgggaacggattgctgcagcttcctccgacctctacctgcggccaggctcagaacagcctggccgacctggcagtcatggatatgttcgctccccttccccttcagtaagaactcaggagaccatgttgcaacagagacccagtgttttccaaggaaccaatggaaccagtgtaatcacacctttggatccaactgctcagctacgaatcatgccactgcctgctgggggcccttcaataagccaaggcctgccagcctcccgttacaacactgctgcggatgccctggctgctcttgtggatgctgcagcttctgcaccccagatggatgtgtccaaaacaaaagagagtaagcatgaagctgccaggttagaagaaaatttgagaagcaggtcagcagcagttagtgaacagcagcagctagagcagaaaaccctggaggtggagaagagatctgttcagtgtttatacacttcttcagcctttccaagtggcaagccccagcctcattcttcagtagtttattctgaggctgggaaagataaagggcctcctccaaaatccagatatgaggaagagctaaggaccagagggaagactaccattactgcagctaacttcatagacgtgatcatcacccggcaaattgcctcggacaaggatgcgagggaacgtggctctcaaagttcagactcttctagtagcttatcttctcacaggtatgaaacacctagcgatgctattgaggtgataagtcctgccagctcacctgcgccaccccaggagaaactgcagacctatcagccagaggttgttaaggcaaatcaagcggaaaatgatcctaccagacaatatgaaggaccattacatcactatcgaccacagcaggaatcaccatctccccaacaacagctgcccccttcttcacaggcagagggaatggggcaagtgcccaggacccatcggctgatcacacttgctgatcacatctgtcaaattatcacacaagattttgctagaaatcaagtttcctcgcagactccccagcagcctcctacttctacattccagaactcaccttctgctttggtatctacacctgtgaggactaaaacatcaaaccgttacagcccagaatcccaggctcagtctgtccatcatcaaagaccaggttcaagggtctctccagaaaatcttgtggacaaatccaggggaagtaggcctggaaaatccccagagaggagtcacgtctcttcggagccctacgagcccatctccccaccccaggttccggttgtgcatgagaaacaggacagcttgctgctcttgtctcagaggggcgcagagcctgcagagcagaggaatgatgcccgctcaccagggagtataagctacttgccttcattcttcaccaagcttgaaaatacatcacccatggttaaatcaaagaagcaggagatttttcgtaagttgaactcctctggtggaggtgactctgatatggcagctgctcagccaggaactgagatctttaatctgccagcagttactacgtcaggctcagttagctctagaggccattcttttgctgatcctgccagtaatcttgggctggaagacattatcaggaaggctctcatgggaagctttgatgacaaagttgaggatcatggagttgtcatgtcccagcctatgggagtagtgcctggtactgccaacacctcagttgtgaccagtggtgagacacgaagagaggaaggggacccatcacctcattcaggaggagtttgcaaaccaaagctgatcagcaagtcaaacagcaggaaatctaagtctcctatacctgggcaaggctacttaggaacggaacggccctcttcagtctcctctgtacattcagaaggggattaccataggcagacgccagggtgggcctgggaagacaggccctcttcaacaggctcaactcagtttccttataaccctctgactatgcggatgctcagcagtactccaccaacaccgattgcatgtgctccctctgcggtgaaccaagcagctcctcaccaacagaacaggatctgggagcgagagcctgccccactgctctcagcacagtacgagaccctgtcggatagtgatgactgaactgcacaaagtgaggggaacagggtgcaggagagggatctctagtttttgtggtttaatttttagtagcaggtcaaaaacctgccctcctgtgacttattccctgagacttttcaggagagccagcccacagatgatgaagaaatgatggaagttcatttggagagtcaaatgggaaaaaaacaaacaaaaaactgcctttga

SEQ ID NO: 2416 - DNA, 6839 bp, Homo sapiens
ggggatgcaagcgggaggataaagcgatgaagtgtgctgcgttaccgcgcatcaggcgctgttgttggagccggaacaccgtgcgactctgaccgaaccggccccctcctcgcgcacacactcgccgagccgcgcgcgcccctccgccgtgacagtggccgtggcctccgctctctcggggcacccggcagccagagcgcagcgagagcgggcggtcgccagggtcccctccccagccagtcccaggcgcccggtgcactatgcggggcacgtgcgccccccagctctaatctgcgcgctgacaggagcatgatctgtgcccaggccagggctgccaagatatcaatgctatgttcagcagaaacggatacagcaagagcagcatagttcaaaaattgagggaggcatcttctctcttttcctgggatttaaacgcgatttaggagggcagatgccctacccgaaaaggccaaccgttaaagaccccggcagtgttgtggtccaaggcgtctcaaagcaggtggccagatctgcgtttctcatcagcagactcactccggctgtggctattacggaattgatgcgcgtacacgtggtgggtcattatgctgctgcacctgtgtagtgtgaagaatctgtaccagaacaggtttttaggcctggccgccatggcgtctccttctagaaactcccagagccgacgccggtgcaaggagccgctccgatacagctacaaccccgaccagttccacaacatggacctcaggggcggcccccacgatggcgtcaccattccccgctccaccagcgacactgacctggtcacctcggacagccgctccacgctcatggtcagcagctcctactattccatcgggcactctcaggacctggtcatccactgggacataaaggaggaagtggacgctggggactggattggcatgtacctcattgatgaggtcttgtccgaaaactttctggactataaaaaccgtggagtcaatggttctcatcggggccagatcatctggaagatcgatgccagctcgtactttgtggaacctgaaactaagatctgcttcaaatactaccatggagtgagtggggccctgcgagcaaccacccccagtgtcacggtcaaaaactcggcagctcctatttttaaaagcattggtgctgatgagaccgtccaaggacaaggaagtcggaggctgatcagcttctctctctcagatttccaagccatggggttgaagaaagggatgtttttcaacccagacccttatctgaagatttccattcagcctgggaaacacagcatcttccccgccctccctcaccatggacaggagaggagatccaagatcataggcaacaccgtgaaccccatctggcaggccgagcaattcagttttgtgtccttgcccactgacgtgctggaaattgaggtgaaggacaagtttgccaagagccgccccatcatcaagcgcttcttgggaaagctgtcgatgcccgttcaaagactcctggagagacacgccataggggatagggtggtcagctacacacttggccgcaggcttccaacagatcatgtgagtggacagctgcaattccgatttgagatcacttcctccatccacccagatgatgaggagatttccctgagtaccgagcctgagtcagcccaaattcaggacagccccatgaacaacctgatggaaagcggcagtggggaacctcggtctgaggcaccagagtcctctgagagctggaagccagagcagctgggtgagggcagtgtccccgatggtccagggaaccaaagcatagagctttccagaccagctgaggaagcagcagtcatcacggaggcaggagaccagggcatggtctctgtgggacctgaaggggctggggagctcctggcccaggtgcaaaaggacatccagcctgcccccagtgcagaagagctggccgagcagctggacctgggtgaggaggcatcagcactgctgctggaagacggtgaagccccagccagcaccaaggaggagcccttggaggaggaagcaacgacccagagccgggctggaagggaagaagaggagaaggagcaggaggaggagggagatgtgtctaccctggagcagggagagggcaggctgcagctgcgggcctcggtgaagagaaaaagcaggccctgctccttgcctgtgtccgagctggagacggtgatcgcgtcagcctgcggggaccccgagaccccgcggacacactacatccgcatccacaccctgctgcacagcatgccctccgcccagggcggcagcgcggcagaggaggaggacggcgcggaggaggagtccaccctcaaggactcctcggagaaggatgggctcagcgaggtggacacggtggccgctgacccgtctgccctggaagaggacagagaagagcccgagggggctactccaggcacggcgcaccctggccactccgggggccacttccccagcctggccaatggcgcggcccaggatggcgacacgcaccccagcaccgggagcgagagcgactccagccccaggcaaggcggggaccacagttgcgagggctgtgacgcgtcctgctgcagcccctcgtgctacagctcctcgtgctacagcacgtcctgctacagcagctcgtgctacagcgcctcgtgctacagcccctcctgctacaacggcaacaggttcgccagccacacgcgcttctcctccgtggacagcgccaagatctccgagagcacggtcttctcctcgcaagacgacgaggaggaggagaacagcgcgttcgagtcggtacccgactccatgcagagccctgagctggacccggagtccacgaacggcgctgggccgtggcaagacgagctggccgcccctagcgggcacgtggaaagaagcccggaaggtctggaatcccccgtggcaggtccaagcaatcggagagaaggtgaatgtcctatactccataattcccagccagtaagccagcttccttccctgaggcctgaacatcatcactacccaacaatcgatgagcctcttccaccaaactgggaagctcgaattgacagccacgggcgggtcttttatgtggaccacgtgaaccgcacaaccacctggcagcgtccgacggcagcagccaccccggatggcatgcggagatcggggtccatccagcagatggagcaactcaacaggcggtatcaaaacattcagcgaaccattgcaacagagaggtccgaagaagattctggcagccaaagctgcgagcaagccccagcaggaggaggcggaggtggagggagtgactcagaagccgaatcttcccagtccagcttagatctaaggagagaagggtcactttctccagtgaactcacaaaaaatcaccttgctgctgcagtccccagcggtcaagttcatcaccaaccccgagttcttcactgtgctacatgccaattatagtgcctaccgagtcttcaccagtagcacctgcttaaagcacatgattctgaaagtccgacgggatgctcgcaattttgaacgctaccagcacaaccgggacttggtgaatttcatcaacatgttcgcagacactcggctggaactgccccggggctgggagatcaaaacggaccagcagggaaagtcttttttcgtggaccacaacagtcgagctaccactttcattgacccccgaatccctcttcagaacggtcgtcttcccaatcatctaactcaccgacagcacctccagaggctccgaagttacagcgctggagaggcctcagaagtttctagaaacagaggagcctctttactggccaggccaggacacagcttagtagctgctattcgaagccaacatcaacatgagtcattgccactggcatataatgacaagattgtggcatttcttcgccagccaaacatttttgaaatgctgcaagagcgtcagccaagcttagcaagaaaccacacactcagggagaaaatccattacattcggactgagggtaatcacgggcttgagaagttgtcctgtgatgcggatctggtcattttgctgagtctctttgaagaagagattatgtcctacgtccccctgcaggctgccttccaccctgggtatagcttctctccccgatgttcaccctgttcttcacctcagaactccccaggtttacagagagccagtgcaagagccccttccccctaccgaagagactttgaggccaagctccgcaatttctacagaaaactggaagccaaaggatttggtcagggtccggggaaaattaagctcattattcgccgggatcatttgttggagggaaccttcaatcaggtgatggcctattcgcggaaagagctccagcgaaacaagctctacgtcacctttgttggagaggagggcctggactacagtggcccctcgcgggagttcttcttccttctgtctcaggagctcttcaacccttactatggactctttgagtactcggcaaatgatacttacacggtgcagatcagccccatgtccgcatttgtagaaaaccatcttgagtggttcaggtttagcggtcgcatcctgggtctggctctgatccatcagtaccttcttgacgctttcttcacgaggcccttctacaaggcactcctgagactgccctgtgatttgagtgacctggaatatttggatgaggaattccaccagagtttgcagtggatgaaggacaacaacatcacagacatcttagacctcactttcactgttaatgaagaggtttttggacaggtcacggaaagggagttgaagtctggaggagccaacacacaggtgacggagaaaaacaagaaggagtacatcgagcgcatggtgaagtggcgggtggagcgcggcgtggtacagcagaccgaggcgctggtgcgcggcttctacgaggttgtagactcgaggctggtgtccgtgtttgatgccagggagctggagctggtgatagctggcaccgcggaaatcgacctaaatgactggcggaataacactgagtaccggggaggttaccacgatgggcatcttgtgatccgctggttctgggctgcggtggagcgcttcaataatgagcagaggctgagattactgcagtttgtcacgggaacatccagcgtgccctacgaaggcttcgcagccctccgtgggagcaatgggcttcggcgcttctgcatagagaaatgggggaaaattacttctctccccagggcacacacatgcttcaaccgactggatcttccaccgtatccctcgtactccatgttgtatgaaaagctgttaacagcagtagaggaaaccagcacctttggacttgagtgaggacatggaacctcgcctgacattttcctggccagtgacatcacccttcctgggatgatccccttttccctttcccttaatcaactctcctttgattttggtattccatgatttttattttcaaaccaaatcaggattgacaaaagctgtgcatgaagaactgccttcttctaagatctaaccttcaggcttctctcctctgttttcaatgaactgctagcctgtatgcaatattaaaaaacagctgtctcaaggtctgtgtatatctccacatacctccattactaacaatgaaatatgaatgcaagttaagctacacttgaccaaatggtaataaatgtttacttccatttctatcattgaagggaaaatgtgagcattaagcactccaggctttcatatgcccatgtcttctgagcagagccaccattttttataatttctaataaccaactccagaactaggagctgatcaactctttgttttcctctccatctacttttccctgtgcataatatccatccaaaggacaacagtggcaaagctgaaatttttatacattcaactcatgattcacatgtggcatcagtcccatcagccggaactagcctagacatacggtgcaaatatgacacttctaacgattaacaacagcaagaaaacacctgctgctgatgcaatgcaatgcatcccaatggttgtggggattgtgggctcaactcaagagaagtttaggagggggagcatccctagtgaatactcacaccacaagaaggacaaacttgtgcacatgtccaagaaagaaagcttcttgattgaggtagcatgaaggatgaggcttcagcccccattgtcttatgtagaatgtggcaatgccaactggagaaagggaagaaggacatattaccttggtttgaatccctgagttctgtactgttctgttttgtttagtctagccacagttcttcacaaaggaaaaaaaaatgtgtagatgataccatgacttttgttaaagccatgacttttgtttgcttggcagacaaaccctttttttaaaactttgatatttttttttcacatttttttttccttttcctttcttaatcatggagttcaagttcctttgcattcgattgtccatcgggaccacactaggaagctgcagagagtgatggtgcttgttagggatcaagggcaacatagtacttctccttcacccatagtaatcctcctggggcagaaacataacaccccaaaggcacgttgatttgtatcaaaataaatatccagtttcttttagcattcagtgaaaacatatctcagaaaacttcatgttgtcagaaaaacagctgcaggctccaaagacagcctaacctctcaactacatttgaaataaacccaaccataatggt

SEQ ID NO: 2417 - DNA, 1809 bp, Homo sapiens
gcttctggcccctttctctggaggagctccgcgcgtggcgagtctgtgtcctccctgtcccccagagcagagaaccctctctgtgtctggacgggggaggagcagacgctggacaggtttttggcaaaatgctggcaattcccaggaagatatgtggagaacggaaaggttgctacacccaaatagtggcgcaaaggctatgattatggaggattggacctgcaaactccagaacagagcaaccttgtaaaatgtgtgtgggcagcacagagaccttgggcaagttaacagtttcctcatctgtaaatactgatttatggaaagcacctggtgtatgttctgccctctgaggaccctgccctttcccaaaaggggtatcttaagaaggaaaatatggctgctctttgccggacagcagagtcccaggctgaactccagtgcacccagttagacttggagcggaaactcaagttgaatgaaaatgccatctccaggctccaggctaaccaaaagtctgttctggtgtcggtgtcagaggtcaaagcagtggctgaaatgcagtttggggaactccttgctgctgtgaggaaggcccaggccaatgtgatgctcttcttagaggagaaggagcaagctgcgctgagccaggccaacggtatcaaggcccacctggagtacaggagtgccgagatggagaagagtaagcaggagctggagacgatggcggccatcagcaacactgtccagttcttggaggagtactgcaagtttaagaacactgaagacatcaccttccctagtgtttacatagggctgaaggataaactctcgggcatccgcaaagttatcacggaatccactgtacacttaatccagttgctggagaactataagaaaaagctccaggagttttccaaggaagaggagtatgacatcagaactcaagtgtctgccattgttcagcgcaaatattggacttccaaacctgagcccagcaccagggaacagttcctccaatatgtgcatgacatcacgttcgacccggacacagcacacaagtatctccggctgcaggaggagaaccgcaaggtcaccaacaccacgccctgggagcatccctacccggacctccccagcaggttcctgcactggcggcaggtgctgtcccagcagagtctgtacctgcacaggtactattttgaggtggagatcttcggggcaggcacctatgttggcctgacctgcaaaggcatcgaccagaaaggggaggagcgcagcagttgcatttccggaaacaacttctcctggagcctccaatggaacgggaaggagttcacggcctggtacagtgacatggagaccccactcaaagctggccctttctggaggctcggggtctatattgacttcccaggagggatcctttccttctatggcgtagagtatgattccatgactctggttcacaagtttgcctgcaagttttcagaaccagtctatgctgccttctggctttccaagaaggaaaacgccatccggattgtagatctgggagaggaacccgagaagccagcaccgtccttggtggggactgctccctagactccaggagccatatcccagacctttgccagctacagtgatgggatttgcattttagggtgatttgggggcaaaaataactgctgatggtagctggcttttgaaatcctatggggtctctgaatgaaaacattctccagctgctctcttttgctccatatggtgctgttctctatgtgtttgcagtaattcttttttttttttttt

SEQ ID NO: 2418 - DNA, 2392 bp, Homo sapiens
gagcagcggctctggcggtcgtggcggtcggagatccgagagctctgcttctctgaaaagcgtgtggctttctggacttgtttcaggccacccacgagccagcgggaaaggattgccagccagagaaagacgaactccgaagtcccaatgcacagatcagcccccagtcaaaccaccaagaggagccgatcgccattttccactactcgtcgtagttgggacgacagcgagagttcgggaaccaacctgaatattgataatgaggactattccaggtatccgccaagagagtacagagcttcgggtagcagaagaggaatggcctatggacatattgactcttatggggcagatgatagtgaggaggagggggctgggcctgttgagcgaccgccagtgagagggaaaactggcaagtttaaagatgataagctgttagacccagtccctgcagcaagatgctcagctagcagagctgacttcctgccacaaagtagtgtggcctcacagtcgtcttctgaaggcaagctggctacaaaaggtgacagctcggagagggagagaagggagcaaaatttacctgcacgtcccagcagggctcctgtgagtatttgtggtggtggggaaaacacctcaaagagtgcagaggaacctgtggtcaggcccaaaatcagaaacctggcaagtccaaactgcgtgaaaccaaaaattttttttgatactgatgatgatgacgatatgccacacagtacttccaggtggagggataccgccaatgacaatgagggccactcggatggcctggcaagaagagggagaggcgagagttcaagtggctatcccgagccaaagtaccctgaagacaaacgggaagcgaggagtgaccaagtgaaaccagaaaaggtgccgagacgacgacgcaccatggccgaccctgacttctggacgcacagtgatgattactacaaatactgcgacgaagactctgacagtgacaaagagtggattgctgctctgcgtcggaaatatcgaagccgagagcaaaccctgtcctccagtggcgaaagctgggagactctgccggggaaagaagagcgggaacctccacaggctaaggtgagtgccagcactggcaccagccctggccccggtgctagtgccagtgccggggctggcgccggggccagtgctggcagcaatggcagcaattaccttgaagaagttcgagaaccatctcttcaggaagagcaggcatccctggaagaaggagaaattccttggctccagtaccatgagaatgacagtagcagtgagggggataatgattctggtcacgagttgatgcaacctggggtattcatgctggatggaaacaacaaccttgaagatgactccagtgtgagcgaagacctagaagtggattggagcctctttgatggatttgcagatgggttaggagtggctgaagccatttcctatgtggaccctcagttcctcacctacatggcacttgaagaacgcctggcccaggcaatggaaactgcccttgcgcacttggagtctctcgcagtggatgtagaggtggccaatccaccagcaagcaaggagagcattgacgctcttcccgagatcctggtcactgaagatcatggcgcagttggtcaggagatgtgctgccccatctgctgtagcgaatatgtgaagggggaggtggcaactgagctgccgtgccaccactatttccacaagccgtgtgtgtccatctggcttcagaagtcaggcacctgccccgtgtgccgctgcatgttccctcccccactctaaagaccaaggccgtttactcctggtctgattattttccccatctgaaatccacaatactgcaggagccctcttgaaattaacaatggaaataaaaccaatcagtcagttagcctaaacctattgattcctcgtgattatttccaatgtgaaaacagttgtgtatgattgcattaaaaatcatatcatcttttagaggttagaaaagggaaaactaaactttctaaatgctacttgagattgcagtaagaagatacgttttctaacctgaaagttaaatcgcatttgttttcttcagtagaatgggaatgtgttgctgttacttgtaatgtcaagtttatctgttaaatatgtccaaaaggcaaaatcatttttgttgcatgttatgggtcgatgttcctgtaattgcagtgccgtaaaagcttattaaagttgttcttttggttttacatggtataatggaattttttggttttgtctgaagcagtggtactgaatgactttataattgatcccttgcatttgcatcaaaagctttagtttcactggaaatgctgacttcaacaattgc

SEQ ID NO: 2419 - DNA, 4672 bp, Homo sapiens
gtgccaccatgcccagctgagttacgcagcgtgacaaatggtcagtctaaccaaccaagtaatgaaggtgatgccatcaaagtttttgtgcgaattcgtcctcctgcagaaagatctgggtcagctgatggagagcagaacttatgcttatctgtgctgtcctccacgagtctccggctgcactccaaccctgagcccaagaccttcacgtttgatcatgttgcagatgtggataccactcaggaatctgtattcgcaactgtggctaaaagcattgtggagtcttgcatgagcggttataatggtaccatctttgcatatggacagactggctcagggaagacatttactatgatgggaccatctgaatctgataatttttctcataacctgagaggagtaatcccacgaagttttgaatatttgttttccttaattgatcgtgaaaaagaaaaggctggagctggaaagagtttcctttgtaagtgttcctttattgaaatctacaacgagcagatatatgatctactggactctgcatcggctggactgtacttaagggagcatatcaagaagggagtctttgttgttggtgcggtggagcaggtggtaacctcagctgctgaagcctatcaggtgttgtctggaggatggaggaatagacgtgtggcatcaacatcaatgaacagagaatcgtctaggtctcatgccgtctttacaattacaatagagtcaatggagaaaagtaatgagattgtgaatatacggacctccctactcaacctggtggatttagcaggatctgaaaggcaaaaagatacccatgcagaagggatgagattgaaggaagcaggtaacataaatcgatcattgagctgcctgggccaagtgattacagcacttgtcgacgtgggtaatggaaaacagagacatgtttgctacagagactccaaacttaccttcttactacgggattcccttggaggtaatgccaaaacagccataattgcaaatgttcatcctggatccaggtgttttggggaaaccctatcaacacttaactttgctcaaagagccaagctgattaaaaacaaggcagtagtaaatgaagacacccaaggaaatgtgagccagctccaagctgaagtgaagaggctcaaagaacaactggcggagcttgcttcaggacagacaccaccagaaagcttcctgaccagagacaaaaagaagactaactatatggagtatttccaggaagcaatgttattctttaagaaatctgaacaggaaaagaagtctctgatagaaaaagttacccaattagaagacctcaccctcaaaaaggaaaaatttattcaatctaataaaatgattgtgaaattccgagaggatcaaataatacgcttggaaaagctccacaaggaatcccggggaggttttctgcctgaggagcaggatcgtttgctctcagaattaaggaatgagattcaaactctgcgagaacaaatagagcaccaccccagagttgcaaagtatgctatggaaaatcattccctcagggaggagaatagaagactgagattattagagcctgtgaaaagagctcaagaaatggatgcccagaccattgcaaaactagaaaaagctttctctgaaataagtggcatggagaaaagtgacaaaaatcagcaaggattttcacctaaagctcagaaagagccatgtttgtttgcaaacactgagaagttaaaagcacaactcctgcaaattcagacagagctgaataattcaaagcaagaatatgaagaattcaaagaacttactaggaaaaggcagctagaattggaatcagagcttcagtctttgcaaaaagcgaaccttaatcttgaaaaccttttggaagcaacaaaagcctgcaagcggcaagaagtttctcagctgaataaaattcatgctgaaacacttaagattataactacaccaaccaaggcctaccaacttcattcccgaccagtaccaaaattaagccctgaaatgggaagctttggctctctatacactcagaattctagcatattagataatgatatattaaatgagccagttcctcctgagatgaatgaacaagcttttgaggccatttctgaagagcttagaacagtgcaggaacaaatgagtgctcttcaagccaaactggatgaagaagagcataaaaacctaaagcttcagcagcatgttgacaaactggaacatcattctacccaaatgcaggagcttttctcatcagaaagaattgattggaccaaacagcaggaagagcttctctcacagttgaatgtccttgaaaagcagcttcaagagactcaaactaaaaatgactttttgaaaagtgaggtacatgacctgcgagtagtccttcattctgctgacaaggagctttcttcagtgaaattggaatatagttcattcaaaacgaatcaggagaaagaattcaacaaactttccgaaagacacatgcatgtacagcttcaattagataatctcaggttagaaaacgaaaagctgcttgagagcaaagcctgcctacaggattcctatgacaacttacaagaaataatgaaatttgagattgaccaactttcaagaaacctccaaaacttcaaaaaagaaaatgaaactctgaaatctgatctgaataatttgatggagcttcttgaggcagaaaaagaacgcaataacaaattatcattacagtttgaagaagataaagaaaacagttctaaagaaatcttaaaagttcttgaggctgtacgtcaggagaaacagaaagagacggccaagtgtgagcagcagatggcaaaagtacagaaactagaagagagcttgcttgctactgaaaaagtgatcagttccctggaaaagtctagagattctgataagaaagttgtagctgacctcatgaaccagatccaggagctaagaacatcggtctgtgagaaaacagaaactatagacaccctgaaacaagaactgaaggacataaattgcaaatacaactctgctttggttgacagagaagagagcagagtgttgatcaagaagcaggaagtggatattctggatctgaaagaaacccttaggctgagaatactttctgaggacatagagagggatatgctctgtgaggacctggctcatgccactgagcagctgaacatgctcacagaggcctcaaaaaaacactcggggctgctgcagtctgcccagagaactgaccaagaaggaagccctgattcaggaacttcagcacaagctaaaccaaaagaaagaggaagtagaacagaagaagaatataacttcaaaatgaggcaactagaacatgtgatggattctgctgctgaggatccccagagtcctaagacaccacctcactttcaaacacatttggcaaaactcctggaaacacaagaacaagagatagaagatggaagagcctctaagacttctttggaacaccttgtaacaaagctaaatgaagacagagaagtcaaaaatgctgaaatcctcagaatgaaggagcagttgcgtgaaatggaaaacctacgcctggaaagtcagcagttaatagagaaaaactggctcctgcaaggtcagctggatgatattaaaagacaaaaggaaaacagtgatcagaatcatccagataatcaacagctgaagaatgaacaagaagaaagtatcaaagaaagacttgcaaaaagtaaaatagttgaagaaatgctgaaaatgaaagcagacctagaagaagtccaaagtgccctttacaacaaagagatggaatgccttagaatgactgatgaagtcgaacgaacccaaactttggagtctaaagcattccaggaaaaagaacaactgagatcaaagctggaagaaatgtatgaagaaagagagagaacatcccaggagatggaaatgttaaggaagcaggtggagtgtcttgctgaggaaaatggaaagttggtaggtcaccaaaatttgcatcagaagattcagtacgtagtgcgactaaagaaggaaaatgtcaggcttgctgaggagacagaaaagttgcgtgccgaaaatgtatttttaaaagaaaagaaaagaagtgaatcttgaggattccggtcagctacctaggcatcaccttgtttgaagatgtttcttctcttttacaagtaagacctactcctggccacttaggagagctgaatttatggaccttaattattaaatgtttataaggtggtggtaaccacctcaagtttctgatgaacattctgcatccatatacaccctgtgacagtcagcagtctgctattaagtggcctacttcaaggctttgaatcaacttaagggaaaaccttttgtctttgtaaaaataaaagcctgtagctaaggtttacagtggacattagccagatcattttcttcttagattatgccataatctcctttgattcttatggaagttctaacaatatatggtggttccaacacctgcagtgagtttaatgactgacttagtagcaggtacaagaagcaaacttgttaatatagattatttttgtattcttactttaggtattttcttgagcattttccatgactgtaaataaagccattttttaag

SEQ ID NO: 2420 - DNA, 4661 bp, Homo sapiens
ggctcggcgctgaaattcaaatttgaacggctgcagaggccgagtccgtcactggaagccgagaggagaggacagctggttgtgggagagttcccccgcctcagactcctggttttttccaggagacacactgagctgagactcacttttctcttcctgaatttgaaccaccgtttccatcgtctcgtagtccgacgcctggggcgatggatccgtttacggagaaactgctggagcgaacccgtgccaggcgagagaatcttcagagaaaaatggctgagaggcccacagcagctccaaggtctatgactcatgctaagcgagctagacagccactttcagaagcaagtaaccagcagcccctctctggtggtgaagagaaatcttgtacaaaaccatcgccatcaaaaaaacgctgttctgacaacactgaagtagaagtttctaacttggaaaataaacaaccagttgagtcgacatctgcaaaatcttgttctccaagtcctgtgtctcctcaggtgcagccacaagcagcagataccatcagtgattctgttgctgtcccggcatcactgctgggcatgaggagagggctgaactcaagattggaagcaactgcagcctcctcagttaaaacacgtatgcaaaaacttgcagagcaacggcgccgttgggataatgatgatatgacagatgacattcctgaaagctcactcttctcaccaatgccatcagaggaaaaggctgcttcccctcccagacctctgctttcaaatgcctcggcaactccagttggcagaaggggccgtctggccaatcttgctgcaactatttgctcctgggaagatgatgtaaatcactcatttgcaaaacaaaacagtgtacaagaacagcctggtaccgcttgtttatccaaattttcctctgcaagtggagcatctgctaggatcaatagcagcagtgttaagcaggaagctacattctgttcccaaagggatggcgatgcctctttgaataaagccctatcctcaagtgctgatgatgcgtctttggttaatgcctcaatttccagctctgtgaaagctacttctccagtgaaatctactacatctatcactgatgctaaaagttgtgagggacaaaatcctgagctacttccaaaaactcctattagtcctctgaaaacgggggtatcgaaaccaattgtgaagtcaactttatcccagacagttccatccaagggagaattaagtagagaaatttgtctgcaatctcaatctaaagacaaatctacgacaccaggaggaacaggaattaagcctttcctggaacgctttggagagcgttgtcaagaacatagcaaagaaagtccagctcgtagcacaccccacagaacccccattattactccaaatacaaaggccatccaagaaagattattcaagcaagacacatcttcatctactacccatttagcacaacagctcaagcaggaacgtcaaaaagaactagcatgtcttcgtggccgatttgacaagggcaatatatggagtgcagaaaaaggcggaaactcaaaaagcaaacaactagaaaccaaacaggaaactcactgtcagagcactcccctcaaaaaacaccaaggtgtttcaaaaactcagtcacttccagtaacagaaaaggtgaccgaaaaccagataccagccaaaaattctagtacagaacctaaagaagtgatacgtgaaattgagatgagtgtggatgatgatgatatcaatagttcgaaagtaattaatgacctcttcagtgatgtcctagaggaaggtgaactagatatggagaagagccaagaggagatggatcaagcattagcagaaagcagcgaagaacaggaagatgcactgaatatctcctcaatgtctttacttgcaccattggcacaaacagttggtgtggtaagtccagagagtttagtgtccacacctagactggaattgaaagacaccagcagaagtgatgaaagtccaaaaccaggaaaattccaaagaactcgtgtccctcgagctgaatctggtgatagccttggttctgaagatcgtgatcttctttacagcattgatgcatatagatctcaaagattcaaagaaacagaacgtccatcaataaagcaggtgattgttcggaaggaagatgttacttcaaaactggatgaaaaaaataatgcctttccttgtcaagttaatatcaaacagaaaatgcaggaactcaataacgaaataaatatgcaacagacagtgatctatcaagctagccaggctcttaactgctgtgttgatgaagaacatggaaaagggtccctagaagaagctgaagcagaaagacttcttctaattgcaactgggaagagaacacttttgattgatgaattgaataaattgaagaacgaaggacctcagaggaagaataaggctagtccccaaagtgaatttatgccatccaaaggatcagttactttgtcagaaatccgcttgcctctaaaagcagattttgtctgcagtacggttcagaaaccagatgcagcaaattactattacttaattatactaaaagcaggagctgaaaatatggtagccacaccattagcaagtacttcaaactctcttaacggtgatgctctgacattcactactacatttactctgcaagatgtatccaatgactttgaaataaatattgaagtttacagcttggtgcaaaagaaagatccctcaggccttgataagaagaaaaaaacatccaagtccaaggctattactccaaagcgactcctcacatctataaccacaaaaagcaacattcattcttcagtcatggccagtccaggaggtcttagtgctgtgcgaaccagcaacttcgcccttgttggatcttacacattatcattgtcttcagtaggaaatactaagtttgttctggacaaggtcccctttttatcttctttggaaggtcatatttatttaaaaataaaatgtcaagtgaattccagtgttgaagaaagaggttttctaaccatatttgaagatgttagtggttttggtgcctggcatcgaagatggtgtgttctttctggaaactgtatatcttattggacttatccagatgatgagaaacgcaagaatcccataggaaggataaatctggctaattgtaccagtcgtcagatagaaccagccaacagagaattttgtgcaagacgcaacacttttgaattaattactgtccgaccacaaagagaagatgaccgagagactcttgtcagccaatgcagggacacactctgtgttaccaagaactggctgtctgcagatactaaagaagagcgggatctctggatgcaaaaactcaatcaagttcttgttgatattcgcctctggcaacctgatgcttgctacaaacctattggaaagccttaaaccgggaaatttccatgctatctagaggtttttgatgtcatcttaagaaacacacttaagagcatcagatttactgattgcattttatgctttaagtacgaaagggtttgtgccaatattcactacgtattatgcagtatttatatcttttgtatgtaaaactttaactgatttctgtcattcatcaatgagtagaagtaaatacattatagttgattttgctaaatcttaatttaaaagcctcattttcctagaaatctaattattcagttattcatgacaatatttttttaaaagtaagaaattctgagttgtcttcttggagctgtaggtcttgaagcagcaacgtctttcaggggttggagacagaaacccattctccaatctcagtagttttttcgaaaggctgtgatcatttattgatcgtgatatgacttgttactagggtactgaaaaaaatgtctaaggcctttacagaaacatttttagtaatgaggatgagaactttttcaaatagcaaatatatattggcttaaagcatgaggctgtcttcagaaaagtgatgtggacataggaggcaatgtgtgagacttgggggttcaatattttatatagaagagttaataagcacatggtttacatttactcagctactatatatgcagtgtggtgcacattttcacagaattctggcttcattaagatcattatttttgctgcgtagcttacagacttagcatattagttttttctactcctacaagtgtaaattgaaaaatctttatattaaaaaagtaaactgttatgaagctgctatgtactaataatactttgcttgccaaagtgtttgggttttgttgttgtttgtttgtttgtttgtttttggttcatgaacaacagtgtctagaaacccattttgaaagtggaaaattattaagtcacctatcacctttaaacgcctttttttaaaattataaaatattgtaaagcagggtctcaacttttaaatacactttgaacttcttctctgaattattaaagttctttatgacctcatttataaacactaaattctgtcacctcctgtcattttattttttattcattcaaatgtattttttcttgtgcatattataaaaatatattttatgagctcttactcaaataaatacctgtaaatgtctaaaggaa

SEQ ID NO: 2421 - DNA, 916 bp, Homo sapiens
ttctcgcctaacgccgccaacatggtgagtcttactgttgcgggctccggggccgtcgaccatgccgctcgacctccacctccgctgggaagctgaggcgccaaacggctcccagagggtcccgggaagcgcatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgttgacaaatgtatttaagcctttggatttaaagcctgttgaggctggagttaggaggcagattgatagtaggattataataaacattaaataatca

SEQ ID NO: 2422 - DNA, 5252 bp, Homo sapiens
taatatggcggggaggaggaggagaaggcggcggcggaccgagctgcgctctgtcagtaccatttgagccattcgcttcctgacaaggcccgtggcgaggggagaggagctgaaggggccgtgggggatcagtgtgactgtgggaagatggaggagtatgagaagttctgtgaaaaaagtcttgccagaatacaagaagcatcactatccacagagagctttctccctgctcagtctgaaagtatctcacttattcgctttcatggagtggctatcctttctccactgcttaacattgagaaaagaaaggaaatgcaacaagaaaagcagaaagcacttgatgtagaagcaagaaagcaggttaacaggaagaaagctttactgactcgtgtccaggagattcttgacaatgttcaggttagaaaagcacctaatgccagtgattttgatcagtgggagatggaaacagtttactctaattcagaagtcagaaacttgaatgttcctgctacatttccaaatagctttccaagccatacggaacactctactgcagcaaagcttgataagatagctgggattttgccattggataatgaggaccaatgtaaaactgatggaatagacttagctagagattcagaaggatttaattctccgaagcaatgtgatagttccaatattagtcatgtagaaaatgaagcttttccaaagacctcttcagcaaccccacaagaaactcttatttctgatggtcccttctcagtaaatgaacaacaggatctaccacttttggcagaagtcatcccagatccctatgtaatgagtcttcagaatctgatgaaaaagtcaaaggaatatatagaaagagaacaatctagacgcagtctgagaggtagtatcaacagaattgttaatgagagtcatttagacaaagaacatgatgctgttgaagtggctgactgtgtaaaagagaaaggccagttgacaggcaaacactgtgtctcagttattcctgacaaaccaagccttaataaatcaaatgttcttctccaaggtgcttccactcaagcaagcagcatgagtatgccagttttagctagcttttcgaaagtggacatacctatacgaactggccatcccactgttctagagtctaattctgattttaaagttattcccacttttgttaccgaaaataatgttatcaaaagtcttacaggttcatatgccaaattacctagtccagagccaagtatgagtcctaaaatgcaccgaagacgttccaggacatcatcagcgtgtcatatacttataaataacccaataaatgcctgtgaattaagccctaaaggaaaagaacaggcaatggacttaattattcaagatactgatgaaaacacaaatgtgcccgaaattatgccaaagttaccaactgatttagcgggagtttgttcaagcaaggtttatgtgggcaaaaatacatctgaagtcaaagaagatgtggttttaggtaaatcaaatcaggtatgtcaatcttcaggaaatcatttagaaaataaagttactcatggacttgttactgtggaaggtcagttaacatccgatgagagaggcgcacacataatgaacagtacctgtgctgcgatgccaaagctgcatgaaccatatgccagcagtcagtgtatagcaagtccaaactttggaactgtgagtggactcaagccagccagtatgttagagaaaaactgcagtttgcaaacagaactgaataagtcttatgatgtaaaaaacccttctcctttattgatgcaaaaccagaatacgagacagcagatggacacacctatggtgtcctgtggaaatgaacaatttttggataacagttttgagaaagttaaacggagacttgatttagatattgatggtttgcaaaaagaaaactgcccttatgtcataacaagtggaataactgaacaagaaaggcaacatttgccagaaaaaagataccctaagggatctggcttcgttaacaagaataaaatgttaggaactagttccaaagaaagcgaggagttactaaaaagcaagatgttagcttttgaagaaatgcggaagagactagaagaacagcacgcccagcaattatcactactcatagctgagcaggaaagggaacaagaaagactgcaaaaggaaatagaagagcaggagaaaatgttaaaagagaagaaggcaatgacagcggaagcctctgagttggacattaacaatgcagtggaattagaatggagaaaaataagtgactctagtttgctggaaacaatgctgtctcaagcggactcactccatacttcaaattcaaatagttctggtttcacaaattctgccatgcaatatagctttgtttctgcaaacgaagcaccattctacctctggggatcatcaactagtggcttgaccaaactctcagtaacaaggccttttggaagagccaaaactagatggtctcaagtttttagtctggaaatacaagcaaaatttaacaaaataactgcagtggcaaaaggatttcttactcgtagacttatgcagacagataagctgaagcaacttcgacaaactgtaaaagatactatggaattcataagaagttttcagtcagaagcaccattaaagagaggcattgtttcagctcaagatgcttcacttcaggaaagagtgttagctcagttgcgagctgccttgtacggtattcatgacatattctttgtaatggatgcagctgaaagaatgtctattctacatcatgatcgagaagttcgcaaagagaaaatgctcaggcaaatggataaaatgaaaagtccacgagtggctctttcagctgcaacacagaagtctcttgataggaagaaatacatgaaagctgctgaaatgggaatgccaaataagaaatttctggttaaacaaaatccttctgaaacaagagtccttcagccaaaccaaggacagaatgcacctgttcataggctacttagtagacaagggagtatatgcaggaaaaatccaaagaaagcggccaaatgttgcgacaatttaagaagacaacattcattaggataaaatggggggaaggattattattcatgttattttccctgcccaagactttatttaaccctggactccgtttacacagacaaagtgacatcagaaggctgagcacttatctggatcatttggtcagtttggtaattcctgctccacacccctattttcctcttaataatacgtttgggtgaagacaaattagtgtttagtaattgcatcatctctgtgcttacctatacaaacataagtttattttatatgcccagatgtctacagagaccctttttgtaaatgtcaaggacatttggatttacttttacagaatattgaaaagataagacaaattataaataagttctaaaacataaatttaattcatctctgcatagtgatttttgaatttgattcaaagggaaattattgcagaagaatgcctttccctcattttataactttaaaaacttggattaaccactcaatgtccactttctttgacttacagtataaccatgtagccaattgtggcccactaaaatctacagaagttaatgtgggtcaccattttggtcagaagcatacattcctgtcagacaactagttgtctgacagaaatgttaggcttcatgtatgttaccccagtactgttagaaacatttgtactaggttataagatctttctgtgacaggtaacaaatttggggaagacagcacaatcttcttgaatgtagctcttgggaatgcattattacatccatttctgtaacataataatatgttgcatgcagttatattttctatttagtctgtatattttgttcttcatagtctgttttttctagcatgcttgatttaggagagaataaagggctatataataataaatccagatttccggataagaatattgcctggttaaaattctgcattgcttaaagacacccatgtttaagatttttcatcactaacatatccattaaaagtatcaactggccaggcagggtggctcacgcctgtactcccagcattttgtgaggccaaggtgggtggatcacctgaggtcaggagtttgagaccagcctgaccaaacatggcgaaaccccatctgtactgaaaatacaaaaattaggcatggtggtgcatgcctgtagttccagctacttgggaggctgagacaggcgaattgcttgaacctgggaggcagaggttgcagtgagctgagactgtgccattgcactccagtcgggttaacagagcaagacactgtctcaaaaaaaaaaaaaaaaaaaagtatcaaccaacaaatgttaccaagataacgtgacttcatgagggagaatgtcactattaatttatcataccatttccaaaaagggctttgtgcttttcacataaaattgagacagtgtatatttaatctaatttaaattttaaagagatactggtattttgaaaatgcaacctatatatattcttaatatccttttaagaatatggagatgaagattgttttctccaattttctgtgccattttaaatttaactttgacatccagctatagacagaaataataagccaccctgggtgtaaacttgattttctttattgagatgtatcatgtattgaatgagtgaaccagaaaattagaagatggtcaaaaaaagtccaagttaccaattttttaaaatttataggcaaagtatcaaattgtcttcttaatatgataaactgtgctttatcattctgaaaactcaggatacagcttattcatagcattgtgggtctctccagtaagaaagatgctaaaagttttgtgcactttttgtgtgtgtaatgcaaattagttaaaacaaatagttttggagaaagttaaaactagctttagagtaaggatgagaaacttgagtgtttttaatttaaagataaaagcctgtgttttacacattcttttttggtgttcatagcttcttctcatacaggtgccagacactgtttgtgcttttgatggatttttatttatatactttttttgcttatttttactttgagtggaatgttcattaatgtaaattgtatttatttttatacttttattttcactagttttgcttctaggcaaaaagcaaaataaacttttcatctt

SEQ ID NO: 2423 - DNA, 5474 bp, Homo sapiens
ggccctgagaggtggagtcggggtggcagcggcggcggttgccaggagcccgcgttgcagcctgagatccgtaatatggcggggaggaggaggagaaggcggcggcggaccgagctgcgctctgtcagtaccatttgagccattcgcttcctgacaaggcccgtggcgaggggagaggagctgaaggggccgtgggggatcagtgcctgctgtgtgctgatactgttctgtgtaatggggattcagtgaacaagactgaaaaggtacctgtacttatggcgcttacattttggtggaggaagacagacaaaaatcaaggaaataaacacgataatttcagatagtgtgtgactgtgggaagatggaggagtatgagaagttctgtgaaaaaagtcttgccagaatacaagaagcatcactatccacagagagctttctccctgctcagtctgaaagtatctcacttattcgctttcatggagtggctatcctttctccactgcttaacattgagaaaagaaaggaaatgcaacaagaaaagcagaaagcacttgatgtagaagcaagaaagcaggttaacaggaagaaagctttactgactcgtgtccaggagattcttgacaatgttcaggttagaaaagcacctaatgccagtgattttgatcagtgggagatggaaacagtttactctaattcagaagtcagaaacttgaatgttcctgctacatttccaaatagctttccaagccatacggaacactctactgcagcaaagcttgataagatagctgggattttgccattggataatgaggaccaatgtaaaactgatggaatagacttagctagagattcagaaggatttaattctccgaagcaatgtgatagttccaatattagtcatgtagaaaatgaagcttttccaaagacctcttcagcaaccccacaagaaactcttatttctgatggtcccttctcagtaaatgaacaacaggatctaccacttttggcagaagtcatcccagatccctatgtaatgagtcttcagaatctgatgaaaaagtcaaaggaatatatagaaagagaacaatctagacgcagtctgagaggtagtatcaacagaattgttaatgagagtcatttagacaaagaacatgatgctgttgaagtggctgactgtgtaaaagagaaaggccagttgacaggcaaacactgtgtctcagttattcctgacaaaccaagccttaataaatcaaatgttcttctccaaggtgcttccactcaagcaagcagcatgagtatgccagttttagctagcttttcgaaagtggacatacctatacgaactggccatcccactgttctagagtctaattctgattttaaagttattcccacttttgttaccgaaaataatgttatcaaaagtcttacaggttcatatgccaaattacctagtccagagccaagtatgagtcctaaaatgcaccgaagacgttccaggacatcatcagcgtgtcatatacttataaataacccaataaatgcctgtgaattaagccctaaaggaaaagaacaggcaatggacttaattattcaagatactgatgaaaacacaaatgtgcccgaaattatgccaaagttaccaactgatttagcgggagtttgttcaagcaaggtttatgtgggcaaaaatacatctgaagtcaaagaagatgtggttttaggtaaatcaaatcaggtatgtcaatcttcaggaaatcatttagaaaataaagttactcatggacttgttactgtggaaggtcagttaacatccgatgagagaggcgcacacataatgaacagtacctgtgctgcgatgccaaagctgcatgaaccatatgccagcagtcagtgtatagcaagtccaaactttggaactgtgagtggactcaagccagccagtatgttagagaaaaactgcagtttgcaaacagaactgaataagtcttatgatgtaaaaaacccttctcctttattgatgcaaaaccagaatacgagacagcagatggacacacctatggtgtcctgtggaaatgaacaatttttggataacagttttgagaaagttaaacggagacttgatttagatattgatggtttgcaaaaagaaaactgcccttatgtcataacaagtggaataactgaacaagaaaggcaacatttgccagaaaaaagataccctaagggatctggcttcgttaacaagaataaaatgttaggaactagttccaaagaaagcgaggagttactaaaaagcaagatgttagcttttgaagaaatgcggaagagactagaagaacagcacgcccagcaattatcactactcatagctgagcaggaaagggaacaagaaagactgcaaaaggaaatagaagagcaggagaaaatgttaaaagagaagaaggcaatgacagcggaagcctctgagttggacattaacaatgcagtggaattagaatggagaaaaataagtgactctagtttgctggaaacaatgctgtctcaagcggactcactccatacttcaaattcaaatagttctggtttcacaaattctgccatgcaatatagctttgtttctgcaaacgaagcaccattctacctctggggatcatcaactagtggcttgaccaaactctcagtaacaaggccttttggaagagccaaaactagatggtctcaagtttttagtctggaaatacaagcaaaatttaacaaaataactgcagtggcaaaaggatttcttactcgtagacttatgcagacagataagctgaagcaacttcgacaaactgtaaaagatactatggaattcataagaagttttcagtcagaagcaccattaaagagaggcattgtttcagctcaagatgcttcacttcaggaaagagtgttagctcagttgcgagctgccttgtacggtattcatgacatattctttgtaatggatgcagctgaaagaatgtctattctacatcatgatcgagaagttcgcaaagagaaaatgctcaggcaaatggataaaatgaaaagtccacgagtggctctttcagctgcaacacagaagtctcttgataggaagaaatacatgaaagctgctgaaatgggaatgccaaataagaaatttctggttaaacaaaatccttctgaaacaagagtccttcagccaaaccaaggacagaatgcacctgttcataggctacttagtagacaagggagtatatgcaggaaaaatccaaagaaagcggccaaatgttgcgacaatttaagaagacaacattcattaggataaaatggggggaaggattattattcatgttattttccctgcccaagactttatttaaccctggactccgtttacacagacaaagtgacatcagaaggctgagcacttatctggatcatttggtcagtttggtaattcctgctccacacccctattttcctcttaataatacgtttgggtgaagacaaattagtgtttagtaattgcatcatctctgtgcttacctatacaaacataagtttattttatatgcccagatgtctacagagaccctttttgtaaatgtcaaggacatttggatttacttttacagaatattgaaaagataagacaaattataaataagttctaaaacataaatttaattcatctctgcatagtgatttttgaatttgattcaaagggaaattattgcagaagaatgcctttccctcattttataactttaaaaacttggattaaccactcaatgtccactttctttgacttacagtataaccatgtagccaattgtggcccactaaaatctacagaagttaatgtgggtcaccattttggtcagaagcatacattcctgtcagacaactagttgtctgacagaaatgttaggcttcatgtatgttaccccagtactgttagaaacatttgtactaggttataagatctttctgtgacaggtaacaaatttggggaagacagcacaatcttcttgaatgtagctcttgggaatgcattattacatccatttctgtaacataataatatgttgcatgcagttatattttctatttagtctgtatattttgttcttcatagtctgttttttctagcatgcttgatttaggagagaataaagggctatataataataaatccagatttccggataagaatattgcctggttaaaattctgcattgcttaaagacacccatgtttaagatttttcatcactaacatatccattaaaagtatcaactggccaggcagggtggctcacgcctgtactcccagcattttgtgaggccaaggtgggtggatcacctgaggtcaggagtttgagaccagcctgaccaaacatggcgaaaccccatctgtactgaaaatacaaaaattaggcatggtggtgcatgcctgtagttccagctacttgggaggctgagacaggcgaattgcttgaacctgggaggcagaggttgcagtgagctgagactgtgccattgcactccagtcgggttaacagagcaagacactgtctcaaaaaaaaaaaaaaaaaaaagtatcaaccaacaaatgttaccaagataacgtgacttcatgagggagaatgtcactattaatttatcataccatttccaaaaagggctttgtgcttttcacataaaattgagacagtgtatatttaatctaatttaaattttaaagagatactggtattttgaaaatgcaacctatatatattcttaatatccttttaagaatatggagatgaagattgttttctccaattttctgtgccattttaaatttaactttgacatccagctatagacagaaataataagccaccctgggtgtaaacttgattttctttattgagatgtatcatgtattgaatgagtgaaccagaaaattagaagatggtcaaaaaaagtccaagttaccaattttttaaaatttataggcaaagtatcaaattgtcttcttaatatgataaactgtgctttatcattctgaaaactcaggatacagcttattcatagcattgtgggtctctccagtaagaaagatgctaaaagttttgtgcactttttgtgtgtgtaatgcaaattagttaaaacaaatagttttggagaaagttaaaactagctttagagtaaggatgagaaacttgagtgtttttaatttaaagataaaagcctgtgttttacacattcttttttggtgttcatagcttcttctcatacaggtgccagacactgtttgtgcttttgatggatttttatttatatactttttttgcttatttttactttgagtggaatgttcattaatgtaaattgtatttatttttatacttttattttcactagttttgcttctaggcaaaaagcaaaataaacttttcatcttaaagaaaa

SEQ ID NO: 2424 - DNA, 1716 bp, Homo sapiens
ggcagaggcgcaggcgcggtgcttcgcagcccgcttccggcctcacacctgccaagcatcacacctgccaagcatcacacctgccaagcatcacacctgccaagcatcacacctgcgatgcctgcacgagctgggtgcggtccgcgcagctgcagtaagggggcgacccggcgtctgttagtcggcggttcatctccttcgtgcctcgatgagctttaacgccattttcctccattctctttcttcacctcttgagtttccaagatggcaactatcaagagtgaacttattaagaatttcgcggaagaggaggccattcatcacaataagatctccattgtaggaactggatcggttggtgtggcttgtgctatcagcatcttattaaaaggtttgagtgatgaacttgtccttgtggatgttgatgaaggcaaactgaagggtgagacaatggatcttcaacatggcagcccttttatgaaaatgccaaatattgtctccagcaaagattacctggtcactgcaaactccaatctagtgattatcacagcaggtgcacgccagaaaaaaggagaaacacgccttgatttagtccagcgaaatgtatccatctttaaattaatgattcccaatattacccagtacagtcctcactgcaaactgcttattgttactaatccagtggatatcttaacttatgtagcctggaagttgagtggatttcccaaaaaccgtgttattggaagtggttgtaatctggactctgctcgttttcgttactttattgggcaaaggcttggcatccactctgaaagctgtcatgggctgatccttggagagcatggcgactcaagtgttcctgtgtggagtggtgtgaacattgctggcgtccctctgaaggatctgaacccagatataggaactgataaagatcctgagcagtgggaaaatgtccacaaaaaagtgatttccagtggctatgagatggtcaaaatgaaaggttatacttcttggggcattagcctatctgtagctgatttaacagaaagtattttgaagaatcttaggagagtgcatccagtttctaccctaagtaagggcctctatggaataaatgaagacatattccttagtgtcccatgtatcctgggagagaatggtatcacagacctcataaaagtaaaactgactcttgaagaggaggcctgcttgcaaaagagtgcagaaacactttgggaaattcagaaggagctcaagctttaaagttgcttaaagctaattctgtagattgaagatgaaatagtagttatggaattgtatatgtcaaacttttgaataaatttgaatttctaaaagttggaaaaatagaggaaagagtgacctatttagtatagccttccagcttttttttttttcttttttgggagggtctcattctgtcacccaggctggagtgcagtggcacaatcatggctcactgcaaccttgacctcccgagctcaggtgagcctcccacttcagcctccagagtaggtgggaccacatgcgtgtgcctccatgcctgcctaatttttgtatctttttgtagagatggggttttgccatgtcatccaagctggttttgaactcccaaagtgctgagattacaggggtgagccactgtgcctggccttagctttgatttagtatccagatgatagatgacacttttttttt

SEQ ID NO: 2425 - DNA, 1146 bp, Homo sapiens
aacagttgccttttcctctcacagaaggaagatttcattttgtttgagacgagaaaccaaaccacacaccaaagagaggggtatgatggctaagaagcccccaaaaccagcccctcgcaggatcttccaggaaaggttaaagattactgctctacctttgtactttgaaggttttttattaatcaagcggtcaggataccgggagtatgagcattactggacagagttgagaggaactactcttttcttttataccgacaaaaagagtataatatatgttgacaaattagacatagtagacctcacatgccttactgagcagaattcaactgaaaagaactgtgcgaaattcacccttgttttgccgaaagaggaagtacaactgaagacagagaacacagaaagtggggaagaatggagaggcttcattcttacagtaacagagctgtcagttccccaaaacgtgtcactcctacctgggcaagtaattaaactgcatgaagtcctagagagagaaaagaaaaggaggattgagacagagcagagtacgtccgtggaaaaagagaaggaaccaactgaagattatgtggatgtactgaaccctatgccagcatgtttttatacagtgtcccggaaagaggcaactgagatgctccagaagaacccttctttgggaaatatgatcctgaggcctggtagtgacagtagaaactactccatcactattcggcaggagatagacattccaagaatcaagcactacaaagtgatgagcgtaggacaaaactacactattgaactggaaaaacctgtaacactcccaaaccttttcagtgtcattgattattttgtgaaggagactcgaggaaatttaagaccatttatatgttcaactgatgaaaacactggtcaagaacccagtatggaagggagaagtgaaaagttgaagaaaaatccacacattgcatgaaatacaatgtgaaagctcctttgtatatcttggggaaagactatgtgagacagagggagaaaacagccattgacaactcaaggagagaggcctcggggggaaaaaaagatcaacctggccaaaaccttgaaaatccggcttcttgacttgtgagaaaataaatttgtgttccttaa

SEQ ID NO: 2426 - DNA, 1907 bp, Homo sapiens
gccgcctgcgaccggcagctcgttcgccgcactttggaggcttcggctgcccctccgacccacgtagggcccggacccgggcctccttgtgaacagcgtgccggcttcgccccacgggttcaccggctggctgggcttcaagcgccgaggccgccgcagtgaccccgcccccgggccgaggatgtgaggcgggccgggcgtccccacaccgggcccgggcgccgggagtgggcgtctgggcagcgccaggcgatggccctgctgctggtgctcctcgcctcttggggcctggggcagtgagggggccggcgggcgtgggccgagtggccgcgggcgccatggagggggtgctgtacaagtggaccaactatctgagcggttggcagcctcgatggttccttctctgtgggggaatattgtcctattatgattctcctgaagatgcctggaaaggttgcaaagggagcatacaaatggcagtctgtgaaattcaagttcattctgtagataatacacgcatggacctgataatccctggggaacagtatttctacctgaaggccagaagtgtggctgaaagacagcggtggctggtggccctgggatcagccaaggcttgcctgactgacagtaggacccagaaggagaaagagtttgctgaaaacactgaaaacttgaaaaccaaaatgtcagaactaagactctactgtgacctccttgttcagcaagtagataaaacaaaagaagtgaccacaactggtgtgtccaattctgaggagggaattgatgtgggaactttgctgaaatcaacctgtaatacttttctgaagaccttggaagaatgcatgcagatcgcaaatgcagccttcacctctgagctgctctaccgcactccaccaggatcacctcagctggccatgctcaagtccagcaagatgaaacatcctattataccaattcataattcattggaaaggcaaatggagttgagcacttgtgaaaatggatctttaaatatggaaataaatggtgaggaagaaatcctaatgaaaaataagaattccttatatttgaaatctgcagagatagactgcagcatatcaagtgaggaaaatacagatgataatataacagtccaaggtgaaataaggaaggaagatggaatggaaaacctgaaaaatcatgacaataacttgactcagtctggatcagactcaagttgctctccggaatgcctctgggaggaaggcaaagaagttatcccaactttctttagtaccatgaacacaagctttagtgacattgaacttctggaagacagtggcattcccacagaagcattcttggcatcatgttatgctgtggttccagtattagacaaacttggccctacagtgtttgctcctgttaagatggatcttgttggaaatattaagaaagtaaatcagaagtatataaccaacaaagaagagtttaccactctccagaagatagtgctgcacgaagtggaggcggatgtagcccaggttaggaactcagcgactgaagccctcttgtggctgaagagaggtctcaaatttttgaagggatttttgacagaagtgaaaaatggggagaaggatatccagacagccctaaataatgcatatggtaaaacattgcggcaacaccatggctgggtagttcgaggggtttttgcggtgtaggaatgtgggtgtagacggaactccagaaaccatcatggaccatgaggcaactctgaggatggaagccacacactaaggacggtaaagcagaaagaagagctgaaaccctgatgataaagaagcagccaattccgtcctgcactgcccacctccagatctcattcatgtgaaacaaagagaaactttatcttgttcaagtca

SEQ ID NO: 2427 - DNA, 2837 bp, Homo sapiens
agctcgttcgccgcactttggaggcttcggctgcccctccgacccacgtagggcccggacccgggcctccttgtgaacagcgtgccggcttcgccccacgggttcaccggctggctgggcttcaagcgccgaggccgccgcagtgaccccgcccccgggccgaggatgtgaggcgggccgggcgtccccacaccgggcccgggcgccgggagtgggcgtctgggcagcgccaggcgatggccctgctgctggtgctcctcgcctcttggggcctggggcagtgagggggccggcgggcgtgggccgagtggccgcgggcgccatggagggggtgctgtacaagtggaccaactatctgagcggttggcagcctcgatggttccttctctgtgggggaatattgtcctattatgattctcctgaagatgcctggaaaggttgcaaagggagcatacaaatggcagtctgtgaaattcaagttcattctgtagataatacacgcatggacctgataatccctggggaacagtatttctacctgaaggccagaagtgtggctgaaagacagcggtggctggtggccctgggatcagccaaggcttgcctgactgacagtaggacccagaaggagaaagagtttgctgaaaacactgaaaacttgaaaaccaaaatgtcagaactaagactctactgtgacctccttgttcagcaagtagataaaacaaaagaagtgaccacaactggtgtgtccaattctgaggagggaattgatgtgggaactttgctgaaatcaacctgtaatacttttctgaagaccttggaagaatgcatgcagatcgcaaatgcagccttcacctctgagctgctctaccgcactccaccaggatcacctcagctggccatgctcaagtccagcaagatgaaacatcctattataccaattcataattcattggaaaggcaaatggagttgagcacttgtgaaaatggatctttaaatatggaaataaatggtgaggaagaaatcctaatgaaaaataagaattccttatatttgaaatctgcagagatagactgcagcatatcaagtgaggaaaatacagatgataatataacagtccaaggtgaaataaggaaggaagatggaatggaaaacctgaaaaatcatgacaataacttgactcagtctggatcagactcaagttgctctccggaatgcctctgggaggaaggcaaagaagttatcccaactttctttagtaccatgaacacaagctttagtgacattgaacttctggaagacagtggcattcccacagaagcattcttggcatcatgttatgctgtggttccagtattagacaaacttggccctacagtgtttgctcctgttaagatggatcttgttggaaatattaagaaagtaaatcagaagtatataaccaacaaagaagagtttaccactctccagaagatagtgctgcacgaagtggaggcggatgtagcccaggttaggaactcagcgactgaagccctcttgtggctgaagagaggtctcaaatttttgaagggatttttgacagaagtgaaaaatggggagaaggatatccagacagccctaagtgtaggaatgtgggtgtagacggaactccagaaaccatcatggaccatgaggcaactctgaggatggaagccacacactaaggacggtaaagcagaaagaagagctgaaaccctgatgataaagaagcagccaattccgtcctgcactgcccacctccagatctcattcatgtgaaacaaagagaaactttatcttgttcaagtcactttagtcaagatttttattatcagatgaatgcaatttctaattgatacaccttaaaattttcaacatgtacacctgatttaacaaaatctagaattaagtcaatacttctacatgcattatagaccaaaggtcactgctataagaactttgggtatatagtcaaattcctcacatttttagaaacttgtttattcattgcatccctcccccatctcactctctcacacactcacatatttattttctcagatccttataagttcataagacatatgtccttattccatttttacagatgagaaaactggggtttgcaggggttaagtaacttatccaagatcacacaattaattagtggcgaagtcataatttgaagtctttctaatgcccaaatgtttccattgtgtcacatatcggagctgtgctctttccatcagccagtttcccattatcatagctgatgacatgcacacccaccatctggggcaggctttagtacagcactctgtgccatcatccagatcaccaaatcttagtaaatggacgtgtcataagagataaggctgccatagaatcacagcagcttctggcttagtaaattacctggatacacaccttttcctagaggaaatcccacatcttcgtaggagatctggtgtaatgctcttgggacctctctctagaggatgagctagtatcactgggtcctagtaagtttcagcaaatataatagagacagaactgtcatcattatcagaaaagaaacagagaaaaatgttaaaacaatggttttgtgaccttaaagtctgtgttagtcccttagcaccaccgctgagattttgctgaaagggacgttttgtgtgttgggcttcactgaaggaagcccctgaaagtgttcagaaatagggaaaatgagaaactgttccagctgaaaatacgggcaagggggaatcattgaagaagacagaatattgaagtgttcaaatgaataaagaagctaaaaact

SEQ ID NO: 2428 - DNA, 1886 bp, Homo sapiens
aatgacatgacagccattccgtggccagggacaccactgcccaagctggagaccacgaggattcagggactgaagccagcatgggaattcctggtttgagatcagagtcctgagtacctcgtgggaacttgggcactcatccgcaggaggtctagacccccagagaattccttgagtctaaggcacaggcccaacatgtgtagcaccagtgggtgtgacctggaagaaatccccctagatgatgatgacctaaacaccatagaattcaaaatcctcgcctactacaccagacatcatgtcttcaagagcacccctgctctcttctcaccaaagctgctgagaacaagaagtttgtcccagaggggcctggggaattgttcagcaaatgagtcatggacagaggtgtcatggccttgcagaaattcccaatccagtgagaaggccataaaccttggcaagaaaaagtcttcttggaaagcattctttggagtagtggagaaggaagattcgcagagcacgcctgccaaggtctctgctcagggtcaaaggacgttggaataccaagattcgcacagccagcagtggtccaggtgtctttctaacgtggagcagtgcttggagcatgaagctgtggaccccaaagtcatttccattgccaaccgagtagctgaaattgtttactcctggccaccaccacaagcgacccaggcaggaggcttcaagtccaaagagatttttgtaactgagggtctctccttccagctccaaggccacgtgcctgtagcttcaagttctaagaaagatgaagaagaacaaatactagccaaaattgttgagctgctgaaatattcaggagatcagttggaaagaaagctgaagaaagataaggctttgatgggccacttccaggatgggctgtcctactctgttttcaagaccatcacagaccaggtcctaatgggtgtggaccccaggggagaatcagaggtcaaagctcagggctttaaggctgcccttgtaatagacgtcacggccaagctcacagctattgacaaccacccgatgaacagggtcctgggctttggcaccaagtacctgaaagagaacttctcgccatggatccagcagcacggtggatgggaaaaaatacttgggatatcacatgaagaagtagactgaaatatcagatttgtcatcaggaatactctttgtctactgtggtcctgtgcacgttggcctcagatggactacaggagattacaacgtacaaggcagatggagcattgacgttttcaaaaccattattcctgtgactggagaggcatcaggagaggtctcgttcgtctccagctcataaaatgtagcagcatcatccttgacagtgatgtttttcaggccctccattgagaacctgaggaaatctgtaaagataagtggtgatgttgtttcaaacgttcagaacagataccatcatcctgcctttgttagctgctgtagggaaagtgcgttacagatgtctgctgacctcacaagagtgaaaagataaactgtgcatgtgtttccacttccgtttctagtactatttatttttaaactacacttggggtggcctaatacctaggaagatgttgctattcacgttagtaaacagcctaaagaaactcttaggtttactgctacatccatttgtttggagaggtaactgttgtctgtgcctttttgaaaaacttccatttggtacaaaatttttactccaacaccccctcaacccttttctcagggaccacacctcttcttcccaaggtccctgggacttcctcattctttgtggtagtacaatgattggtagcaggtaaaataaatacatagaaagactactgtcaaaa

SEQ ID NO: 2429 - DNA, 7743 bp, Homo sapiens
gggcggtgcggtgcggaagcggaagtgaagggtgcgcttggcggcggcggcgggagctgcggagtcgggaatcaaaacaaagggcctggggggggcggggggaaggcggcggggccggaatgtgagcggaggtggagccggcggcagagggtggaagaatgaaagaaaagaaagatgaaaggatgttgaatcactttgcatggctgtatgatggaaggaaacggaactgagaactcctgcagtagaacacgtggatggcttcaacaagataatgatgctaagccatggctttggaaattctctaattgcttttctcgtcctgagcagacgctgccacatagtccccaaacgaaagagtacatggagaacaagaaagttgctgtggaactaaaggatgtaccatcaccccttcatgctggctctaagctttttccagcagtcccacttcctgatattcgttctcttcagcagcctaaaatacagctttcttctgtccccaaagtaagctgctgtgctcattgccctaatgaaccctccacttcgccaatgcgttttggtggtggtggtggcggtagcggaggtaccagtagcttgattcacccgggcgcactgttagactcgcaaagcaccaggacaatcacgtgtcaggtagggtcagggtttgctttccagtctgcatcttcactccagaatgcctcagctaggaacaatttggcaggcattgcaagtgactttcccagcatgtgtctagagagtaacctgtcttcctgcaaacacctgccctgttgtggaaaactccacttccagtcatgtcatggtaatgtgcacaagctgcatcagtttccgagtctgcagggctgcacctccgctggctatttcccctgttctgatttcacaagcggggctccagggcatttggaagagcacatttcacagtcggagctaacgcctcacttgtgcaccaactctttgcaccttaatgtggtacctccggtttgtttaaagggctcactttactgcgaagactgtctaaacaagccagcaagaaatagcataatcgatgcggctaaagtctggccaaatataccacctccaaatactcaacctgcacctcttgctgtccctctgtgtaatggctgtggaaccaaaggaacagggaaggagaccacgttgttattggcgaccagtctaggcaaagctgcttcaaaatttgggtcaccagaagttgcagtagctggacaggtgctagaaaacttaccccccattggagttttttgggatattgaaaactgctccgttccctctggccggtcagcaactgctgttgtgcaaagaatccgtgagaagttttttaaaggccacagagaagcagaattcatctgtgtatgtgacatcagtaaagaaaacaaggaagttattcaagagctgaataattgccaggtaaccgttgcccacatcaatgctactgcaaagaatgccgctgatgataaactgcggcagagtctccgcagatttgcaaatacacacactgctccagccacagtggttcttgtgtcaactgatgtcaattttgcattggaacttagtgacctgagacacaggcatggtttccacattattttggtccataaaaaccaggcctcagaagcactgctgcatcatgctaacgagctgatcagatttgaagagttcatttccgacttgccccccaggttaccactaaaaatgccacagtgccacactctgctctatgtttataacctaccagcaaataaggatggcaagagcgtcagcaacaggctcagacgcctgtccgataattgtggtgggaaagtgctgagtatcacaggctgcagtgcaattctccgcttcataaaccaagatagtgcagagcgcgctcagaagcgaatggaaaacgaagatgtctttggtaataggatcattgtgtcatttactccaaaaaatagagaactctgtgaaacaaagagttcaaatgcaattgctgataaagtgaagtctcccaaaaaacttaagaatccaaaattgtgcctcatcaaagatgcaagtgaacaatcttccagtgccaaagccacgcctggaaaagggtcacaggcaaattctggatctgctacaaaaaatacaaatgttaaaagtttacaggagctgtgccgcatggagtcaaaaactggtcatagaaacagtgagcaccagcaaggtcacctgaggctggtcgtacccactcacggtaactcaagtgctgcagtgtcgacgccgaaaaactcgggggtggcagaacccgtttacaaaaccagtcagaaaaaggagaacctcagtgcccgaagtgttaccagttctcctgtagagaaaaaagataaagaggagactgtattccaagtgagttacccgtctgcttttagcaagttagttgcatccaggcaagtcagtcctctgctcgcatctcagtcttggtcttctaggagtatgtctccaaaccttttaaacagagcatccccgcttgctttcaacattgcaaattcgagcagcgaagccgactgcccagacccatttgcaaatggtgctgatgtccaagtcagcaacatagactacagattatcccggaaggagctgcagcagctcctgcaggaagcatttgccaggcatggcaaggtgaagagtgttgagctcagcccccatacagattatcaactcaaggctgttgtgcaaatggaaaacttacaagatgcgatcggtgcagtgaatagcctccacagatacaaaattggcagcaaaaagatcctggtctcacttgccaccggggctgccagcaaatcactctctttactgagtgcagaaacaatgtctgttcttcaggatgcccctgcctgttgcctgcctctgtttaaatttacagatatctatgaaaaaaagtttggacacaagttgaatgtgtcagatctatataaattaacagacacggtcgcaatccgtgaacaaggaaacggacggctggtgtgtctcctacccagcagtcaggcccgccagagccccttggggtcttcccagtcacacgacggctcctccacgaattgcagcccaattatatttgaagagttagaatatcacgagcctgtctgcagacagcattgttccaataaggatttcagcgaacatgaatttgatccagactcttacaagattccttttgtgattctttctttgaagacatttgcgccccaggttcacagtcttctccagacccacgagggcaccgtgcctttattgagctttccagattgttacattgcagagtttggcgatctagaagtagtgcaagaaaaccaaggaggtgttcccttagaacacttcattacctgtgttccaggtgtaaacattgccactgctcagaatggcatcaaagtggttaaatggattcacaacaagcccccgcctcccaacactgacccttggcttctgcgttcgaagagtcctgtaggtaacccccagctgatccagttcagtagagaagtgattgacttgctgaaaagccagccatcttgtgtcatacccatcagtcatttcatcccatcctatcaccatcattttgcaaagcagtgccgagtgtcagactacggatactccaagctgattgagttattagaagcagtgcctcatgtattgcagattcttggaatgggctccaaacgtctgctgacccttacccacagggcccaggtgaagcgctttactcaggatttactaaaacttctcaaatcccaggccagcaaacaggtcattgtgagagaattctcacaggcttatcactggtgtttctcaaaggactgggatgtcactgaatatggtgtttgtgagttgattgacatcgtatcagagattccagacacaaccatctgcttgtcccaacaagataatgaaatggtgatttgtatccccaaaagagaacgcactcaggatgaaatagaaaggacaaaacagttctccaaggatgtcgttgatttgctgcgtcaccaaccccatttccggatgccctttaataaatttatcccttcttaccatcaccactttggccggcagtgcaaacttgcgtactatgggtttaccaaactacttgaactttttgaagccatacctgatactttacaagtattggaatgtggagaagaaaagatccttactctgacagaggtggagcggttcaaagctctagctgcccagtttgttaaactccttcggtcccaaaaagataactgccttatgatgacagatctccttacagaatatgctaaaacttttggttatacatttcgtctccaagactatgatgtcagttccatttcggctttaactcagaaactctgccatgtcgtgaaggttgccgatatagaatctggcagacagattcagctgatcaaccgaaagtctctgcgatctctcactgcccagttgctggtattgttgatgtcttgggaaggaaccacccatctttctgttgaggagctcaagagacattacgaaagtacccacaacactccccttaacccctgtgaatatggattcatgaccttgaccgaactgctgaagagcctgccatacttggttgaggttttcactaatgataagatggaagaatgtgtgaagctcacaagtctgtatttgtttgcaaagaatgtgcggtctttacttcatacttaccactaccagcagattttccttcatgagttttccatggcctataccaagtatgtcggagaaactctgcagcccaagacctacggccacagcagcgtggaggagctcttgggagcaattccacaggtggtctggataaaaggacatggtcataagagaattgtagtgttaaaaaatgacatgaaaagtcgtttgagttcactcagtctctcccctgccaatcatgaaaaccagccctcggagggcgagcgcatcctggaggtgcccgaatcgcacacagcctcggaactcaagcttggagctgacggcagtgggcccagtcacacagagcaggagcttctccgcctgaccgacgactcccccgtcgacctcctgtgtgcgcctgtcccctcgtgcctgccgtcccctcagctgagaccagaccccgttatcctccaatctgctgatctcattcagtttgaggagcgccctcaagagccttctgaaattatgattttaaaccaagaagaaaaaatggagattccaataccaggaaagagcaaaactctgacctctgactccagctcgtcctgcatctcagcagctgtccccgtgcctccctgcccctcctcggaaacctccgagtcactgctcagcaaggaccccgtggaaagcccggccaaaaagcaacccaaaaatagagtcaaattggcagccaacttttccttagcacctataaccaagctttaactcccatttggaatatagaattaggatgggaaaacactgtctgattctgcacacaaaagtgggtttcaaaaatacatccttttctgtgtcatgaaaaccccccgaagccattgacttcatcttacctgtgttctatcatgtttttcttttccattgaacacagctttgagctgaagtctttcttttcttcttcctttttctttcttttttcaattatttgaagaacttgtggcatttgttaaagaatccttaatatattttaccaaatttttagtaactattatgaaatacaatggtgttccaaaagaagaaagcactaaaaactcaactagcaggaagcggttttgcttccattgagccacgtcggtggtgtcatcctacatgtagcataatagagtctctcagcctttgcttactggtgtttccgacagtattaacccagtgcgtggcatgtctttgaagcaaagcctgtcccgctagcctgtgtgttcacacaccaaaggagaagggtaggcgaggggttcggagtgtattttcaggttggaatgtgaaggttcctggcttccatgtgacttgtaagtgtgccttgttttttatttaaactatgtctgtagttgacaaaagtggcttcatcacaaatttttttaaacgtttctactttggggttccatttaggagctttctagaaagttgaggatgtttgaagcttcccttctgtgttccagtttgatatgggttaggttaaggaaaaggagatggtctcgatgtcatggatttaaagtcagcatttggattacaacacacattattgtgtgtcgagaggcagcattggaaagagcctgattttctaaaatatgcatcaagtgcataaattacaaatcagagctgagtggggaggtgcttcagcagcagcgggatcaatacgatttccactgggaagagacaggaattctacctacacataggaaggccaaggttgatccacttaaccttgttattgtaattttaaagctggtatcggtagctgggaagctttatgtgtgtgtatgtcagctcagcatcttttaatcgtgtctgattttactctcgttacttctcgctgttggaagcatctctgggtttcttgtggcgtctggtgtggaatggccttcctctctaggtgcctgaggtgtccgctgacgggtggcctctcacccccctctagagaaacctgacatttacaatggattgtatttgtccggcaaaaaaggcggattcattcatagagcagaaagaacctgttggcgtaaggtcttccactagttagatggtttcttttggggaaatgtttatatttggtaacttctagaaagccagaaaatggactctgatttcatagcattttgataaaatgccacaaaataagggctatagagagatttttacaagtcagattttttgttccccaaatcttttaaatgaagccagtgactcccagttctcaacacatggccccagtcaagacagaacaccatggaaaaaaccctgtaagtattatggcactctccgaatcctcctgaaggcatttcctctacagacatagtgttacaggaagtgaaatgcaaatgtgcaattttttttaaaggagcttttaaacaaagtaataataattggtgttgagaacatcagttgccttattctaagatttcataaggctgagtttgcacgcttggacttcagttctgctagcatgtaaagagtggtggactttaaaaccgtaagaggtatcattacaagtcacctggaacagactcaaagaacaggttctttgggcaacagacaaagaagaatcaagttctgtgctgtcccgtgagtgtgtctgagtaccattcactggagttgctgcttaggtctgggacgtgtgtgtgactcttaacaattgctgtctgaaaatgagagagaagacttcggaagcacattgtgttcataatgtactccacaatggccagtccaattgctatctatttttttatccagaggcttaattaaatgatgtggtaaaatgatgtttgagcattaagacaatgtaattctttatttctgggtggaaagatataccggattaaatttatctgtttaaaaaaatgacaaaagttatcaccaaaaccccctttcccatcttgcactgtttgttttggattgggtttgggggaaagagatgtttttcttagttgtctactttgtttgaacacttttgttgtggttcaagtgctgttttgtgtgttgggaccaaacagttgtcaataaactttacaagcgagcatctat

SEQ ID NO: 2430 - DNA, 1026 bp, Homo sapiens
aatgacatgacagccattccgtggccagggacaccactgcccaagctggagaccacgaggattcagggactgaagccagcatgggaattcctggtttgagatcagagtcctgagtacctcgtgggaacttgggcactcatccgcaggaggtctagacccccagagaattccttgagtctaaggcacaggcccaacatgtgtagcaccagtgggtgtgacctggaagaaatccccctagatgatgatgacctaaacaccatagaattcaaaatcctcgcctactacaccagacatcatgtcttcaagagcacccctgctctcttctcaccaaagctgctgagaacaagaagtttgtcccagaggggcctggggaattgttcagcaaatgagtcatggacagaggtgtcatggccttgcagaaattcccaatccagtgagaaggccataaaccttggcaagaaaaagtcttcttggaaagcattctttggagtagtggagaaggaagattcgcagagcacgcctgccaaggtctctgctcagggtcaaaggacgttggaataccaagattcgcacagccagcagtggtccaggtgtctttctaacgtggagcagtgcttggagcatgaagctgtggaccccaaagtcatttccattgccaaccgagtagctgaaattgtttactcctggccaccaccacaagcgacccaggcaggaggcttcaagtccaaagagatttttgtaactgagggtctctccttccagctccaaggccacgtgcctgtagcttcaagttctaagaaagatgaagaagaacaaatactagccaaaattgttgagctgctgaaatattcaggagatcagttggaaagaaaggaaaaagaatgggaggagtcagcaaagaccaagataaaaatggcacttctctggaggagcagtggtggtggacccagagttctgagtatacctgaggcatttatgaagaacagcttcactctcaccccacctggcttctcagaacacaattag

SEQ ID NO: 2431 - DNA, 1857 bp, Homo sapiens
ggtgccacccctccccccggcggccccgcgcgcagctcccggctccctcccccttcggatgtggcttgagctgtaggcgcggagggccggagacgctgcagacccgcgacccggagcagctcggaggcggtgaataatagctcttcaagtctgcaataaaaaatggcctccaacaaaactacattgcaaaaaatgggaaaaaaacagaatggaaagagtaaaaaagttgaagaggcagagcctgaagaatttgtcgtggaaaaagtactagatcgacgtgtagtgaatgggaaagtggaatatttcctgaagtggaagggatttacagatgctgacaatacttgggaacctgaagaaaatttagattgtccagaattgattgaagcgtttcttaactctcagaaagctggcaaagaaaaagatggtacaaaaagaaaatctttatctgacagtgaatctgatgacagcaaatcaaagaagaaaagagatgctgctgacaaaccaagaggatttgccagaggtcttgatcctgaaagaataattggtgccacagacagcagtggagaattgatgtttctcatgaaatggaaagattcagatgaggcagacttggtgctggcgaaagaggcaaatatgaagtgtcctcaaattgtaattgctttttatgaagagagactaacttggcattcttgtccagaagatgaagctcaataattgttcacattgttcttttatatatatttatatatatatataaaaattgggtcttagattttgatttactagtgtgacaaaataactacatcctaatgaaaatcaagtttgatatgtttgttttgaaagtagcgttggaagagttgttgggggttttttgcatccatagcactggttactttgaacaaataaataaaagctttctgtagttgcttcctttatcagaaaagaacatttgataccatggtatatcatttcctcttcattaaagaacagcttttctaaatgttgggggaaatgtccatagtcattactcagtcaaaacttgtgttctcatgagcctaaggaccattctagatttattacgtgttttttgtgtgtgtgtgtgtgtgtgtgtgtgtgtgtatccataaaatgcatatgtaaatttttttttgtttttaagcattcacccaaacaaaaaaatcacaggtaaacccatgtttctgagatgccattattccaagcaaaataagagataatcccttcaagttaaattgaaaattttcctgaaaccatacatttcaagtgaaataagtaattctagataggacaatttaaattggataattttaaagtgtctataattgcagtggtttatttgcaaaattcctaaaaggaaaaattttatcactgccatcacagcaggtttcctcatccagatgaggaaactagacaaatgctagtgtgttttaactagctaaacaaaactaagttaaatgaacatttaaaagtttccctagcgggccattccttagcaaaatgttggaatccctgttgctacattgactaaaaggtcatgatgaatggaatatgtaagacttggctcatagaaacctaatcagatggttagaggtgttggcagtttaggacctgctgtcataaatgtgtgaacaaccttttgtaacctaacctattgacctgcatgttttttctttaccccaattcattacatggaggctcaatcttgagtttgctttactggttcagcaaaagccaggaagaacaactttgtagtaatcaaaatgttatccaactgtatattgtttactttattgtaaatactggtgaacagtggttaataaatagttttatattccttta

SEQ ID NO: 2432 - DNA, 1384 bp, Homo sapiens
agtcggcggccggactgggaagatggacgcagctactctgacctacgacactctccggtttgctgagtttgaagattttcctgagacctcagagcccgtttggatactgggtagaaaatacagcattttcacagaaaaggacgagatcttgtctgatgtggcatctagactttggtttacatacaggaaaaactttccagccattggaggttgtcgggacatttcactctccagtaaatgtggcccttggcgttactgagtcctaagaggggggacaggccccacctcggacacaggctggggctgcatgctgcggtgtggacagatgatctttgcccaagccctggtgtgccggcacctaggccgagattggaggtggacacaaaggaagaggcagccagacagctacttcagcgtcctcaacgcattcatcgacaggaaggacagttactactccattcaccagatagcgcaaatgggagttggcgaaggcaagtccataggccagtggtacgggcccaacactgtcgcccaggtcctgaagaagcttgctgtcttcgatacgtggagctccttggcggtccacattgcaatggacaacactgttgtgatggaggaaatcagaaggttgtgcaggaccagcgttccctgtgcaggcgccactgcgtttcctgcagattccgaccggcactgcaacggattccctgccggagctgaggtcaccaacaggccgtcgccatggagacccctggtacttctcattcccctgcgcctggggctcacggacatcaacgaggcctacgtggagacgctgaagcactgcttcatgatgccccagtccctgggcgtcatcggagggaagcccaacagcgcccactacttcatcggctacgttggtgaggagctcatctacctggacccccacaccacgcagccagccgtggagcccactgatggctgcttcatcccggacgagagcttccactgccagcacccgccgtgccgcatgagcatcgcggagcttgacccgtccatcgctgtggggtttttctgtaagactgaagatgacttcaatgattggtgccagcaagtcaaaaagctgtctctgcttggaggtgccctgcccatgtttgagctggtggagctgcagccttcacatctggcctgccccgacgtcctgaacctgtccctagattcttctgatgtagagcgactggaaagattcttcgactcagaagatgaagactttgaaatcctgtccctttgaaaatcctggggtcgggggtggcacctgtgagagcctggggctcctggtgccgctgcgtttcatccatcccgcccgctcgcctgccgagggctgcgccccgtgctgcctccccccaga

SEQ ID NO: 2433 - DNA, 1306 bp, Homo sapiens
tgcctccgggtcgcggtcattttgagcccctgtctggatgacttcttgcggctgttctacccctccccctccccgcggtaccttgcacttttctccctccctgccccctctcgagtccaccctccgggccttctgcccctgatcgcttggttttccttgcagtcgcctgctgctgtcgtcgggaggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctgggcactattatcaaaagtcaaaatatgactcaagtgtgagtggtcaatcatcttttgtgacatccccagcagcagacaacatagaaatgcttcctcattatgagccaattccattcagttcttctatgaatgaatctgctcccactggtattactgatcatattgtccaaggtagaaacttctcttgaaatgaatttcaacattttatggtccaactcaaagtaaacaagtatggagatacttgggatgagtgaaaaattacatcattggacatgaaggagtttcaacatccagcttcatctaggtggtcatgattacctgcatgctttgagctcagcagcagtcttcataaacacatttaaaacaagatcctgggtttttgtggtttgacttctatggtgttttaaaaaaacacagatttttagtgttaatattgtgtaaatgtactcaccttagggattcatttgaatgatggtattataccatgattgtatacagtttgtgaaattgttgcaagggcaaagataactcttaaaaaaccgtcgagattacaatgctctagaatcagcatataagaaaataaatgatatctgcatgttgaattggggtggatggggggagcaagcataatttttaagtgtgaagctttgcatcaagaaattattaaaaagctttttttctccagtattttctgtattatcttaatgtttatggcaaataaaatgtaaaggaacatgcaa

SEQ ID NO: 2434 - DNA, 1304 bp, Homo sapiens
aacagattttaactctgaaaagccatttccagtgtctatagactattgtgagcctggagaagtagcatttagttgggatagcttcactagagctgcctgccaaagacttccttccacaggatcttgtcgcaccagcaactgacaggagcttgggagctcgggagcttgggagagggcttatgtttttaataatgtagctgtcagttcgaagcctggaaatgttgaccctcaaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagccttgctgtctgtgaggaatcttctgccagaccaggaggtgaaagtcttcaggatcagactctctgaaaactgcaaatggaaaggaattcaaaagaatttagattaaaagttaaataaaaagtaggcacagtagtgctgaattttcctcaaaggctctcttttgataaggctgaaccaaatataatcccaagtatcctctctccttccttgttggagatgtcttacctctcagctccccaaaatgcacttgcctataagaaacacaattgctggttcatatgaaacttaggaaatagtgaataaggtgcatttaactttggagaaatacttttatggctttggtggagatttctcaatactgcaaaagttgtccagaaatgaatctgagctgatggtgactttaagttaatattattaatatatcactgcatatttttacccttatttttgctccttacagcaagattagtaggttataaaaatttaaatttaaacaaaattatttcatgacaaaatgggaaacttcacatcatacttatttttgtttgcctttcaggcatcatattagcttttataaaaaatggtcttgctgctgaaattgtacttattttatcagaggctgggtgcagtcaagacaaaagtaaaatggtttacctgagcccaggggagggaaaattgattaagatatcattatttttgtttggtttggttttgcttttttcctcttactttaattgaaatactctgaattcccctcatggaaacagagagcattgagagcactttctttaaaaggaccaaaaataaattcctaatagattttgtcct

SEQ ID NO: 2435 - DNA, 2416 bp, Homo sapiens
agagaagaagcaggcagcttgagacaggtggagctggatcaagctgtgaacgtgatttgctggaagctggtcattagtgttgacgatgtgtcacactgtgtaagggaatcgcatggagatgggcattccgaactgttaatggggacatgggactccagttgtctctgatcacttgtgtggattttcctggcgtagaacgacagaagccgctagtaagtcgccaagacctacagcaggaattctgcaccaaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagccttgctgtctgtgaggaatcttctgccagaccaggaggtgaaagtcttcaggatcagactctctgaaaactgcaaatggaaaggaattcaaaagaatttagattaaaagttaaataaaaagtaggcacagtagtgctgaattttcctcaaaggctctcttttgataaggctgaaccaaatataatcccaagtatcctctctccttccttgttggagatgtcttacctctcagctccccaaaatgcacttgcctataagaaacacaattgctggttcatatgaaacttaggaaatagtgaataaggtgcatttaactttggagaaatacttttatggctttggtggagatttctcaatactgcaaaagttgtccagaaatgaatctgagctgatggtgactttaagttaatattattaatatatcactgcatatttttacccttatttttgctccttacagcaagattagtaggttataaaaatttaaatttaaacaaaattatttcatgacaaaatgggaaacttcacatcatacttatttttgtttgcctttcaggcatcatattagcttttataaaaaatggtcttgctgctgaaattgtacttattttatcagaggctgggtgcagtcaagacaaaagtaaaatggtttacctgagcccaggggagggaaaattgattaagatatcattatttttgtttggtttggttttgcttttttcctcttactttaattgaaatactctgaattcccctcatggaaacagagagcattgagagcactttctttaaaaggaccaaaaataaattcctaatagattttgtcctaagagagtgtttttttttctagcatcattttctttacatgccactcatgtcataaggcatggacaggctatctttcagtggccattactatgtttcgtacacatgctttattttacttgggctctgagaaatgtgtggctttccttcagcattttatttgtgcttctctttttaatggagattgaaaagggagaataatgtgaatatcacggcttatattattaaatgttgattgatggcttgtaatgtactgcacacaatatatgttaactctgcagaatgacagaccctgggagaagtaatgccccagttgtcccccactcctaatgccaggcagagaaggacagcctttatagacttaatctgctttttgtcccatttgacaaggtaccaggaggaaattttttaagggatcaactgtatcacagtgcccactctggacctaagtctagtgtatccatacaattggtgcagagaaataaggtgtaaatggtgctttgttcctgctggttccaagctcagaaaccaagactagctttgtaggagagaatgagagcctgcaagcctctctttggattggctgaggagtggtgggagcagggggttgatagaaaacatccagacacacatataagcaagtggccgtgctacctttttagagaataaagaaacagacttttgagtttatatgcaatgccttcattaggtaccaccggcacttacaaaatgtgcggactgaatcccagagaacactggcagatgtatacagtatatggattgtatcgcttccccaatgtttgtaaattcacagtatttggaaaactgccttcattttccagtgtgggaaaaactcttgctacctgtattacttgatctcagacccatacctgatggttcagtctgtccttaagttaaaagaattttgcttttctaatgttatactatttacctgtcagtgtattactgcaacttgaatcactcttttactgttgttggatataaacttatcctgtaccaatgtatttattaacacttgtattttattattgagcatatcaataaaaatattaaaaaataacagattgttttttacc

SEQ ID NO: 2436 - DNA, 1994 bp, Homo sapiens
ggcttgctcgcgcgtgcgcaccagaagccagcagtggggttgcacacgcgcctcttcacgaggtggaaacaagatggaggattcggcctcggcctcgctgtcttctgcagccgctactggaacctccacctcgactccagcggccccgacagcacggaagcagctggataaagaacaggttagaaaggcagtggacgctctcttgacgcattgcaagtccaggaaaaacaattatgggttgcttttgaatgagaatgaaagtttatttttaatggtggtattatggaaaattccaagtaaagaactgagggtcagattgaccttgcctcatagtattcgatcagattcagaagatatctgtttatttacgaaggatgaacccaattcaactcctgaaaagacagaacagttttatagaaagcttttaaacaagcatggaattaaaaccgtttctcagattatctccctccaaactctaaagaaggaatataaatcctatgaagccaagctccgccttctgagcagttttgatttcttccttactgatgccagaattaggcggctcttaccctcactcattgggagacatttctatcaaagaaagaaagttccagtatctgtaaaccttctgtccaagaatttatcaagagagatcaatgactgtataggtggaacagtcttaaacatttctaaaagtggttcttgcagtgctatacgtattggtcacgttggaatgcaaattgagcacatcattgaaaacattgttgctgtcaccaaaggactttcagaaaaattgccagagaagtgggagagcgtgaaactcctgtttgtgaaaactgagaaatcggctgcacttcccatcttttcctcgtttgtcagcaattgggatgaagccaccaaaagatctttgcttaataagaagaaaaaagaggcaaggagaaaacgaagagaaagaaattttgaaaaacaaaaggagaggaagaagaagaggcagcaggctaggaagactgcatcagttcttagtaaagatgatgtggcacctgaaagtggtgatactacagtgaagaaacctgaatcaaagaaggaacagaccccagagcatgggaagaaaaaacgtggcagaggaaaagcccaagttaaagcaacaaatgaatccgaagacgaaatcccacagctggtaccaataggaaagaagactccagctaatgaaaaagtagagattcaaaaacatgccacaggaaagaagtctccagcaaagagtcctaatcccagcacacctcgtgggaagaaaagaaaggctttgccagcatctgagaccccaaaagctgcagagtctgagaccccagggaaaagcccagagaagaagccaaaaatcaaagaagaggcagtgaaggaaaaaagtccttcgctggggaaaaaagatgcgagacagactccaaaaaagccagaggccaagtttttcaccactcctagtaaatctgtgagaaaagcttcccacacccccaaaaaatggcccaaaaaacccaaagtaccccagtcgacctaaagtcagtgattcaactggaaggaaacctcaatgctgcctccagagctttttggaaatactcagatcctggccgcctttgtaaccttctctaaacgtcaggcctggacttaaaagattttttaaaacctccataagtagtccaggggcggtggctcacgcctgtaatcccagcactttgggaggccgaggcaggcggatcacaaggtcaacgagatcgagaccatcctggccaacatggtgaaaccctgtctgtaccaaaaatacaaaaattaattgggcatggtggtggacacctgtaatcccagctactagggaggctgaggcaggagaattgcttgaacctgggaggcggaggttgcagtgagccactgcactccagcctgatgacagagcaagactcagtctcaaaaataaataaaaataataaaacctccataagtaatcctga

SEQ ID NO: 2437 - DNA, 768 bp, Homo sapiens
ggtgtttggtggagcccgcgatggccgaacctgcgtctgtcgcggctgaatctctcgcgggcagcagggcgcgcgctgcacgcacagtactaggtcaggtggtgctcccgggtgaggagctgctcctgccggaacaggaggacgcggaaggccctgggggtgcagtggagcgaccgttgagcctgaatgctagagcgtgctcgcgggtgcgcgttgtatgcggtccgggccttcggcgctgtggggaccgcctgctggtcaccaagtgcggccgcctccgtcacaaggagcccggcagtggcagcggcggcggtgtttactgggtggactctcagcagaagcggtatgttccagtaaaaggagaccatgtgattggcatagtgacagctaaatctggagatatattcaaagttgatgttggagggagtgagccagcttctttgtcttacttgtcatttgaaggtgcaactaaaagaaacagaccaaatgtgcaggctattagctccagattgtgaaatcatacaggaagtgggaaaactctatccactggagatagtatttggaatgaatggaagaatatgggttaaggcaaaaaccatccagcagactttaattttggcaaacattttagaagcttgtgaacacatgacgtcagatcaaagaaaacagatcttctccagattggcagaaagttgatataggtggacttttttacaggtcagttgaggcaaaaaactatgggttttttcaggtgaacctcccccattt

SEQ ID NO: 2438 - DNA, 3012 bp, Homo sapiens
gactcctgtgcggaacgtgagtgactgagcggcaaagcccgaatggtctctagcgaccggcccgtgtcactggaggacgaggtctcccatagtatgaaggagatgattggaggctgttgcgtttgctcagacgagagaggctgggccgagaacccgctggtttattgcgacgggcacggctgcagcgtcgcggtgcatcaagcttgctatggcattgttcaagtacccactggaccgtggttttgcaggaaatgtgaatctcaggagagagcagccagagtgagatgtgaactttgtccccataaggatggagctttaaaaagaacagataatgggggttgggcccatgtggtttgtgccctgtatattccagaggtacaatttgccaatgtttccacaatggaaccaattgttttacagtctgttccgcatgatcgttataataagacttgctacatttgtgatgaacaaggaagagaaagcaaagcagccactggtgcttgcatgacatgtaataaacatggatgtcgacaggctttccatgtaacatgcgctcagtttgccggactgctttgtgaagaagaaggtaatggtgccgataatgtccaatactgtggctactgtaaataccattttagtaagctgaaaaagagcaaacggggatctaataggtcatatgatcaaagtttaagtgattcttcctctcactctcaggataaacatcatgagaaagagaaaaaaaaatataaagagaaggacaaacacaaacagaaacacaagaagcagccagaaccatcacctgcattggttccatccttgactgttactacagaaaaaacttatacaagcactagcaacaactctatatctggatcattgaagcgcttggaagatactactgcacgatttacaaatgcaaatttccaggaagtctctgcacacacctctagtggaaaagatgtttcagagactagagggtcagagggcaaagggaagaaatcttcagctcacagctcaggtcaaaggggaagaaagcctggtggtggaagaaatccaggaacaactgtgtcagcagctagcccttttcctcaaggcagtttttcaggaactccaggcagtgtaaagtcatcttctggaagttcagtgcagtctccccaggatttcctgagctttacagactcagatctgcgtaatgacagttactctcactcccaacagtcatcagcaaccaaagatgtacataaaggagagtctggaagccaggaagggggggtaaatagttttagtaccttaattggcctcccttcaacctcagctgttacttcacagcctaaaagctttgaaaattcacctggagatttgggtaattccagccttcctacagcaggatataagcgggctcaaacttctggcatagaagaagaaactgtaaaggaaaagaaaaggaaaggaaataaacaaagtaagcatgggcctggcagacccaaaggaaacaaaaatcaagagaatgtttctcatctctcagtttcttctgcttcaccaacatcatctgtagcatcagctgcaggaagcataacaagctctagtctgcagaaatctcctacattgctcaggaatggaagtttacagagcctcagtgttggctcatctccagttggttcagaaatttccatgcagtatcggcatgatggagcttgcccaacaactagtatttataacagcaatgatgtagcagtatcgtttccaaatgtagtatctggctcgggatctagtactcctgtctccagctctcacttacctcagcagtcttctgggcatttgcaacaagtaggagcgctctctccctcagctgtgtcatctgcagcccctgctgttgctacaactcaggcaaatactctatctggatcttctctcagtcaggcaccatctcatatgtatggcaatagatcaaattcatcaatggcagctcttatagctcagtctgaaaacaatcaaacagatcaagatcttggagacaatagccgcaacctagttggcagaggaagctcaccccgaggaagtctctcgccacgatcccctgtaagcagcttacagattcgctatgatcaaccaggcaacagcagtttggaaaatctgcctccagtagcagccagcatagaacagcttttggagaggcagtggagtgaaggacagcaatttttactagaacagggtactcctagtgacattttaggaatgctgaagtcattacaccaacttcaagttgaaaaccgaagattagaggaacaaattaaaaacttgactgccaaaaaggaacggcttcagttattgaatgcacagctttcagtgccttttccaacaataacagcaaatcctagtccgtctcatcaaatacacacattttcagcacagactgctcctactactgattccttgaacagcagtaagagccctcatataggaaacagctttttacctgataattctcttcctgtattaaatcaggacttaacctccagtggacaaagtaccagcagctcatcagctctttctaccccacctcctgctgggcagagtccggctcaacaaggctcaggagtgagtggagttcagcaggtcaatggcgtgacagtgggggcactagctagtggaatgcagcctgtaacttccaccattcctgccgtgtctgcagtgggtggaataattggagctttgccaggtaaccaactggcaattaatggcattgtaggagctttaaatggggttatgcagactcctgtcacaatgtcccagaaccctacccctctcacccacacaaccgtaccacctaatgcaacacatccaatgccagctacactgactaacagtgcctcaggactaggattactttctgaccagcaacgacaaatacttattcatcaacagcagtttcagcagttgttaaattctcaacagctcacaccaaacatggttaaggaattttcagcacaaattattgcttggagaccatga

SEQ ID NO: 2439 - DNA, 3318 bp, Homo sapiens
gggagattacggggcggggacgagctgtcgcgctggttgctcgtgcaggagcgggacccggaacagaccgccgtgagagaggaggggtgccggccgggattcgcggcccggagctcgggaccggttgcttcattccagcctcgcagtcacctctgtgccctgctggttgtcttcccagcgctgctgtagttgccttccatggatctataggagagcaagtcctccaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagggacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggacacgagagacttcctaaacaggtatccacggaagaagttctgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctaggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccccagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttccctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccgggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttctaagagactgttccaacggctctgggcctcagtggtcacttgaccaccattgtctcagagctgcccactttgtgtgtgtcacatgctgcctgagtcacatgtacatcttatttctgcctctagttttgtaagctcctggagggcggataacatcttatactactcttgtattctcatggcacctagtgcagtgctgggcacagagtaggtgctcaataaagacttgttgaatgaa

SEQ ID NO: 2440 - DNA, 3026 bp, Homo sapiens
ggtgccttaggcgctggagaaaaacttcacccgcgcccacaggccccctttccgcaggctgcgctggcggttcaggtttgcaggccggaagtgaaatgttcttttttgatttttaaaaaggaagcctccggccctatggttttctggggttggagtggatgtgtgtgctgggggaggcggagacgtcccgctccaggcagggccttgggtcttaataggtggggaaatctctgccaaataggaggcctctcggagcctcagtttccccatctgcagactgggctctgacttcttctggcatgagagggtgtgtgagagtaaaaggaggcagctagccccgtgccgggagacacgtcagccatgtcatctgagcctcccccaccaccacagccccccacccatcaagcttcagtcgggctgctggacacccctcggagccgtgagcgctcaccatcccctctgcggggcaacgtggtcccaagcccactgcccactcgccggacgaggaccttctcggcgacggtgcgggcttcacagggccccgtctacaaaggagtctgcaaatgcttctgccggtccaagggccatggcttcattactccagctgatggcggccccgacatcttcctgcacatctctgatgtggaaggggagtatgtcccagtggaaggcgacgaggtcacctataaaatgtgctccatcccacccaagaatgagaagctgcaggccgtggaggtcgtcatcactcacctggcaccaggcaccaagcatgagacctggtctggacatgtcatcagctcctaggagatggtggaagcaccccttgtcctgtgcttgtgggagactttgcagggaggaggcagcagacactggagatgacattcttccacacgagacggggcttcagccgggcatggtccctctcaagtatctcctggaggaaggggtatggggggcaggtgtggggtgtggggtgttcccggccatcagcacagcctatgaccattgcaacaacctctcaccatctgaagagcattaaaagcatttaaaaaggagaggtgcccactggtggctgagtggaggttccaaccccatcccagggagtggatcaagggtggtatttctccagctgctcagacacatgggctcaacccacagaatccctcttcctcctggagctggaggccccagattcccagatctggccccctggcagcctgacagggaccttgcgtgacttctccaaggcaaatttccacctaagtgccccttgcgcctctcctggggcctgggcaaagcagttttctaattcttggcttggttggttctaggggagctggcttgaagtgggtggggaaaggcgggggtggcggtctttggattggacggatgttgccttttggtgcctttgcagtgggaggcggcatagctgcctgtctggggaagacagttctcccagcactcccacccctgggcacagcaggctggtactgggaggctgaacccctcttagagcctgaccttttcatctgccttctggttgtgtgaccatcactcaacagccatttcacagcccctgtaattatggcggcggggggctggggtggtggtggtgggaagggcttgtggagaggacacagtctttgtttaaaaactttgtcccgatccatccagaaaagagtaggtagcttgcatcctgacagcctggcaaagtcaagaaagttgaaggagaaacatacctttggagagggggttttctttaaaactagtgttaagaaatgcttagggattttttttttcttatttttcataactaaagctttcacccagagccggctctgtttgcactttgctgccgacattgcaaactttttggcagggtgggagactgagtctcattctgtcacccaggctggagtgcagtggcccgatctcagcttactgcaacctctgccctccagggttctggcaattccgcctcagtctcctgagtagctgggattacaggcatgcgccaccacacccggttaatttttgtatttttagtagagaccaggtttcatcatgttgggcaggatggtcttgaacccctgacctcagatgatctgcccatctcggcctctcaaagtgctgggattacaagtgtgagccatcgcgcccggcctgcaaacttttttgtaggtatttctggtaaacaaatccttaggttatctttgctgtggttgtggtttggctttagtcatgatttcaaagtagaaatagctaggcattattttttgaaatatatgacctatatgtagtcaagaatccactgaacagaggcaagcaaaccttttggaaactggcttttgggcagacagtaaacgtccagtttgatgctggaagcatgaacagcttcatcaggtaggtactcctcaactctgatgagtttgtcctttcagcctaagggggtggaagggagttgtttgagaatagcaaatacgcatgttgattgcgagtgtgtggagacaaaggcagttcccaccacagttaggtcctggccattgtttcctcgcctgcgatgctccttgtacatcctcaccctcctctcccgcctctgccttctgctgggtcaaaggtggccttttctctccagccttgaattgttccctgttggcttcccaagggcccatctgctggtacagtccacacttccacagccaagacccgagagggctttcactgccccaagcctctctcctgtgaccctgggattctgtcttggcagaatcctttgtcagcggctcttactctgtccttcctgtttggccacagctctttcaatcaatgggtattctagaaccgcaggatgtcagagctggaagggacgcgataccggtttacacaaggggaaactcctcgaggctctgggagggacggagggttttggtgacagagcgagagctaaaattgaggattcctgaatccagatcttgcctcccatcagccatctttctcccaataaatttttgttttgtgcaaggcta

SEQ ID NO: 2441 - DNA, 1380 bp, Homo sapiens
ggccctcgcggggggcttgtgggtcctcctccccctcccactgacaactgccccaactgctcttcccgccccggtcacagtgaaaatgtagacggggtcgttgtccactatgttaggtcttaatggtgggaggacgcccgagtgctcggcccgtttcaccccgaggaggaaggacactgggtcatgacgccatcagagggcgccagagcagggaccggacgcgagttggagatgttggactcgctgttggccttgggcggcctggtgctgcttcgggattccgtggagtgggaggggcgcagtctcttgaaggcgcttgtcaagaaatctgcactgtgtggggagcaagtgcatatcctgggctgtgaagtgagcgaggaagagtttcgtgaaggttttgactctgatatcaacaatcggctggtttaccatgacttcttcagagaccctctcaactggtcaaaaactgaggaggcctttcctggggggccgctgggagccttgagagccatgtgcaagaggacagatcctgttcctgtcaccattgctctcgattcactcagctggctgctacttcgccttccctgcaccacactctgccaggtcctgcatgctgtgagccatcaggactcttgtcctggtgacagctcctcagtggggaaagtgagtgtgctgggcttgctacatgaagagcttcatggaccaggccctgtgggagctctcagcagccttgctcagactgaggtgaccctgggcggtaccatgggccaggcctcggcccacatcctgtgtcggaggccccgacagcgcccaactgaccagactcagtggttctccatccttccggacttcagcctggatctccaagaggggccctctgtagagtcccagccctactccgatcctcatatacccccggtggatcccacaactcatttgacctttaaccttcacctgtccaagaaagagagagaagccagagatagcctgatcctgcccttccagttcagttctgaaaaacagcaggctctcctgcggcctaggccagggcaggctaccagccacatcttctatgagccagatgcttatgatgacctggaccaagaagacccagatgacgacctggatatttgactggccagatttgattagattgtaattggagggggcgcgggaagactttgggcccagaaccatctttctattgtttgtgttagccttaccctgtccctgccccaccttggttccccttgtctatggagccccgccttgtgagccaggaagcagcgtctcatcaggacagaaggtaggatgaagacatggggtaatgtgagagagtagaacacccccgtacctaataaaaatctttatttttttatt

SEQ ID NO: 2442 - DNA, 1468 bp, Homo sapiens
ggccctcgcggggggcttgtgggtcctcctccccctcccactgacaactgccccaactgctcttcccgccccggtcacagtgaaaatgtagacggggtcgttgtccgtacgactgtgcgccagggctcggggaggggcgccctccgcgtgagcgcccccctgggaatattgaacataatcacctctcattccagactatgttaggtcttaatggtgggaggacgcccgagtgctcggcccgtttcaccccgaggaggaaggacactgggtcatgacgccatcagagggcgccagagcagggaccggacgcgagttggagatgttggactcgctgttggccttgggcggcctggtgctgcttcgggattccgtggagtgggaggggcgcagtctcttgaaggcgcttgtcaagaaatctgcactgtgtggggagcaagtgcatatcctgggctgtgaagtgagcgaggaagagtttcgtgaaggttttgactctgatatcaacaatcggctggtttaccatgacttcttcagagaccctctcaactggtcaaaaactgaggaggcctttcctggggggccgctgggagccttgagagccatgtgcaagaggacagatcctgttcctgtcaccattgctctcgattcactcagctggctgctacttcgccttccctgcaccacactctgccaggtcctgcatgctgtgagccatcaggactcttgtcctggtgacagctcctcagtggggaaagtgagtgtgctgggcttgctacatgaagagcttcatggaccaggccctgtgggagctctcagcagccttgctcagactgaggtgaccctgggcggtaccatgggccaggcctcggcccacatcctgtgtcggaggccccgacagcgcccaactgaccagactcagtggttctccatccttccggacttcagcctggatctccaagaggggccctctgtagagtcccagccctactccgatcctcatatacccccggtggatcccacaactcatttgacctttaaccttcacctgtccaagaaagagagagaagccagagatagcctgatcctgcccttccagttcagttctgaaaaacagcaggctctcctgcggcctaggccagggcaggctaccagccacatcttctatgagccagatgcttatgatgacctggaccaagaagacccagatgacgacctggatatttgactggccagatttgattagattgtaattggagggggcgcgggaagactttgggcccagaaccatctttctattgtttgtgttagccttaccctgtccctgccccaccttggttccccttgtctatggagccccgccttgtgagccaggaagcagcgtctcatcaggacagaaggtaggatgaagacatggggtaatgtgagagagtagaacacccccgtacctaataaaaatctttatttttttatt

SEQ ID NO: 2443 - DNA, 1734 bp, Homo sapiens
cgcgcagaagtccggggctggcaagcgcttcctgcgcagcgcctaggcgacctggagtttgtgacgctgtgatggtctagaggctggagattcaagatctgggtgccatcattttctggttctgttgatgaccctcttccaggttacatacagcttacatcttgcatcctcaagcgtttttcttataaggctaaaaattcacaaagcatatatcaatgaatcaggaggatctagatccggatagtactacagatgtgggagatgttacaaatactgaagaagaacttattagagaatgtgaagaaatgtggaaagatatggaagaatgtcagaataaattatcacttattggaactgaaacactcaccgattcaaatgctcagctatcattgttaattatgcaagtaaaatgtttaaccgctgaactcagtcaatggcagaaaaaaacacctgaaacaattcccttgactgaagacgttctcataacattaggaaaagaagagttccaaaagctgagacaagatcttgaaatggtactgtccactaaggagtcaaagaatgaaaagttaaaggaagacttagaaagggaacaacggtggttggatgaacagcaacagataatggaatctcttaatgtactacacagtgaattgaaaaataaggttgaaacattttctgaatcaagaatctttaatgaactgaaaactaaaatgcttaatataaaagaatataaggagaaactcttgagtaccttgggcgagtttctagaagaccattttcctctgcctgatagaagtgttaaaaagaaaaagaaaaacattcaagaatcatctgtaaacctgataacactgcatgaaatgttagagattcttataaatagattatttgatgttccacatgatccatatgtcaaaattagtgattccttttggccaccttatgttgagctgctgctgcgtaatggaattgccttgagacatccagaagatccaacccgaataagattagaagctttccatcagtaaaaggatgttttcttttttcacacagtaaaaattcttatcattcaaggatattggaaccacaggactatttggataaaaaacattatttgcaaattaatgcgcataggccatcttacttttattgcaaaatggcatgtgctgccatctattattcatttttaaatggtcatttcttattcagtgagtgctttagtgttttaaactatatggataagaatgcaggtagataatattctaggcataaaacatttaatgtaccttacctcatgcaatattctttggattctttgttgatttatgatattgctaatataatattttcttaaaatatataacaatatcttttatgcattttgagttccagctggtgcttctttatatttagaaattataatgggaaggtcatttaatttacagatggttttaaaattgaggtaatatctgaggtggcataatttaaaaatatttagcaaatttgtttcatatatactgtcttatttctagatttgtttaaaattggaatatgaaaaactaatggataaagctagcataaaattgatattttagtttgtattattaatatatcatgttaccttatatattaatctactcttgattctgctaattattaccaacaaaattgtattcatgacattttattaatcctctgtgaattttctgtaaataaaattatttctgaaaatctcta

SEQ ID NO: 2444 - DNA, 3824 bp, Homo sapiens
gagcacagagaagctcccagctttgaaggtcttgcggtggtgcgtggcgggcaggaacccacaattccaaatacaaacggtcggcgcgagaagcgcttctgggcgcaggcgcctggctgtagcgactggttgcgggaggctggactctggtgactgtaagcatcaagtgtacctgatttgtgaacctatcttgcttcagttggtttcctcctaaatattaggcagatgggattggctggtctgtgctctgctaggtgaaaaattagacgatttcaagaattggagctgaatctgatgttaagtaatggcaacaggtgacttaaaaagaagcttacggaacctagaacaggtgctccgcttgctaaattatcctgaagaggtggactgtgtaggtttgataaagggagacccagcagcatctttgcccatcatcagctattcttttacctcatactcaccttatgtaacagaacttataatggaatccaatgtagagctcatagcaaaaaatgacttgcgctttatagatgctgtctataagcttcttcgtgatcaatttaattataaaccaattttgacaaaaaagcagtttatccaatgtgggtttgcagaatggaaaatccaaattgtttgtgatattttgaattgtgtgatgaaaaagcacaaggaattaagcagtcttcagaagattccatcacaacaaagaaagaaaatcagttctggtaagtcagaacctcctttgggcaatgagaaaatatctgcagaggctgttggcgttgatatcagtggcaggtttatgacctcaggaaagaagaaagctgtggtgattcgtcacttgtataatgaagataatgttgacatttctgaggatacattaagtccaataacagatgttaatgaagcagttgatgtgtctgacttaaatgctactgaaataaagatgcctgaagtaaaggttcctgaaatcaaggctgagcaacaggatgtaaatgttaatcctgagattactgcactacaaactatgcttgctgaatgccaagaaaatcttaagaaactgacttcgatagagaaaaggttagactgtttggaacaaaaaatgaaaggaaaagtgatggtagatgaaaacacctggactaatcttcttagtcgtgtcactcttcttgaaacagaaatgcttttgtctaaaaagaatgatgaatttatagagtttaatgaagttagtgaagactacgcttcttgtagtgacatggaccttctgaatcctcacagaaaaagcgaagtagagaggccagcaagtattcctctgtcctctggctatagtacagcatcatcagattcaactcccagagcctctactgttaattactgtggtttgaatgagatttcagaggaaacaacaatccagaaaatggaaaggatgaaaaaaatgtttgaagaaactgcagagttactgaaatgtccaaatcactacttgtaggattttctacatgaacttttttctaggactttggttactatacatattgtatattttaagaattctttatacaattttaatatactgcaatactgcagtttttgacaatttggattccatttggtatatgaatttttgcattcattattgaataactcttttaatatttttgagcaatgattatactgctttaccttgtgtcactttttttttttttaggaaaaactcatgttccagtatatttctcttacagagtgaagtcattacagcactgtatttctgtgttgacatttgttggcagtgtgctaagtaatgttttttaaagcacaggcttgaggactatggtttacatcctgttggaaacattccaaatgggacttgtgtattatacccaggaggctctcatatataccatcttggcatctgtactgatgaataagttataatgaacagttaaaaatgctcattgaaaattaaataaaacaaaaaggcagttatttcatgcttggtcaaaaacatcaatacctttccaattaacactgagaaattaaggttaagattctccttttgtactgggaaacaggctggaggactatggtcctcaagtttagaccaagaggactatggtctcaaggttcaccatgagaaatgtgttgaacattttagtatgctctattgtataatttttttggagggggggatggagtttcgctgttgttgcccaggctggagtgcaatagcacgatcttggctcaccgcaacctctgcctaccgggttcaagtgattcttgtgcctcagcctcctgagtagctgggattataggcatgcaccaccatgcccagctaattttgtatttttattagagacagggtttctccgtgttggtcaggctggtctcaaactcctgacctcaggtgatctgcctgtcttggcctccggcgtaacactttttaagaccagtgtaacagaaagagaatgtagccattctagccaccgttaaaagatacacagtgaggtgttgtgttttgtttttttaatgatgaaaagttacacattttttggagagaaaagtcttagctgaaggtaaatcaatggaaaaatgaaatttatttttaatattactactatatgaattatctttttttaaacttgtagataaaagtgttccagtaatcagaaaatcctcaagaaaattgacttcattatttggaaggaaaattagtattttttttaatattatatggaccatctgattatattttatttattcatctatttatgggtctcactctattgcccaggctggagtgcactggcgtgatctcggctcactgcaccttctgcctaccgagttcaagcgattcttgtgcttcagcctcctgagtagctgggactataggcctgtaccgtcatgcctggctaatttttgtatttttgtagagacagggtttcaccatgttgcccagtctgttctcaaactcgtgagctaaagctactcgcccacctggatgtcccaaagtgctagattccatggaattttcctgcatggagtgctacatcctcttgttccagtctcagctggctgctccgtgggcatacttcatacctttcatcacagagctttgcttggcctctctcctgtgtgtaatctctgtttcttggatcctgtgcttaccttttcctgctgtactctgatgtttcagtgaagctcatccacgaagtccagaattctgcctggaaaccagcttcctcctcagctccagctcttttaatgggcatatcaaaactgatgactttttccttcctgctacatgggtaacacttagttgtttgtctaatttctattttccagaaatttctcaaaatgtctgctgatagcccctcactcatatttttcatgtgggtttatagctttcatatttctttattattgtaaatgggggctgtggaaggtgagaaaacacatgctttcttaaaacagaagctctctccttcattaatttaaatatttttatcggctctagaaaatgcataaggttagtacaagatcagtagagagaaagtcaaagattacagaagtgctgaagcagaccattcttcctttcttcccaatgtctattaagatcacacataggtaaactgttacaaatccagaatggtgaaagagtccaacaatggctgagggaagtagaggttaagatatagctcaacagtgaaagtagcagggaaagagctgggcaaggccaagaccatcttttgtaccgttggtacagtaggctaaaggtacggtgttccatattaaatacagcaatatgaagaaaaataaattaagtcccttatacctaa

SEQ ID NO: 2445 - DNA, 1269 bp, Homo sapiens
gcaggcggcaggaggcgggtgggtcaaggtaactctgggctacagagtccttgctgggggttcggggagcgcttggaccccggcttctgggacgcgtcagaatattatccagcaatgcaaatgaacaaactataactacacacagctgcatggataaatgtcagaaacatgacgttgagtgtgagaagccagatgcaaacgaggactcactgtgcaattctgtgcatgtacagtggccaggagaagggagcactggctttgctttcatcaggccaaagatgcctttctttgggaatacgttcagtccgaagaagacacctcctcggaagtcggcatctctctccaacctgcattctttggatcgatcaacccgggaggtggagctgggcttggaatacggatccccgactatgaacctggcagggcaaagcctgaagtttgaaaatggccagtggatagcagagacaggggttagtggcggtgtggaccggagggaggttcagcgccttcgcaggcggaaccagcagttggaggaagagaacaatctcttgcggctgaaagtggacatcttattagacatgctttcagagtccactgctgaatcccacttaatggagaaggaactggatgaactgaggatcagccggaagagaaaatgaagaccccagagacatttattggggagtaggatgtggctgagtgctttttttttggccagactagcggattcagtcctggaagagagtatcatataatgagacccacaggcactggcacccttgggttggcaatagaaggtgacatggaatggagaaaaccaagattccagatggggatagtaactagaaggtgcttcagatgcactgcctgcgggtgccagtctgaaaaccagaccgcacagaggcctggggctgctgatgagctttttggtgctctccacacacaagctcgcaaacacacatgtcccagaatagctctgttgggttgtgttgggagaagcggctggagttcattctctcacccccttatgttggtgtttggcgtgtgacagcagttctacagagctctgtgttggggtcatggatgagcggctctcttggctcttaaaggcaggcctctctcttcttgcctttaaagaatcctccttcctcacacctggcctcctctggcttcagcttctcagcagcaagcaccagccttccacaacaacactatatttttatgctactttcctgtttgcactactacttttttattaaacgatgttaa

SEQ ID NO: 2446 - DNA, 1552 bp, Homo sapiens
gctcaggccccgccctcagacgagcaccgcccgccggctcctcccgcggctcgaatcgccgtctctctcctccccgccccgccgagttctagaattcgccgcgcagctgcttcagcccctcagccccagccggaccctcgggtcctcatccaccctcgcaggcgcaggccgtggctaccccgaagtcaactgtggaggatccttcctggcttccttcagctccatcctgcccttggatctaggtcacccgcttggacccaactatctgaggcccgaatgccccgcagctcccgctgctccctcgcgttctgctgacccccctccgagtcaggacatcccctttagaccccactttaggccctttcagcccaactccaactagccccatctgccgcttccgcacgagacagagtttcactcttgttgcacagactggagtgcaatggcgcgatctcaactcaccgcaacctctgcctccctggttcaagcaattctcctgcctcagcctcctgagtagctgggattacagcaccaaaaaggagactaactacccagccccgtccagtcatgcaggtgcaggatgatggagtcaacctcatcccctttgccaagtgttccagggtggtcagccgatctccacccccaaggttgccttcccagagcctcagacccatgccccagcgttatggagatgtcttctggaagaaccttaatcaaaggcccacccccacttggctggaggagcagcacattccacccatgctgagagccactggttgctcccagcttggtctgtatcctcctgagcagctcccaccccctgaaatgctttggagaagaaagaagaggaggccatgtttggaaggaatgcagcagcagggccttgggggagtccccgcccgggtgagggctgtcacttaccacctggaggacctaagaaggcgtcagagcatcatcaacgaactgaagaaggcccagtggggcagctctggggctgcatctgagccagtggtgcttggcgaagagggctgtggattccccagcaccaatgaataccctgatctggaagaggagagagcaacctatccacaggaagaggaccgttttctcactcctggcagggcccagctgctttggtctccctggagccccctggatcaggaggaggcttgtgcctccaggcagctgcactctctggcctcgttcagcactgtcacagccagaaggaacccccttcacaatccctgggggatggagttggcagcgtctgaagagtaaggagaaaccaccgatgccgagaggctagtggtgccccagggacccaagactagttccgtcactagagtcaccctcattgctgacatgaaggcgtttccccttccttcgtctctccaactgcctttcccatcctctgaactaggcattaacagcccccgtgggctcccatctcaacccaccgctctcacaggagcaccccaagtcctgttttcctccaggccccgctcctggccttgtattctctctgctctgttattaaaaagcaagcaagtgg

SEQ ID NO: 2447 - DNA, 2677 bp, Homo sapiens
tgctcctgcaccggtctgcatctcccagcagaaggcgcagccatgaatccgttattcggccccaacctcttcctcctgcagcaggagcagcagggcctggccgggccactgggggactcactgggaggcgaccacttcgccgggggaggagacttgcccccggcgcctctctcgccggccggccctgctgcctactcgccgcccgggccgggcccggccccgcctgccgccatggccctccgcaatgacctgggctccaacatcaacgtgctcaagaccctgaacctccggttccgctgcttcctggccaaggtgcatgagctggagcgccggaaccggctgttggagaagcaactgcagcaagcgctggaggagggtaagcagggccggcggggcctgggtcgtcgcgaccaggcagtgcagaccggcttcgtcagccccatccggcccctggggctgcagctgggcgcccggccggccgctgtctgcagcccttcggcgcgcgtgctgggctcgcccgcgcgctccccggccggccccctcgcgccctccgcggccagcctctcgtcgtcctccacctccacctccaccacctattcctcgtcggcccgcttcatgcccggcaccatctggtcgttctcgcacgcccgccggctcgggccgggactggagcccactctggtgcaagggcctggcttgtcgtgggtgcacccggatggggtgggcgtccagatcgacaccatcacgcccgagatccgcgctctctacaacgtgctggccaaagtgaagcgggagcgggacgagtacaagcggaggtgggaagaggagtacacggtgcggatccagctgcaagaccgtgtaaatgagctccaggaggaagcccaggaggctgatgcctgccaggaggagctggcactgaaggtggaacagttgaaggctgagctggtggtcttcaaggggctcatgagtaacaacctgtcggagctggacaccaagatccaggagaaagccatgaaggtggatatggacatctgccgccgcatcgacatcaccgccaagctctgcgatgtggctcagcagcgcaactgcgaggacatgatccagatgttccaggtcccatccatgggggggcggaagcgggagcgcaaggctgccgtcgaggaggacacctccctgtcggagagtgaggggccccgccagcccgatggggatgaggaggagagcacagccctcagcatcaacgaggagatgcagcgcatgctcaaccagctgagggagtatgattttgaggacgactgtgacagcctgacttgggaggagactgaggagaccctgctgctttgggaggatttctcaggctatgccatggcagctgcagaggcccagggagagcaggaagatagcctggagaaggtgattaaagatacggagtccctgttcaaaacccgggagaaggagtatcaggagaccattgaccagatagagctggagttggccacggccaagaacgacatgaaccggcacctgcacgagtacatggagatgtgcagcatgaagcgcggcctggacgtgcagatggagacctgccgccggctcatcacccagtctggagaccgaaagtctcctgctttcactgcggtcccgcttagcgacccgccgccgccgccaagcgaggctgaggactccgatcgcgatgtctcatctgacagctccatgagatagagacctgcctcccccttgcacccgaggccctcgcagcagggagctcagcgaggcagagggtggggctgcacagaggggaacatcagctgcagctctgcaccaggccggtccctggggactggggcgctcctccctcaggctttctccctcagtcttggcttctccagggctctggggtgtctggagctaggcttggccctaccattctggggccatttccaccacagttggggctctcctgccttcacgcgtgggtgtctgctacttccccatctttaaaatgctgccagagcgattgcggcccctcaccttgtccacgtatcaggaatgtgaatgtgggacctttcctccatccctgttgtccggagccagctcactgtcttccacactggtgctaactggcccaggcactggagtggaatagaatgcagctggaggctacgcatggcctctgcagcacacgcagctggagagggcttctgtccctgtcagcggcagagggcgttggggctggccggggcaccttgtccctgctatggtccacgtgctcacgctgtccacctgccaggtggagtgtatgtggctgtggccctccctcgtggaggtgccgtgctttaaagaggccttagtgcccgggatgggcacagtgttttgaagggaggtgggagctcttgctctcctggtcactgcagaatgacagagaaggtgaagctccatgcatgtgtgcgcgggtgtatgtgcgctcagggtctctgtttaagtatcagctaaagatgtgcttcctccgtgtctgtcatacactgagaccaacaggctacagtgtccctgattcttggaaaagcctggagaagctggggagatgcggttcacaatgcctcggtataggaggctgtgttgagctgacattcaaatggattctttaataataatgaaactggcgagtatttattgtgca

SEQ ID NO: 2448 - DNA, 1838 bp, Homo sapiens
atctgagggaggcaggggaatgagccaggctggagctgagccagcagggcagggcccccctgctgcgacagtggcatcctgatagtgagatgctcagatgctgctgccctctagtggccgccagttccctgcaactcagaccacgtgatttctgggaaaaggccctccctggaggagaactgaaacttagggtggggactgtagaaaggggcggagagatcagccgcccagccaggagttaagctgaggtcgtctgagccctgcgacagcctggacagcaactcaggatggcatcaggcagggcacgctgcacccgaaaactccggaactgggtggtggagcaagtggagagtgggcagtttcccggagtgtgctgggatgatacagctaagaccatgttccggattccctggaaacatgcaggcaagcaggacttccgggaggaccaggatgctgccttcttcaaggcctgggcaatatttaagggaaagtataaggagggggacacaggaggtccagctgtctggaagactcgcctgcgctgtgcactcaacaagagttctgaatttaaggaggttcctgagaggggccgcatggatgttgctgagccctacaaggtgtatcagttgctgccaccaggaatcgtctctggccagccagggactcagaaagtaccatcaaagcgacagcacagttctgtgtcctctgagaggaaggaggaagaggatgccatgcagaactgcacactcagtccctctgtgctccaggactccctcaataatgaggaggagggggccagtgggggagcagtccattcagacattgggagcagcagcagcagcagcagccctgagccacaggaagttacagacacaactgaggccccctttcaaggggatcagaggtccctggagtttctgcttcctccagagccagactactcactgctgctcaccttcatctacaacgggcgcgtggtgggcgaggcccaggtgcaaagcctggattgccgccttgtggctgagccctcaggctctgagagcagcatggagcaggtgctgttccccaagcctggcccactggagcccacgcagcgcctgctgagccagcttgagaggggcatcctagtggccagcaacccccgaggcctcttcgtgcagcgcctttgccccatccccatctcctggaatgcaccccaggctccacctgggccaggcccgcatctgctgcccagcaacgagtgcgtggagctcttcagaaccgcctacttctgcagagacttggtcaggtactttcagggcctgggccccccaccgaagttccaggtaacactgaatttctgggaagagagccatggctccagccatactccacagaatcttatcacagtgaagatggagcaggcctttgcccgatacttgctggagcagactccagagcagcaggcagccattctgtccctggtgtagagcctgggggacccatcttccacctcacctctttgttcttcctgtctcctttgaagtagactcattcttcacacgattgacctgtcctctttgtgataattctcagtagttgtccgtgataatcgtgtcctgaaaatcctcgcacacactggctggtggagaactcaaggctaattttttatccttttttttttttaattttgagatatacgccctctttcatctgtaagggactaggaaattccaaatggtgtgaacccagggggcctttccctcttccctgacctcccaactctaaagccaagcactttatattttcctcttagatattcactaaggacttaaaataaaattttattgaaagaggaa

SEQ ID NO: 2449 - DNA, 2592 bp, Homo sapiens
ccttctcttctggtaggactcaagagtagccttcctcgaggacctgcctttcccatttgctgcctgaagttaatgtttcttgctggccaaatcagggacatgccggcattagcgggatgagtgggtgttccggcagggatgtggtcattgacggccagtgagggcgagagtaccacggcccacttcttccttggagctggagatgaggggctgggcacccgtggaataggcatgaggccagaagagagtgacagcgagctccttgaggatgaggaggatgaagtgcctcctgaacctcagatcattgttggcatctgtgccatgaccaagaaatccaagtccaagccaatgactcaaatcctagagcgactctgcagatttgactacctgactgttgtcattctgggagaagatgtaatccttaatgaacctgtggaaaactggccatcctgccactgcctcatctctttccactccaaaggctttcctctggacaaagctgttgcttactccaagcttcgaaacccctttcttatcaatgatctggccatgcagtattacatccaagataggagggaggtgtaccggatcctgcaggaagagggtattgatctgcctcgatatgctgtgctcaaccgtgatcctgcccggcctgaggaatgcaacctgatagaaggtgaagaccaagtagaggtcaatggagctgtctttcccaagccctttgtggagaagccagtgagtgcagaagaccacaatgtttacatctactaccccagctcagctggaggaggaagccagcgtctctttcgtaagattggcagccgaagcagtgtttactctcctgagagcagcgtccgaaagacggggtcgtacatctatgaggagtttatgccaacagatggcacagatgtcaaggtgtatacagtggggccagattatgcccatgctgaagctagaaaatctccagctttggatgggaaggttgaacgagacagtgaggggaaagagattcaatatccagtcatgctgactgccatggaaaagctggtggccaggaaagtctgcgtagctttcaagcaaacagtttgtggatttgaccttcttcgtgccaatggtcattcctttgtgtgtgatgtcaatggctttagttttgtcaagaactcgatgaaatactacgatgactgtgccaagattctggggaacaccataatgcgggagcttgccccacagttccagattccatggtccatccccacggaggctgaggacattcccattgttcccaccacatctggcactatgatggaacttcgttgtgtcattgcaattattcgtcatggggatcgtactcccaagcagaagatgaagatggaagtgaaacacccaaggttttttgctctgtttgaaaaacatggtggctacaagacagggaaattaaaactcaagcgacctgagcagctccaggaggtgctggatatcacaaggctgttgttggctgaactggagaaagaaccaggtggtgagatcgaggagaagactggaaaactagagcagctgaagtctgtactggagatgtatggtcacttctcaggtataaaccggaaggtacaattgacttactaccctcatggagtaaaagcttctaatgaggggcaagatccacagagggaaactctggccccatctctgttgctggtactgaagtggggtggagaactgactcctgctggccgtgttcaggctgaggagctggggcgagcttttcgctgcatgtaccctggaggacagggtgactatgctggcttccctggttgtgggctgcttcgtctccatagcactttccgccacgatctcaagatctatgcctctgatgagggtcgtgttcagatgactgctgctgccttcgccaagggccttctggctctagaaggggagctgacacccattttggtgcaaatggtgaagagtgccaacatgaatgggctactggacagcgatggggattccttgagcagctgccagcaccgggtgaaggctcggctgcaccatattctacagcaggatgcgccctttggccctgaggactacgatcagctggctcccaccagaagtacttccctgctcaactccatgactatcatccagaatcctgtgaaggtctgtgatcaggtatttgccctgatcgaaaacctcacccaccagatccgggaacgaatgcaggaccccaggtctgtagacctgcagctctaccacagtgagacactagagctaatgctacagcgttggagcaagctggagcgtgactttcgacagaagagtgggcgctatgatatcagtaagatccctgacatctatgactgtgtcaagtatgatgtgcagcacaatgggagtctgggacttcaaggcacagcagagttgctccgtctctctaaggcactggctgatgtggtcattccccaggagtacgggatcagtcgggaggagaaactggaaattgctgtgggcttctgtcttccactgttgcggaagatactacttgacctgcagagaacccacgaggatgagtctgtcaacaagctgcatcccctgtga

SEQ ID NO: 2450 - DNA, 788 bp, Homo sapiens
aacctcacgaggccttacgtgcctagagcggttcctctccgtggcgccctaccgccttcggcgcgaaggtggctggtgcgtaccgtcccgaaccctaggagccgagatcccacccgcaggaccccaaaacccaatgatcctgcagcagcccttgcagcgaggcccccagggaggggcccagcgcctcccgcgggccgccttgggggtgacttggggcctggacgccagctcccctctccgaggagctgtgcccatgagcaccaagcggcgcctggaggaggagcaggagcctctgcgcaagcagtttctgtctgaggagaacatggccacccacttctctcaactcagcctgcacaatgaccacccctactgcagcccccccatgaccttctccccagccctgcccccactcaggagcccttgctctgagctgcttctctggcgctatcctggcagcctcatccctgaggccctccgtctgctgaggctgggggacacccccagtcccccctaccctgcaaccccagctggggacataatggagctctgagtgctggtggacagtgcccctcccaccttccttcttccccacaacagaagagaccagcgactcccgcaaagggacaaggttcctccctctcctgcagagtaggcatctgggcaccaagaccttccctcaacagaggacactgagcccaacggagttctgggatgggaggggtgggagcatgggaagggaggcatcccacccccaagaagaactgaataaagattgctgagcaaaggaa

SEQ ID NO: 2451 - DNA, 5644 bp, Homo sapiens
tccggcgggactcaagagtagccttcctcgaggacctgcctttcccatttgctgcctgaagttaatgtttcttgctggccaaatcagggacatgccggcattagcgggatgagtgggtgttccggcagggatgtggtcattgacggccagtgagggcgagagtaccacggcccacttcttccttggagctggagatgaggggctgggcacccgtggaataggcatgaggccagaagagagtgacagcgagctccttgaggatgaggaggatgaagtgcctcctgaacctcagatcattgttggcatctgtgccatgaccaagaaatccaagtccaagccaatgactcaaatcctagagcgactctgcagatttgactacctgactgttgtcattctgggagaagatgtaatccttaatgaacctgtggaaaactggccatcctgccactgcctcatctctttccactccaaaggctttcctctggacaaagctgttgcttactccaagcttcgaaacccctttcttatcaatgatctggccatgcagtattacatccaagataggagggaggtgtaccggatcctgcaggaagagggtattgatctgcctcgatatgctgtgctcaaccgtgatcctgcccggcctgaggaatgcaacctgatagaaggtgaagaccaagtagaggtcaatggagctgtctttcccaagccctttgtggagaagccagtgagtgcagaagaccacaatgtttacatctactaccccagctcagctggaggaggaagccagcgtctctttcgtaagattggcagccgaagcagtgtttactctcctgagagcagcgtccgaaagacggggtcgtacatctatgaggagtttatgccaacagatggcacagatgtcaaggtgtatacagtggggccagattatgcccatgctgaagctagaaaatctccagctttggatgggaaggttgaacgagacagtgaggggaaagagattcgatatccagtcatgctgactgccatggaaaagctggtggccaggaaagtctgcgtagctttcaagcaaacagtttgtggatttgaccttcttcgtgccaatggtcattcctttgtgtgtgatgtcaatggctttagttttgtcaagaactcgatgaaatactacgatgactgtgccaagattctggggaacaccataatgcgggagcttgccccacagttccagattccatggtccatccccacggaggctgaggacattcccattgttcccaccacatctggcactatgatggaacttcgttgtgtcattgcaattattcgtcatggggatcgtactcccaagcagaagatgaagatggaagtgaaacacccaaggttttttgctctgtttgaaaaacatggtggctacaagacagggaaattaaaactcaagcgacctgagcagctccaggaggtgctggatatcacaaggctgttgttggctgaactggagaaagaaccaggtggtgagatcgaggagaagactggaaaactagagcagctgaagtctgtactggagatgtatggtcacttctcaggtataaaccggaaggtacaattgacttactaccctcatggagtaaaagcttctaatgaggggcaagatccacagagggaaactctggccccatctctgttgctggtactgaagtggggtggagaactgactcctgctggccgtgttcaggctgaggagctggggcgagcttttcgctgcatgtaccctggaggacagggtgactatgctggcttccctggttgtgggctgcttcgtctccatagcactttccgccacgatctcaagatctatgcctctgatgagggtcgtgttcagatgactgctgctgccttcgccaagggccttctggctctagaaggggagctgacacccattttggtgcaaatggtgaagagtgccaacatgaatgggctactggacagcgatggggattccttgagcagctgccagcaccgggtgaaggctcggctgcaccatattctacagcaggatgcgccctttggccctgaggactacgatcagctggctcccaccagaagtacttccctgctcaactccatgactatcatccagaatcctgtgaaggtctgtgatcaggtatttgccctgatcgaaaacctcacccaccagatccgggaacgaatgcaggaccccaggtctgtagacctgcagctctaccacagtgagacactagagctaatgctacagcgttggagcaagctggagcgtgactttcgacagaagagtgggcgctatgatatcagtaagatccctgacatctatgactgtgtcaagtatgatgtgcagcacaatgggagtctgggacttcaaggcacagcagagttgctccgtctctctaaggcactggctgatgtggtcattccccaggagtacgggatcagtcgggaggagaaactggaaattgctgtgggcttctgtcttccactgttgcggaagatactacttgacctgcagagaacccacgaggatgagtctgtcaacaagctgcatcccctctgttatctcaggtactcccgaggcgtgctctccccaggtcgccacgttcgaacgcgtctctatttcaccagtgagagccatgtccactccctgctcagtgtcttccgttatggaggacttcttgatgagacccaggatgcacaatggcagcgagctttggattatcttagtgccatctcagagcttaactacatgacccagattgtcatcatgctttatgaggacaacacacaggatcccttatcagaggaacggttccatgtggagctacacttcagccccggagtgaaaggtgttgaggaagaaggcagtgccccggctggctgtggattccgtccagcctcttctgagaatgaggagatgaaaaccaaccaaggcagtatggagaacctgtgtccaggaaaggcatcagatgaaccagaccgggcattgcagacttcaccccagcctcctgagggccctggccttccgaggagatcacccctcattcgtaaccgaaaagctggttccatggaggtactttctgagacttcatcctcgaggcctggtggctaccggctcttttcatcttcacggccacccacagaaatgaagcagagtggcctaggctcacagtgcacagggctgttcagcaccacagtgctgggtggctcctccagtgccccgaatcttcaggactacgcccgcagccatggcaaaaagctaccacctgccagtctgaagcaccgagatgagctcttgtttgtcccggccgtaaaacgattttctgtgtcgtttgcaaagcatccgactaacgggtttgaagggtgttccatggtgcctaccatctaccctctggaaacactgcataatgccctttccctacgtcaagtgagtgaattcttgagtagagtctgccagcgccacactgatgcccaggcacaggcatctgcagccctctttgattccatgcacagcagccaggcctcagataacccattttctccaccacgtactcttcattcacctcccctgcaactccagcagcgctctgagaagcccccttggtacagcagtggcccttctagcactgtgtccagtgctggtccttcttcccctactacagtagatggtaactcccaatttggcttcagtgatcaaccctccctaaattcacacgtggctgaagaacatcaaggccttgggctgctccaggagacccctgggagtggagcacaagagctctccatagaaggggagcaagagctttttgaaccaaatcagtccccacaggtgccacctatggaaaccagccagccatacgaggaggtcagccagccatgtcaggaggtccctgacatcagccagccatgccaggacatttctgaggcgctcagccagccatgtcagaaggtccctgacatcagccagcaatgccaggagaaccatgacaatggtaaccacacatgccaggaggtccctcacatcagccagccatgccagaagtccagccaactgtgccagaaagtctctgaggaagtttgccagctatgtctggagaactccgaggaggtcagccagccatgccagggggtctctgtggaggttggcaagctggtccataagttccatgtaggggttggtagcttggtccaggaaacccttgtagaagttggcagcccagctgaagagatccctgaggaggtcatccagccataccaggagttctctgtggaggttggcaggctggcccaggagacttctgcgatcaatctgttatctcagggcatccctgagattgataaaccatcccaagagttccctgaggagattgatctgcaggcccaggaggtccctgaggagataaattagaagtcctgggtggtccctgaagtgattgatcagctgcctggagagggtattcctcaagcccagcatccatctggtgatccaaaccctcagagccagtctctagcccatgaccagcactcaccccttccaccagcaacatgtgattaattttctcattagtggtatcacactataccagccatttgagccagcaaccttttctgttggctaactcactggccagctctcaccagcggtgtctggggaagtagttctctttgtatgaagcatacctgtgccagagctgtggttgaggaggagccagttttaggttcgaagaagccattggctcctcacttagccattagacttgaataggatttccttggggtgggttggtctgtcattacccagccttctctgagcatcctaggaaatcacagattgttaaaggaaatgccgcttcactgctgaagacaccatctggcgacagcaaatgcaaaagaggggactctagggtcttcacttttctggggaaatgttcacgacttctcaaggtacgcttagaccatatgtgcattcaggggactcttgtctttgccagcactcctcaggtgagcccgggatggctatctgaaatgtctggaaaatagagtcccttccccaaacatctgacatggccactaaatctttagacttgccttatagatccttccatatcatccccaagtgccccttctgcctcagtcctgttcctctgggcaatagctctagggaaaagtaggtattagactgctgtgcaaaattcagagcaactacttaaaatgctctagaggattcttagccagtctgtgaaagtgggcctcctctgtggtggggctgtttggcttaggagatgctgtagtagtagagataatcaggttctattttaagcaatcagcagagatcaatattgtacagatacaagcaaaggtttaataaatatatatatatatatttatttctgtagttgtgccagggacagactggccaaagaccaaacactgcagggtccccaagaaatttgtccttatatcattgtgtctgagggccagatatgattatgaagctttttccaaagatccagggatgggaatgggagtgggtaggaggggtaatgcggtcattggagtcgggggctggaacattatgagtgctcaataaatataaactaatgagaatggtggtgatgga

SEQ ID NO: 2452 - DNA, 928 bp, Homo sapiens
cttttccaagcggctgccgaagatggcggaggtgcaggtcctggtgcttgatggtcgaggccatctcctgggccgcctggcggccatcgtggctaaacaggtactgctgggccggaaggtggtggtcgtacgctgtgaaggcatcaacatttctggcaatttctacagaaacaagttgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccgtctcaaggtgtttgacggcatcccaccgccctacggaaacaggccgagaagaacgtggagaagaaaattgacaaatacacagaggtcctcaagacccacggactcctggtctgagcccaataaagactgttaattcctcatgcgttgcctgcccttcctccattgttgccctggaatgtacgggacccaggggcagcagcagtccaggtgccacaggcagccctgggacataggaagctgggagcaaggaaagggtcttagtcactgcctcccgaagttgcttgaaagcactcggagaattgtgcaggtgtcatttatctatgaccaataggaagagcaaccagttactatgagtgaaagggagccagaagactgattggagggccctatcttgtgagtggggcatctgttggactttccacctggtcatatactctgcagctgttagaatgtgcaagcacttggggacagcatgagcttgctgttgtacacagggtatttctagaagcagaaatagactgggaagatgcacaaccaaggggttacaggcatcgcccatgctcctcacctgtattttgtaatcagaaataaattgcttttaaag

SEQ ID NO: 2453 - DNA, 1734 bp, Homo sapiens
gcgctgcctacggaggtggcagccatctccttctcggtaagtgttaatccgtggcaatccgcattcctgcgggattcatctggccccgtcgcccagtggtgcggaggcctccccttcagcgcggtagtgtctgtgggtattgttattgtcagcttactggagcgtgtacaggaacagaacgaagccgccgagttgatagggctttgcgtcccagagcctcctgccctccgcctgtattcagagctgcgggctgcttgtttgttccttggcggtggagggtgctagttgaggccagacttcggggtctcctgggggccgtgggacgaccaggggtggcccagcttgacagctttcagctgggatctgtggatcccagcgctcaccaatgtcggcccacgtgtattcgttcatgccatggccggcttcttccgctgcagtctctggcccgagggctgctgctgcgggaccgccaaggaaagacgagctgtaggtcggctggtccagctgcaggcagaaattctggtagtatctctgggaatatgaagatgcaactgcccccaccttgccttcgaggatatcatgggccagaaggcagagtcgttttgaatacgtggttcattgagtacccactctgggccagttgatggctgcgaagagagcagaaggggtgctgctgtaggaaatcaatggctcggaagaccacactgaggaaggtgtgagttgatactggaagatctccaggtttgaggcatcttcagaggtatatggtggttttgtgtgtgttgagggtgtggtagcgcagcagctccctagggaattagaaggttttattgaacatttaccctgtgacaggcactgcaggcattcagcgcgcagtgtcatcttcattttacaggtgaggaaaagactcaggttcaagtagatggtcaaggccagtactaccggaaggaccatctgggggttcggacactggtggggtgggatttgctgccccttgcaaattgagagtgtcttggggtcagttttgatttgctcagctgttggcattctttgggctctgagtgggtgaggtgacccttgacctcctgggatcgcatctggagagtgcctagtattctgccagcttcggaaagggagggaaagcaagcctggcagaggcacccattccattcccagcttgctccgtagctggcgattggaagacactctgcgacagtgttcagtccctgggcaggaaagcctccttccaggattcttcctcacctggggccgcttcttccccaaaaggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaat

SEQ ID NO: 2454 - DNA, 1749 bp, Homo sapiens
aggggttacgacccatcagcccttgcgcgccaccgtcccttctctcttcctcggcgctgcctacggaggtggcagccatctccttctcgctggcgattggaagacactctgcgacagtgttcagtccctgggcaggaaagcctccttccaggattcttcctcacctggggccgcttcttccccaaaaggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgccatctggcatcttccttccttgattttaagtcttcagcttcttggccaacttagtttgccacagagattgttcttttgcttaagcccctttggaatctcccatttggaggggatttgtaaaggacactcagtccttgaacaggggaatgtggcctcaagtgcacagactagccttagtcatctccagttgaggctgggtatgaggggtacagacttggccctcacaccaggtaggttctgagacacttgaagaagcttgtggctcccaagccacaagtagtcattcttagccttgcttttgtaaagttaggtgacaagttattccatgtgatgcttgtgagaattgagaaaatatgcatggaaatatccagatgaatttcttacacagattcttacgggatgcctaaattgcatcctgtaacttctgtccaaaaagaacaggatgatgtacaaattgctcttccaggtaatccaccacggttaactggaaaagcactttcagtctcctataaccctcccaccagctgctgcttcaggtataatgttacagcagtttgccaaggcggggacctaactggtgacaattgagcctcttgactggtactcagaatttagtgacacgtggtcctgattttttttggagacggggtcttgctctcacccaggctgggagtgcagtggcacactgactacagccttgacctccccaggctcaggtgatcttcccacctcagccttccaagtagctgggactacagatgcacacctccaaacctgggtagtttttgaagtttttttgtagaggtggtctagccatgttgcctaggctcccgaactcctgagctcaagcaatcctgcttcagcctcccaaagtactgggattacaggcatcttctgtagtatataggtcatgagggatatgggatgtggtacttatgagacagaaatgcttacaggatgtttttctgtaaccatcctggtcaacttagcagaaatgctgcgctgggtataataaagcttttctacttctagtctagacaggaatcttacagattgtctcctgttcaaaacctagtcataaatatttataatgcaaactggtc

SEQ ID NO: 2455 - DNA, 803 bp, Homo sapiens
tggaaatctaaagggaatggtgaagttgcaccgtaaggggaaggtgactgaggagctgaaactgactgaggggctgaagcatttcggacaggagaaaggatcaggaggagacagagcggagaatggagcctcagggctacccagcgtttggctgggatcactcgcttcacaaaaggaaaagacttcctcctgtgaagagatccttagtatactacttgaagaaccgggaagtcaggctacagaatgaaaccagctactctcgagtgttgcatggttatgcagcacagcaacttcccagtctcctgaaggagagagagtttcaccttgggacccttaataaagtgtttgcatctcagtggttgaatcataggcaagtggtgtgtggcacaaaatgcaacacgctatttgtcgtagatgtccagacaagccagatcaccaagatccccattctgaaagaccgggagcctggaggtgtgacccagcagggctgtggtatccatgccatcgagctgaatccttctagaacactgctagccactggaggagacaaccccaacagtcttgccatctatcgactacctacgctggatcctgtgtgtgtaggagatgatggacacaaggactggatcttttccatcgcatggatcagcgacactatggcagtgtctggctcacgtgatggttctatgggactctgggaggtgacagatgatgttttgaccaaaagtgatgcgagacacaatgtgtcacgggtccctgtgtatgcacacatcactcacaaggccttaaaggacatccccaaa

SEQ ID NO: 2456 - DNA, 1552 bp, Homo sapiens
atgaccaggctggggacagttcccaggaaggccttggagatgagctgtgccatccagaatcagctggcccgcatcctggccgagtttgagatgaccctggagagggacgtcctgcagccactcagcaggctgagtgaggaggagctgccagccatcctcaaacacaagaaaagcctccagaagctcgtgtccgactggaacacactcaagagcaggctcagtcaggcaaccaagaattcaggcagcagtcaaggcctaggaggcagcccgggtagtcacagccatacgaccatggccaacaaggtggagacgctgaaggaggaggaggaggagctgaagaggaaagtggagcaatgcagggacgagtacttggctgacctgtaccactttgttaccaaggaggactcctatgccaactacttcattcgtctcctggagattcaggccgattaccatcgcaggtcactgagctcgctggacacagccctggctgagctgagggagaaccacggccaagcagaccactccccttcgatgacagccacccacttccccagggtgtatggggtgtcgctggcaacccacctgcaagagctgggccgggagattgccctgcccatcgaggcctgcgtcatgatgctgctttctgagggcatgaaggaagagggtctcttccgtctggctgctggggcctcggtgctgaagcgtctcaagcagacaatggcctcggacccccacagcctggaggagttctgctccgacccgcacgctgtggcaggtgccctcaagtcctatctgcgggagctgccagagcctctgatgaccttcgacctctatgatgactggatgagggcagccagcctgaaggagccaggggcccggctgcaggccctccaagaggtgtgcagccgcctaccccccgagaacctcagcaacctcaggtacctgatgaagttcctggcacggctggccgaggagcaggaggtgaacaagatgacacccagcaacatcgccatagtcctgggacccaacttgctgtggccacctgagaaagaaggggaccaggcccagctggatgcagcctccgtgtcttccatccaggtggtgggcgtcgtcgaggcgctgatccagagcgcagacaccctcttccctggagacatcaacttcaacgtgtcaggcctcttctcagctgttaccctccaggacacagtcagtgacaggctggcctctgaggaacttccgtccactgccgtgcccaccccagccaccaccccggctccggctccggctccagctccagctccggccccagccttggcttcagcagctaccaaggaaaggacagagtctgaggtgcctcccagaccagcctcccccaaggtcaccaggagtcccccggagacagctgccccagtggaggacatggctcggaggagtcctaggggagccaccggaaggaaggagaggtttgcctgctcctacgggactgattcttctcttgccgacatgttttttgtaaggctggtaaataaattattttggacaaaactgg

SEQ ID NO: 2457 - DNA, 2010 bp, Homo sapiens
ggcccgcgggactcagaccagcggggagcgcggcctccgcccttggggccctcccgccgggccggagacccaagcccccaacgccaggccctgccctggaagcgctcgcggcccggcgcctggacgggggagttgctgctctttggcgtaaattgcaatcgattagggatcgtttctcagaatcaagttagaagtgagagttcagataagtgaggccgccattgctgctttgaacacctcagaaggggagaatggatttatcaggagtgaaaaagaagagcttgctaggagtcaaagaaaataataaaaagtccagcactagggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtctcggtccagctcgacttccagctcaggctccagcaccagcactggctcaagcagtggctccagctcttcctcagcatccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggaggacaaattgatggccaggagatcactgccaccgccgtgctggccccctggcctaggccaccccccaggagattcagccctcccaggagaatgttgccaccaccgcctatgtggcgcaggtctcccccacggatgaggagaaggtcccgctccccgaggcgcaggtcccccgtgcgccggagatcacggtccccgggccgccgccgccacaggagccgctccagctccaactcctcccgataaacaggccactgaagctctcgcccctgtaacttataccccacccagctcagttttgtcacttttctagccaaaggaagaccagtaggaaagcaaacccttgactctggcaggatttgcaggcagcaggcagcacccctctgccagccgggccccggctgcagaagtgctgttggtttggatgctgtgtgcctgtcaagattccctccggttttctggctagaaagctcatccgtttccggtttctaagagtcagttcagtggcagagccaccagggaaaagtgaggctcttgggggtggtttgaccctgcttacctgggagcacacttttcccttccccgatgacctgggatggtggccaggccgtgcccttgctgttgctgggcagtgtccttttggaaagggagctgccccaggctttagtgcagctgccaaccctgttaggcctggcctctcgaggcctcttctgacctcaagggtcacaccccctcaaagatcctctcacccatggtagttgctgctcgtggttctgtctgtccgtgcaccgatgcacacaccgcaccccaccactgtactctgaaattggcgagtgagtggagagccagctctgcggagtcatcacgcagccatggttgtgcctgccgttcatggtggtctttcaggttatcttggcaacatgtacattgcttttattttttttcttttttgctttcattgtacagtcagtactataaaatttctcttttgagttttatacctttgtagcattttagatgacattgtgtttgtactttgttgtgtagagtggaagaattgtgttgaataaacccaagatcggaatgc

SEQ ID NO: 2458 - DNA, 1467 bp, Homo sapiens
tggtactgaggaggcctagcagggtgaaggccacggtcgcggccttcacgggttcctcggccgtcctgagtcccaaatcccaagctggagccgttcagctcccctccaccgcttagagatttggggggctctggccccgtccttgcggaccattccgaggggagtccagaggtgtcagtaattaacactgtggatacctcccatgaggacatgattcacgacgcccagatggactactatggcacccgcctggcaacctgctcatcagacaggtccgtcaaaatctttgatgtgcgcaatggagggcagatccttatcgccgacctcaggggtcatgagggtcctgtgtggcaagtggcctgggctcaccccatgtacggcaacatcctggcatcgtgctcctatgaccggaaagtcattatctggagagaggaaaacggcacctgggagaagagccacgagcatgcgggacacgactcctcagtgaactcggtgtgctgggccccccatgactacggcctgatcctggcctgtgggagctcggatggggccatctccctgctgacttacaccggggaaggccaatgggaagtaaagaagatcaacaacgctcacaccattggctgcaatgccgtcagctgggcccctgctgttgtacctggaagcctcatagaccacccatcggggcagaaacccaattacatcaagaggtttgcatcaggtggctgtgacaacctcatcaagctgtggaaggaggaggaggacggccagtggaaggaggagcagaagctagaagcgcacagtgactgggttcgagatgtggcctgggccccctccatcggcctgcccaccagcaccatcgccagctgctcccaggatggtcgtgtgttcatttggacctgtgatgatgcctcaagcaatacgtggtcccctaaattgttgcacaagttcaacgatgtggtgtggcatgtgagctggtccatcacagccaacatcctggctgtctctggtggagacaataaggtgaccctgtggaaggagtcagttgatgggcagtgggtgtgcatcagtgatgtcaacaagggccagggctccgtatcagcatcagtgacagagggccagcagaacgagcagtgacaagacaggtggggcctggctccccacccgccagctccaggactgccccttcctgggccaactaaccagacaactgggaagagcccccaactccaacaggattattttcccaggaggagttacagatgcagccacagattgatcatctgccttaacgtgatcggagatgctttgtaatctactgtccagctgaaagcactcatgttacgaggaagaaactacaagtgatgttcaaatctattttgggtcatttttatgtacctttgggttcaggcattatttggggggttttgtttccaaaggaactaaataaagtcatattgcttataa

SEQ ID NO: 2459 - DNA, 7122 bp, Homo sapiens
cgcgactggccttgagggagagctggggcctgctcccggagagatacggctatgtcgatcgaaatcgaatcttcggatgtgatccgccttattatgcagtacttgaaggagaacagtttacatcgggcgttagccaccttgcaggaggagactactgtgtctctgaatactgtggacagcattgagagttttgtggctgacattaacagtggccattgggatactgtgttgcaggctatacagtctctgaaattgccagacaaaaccctcattgacctctatgaacaggttgttctggaattgatagagctccgtgaattgggtgctgccaggtcacttttgagacagactgatcccatgatcatgttaaaacaaacacagccagagcgatatattcatctggagaaccttttggccaggtcttactttgatcctcgtgaggcatacccagatggaagtagcaaagaaaagagaagagcagcaattgcccaggccttagctggcgaagtcagtgtggtgcctccatctcgtctcatggcattgctgggacaggcactgaagtggcagcagcatcagggattgcttcctcctggtatgaccatagatttgtttcgaggcaaggcagctgtcaaagatgtggaagaagaaaagtttcctacacaactgagcaggcatattaagtttggtcagaaatcacatgtggagtgtgctcgattttctccagatggtcagtatttggtcactgggtctgttgatggattcattgaagtatggaactttactactggaaaaatcagaaaggatcttaagtaccaggcccaagataactttatgatgatggatgatgctgtcctctgcatgtgtttcagcagagatacagaaatgttagcaactggggcccaagatggaaaaatcaaggtgtggaagattcagagtggacaatgtttaaggagatttgagagggcacacagtaagggtgtcacctgtctaagcttttctaaggatagcagtcagatccttagtgcttcttttgaccagacaattagaattcatggtttaaaatctgggaaaaccctgaaggaatttcgtggccattcctcctttgttaacgaagcaacatttacacaagatggacattacattattagtgcatcctctgatggcactgtaaagatctggaatatgaagaccacagaatgttcaaatacctttaaatccctgggcagcaccgcagggacagatattaccgtcaacagtgtgattctacttcctaaaaaccctgagcactttgtggtgtgcaacagatcaaacacggtggtcatcatgaacatgcaggggcagattgtcagaagcttcagttctggtaaaagagaaggtggggactttgtttgctgtgccctctctccccgtggtgaatggatctactgtgtaggggaggactttgtgctctactgtttcagtacagtcactggcaaactggagagaactttgacagtgcacgagaaggatgtgattggtattgcacatcaccctcatcagaacctgattgctacctacagtgaagatggactcctaaagctctggaaaccataattcaacttttctttttaaatcagctcgaaagcatgtacttaaatgaagcatattcatgtaatgtgcttttttttttttttgccagcttttctaagcaaatagattgtctgaattagtcacagaataattttgtgaaaattcatgtttaagtagcaactaccctttctttttttatatatttttaaggtattagtttatcttcttctaactggtgcagtcacttaatgttttcattaatcttcgacctggagagtgaaatactgatatttctagaaaaaaattctactcctctgattatttgaaatgctgaggaaaatgtccctcccatagtaaaacttgtaaataaggaactatatcatattcagtagctgtgttctgttccatctttttttttttttttgagatggagttttgcttgttgcccaggctggagtgcagcggcacgatcttggttcactgcaacctccgcctcccaggttcaagcgattctcttgcctcagcctcccgagtagctggggactacaggtgtgcgacaccatgcctggctaatttttttgtatttttagtagagatggggtttcaccatgttggccaggctggtctcaaactcctgacctcaaaggatccacccgccttggcctcccaaagtgctgggatcacaggcgtgagccaccatgcccggcccatctttttttttttttttttttttaaagatgttaataaactttatacctttctggagactttgttctaaaatgtacataaatgctcatctagttaacatatttacttagaatgtgggaggaggagtcacattattatccctgaatctcaagtacagcagaagtgaattcctgggatagtaggatagactaacatgtaaaaaggccaggtgatgcataggttctcatttcactgccctcagccttcctctccttctgagctgtgccttctcacatgttcagtcaactccagggaatattgtctccatcttctggatagaactagttgcaggatccgttacaagaattcagagttttggcatctcccctttgtatgttgtaggagaaggtttggcattgaaaatgtgctgttgttccaaagaaaaattagcaaaggacttgagatttagaaaagtctcctttgtaatgtgcatcattaccagttatctaaagaaaaacatgtaaaagccaacaaaacccttgaaaatattttgcatatggatgtctgtttcacgtttcaactgaagatgtatagagcacctctgatgatgaggaagataccatgctaggcagtactttcaagaacgtgagttcttatttctgcaggccttttgtgcccccttttaaatgttagcatttattaggtacaaactagtggggaaggtttttttaaaaagttttgcagtcttgtaatttacctttttaaaaaatttattttatttttctgagatggagtcttgctctgttgcccaggctggagtgcagtggtgccatctcagctaactgcaacttccacttcccaggttcaagcgattctcctgccttagcctcccaagtagctgggactacaggcgcatgccagcatgcctggctaatttttgtatttttagtagagcgggggttttgccatgttggccaggctggtcttgaactcctgacctcaggtgatccgcctgccctggcctcccaaagtgctgggattacaggcatgagccactgcgcccagccttgtaatttacctttgatggtgacctgaaatgcagtatgatcctatatgtggcacgtagtaatgttcagtgtttgctgaattaattctgggcagcactaagaaatccctctttcccagtcatattctataacacatttcccatttgccacaaaacctgcagctttttggtccaggtaatgacatttgctgccattttgatgatttaaaaatggtcgtgggagttgaacatagtcatgaattcaggattcctgagcatgtagacagtcatcccagtggaaagacacgttcacttaagagaagtttaagttagaggaaacagtttatgctaaaaaaatttttagaaaagtccttgagaatttttgatttagtcttgacctcatgaagctggtagttatgatgtgcatagtttgtatcaccgtttatgaagatggagaatctagtcagcacgtgttggtttattctaggaatttttagggaacacttctgttgctggcaccaggtgatgaatatggttaaaaaaagactcgtttctgcctaaacatagggaagaagagcaaattaaaaggagtaattaaaactgataaaagctcaagttacctttgtgatgatgaggcgggcagttaacgcgaaagggttgggaaaggcttcctggagggactagggggcggtctaagcacagggaacctaaccggggactccagtgtggcacagcggcaaggtatgtgctgggcaaaatgataggtgtcttgggagaccaggcaaagagagctggattaggagccgttaagtatatatttttcttctttttaaataaaataatgcactgggtgaacatgtaaacgctaagttgaaaatctgcctttcccaggtaacccttgttaatctttctacaacttcatttcgtacaaacctgaaaaacacactgattttgtctttaaatgggcacacgctgcttacactcctcggcgcctagcctttctgaagccccacgcggccgtccctccagcattgaaggctggggcagcccagctcccctccagcgcccttacagccagaccgcggcggggtcgggccgcgcacgcgcagggcggacggccggatctggggcgccgctgctccgggtggtcggaggtaggagtcccatcttgggtccagggccggtagagccccttaccgggggtagggagactgcgcacccgctagagccaactgtcagggcctgcagacgtcgggtgacgtcactgttacaaaattggcggtcacatcgtcttaagggccggtggcagcggctgcgcgaacgggagttggctgccgggaatcagtgctcacttccttctgaattgggcgtgtgcagtcggttcctagggaagtgctctgctgcagccaccagatttaacggatgctgctctctagcacttaacatagaagctaaactacctggcgttaaaattaattccatgagcataaggacatttgtcctatcccctattctgctgttgaattaatgactggaaaacattgcgcggaggtatttgggagtagtatggctttttttttttttttttttttaacagcaaatggtataaatctcaggtacaattcagtatcttcttcaccagttgttttttttcagcatgtattattactaccactaacggcctctgttgagcccttccttgctatgtaagcagccatatttaattctcagaacaatgtaatgagggtgcgcaaatgcacatgaagaaacaggtttccagacgtgaggcacctaactcagtccaacttgcacgaagctcgcattgaaaaccagatgtgactccgaagctaggttttttttctctcttgcctcactctcaatattgctgtcagttcctcctcaatctttaggtttgggcagggacaaagaatacatggattgttcctccacatgctgcaaacacattcacctaagcagagcacaggtagtgagatgagtagagagaactgaattagaggattctggatgtcagtctttgctgtcacttcttttggcttgtgctagaacagtggttcttacaagtgtcacgtgatagacacattctaaggtcctatcccagacctacagaatcagaaattggtggtggggcccagcaagcgtgctcaaatttgagagcaggtagactacagggtagtttccgcatatacaaaaggtgttttaattcttgctgtcagtctcagaagtttcatgctgagataaccaaatttaaatgataaaggtgcaagactgactcttaaaatcacattttttcaaattgccatagcttgctagtgttctcattcactgtgcttttacagcttcattttccactattttaagagaagaaattgctatgaagtgtatgtccaagtgaggaagttccctggtctgaggttgtttaaaacttacaataggccgggcacggtggctcaagcctgtaatcccagcactttgggaggccgaggtgggtggatcacgaggtcaggagttcaagaccaccctggccaacatggtgacaccctgtctctactaaggatacaaaattagccgggcatggtggcacacgcctgtagtcccagctacctaggaggctgaggcaggagaatagctggaacccgggaggcagaggttgcagtgagctgagactgtgccactgcactccagcctgggtgacagagcaagacttggtctcaaaaacaaaaaacaaaaaaaccaaacttggaatagcaagggctgcccattatttaaccttccacggcaattttaacagtggtattctgttccaagtggttaatattaaatccatgtgtcagtgttggtggctttcaaccttggctgcgcataatcattttgatgcttaggctacacccagccgagttatacagaatccctggagggtgggacctgatgagtgttttaatgtttcccgggtaattccaatggtagccaaggttaagaaccagtaccgtacgtacaaaaaagttgagaagctaatttcacgtacagaaaatttgccactgttccaagagcactctcaagcgacataattggcctctactcctattccctacaagtatgaatgggcaggagaagcatcacagagaaagcagagttagtgctggaacttgtatttttgtggatgatgaccttggttaatgttttttcataggctctgtttcataggctttgttttttcataggctctccctcattacattgttctgagaattaaatatggctgcttacatagtaatgaagggttcaacagaggctgttagtggtagtaataatacaagctgaaaaactacacagacaaacctatcagtttctgcctcttcaggatataactattaggttagtgcaaaagtaattgcggtttttgccattaaaagtaatggcacattacttttgcaccaaccgacctaatatgactttcttttagtgttcttaggatttttaattgtaaaacatgtaacaaattttcctaaacaattgtgcaattcagtggcattatttacgatgttacgcaaccactattgtatttccaaaatgtcatcaccctaaacagaagccctgtaacattgtcaattaacttctccttcccttcccctcagcctttggtactgtttctgcctcaatgcatttgtctaagtttagttcatataagtgaaattatacaatacttgtccttttttatctggcttatttcatttagcatgttttaaaggttcatccatgtatcaaacagtaaagtgcttcatatttgggggaagtataaaaag

SEQ ID NO: 2460 - DNA, 4921 bp, Homo sapiens
attccgactttcccgccccgtacgtgaggggccgccttgaagcctcttccgccacggacactcgaaactgatcttgaagcccctgccgtcacggatactagaaactgatctcgaagccccttccgccacggacactcgaaactctcccccactgttagacctcagcagccagcagcccgccgcccggcgctgcagctccctgcccgcaggagccacgtctcgcgcgactccccccacctctcgcgacacttgccgcccgtgccctgcggccctgcacgccccacccgcggtcgcgcgccgcgctccccgccgcctcaccttttcgcctggcatccgggcccgctactcgcccactgggagcgccgtggcgcctggtgttcggcgcgagcccggcggggctgcaggttccgccctgctccgccgcgccccgcccgggctggggtaaaggccgcggccgggccatgcagtgtcctcctcagggagggcaggagagcctgaggagtggcggggccgccagagagcgaaatgtcatcagtgcagtcacaacaggagcagttgtcccagtcagatccatctccgtcaccaaactcatgtagttcctttgagctaatagacatggatgctggcagcttgtatgaaccagtttctccccattggttttattgtaagataatagattctaaggagacatggattcctttcaactctgaggattcacagcagctggaagaggcatatagctctggaaaaggttgtaatgggagagttgttcctactgatgggggcagatatgatgttcatttgggggagaggatgcggtatgctgtatactgggatgaactggcatcggaagtgagacgatgtacgtggttttacaagggggacaaagacaataagtatgttccctactcggagagcttcagccaagttttagaggaaacttacatgcttgctgtaactttggatgaatggaaaaagaaactggaatctcccaacagagaaattattattttacacaatccaaagcttatggtgcattaccagccagttgcagggtctgatgattggggttcaacacccacggagcagggtcgaccaagaactgtgaagagaggagttgagaacatctctgttgacattcattgtggagaacctttacaaatagatcacttggtttttgtagtccatgggattggaccagcttgtgatctccgctttcgaagcattgtacagtgtgttaatgattttcgcagtgtttccttgaacttgctacagacacattttaagaaagcccaagaaaatcagcagattgggagggtagaatttcttccagtcaactggcacagtcctttgcattctactggtgtggatgtagatctgcagcgaataaccctgcccagcattaaccgcctcaggcacttcaccaatgacacaattctggatgtcttcttctacaatagtcccacctactgtcagactattgtggacacagttgcttctgaaatgaaccgaatatacacactttttctacagaggaaccctgatttcaaagggggtgtatccattgctggtcatagtttaggttcgcttatattgtttgatatcctaacaaatcagaaagattctttgggggatattgacagtgaaaaggattcgctaaatattgtaatggatcaaggagatacacctacactagaggaagatttgaagaaacttcagctctctgaattctttgatatctttgagaaggagaaagtagataaggaagctctggctttatgtacagaccgagatcttcaggaaataggaattcctttaggaccaagaaagaagatattaaactatttcagcaccagaaaaaactcaatgggtattaagagaccagccccgcagcctgcttcaggggcaaacatccccaaagaatctgagttctgcagtagcagtaatactagaaatggtgactatctggatgttggcattgggcaggtgtctgtgaaatacccccggctcatctataaaccagagatattctttgcctttggatctcccattggaatgttccttactgtccgaggactaaaaagaattgatcccaactacagatttccaacgtgcaaaggtttcttcaatatttatcacccttttgatcctgtggcctataggattgaaccaatggtggtcccaggagtggaatttgagccaatgctgatcccacatcataaaggcaggaagcggatgcacttagaactgagagagggcttgaccaggatgagtatggaccttaagaacaacttgctaggttcgctgcggatggcctggaagtcttttaccagagctccataccctgccttacaagcttcagaaacaccagaagaaactgaagcagaacctgaatcaacttcagagaagcctagtgatgttaacacagaagagacctctgtggcagttaaagaagaagtcctgcctatcaatgtggggatgctgaatggaggccaacgcattgactatgtgctacaggagaagcctattgaaagttttaatgagtatttatttgctttacaaagccatctatgctactgggagtctgaagatacagtattgctcgtcctcaaagagatctaccaaacccagggtatcttccttgatcagcctttacagtaaaaatgacccatctatggctgcttaatacggacattgagggatccttccccagaaaatccacctgtttgttgctgcaattttcctctcctcagctgcgtcatttcctgcatgttgcctgccacttactcaccactggggtctttggaagataatcttcctctttggaaatgaatggaaaagcaaaaggccctattacttttaaccactggcttcatataaacacttgccatttttttctgcatagctgggggtggtttgtgtctttaattctttgatgatagtttatagttgccacactttattgattagtacttgacagggtgtaaagcctattttgggtttgatttgttttgggtggggtagacatgtttttaaggaacttattgcttatctttagaaaatgttctagtttggaaacagattcttgagattcagaaggcattttggagtacacttatctcttgtttgtgttgaactgaaggctaagtctcagtggacatggaaaagacttttgggtgatttatttttgaacctgcatttctttcttatgtgtagtgtatgaagaaagactagaatgtagctttaaaaaagtgttgtttactctcttagaactgacagacttattgccagaaatcactgatgttcattgtttttgcaactgtttgagctgctgtaagagtctaaagttgacaagttagttcatgttaggtgcatctttataaagcaaagatgttgtatatcctaggcctcccttttatatttgatagaagttatttgctaatagcttctattcttacgttgaaaatagttgtaaaagctgatgaacctgaaattgtgtagcctctacaggctgctgaggttctaaataaaaccttttagtggtgcctttatggtgaaacagaatttgtcacctgccatttctacttgagctaaggtagtattgtgtatcctctttccttcttaggtatccataatccacaaagcatatttaaaaggctcttggcacgggcagcattggttgagcaggtaggtttggctagggggaaatgtttaacttgttctgaaagaaaaacttatgtctgtagggtccaagaaacagctattccagagtcagtgtcagctgagtctggaacatatgaagtgaggtttacttctaagaacacaagtgactgcacactaattttgtcaaggcatcttttcactactttgctgtagatttttcttcttcattggtcagtttgtcattgtctttgtagttctctttatgataatcctttatacttgctctcagattccacaggcctctgtttatagagtggcaaaggcaggcgagctgtggtttattgtttataaatttttttataaatgttatggtattcaaagccactgacatttaatatttactgaagccattccttagacagcagtggtctttatccctttctggaaagaaaaggaaaatgaagggtaattactgtcaccatggagattgtagaggtaaggttggggtataggtcaggcctggcctttctttgtcatctgcttatagtctagtgctaagtatgccactaagtttcagatatatggaatactttatttttttaaaggtatataaactctgagttattgagaattaagtattcactgtatattaaggggaagcttttgccaagttgtggtcttcaaatttatgtttactcttcctattggcagaataggtgctatttaagagtaaaccaaaggataagcagagggagtccctataaccaaagatggacagcatagccctggatagccagataaaccactctttgtattaagaaatgtttctttcctagtggtgaggggtgggtaactgtgaaagagctttatatcttgtctattcatggtattatagctgtatattcccaggatgataagcttgattgaaatcctgtatttagtcatatattatttgcgctgcttcatttgtatcatgtgcaatctctagaccaaccctatttttaaactctggtacagcatcattttgtacatattcccagctgcagaactagtatcacttatctcagcaaaagagattgtttgcatggaaagattaatagcactgattagatttctaatattttgcatttttgaaatgtttgttttctacgtgattatatttaaaactttagtaaatactaacatgaaaccatattgactagtggcctacttttacctggactcacccgtctcaaagtcaagaaaatcagtacagtca

SEQ ID NO: 2461 - DNA, 9451 bp, Homo sapiens
gtgctgtggcggcggcggcggcggtagtggcggcggcggcggtgcctgggcggcagcagcagcagtagcggcagccctgaggacggtgagacggccgcggcggcggcgacagcgcggaagtcgcgcgggacccagagcttcccccctgtcgctagtgctgaggctttcgcctttcctacccagcttcttgctcacggcccgggctgggctgggcagggcaacgcgcccccggggaggggcggagctgtagatatggtgtaagatacttcttcaagattggacagctggggaccttcttctgattaaccttaaaccaacttgtagccatagagacacctcacaaggttcccatttttgttgttgttgttgttgattttctgctcacacctttcctgaccttgcaaccatgtatggaagtgcccgctctgttgggaaggtggagccgagcagccagagccctgggcgttcacccaggcttccacgttcccctcgcttgggtcaccgtcgaaccaacagtacgggagggagttcgggaagcagtgttggaggtggcagtgggaaaaccctttcaatggaaaatatacaatctttaaatgctgcctatgccacctctggccctatgtatctaagtgaccatgaaaatgtgggttcagaaacacctaaaagcaccatgacacttggccgttctgggggacgtctgccttacggtgttcggatgactgctatgggtagtagccccaatatagctagcagtggggttgctagtgacaccatagcatttggagagcatcacctccctcctgtgagtatggcatccactgtacctcactcccttcgtcaggcgagagataacacaatcatggatctgcagacacagctgaaggaagtattaagagaaaatgatctcttgcggaaggatgtggaagtaaaggagagcaaattgagttcttcaatgaatagcatcaagaccttctggagcccagagctgaagaaggaacgagccctgagaaaagatgaagcttccaaaatcaccatttggaaggaacagtacagagttgtacaggaggaaaaccagcacatgcagatgacaatccaggctctccaggatgaattgcggatccagagggacctgaatcagctgtttcagcaggatagtagcagcaggactggcgaaccttgtgtagcagagctgacagaggagaactttcagaggcttcatgctgagcatgagcggcaggccaaagagctgtttcttcttcgaaagacattggaggaaatggagctgcgtattgagactcaaaagcagaccctaaatgctcgggatgaatccattaagaagcttctggaaatgttgcagagcaaaggactttctgccaaggctaccgaggaagaccatgagagaacaagacgactggcagaggcagagatgcacgttcatcacctagaaagccttttggagcagaaggaaaaagagaacagtatgttgagagaggagatgcatcgaaggtttgagaatgctcctgattctgccaaaacaaaagctctgcaaactgttattgagatgaaggattcaaaaatttcctctatggagcgtgggcttcgagacctggaagaggaaattcagatgctgaaatcgaatggtgctttgagtactgaggaaagggaagaagaaatgaagcaaatggaagtgtatcggagccattctaaatttatgaaaaataaggtagaacaactgaaggaggaactaagttcgaaagaggctcaatgggaggagctgaaaaagaaagcggctggtcttcaggctgagattggccaggtgaaacaggagctgtccagaaaggacacagaactactcgccctgcagacaaagctagaaacactcacaaaccagttctcagatagtaaacagcacattgaagtgttgaaggagtccttgactgctaaggagcagagggctgccatcctgcagactgaggtggatgctctccgattgcgtttggaagagaaggaaaccatgttgaataaaaagacaaaacaaattcaggatatggctgaagagaaggggacacaagctggagagatacatgacctcaaggacatgttggatgtgaaggagcggaaggttaatgttcttcagaagaagattgaaaatcttcaagagcagcttagagacaaggaaaagcagatgagcagcttgaaagaacgggtcaaatccttgcaggctgacaccaccaacactgacactgccttgacaactttggaggaggcccttgcagagaaagagcggacaattgaacgcttaaaggagcagagggacagagatgagcgagagaagcaagaggaaattgataactacaaaaaagatcttaaagacttgaaggaaaaagtcagcctgttgcaaggcgacctttcagagaaagaggcttcacttttggatctgaaagagcatgcttcttctctggcatcctcaggactgaaaaaggactcacggcttaagacactagagattgctttggagcagaagaaggaggagtgtctgaaaatggaatcacaattgaaaaaggcacatgaggcagcattggaagccagagccagtccagagatgagtgaccgaatacagcacttggagagagagatcaccaggtacaaagatgaatctagcaaggcccaggcagaagttgatcgactcttagaaatcttgaaggaggtggaaaatgagaagaatgacaaagataagaagatagctgagttggaaaggcaagtgaaagaccagaataagaaggtagcaaatctgaagcacaaggaacaggtggaaaaaaagaagagtgcacaaatgttagaggaggcgcgacgacgggaggacaatctcaacgacagctctcagcagctacaggacagtctccgtaagaaggatgacaggattgaagagctggaagaagcactaagagaaagtgtacagataactgcagagcgggaaatggtgctagcacaagaggaatcagccaggaccaatgctgaaaaacaggtggaggagttactgatggccatggagaaggtaaagcaggaactagaatccatgaaagcaaagctgtcctccacccagcagtctctggcagaaaaggaaactcacttgactaatcttcgggcagagagaaggaaacacttagaggaagttctggagatgaagcaagaagctcttctggctgccattagtgaaaaagacgccaatatagctctcttggagctttcgtcctctaagaagaagacccaagaggaagtggctgccctgaagcgggagaaggatcgtctggtacagcagcttaagcagcagacgcaaaatcgaatgaagctaatggccgacaactacgaggatgaccacttcaaatcctcccattccaatcaaacaaatcacaagccctccccagaccagatcatccagcccctcttagaacttgaccaaaatagaagtaaattaaagttgtacattggacacctgacaaccctctgccatgaccgagaccccctgatcctccgtggactcactccaccagcttcctataacttggacgatgaccaggcggcttgggagaatgagctgcagaagatgacccgggggcagcttcaggatgagttagagaaaggtgaacgggacaatgcagaactgcaggagtttgccaacgccattcttcagcagatagcagaccattgtcccgacatcctagagcaagtggtcaacgccctggaagagtcctcttgaccctgctttatggggaagcctgaggtagtcaacccaggagccaagaaaagagaactacgaggaacaggtgcccggaaccttcttggcaccaaacactacaaacttcatcccaacttgctcacttgaagaagtgtgattccagcaccgtttctacatctgccatcttactctgcctttctgctttggatgtggtctctacactaaccttcttgatgtccagggtagataaagggtcgaatctctctgaagaactgccacctggtcatcagcagtggagaactgtgggagctggtggctctgccctgacagagagccatggagcagaggagcctctcacctcctgtcctctgacatgagaatgaaaccaggaatggacttggagttcaacaggctgagaggatgcctccaatggaccagagagctgagtgttctaatatcacaataggtgctttctcctaaaagggcaaaaaacaatctcaaaaagattagaaaaagagaaggggggaagggaagagaaaatcgactcttctttttactgtctcttctgcttactttccacatgagatgctttgtaccggggagctgtgagcaggcctcacgatggcttgggagcactcgttctcccaaggtctgagtcttcatccagccctgcctgtctgtcgcagccttcctcactctgttcctcggccagttaacaagaagatggtgtgaggtgttctccaccagtctctcctgtttgagactgttgacgttatcatactgaggtgttagatcaaatatctctaattgaagaacatgtgaggttgaaagagcaccagccagggcaacatagcgtgaccctgtctctacaaaaaattaaaaagagaacatacaaagttgacatatgagaccctgttgtccccgcctgcagctttgccccagtaacagatgcccgttgctcttgggctggtttcccctgaacacctccaagaggctgcctgccttgccagcacccgtgtcctgagctcctgcagcccagtggctgctgaagttgtgatccctcactcaccctgctagctttgcccttgactcgtcttctctgaacctcagcctcgtgcattgcctggaaccttcttctagcataaatgaaggtttttcctcctacacacattccttcctcggttatttcattcagagaatatttatgaaatgcctactgtgtgcaagtcatccatccttgaaaaggccacttctcagtgagggagagatgtagtggattctgtgagacatacctgctggagttgaagcagtaaatagcatgtccttcccctccccgatcttaaggtgtgttttctagaaaagttccctaatggaattcatgagtttgggggtctcagtcacccgcttgcctgtaggattccatttgatgattctggatttttgctgtttgttattgcccttagaggggctctgagtatctacttgtgggtggccatttcctgacatctgcatgtacctcgtggaattcagccagcttcatgttgcaaatcagaaagctgaccccaagactgcaaatcaatgaaggtattggcattgttaaggacgtagcgtagacaacagcagtcataaataattaggcaggaacttaacccaaatctagttctttgaccacctctaccaccagaacccagcagacactcacatctcctgataagagttgctggactcgatgtttttgttttgcattttctcctctccttccccacttactcagagaatttaaagtctgtagagtcagcacagccccatcagtccaggaacttcccaccaccagcccttgactgtcccattaactgacatggtcagatttccagctccccctactccctgctgtgaaacaatccctctccctgtgagaggaaactgtggagcgtttcttatcgaaggttaaatggactctgctcataaacctcttactgagatgcttcctgatagccaggctggccagagaggggtgcaggggttagatagtaagtggtggtcgtttgtggtcagttacctcaattctgttcattgcagtgcccgtaaaccatgtagaaagctcccagcactgaaaggcaggagtgttagcatctcgctttatccaccataacgtaaagaactgcggtgtgataacagccttcacggggccacggtggaaccaagacagcaggcgaggccatgcctaaacaagtggtctggcacgggcactggccagctgctctctccaagcaggtggcccagatcccacccacgtggactttctcatcaggtgcagcgcctgccactctcagccactgggtgtgtcactctcctcttcatctcagcattctccatcacttcccctccagaaaaacggatggaaggaagccctctgtgacactgcttctgagaagaagcatttccgggaccgatatcatctgtctggtctctgtgaacagcaaggaatcttcttgaccgttcttgggcactggaggctggctaggagttcagtaataaacgtggccttcgtgctgtagggcagagtggatgcagtttgtagctttcagagtgtctcattgagtctagatcattgaaccaacacttaaccaaatgtcccactcccatcacactaggacttgtcattccatgcccctctcctagtggtcatggtttcatatgggcatacaactgctactgaagttatatagccttgaaaactcagtgcaggttgcccttaattttccccaaacccctccatcggcaagtctagttgccctttagcacctaaagatctgcaccccaaaccaatgtcaccataaagagggcacgaagaagagtgggtgtgatcccaacggggttttgtaactgaagaagcccagtgtgagcttctcatcttttcatatacctctaacccccggtactcattgaatcattgatgaggtatctcaattgagatttgcaaggactttgataccatttgaaatggaaaaattttgaacgggctttaacatgtttaagaaatatggatggggccggccacagtggctcacgcctgtaatcccagaactctggaaggctgaggcaggcggatcacctgagatcaggagttcgaggccagcctggccaagatggcaaaaaccccgactctactaaaaatacaaaattagccaggcgtggtggcgtacgcctgtaatcccagctactcaggaggcaggagaatcgcttgagcctgggaggcagaggctgcggtgagccgagatcgtgtcactgcactccagcctgggtgacagagactccatttaaaaaaaaaaaaaaaaaatatatatatatatatatatatatatatatggatgggaatcaccaaattcatctcagctctaaccttttaacctttgtccttgcactttacaatctaaagatctacctgtggctctcagacttcctcacacttgggttttagaaataacttgtaaagcagactggacccaaggccgccttcagtgtcaagaagggcattgtgacttgcccctcaatttctgtccattgaagtctggttttccatgaggaacttgcgggctcacccacccccagagtgagagaagaggaaggcgaagtcatcacagacacggtcttagccacctgctgaactaatccctccgctattgagggtcagggttgtgaggcaaccatcatgtgtcaccccaaaatataaatgtttctgagccgcccatccactggcatttggatttgctgccagagtcctgttcctcccagaaccatcccgccctcctgttgaccatgttacttgagtgtaggcccggtgtcaagaccctcagagtctttgaggaaagagccaagcagagaagaccgctgcgtggagtgtgacaccacatggcatttctcaagcccagcggaccctgtgtcagcaaataccagtaatttaacatctgctcctggcctcctcttcacctgcctgggttcggaactgaggaggaaggatgagaagagactgcaatgcagcaggcaccctctgcagagtgaggccgcccgtccatcactgccagccctgggctgctcaggaggggacgtgaaccactcaaaggaatgtcttaaagaggatctggagtttcccccatgcaaattagggaagaattaggcaagaaaagacatacattacagggaaatccttctgaacaaaatggctgtcttcacctactcttcttgcaagaaaagacatacattacagggaaatccttctgaacaaaatggctatcttcacctactcttcagcaaaaaccgtctccagactttttagtgtcaaaaatgtaaccaactgtctcctgattttttccaatgtgtttggcaagtgctgtggccctgttgtaggtacttctcctgactcttgggggagaagtggttttagggattgatttgggggagcgggtttttgtcccatcccacctcctctcttctttctctgcttgtcgatattgtctgtgtgattcagagaattggggcagttacattgtgtctgttgttgagattattaaaagattaaaacgtagttgtagaaatgaaaaattaaacagctgtgttttaaaaatgcaaaccaatatcttgttaataaaggaattcaagctatggggcagccacactcccctcctcccaggctggcataggtggccctgggctggcggcttaggaagcatggagcacacttagggtagtgcctgcctgggcaagagacacctgccgagcaaaaggaacgagaatctggggctcagagcctcgcagttgtgccaggattttcctatacatgttcaggacctctgggtagaggtttcacagtttgtgaccccataaccaccctcacccgacgtgggttctagctcagtgtgcctaatactgcatggtaacctgggcttgaccctgaagcccctgcctggcaggccacaggacctctcctgcccacttggtgctatctcttccagtgaccacccagcacgggtgagcactggccagcctggagcctgcaatccaggtggaacagactgtcctccatgtcagttccttctggcttcaggccctcaattatttccctttgagcttttttagaccctagatctcctaggcccaggctctctcttgaccccagagaagccactgtcaggaaaggaagtgaaccctactgaagccagagaattcaccccggccaaagcaggccctctgggtccagcccctcattccacaccacgccagtattgcatccatctactgcagctacacatcctgagggcagcaccacccactctggcctgctggcccatcgcaggactagcccaggcacctgccgggcattgcaggatatccagtggggcctgtgactgctccctgatgcgtcagaagagaagtgttgcactttagtggaggagctgaggagcacctgcccccttgtagcttgagttccttttggtaacagtagcagcctccatggtggtgtctgggatgcacgtgcacccgctgccttcagctgtatgtgtgtgttcctgctggagttgtgttactgacaggataatgacattacaaagaaattgtgttatattcaactttgccttgataattattgtaaacactttgttcattttttcttttttattcacaaactaaatccaccaggaaattataaagttattt

SEQ ID NO: 2462 - DNA, 3061 bp, Homo sapiens
gccatgaacttccaggcgggcggggggcagagcccgcagcagcagcagagcctggcggctccggggggcggcggcgctgccgcgcagcagctcgtctgcggcgggcagttcggcggcgcggggcccggggccgggggcggcggcggcccctcgcagcagctggccggcgggcccccccagcagttcgcgctctccaactccgcggccatccgggccgagatccagcgcttcgagtccgtgcatcccaatatctacgccatctacgacctgatcgagcgcatcgaggatttggcgctgcagaaccagatccgggagcacgtcatctccatcgaggactcgtttgtgaacagccaggagtggacgctgagccgctccgtaccggagcttaaagtgggcatagtggggaacctgtctagcgggaagtcagccctggtgcaccgctatctgacggggacctatgtccaggaggagtcccctgaaggggggcggtttaagaaggagattgtggtggatggccagagttacctgctgctgatccgagatgaaggaggcccccctgagctccagtttgctgcctgggtggatgcagtggtgtttgtgttcagcctggaggatgaaatcagtttccagacggtgtacaactacttcctgcgtctctgcagcttccgcaacgccagcgaggtgcccatggtgcttgtgggcacgcaggatgccatcagcgctgcgaatccccgggttatcgacgacagcagagcccgcaagctctccacagatctgaagcggtgcacctactatgagacgtgcgcgacctacgggctcaatgtggagcgtgtcttccaggacgtggcccagaaggtagtggccttgcgaaagaagcagcaactggccatcgggccctgcaagtcactgcccaactcgcccagccactcggccgtgtccgccgcctccatcccggccgtgcacatcaaccaggccacgaatggcggcggcagcgccttcagcgactactcgtcctcagtcccctccacccccagcatcagccagcgggagctgcgcatcgagaccatcgctgcctcctccacccccacacccatccgaaagcagtccaagcggcgctccaacatcttcacgtctcggaagggtgctgacctggaccgggagaagaaggctgccgagtgcaaggtggacagcatcgggagcggccgcgccatccccatcaagcaggggatcctgctaaagcggagcggcaagtccctgaacaaggagtggaagaagaagtatgtgacgctctgtgacaacgggctgctcacctatcaccccagcctgcatgattacatgcagaacatccacggcaaggagattgacctgctgcggacaacggtgaaagtgccagggaagcgcctgccccgagccacacctgccacagccccgggcaccagcccccgtgccaacgggctgtccgtggagcggagtaacacacagctgggtgggggcacagccagtggcccagctgaggtactcagttccagccccaagctggatcctcccccatctccccactccaaccggaagaagcaccggaggaaaaagagcaccgggaccccccgaccagacggccccagcagtgctactgaagaggcagaggagtcgtttgaatttgtggtggtgtccctcactgggcagacgtggcacttcgaggcttcaacggcggaggagcgggagctgtgggttcagagtgtgcaggcccagatccttgccagcctgcaaggctgccgcagtgccaaggacaagactcgactggggaaccagaacgcagctctggctgtgcaggccgtccgcaccgtccgcggcaacagcttttgtatcgactgcgatgcacccaatccagactgggccagcctgaacctgggtgccctgatgtgcattgagtgctcaggcatccaccgacacctgggggctcacctgtcccgggtgcgctcccttgacctcgatgactggccgcctgagctgctggctgtcatgactgccatgggcaatgccctcgccaacagcgtctgggagggggccttgggtggctactccaagccagggcctgatgcctgcagagaggagaaggaacgctggatacgggccaagtatgaacagaagctcttcctggccccactgccaagctcagatgtgccactggggcagcagctgctccgggccgtggtggaagatgacctgcggctgttggtgatgctcctggcacatggctccaaagaggaggtgaatgagacctatggggacggggacgggcggacggctctacatctctccagtgccatggccaacgttgtcttcacgcagctgctcatctggtacggggtggacgtgaggagccgggacgcccggggcctgactccactggcatatgctcgccgggccggcagccaggagtgtgcagacatcttgatccagcatggctgccctggggagggctgtggcttagcgcctacccccaacagagagcctgccaatggcaccaacccctctgctgagctgcaccgtagtcctagcctcctataaggcccaggaagagggcagaggggccagaaggactccatggcccaaagaccctcctccctgcaggcactgtgggaacagacacagagatggagaagcagggacatgctgagaggacgaagccaaggaaattagggaggagagtcaaagggatcaaggagagttggggatttgagctgcagcagagagggatgagggatttagccctctgccctaaggtgccattgaaaagggacaggacccttcggaggtgcctgtgaggagaggggagcaggacctctccctcctccagatccctgcctcctagtgccagcccctcacacgccttcatcctgaaacaggaagaggacggcaccaagttgggggtgctggatgaaagagacgaggggtgatctgtgagtcccatgtaaactttgtacattggaatatttatgtttgtgtacatatttgatgtgtgtgtgtatgatgagccaataaaccagactgtgtgcgtggc

SEQ ID NO: 2463 - DNA, 681 bp, Homo sapiens
gttgctagccggggccagcggcggtggcggcggcggcggaggcgtcggtggaggaggggaggcggcgaggaggcgcagctcccgctgcaccgcgatcgacgctgcggagcgagcccacccgccccgggagctcgcctccccggtgctcccccgccctccccgcccccccagcggcgctgcctcctccaaatgagcgattcgcccgctggatctaacccaaggacacccgaaagcagcggcagcggcagcggcggcggcgggaagaggccggcggtgccggcagcggtgtccctcttgccaccggcggaccccctgcgccaggcgaaccggctcccgatcagggtcctgaagatgctgagcgctcacaccggtcacctcctgcacccggagtacctgcagccgctgtcctccactcccgtcagccccattgagctggacgccaagaagagccccttggcgctgctggctcagacctgctcgcagatcggcagccccgggtcgctgtccttgcggaatccacacactttgggcctaagccggtaccacccctatggcaagagccacttatccacagcggggggcctggccgtgccgtccctccccacagccggaccctactattcgccatacgcgctgtatggacagagactagcttcagcctcggcgctgggataccagtaa

SEQ ID NO: 2464 - DNA, 3225 bp, Homo sapiens
atgaacttccaggcgggcggggggcagagcccgcagcagcagcagagcctggcggctccggggggcggcggcgctgccgcgcagcagctcgtctgcggcgggcagttcggcggcgcggggcccggggccgggggcggcggcggcccctcgcagcagctggccggcgggcccccccagcagttcgcgctctccaactccgcggccatccgggccgagatccagcgcttcgagtccgtgcatcccaatatctacgccatctacgacctgatcgagcgcatcgaggatttggcgctgcagaaccagatccgggagcacgtcatctccatcgaggactcgtttgtgaacagccaggagtggacgctgagccgctccgtaccggagcttaaagtgggcatagtggggaacctgtctagcgggaagtcagccctggtgcaccgctatctgacggggacctatgtccaggaggagtcccctgaaggggggcggtttaagaaggagattgtggtggatggccagagttacctgctgctgatccgagatgaaggaggcccccctgagctccagtttgctgcctgggtggatgcagtggtgtttgtgttcagcctggaggatgaaatcagtttccagacggtgtacaactacttcctgcgtctctgcagcttccgcaacgccagcgaggtgcccatggtgcttgtgggcacgcaggatgccatcagcgctgcgaatccccgggttatcgacgacagcagagcccgcaagctctccacagatctgaagcggtgcacctactatgagacgtgcgcgacctacgggctcaatgtggagcgtgtcttccaggacgtggcccagaaggtagtggccttgcgaaagaagcagcaactggccatcgggccctgcaagtcactgcccaactcgcccagccactcggccgtgtccgccgcctccatcccggccgtgcacatcaaccaggccacgaatggcggcggcagcgccttcagcgactactcgtcctcagtcccctccacccccagcatcagccagcgggagctgcgcatcgagaccatcgctgcctcctccacccccacacccatccgaaagcagtccaagcggcgctccaacatcttcacgtctcggaagggtgctgacctggaccgggagaagaaggctgccgagtgcaaggtggacagcatcgggagcggccgcgccatccccatcaagcaggggatcctgctaaagcggagcggcaagtccctgaacaaggagtggaagaagaagtatgtgacgctctgtgacaacgggctgctcacctatcaccccagcctgcatgattacatgcagaacatccacggcaaggagattgacctgctgcggacaacggtgaaagtgccagggaagcgcctgccccgagccacacctgccacagccccgggcaccagcccccgtgccaacgggctgtccgtggagcggagtaacacacagctgggtgggggcacaggtgccccccactcggccagcagcgcatccctgcactctgagcgccccctcagcagctcggcctgggctggcccgcgccctgaggggctgcaccagcgctcctgctccgtttccagcgccgaccagtggagtgaggccaccacttccctgcccccaggcatgcagcaccctgccagtggcccagctgaggtactcagttccagccccaagctggatcctcccccatctccccactccaaccggaagaagcaccggaggaaaaagagcaccgggaccccccgaccagacggccccagcagtgctactgaagaggcagaggagtcgtttgaatttgtggtggtgtccctcactgggcagacgtggcacttcgaggcttcaacggcggaggagcgggagctgtgggttcagagtgtgcaggcccagatccttgccagcctgcaaggctgccgcagtgccaaggacaagactcgactggggaaccagaacgcagctctggctgtgcaggccgtccgcaccgtccgcggcaacagcttttgtatcgactgcgatgcacccaatccagactgggccagcctgaacctgggtgccctgatgtgcattgagtgctcaggcatccaccgacacctgggggctcacctgtcccgggtgcgctcccttgacctcgatgactggccgcctgagctgctggctgtcatgactgccatgggcaatgccctcgccaacagcgtctgggagggggccttgggtggctactccaagccagggcctgatgcctgcagagaggagaaggaacgctggatacgggccaagtatgaacagaagctcttcctggccccactgccaagctcagatgtgccactggggcagcagctgctccgggccgtggtggaagatgacctgcggctgttggtgatgctcctggcacatggctccaaagaggaggtgaatgagacctatggggacggggacgggcggacggctctacatctctccagtgccatggccaacgttgtcttcacgcagctgctcatctggtacggggtggacgtgaggagccgggacgcccggggcctgactccactggcatatgctcgccgggccggcagccaggagtgtgcagacatcttgatccagcatggctgccctggggagggctgtggcttagcgcctacccccaacagagagcctgccaatggcaccaacccctctgctgagctgcaccgtagtcctagcctcctataaggcccaggaagagggcagaggggccagaaggactccatggcccaaagaccctcctccctgcaggcactgtgggaacagacacagagatggagaagcagggacatgctgagaggacgaagccaaggaaattagggaggagagtcaaagggatcaaggagagttggggatttgagctgcagcagagagggatgagggatttagccctctgccctaaggtgccattgaaaagggacaggacccttcggaggtgcctgtgaggagaggggagcaggacctctccctcctccagatccctgcctcctagtgccagcccctcacacgccttcatcctgaaacaggaagaggacggcaccaagttgggggtgctggatgaaagagacgaggggtgatctgtgagtcccatgtaaactttgtacattggaatatttatgtttgtgtacatatttgatgtgtgtgtgtatgatgagccaataaaccagactgtgtgcg

SEQ ID NO: 2465 - DNA, 3257 bp, Homo sapiens
cagtccgaggagggtcacgcaggcggcagatgccaggcgggcagccccgcccctgcgcgccgcctcagcggcgccttcaagacgctggtcccaggcacccacgcccagggcgcctcggatacccaccccctcggccccccgcacaccccggtcctcgacccctctccgcaggatggtttcccggtcctctggcgaggatcctccaaggcgtctcacatgaaccggctcagaaacgccaaaatctacgtggagagagctgtcaagcagaagaagatctttacaatccaaggctgctacccggtgatccggtgtctcttgcgccggaggggctgggtggagaagaagatggtccatcgctcaggccccaccctgctgccaccccagaaggatctggatagctcagcgatgggtgacagtgacaccactgaggatgaggatgaagatgaggacgaggagttccagccatcacagctgttcgacttcgatgatttactgaaatttgatgacctagatggaacacatgctctgatggtgggtctatgtctcaatctccggaatttgccgtggtttgatgaggttgatgccaactccttcttcccacgctgctactgcctgggggctgaggatgacaaaaaagccttcatagaggacttctggctgactgctgcccgcaacgttctcaagctggtggtgaagtctgagtggaagtcataccctattcaggcagtagaggaagaggcctcaggagacaagcagcccaagaaacaggagaaaaacccagtgttggtgtccccagagtttgtggatgaagctctgtgtgcgtgcgaggagtaccttagcaacttggcccacatggacatcgacaaggacctggaggccccgctgtacctcacccccgagggctggtccctcttcctccagcgctactaccaagtggtccacgaaggggcagaactcaggcacctcgacactcaggtccagcgctgtgaggacatcctgcagcagctgcaggccgtggtaccccagatagacatggaaggggatcgcaacatctggatcgtgaagccaggagccaagtcccgcggacgaggcatcatgtgcatggaccacctggaggagatgctgaagctggtgaacggcaaccccgtggtgatgaaggacggcaagtgggtggtgcagaagtatattgagcggcccctcctcatctttggcaccaagtttgacctcagacagtggttcctggtaactgactggaacccacttaccgtgtggttctaccgcgacagctatatccgcttttccacgcagcccttctccctgaagaacctggacaactcagtgcacctgtgcaacaactccatccagaagcacctggagaactcatgccatcggcatccactgcttccgccagacaacatgtggtctagccagaggttccaggcccacctgcaggagatgggtgccccaaatgcttggtccaccatcatcgtgcctggcatgaaggatgctgtgatccacgcacttcagacctcccaggacaccgtgcagtgtcggaaggccagctttgagctctatggcgctgacttcgtgttcggggaggacttccagccctggctgattgagatcaacgccagccccacgatggcaccctccacagcagtcactgcccggctctgtgctggcgtgcaagctgacaccctgcgcgtggtcattgaccggatgctggaccgcaactgtgacacaggagcctttgagctcatctataagcagcccgtcaccacttccccagcctccacaccaaggcccagctgccttctccccatgtactccgacaccagggccaggtcctcagacgacagcacagcaagctggtgggcactaaggccctgtcgaccacaggcaaggccttgaggactctacccacggctaaggtcttcatttccctcccaccgaaccttgatttcaaggtggcacccagcatcctgaagccaagaaaggctcctgctctcctgtgcctccgaggcccccagctggaagtgccttgttgcctctgccctttgaagtcggaacaattcctagcacctgtcggaaggtcaaggccaaaggcaaattcaaggccagactgtgacaaacccagggctgaggcctgccccatgaagaggctgagccccctgaaacccctgccccttgttggtacattccagaggcgcaggggcctgggggatatgaagctagggaagcccctgcttcgattccccactgcccttgtcctggatccaacaccaaataaaaagaaacaagtgaagtatttggggcttgactccattgctgttggagggtcaagagtggatggggcgaggccgtgtaccccagggtccacagcaagagcctgaggccatcagcagctcctccgtgcagcgaggcccagaattcccacctaaggacagacatggggcttcctatttagggactcccccagcatctccgatccaggggtggggagcgtgagccttcactttacagatgaagaaactgagtctgaaagaggaggcatggcttacccaagatcacgtggcagtgagtcgacgcagggacatattgccagaactgccgagcactgggagccccccaaccccagagaacaagccaagctagcagaatgacacctaccgggcataggaacgttaatgccatgagacaggggaaggaattggccttgcctaaacctcagcccttctgcagagggcatgggtctatcccttcttcagcaaggggccaaggtcacctaaaaatgaaacatccaataagccacacccacctgaagaaaagtgtggcactgcttagttgtagtgggttgaactgtggtcccctgaaaagagatgtctacttggaccctgtgaatgtgaccttatgtgggaaaagagtctttgtagctgggtatggtggctcacacctgttatcccagcactttgagaggccaaggcaggagatcgcttgagcccgcaagttcaagaccagtctgggcaacatggtgaaaccgtttctacagaaaattagctgggtgtggtggcacacacctgtagtcctagctactcgggaggcctaggtgggaggattacctgagcctgggaagatcaaaactgtggtgagctgtgatcacgccactgcgctctgagcctgggagacagagtgaaaccctaaatcaaaaaaaaaaaaaaaggtctttgcagatgtaaataaatttaagatcttaaatg

SEQ ID NO: 2466 - DNA, 1961 bp, Homo sapiens
aaggtgggcctcgagcaaagccgctagaggtggggtgcgggtggtcggcctcaggcgagccccggggcacagcccggggcgggaggcggagcttggcggccgagatctccgcgctgcagttagccccgccgagcgccaggagctgcgggtaggaggggcgagagaaaggatgggggtacagaaccggaagaaacgaagggctcgtccgcttcggcttgtcctaatttggtgcccaatctgaagctgggctgtaccattgcatacctgggggaggctgtggcaaaggtgacaagaaggccgaaggcacaaagggaagctgcacccattcctggaggagcttaaatagtgactcgagtgcaagaatttaaaaataccgagacagccctaggtggaaaacttccggaaggcccaagcgttcgtaagggctctctaccccgctcggagcatagatggtaccgtccggaagtccgggcggagaccgtagctgcgcttctcgcgaaagggcaggcatcgcggggctggccacttccgtacttccgctttccggcccagccagcgcccgcgatgactgccactctccgcccctacctgagtgccgtgcgggccacattgcaggctgccctctgcctggagaacttctcctcccaggttgtggaacgacacaacaagccggaagtggaagtcaggagtagcaaagagctcctgttacaacctgtgaccatcagcaggaatgagaaggaaaaggttctgattgagggctccatcaactctgtccgggtcagcattgctgtgaaacaggctgatgagatcgagaagattttgtgccacaagttcatgcgcttcatgatgatgcgagcagagaacttctttatccttcgaaggaagcctgtggaggggtatgatatcagctttctgatcaccaacttccacacagagcagatgtacaaacacaagttggtggactttgtgatccacttcatggaggagattgacaaggagatcagtgagatgaagctgtcagtcaatgcccgtgcccgcattgtggctgaagagttccttaagaatttttaaaccatctggctggatctcgtggccttccccctcagactacccatgtctccacgaaggcgtcctggagtcactccccgagcagcgcggcggcggcagggagttgggttggggtgggcatttgatgcgggaggtgggtggtgtgcttgctagctgggcaagaaagcagcagtggacctgccccaaggccacacgtgcctggtcaggctggcttctgatgttcagtcccctgggccgggacagattttttttaacgtcttgaaacttaaactctgtgcttgtaggatactgtaacctttttgtctttttttttttttttttttttaaacctccacctccagtggctgtgactggtcccagtgattatacgttattggttgctgtgggtctgggcgggcctggagccagaaggcgacttattttttctctcctatgccaccccaggtggggagggagggaggtttcagactccagtttctcccttgcccttttattcccaagcctccttggccccagtataagtgttgggaactctctgccagcttcctgagttctgcctaaagatggccccccagcactggttggggacaagggccaaattggtgaccaccagtcatgcctaggacctggggcccaaaagccgggcaacctctggctacaggggccattgggtgccctcccagttgagaggggccgctgtttcgccttgtccgtcagtgccagtgcctgtgccagaggtggcgaggtgagtcctccagagcttcctggccgggccctcctcctgcctgttctggctcctctgctcccacgctagctgtcccttttctgattctggtggatcctccctcccctaattaaagtctctttttgcccctttggggctgcatgaggtc

SEQ ID NO: 2467 - DNA, 1692 bp, Homo sapiens
gggagacgctgcgcgcggggctagcgggcggcggagcggacggcgacggggcgctctcgggctgccggcggggccgagcgccgcgcgtcccgagcatggcaggctccctgcctccctgcgtggtggactgtggcaccgggtattgccatcagagagtcagcaaaggtagttgaccaagctcaaaggagagtgttgaggggagttgatgaccttgactttttcataggagatgaagccatcgataaacctacatatgctacaaagtggccgatacgacatggaatcattgaagactgggatcttatggaaaggttcatggagcaagtggtttttaaatatcttcgagctgaacctgaggaccattattttttaatgacagaacctccactcaatacaccagaaaacagagagtatcttgcagaaattatgtttgaatcatttaacgtaccaggactctacattgcagttcaggcagtgctggccttggcggcatcttggacatctcgacaagtgggtgaacgtacgttaacggggatagtcattgacagcggagatggagtcacccatgttatcccagtggcagaaggttatgtaattggaagctgcatcaaacacatcccgattgcaggtagagatattacgtatttcattcaacagctgctaagggagagggaggtgggaatccctcctgagcagtcactggagaccgcaaaagccattaaggagaaatactgttacatttgccccgatatagtcaaggaatttgccaagtatgatgtggatccccggaagtggatcaaacagtacacgggtatcaatgcgatcaaccagaagaagtttgttatagacgttggttacgaaagattcctgggacctgaaatattctttcacccggagtttgccaacccagactttatggagtccatctcagatgttgttgatgaagtaatacagaactgccccatcgatgtgcggcgcccgctgtataagaatgtcgtactctcaggaggctccaccatgttcagggatttcggacgccgactgcagagggatttgaagagagtggtggatgctaggctgaggctcagcgaggagctcagcggcgggaggatcaagccgaagcctgtggaggtccaggtggtcacgcatcacatgcagcgctacgccgtgtggttcggaggctccatgctggcctcgactcccgagttctttcaggtctgccacaccaagaaggactatgaagagtacgggcccagcatctgccgccacaaccccgtctttggagtcatgtcctagtgtctgcctgaacgcgtcgttcgatggtgtcacgttggggaacaagtgtccttcagaacccagagaaggccgccgttctgtaaatagcgacgtcggtgttgctgcccagcagcgtgcttgcattgccggtgcatgaggcgcggcgcgggcccttcagtaaaagccatttatccgtgtgccgaccgctgtctgccagcctcctccttctcccgccctcctcaccctcgctctccctcctcctcctcctccgagctgctagctgacaaatacaattctgaaggaatccaaatgtgactttgaaaattgttagagaaaacaacattagaaaatggcgcaaaatcgttaggtcccaggagagaatgtgggggcgcaaacccttttcctcccagcctattt

SEQ ID NO: 2468 - DNA, 3760 bp, Homo sapiens
cacaactgtctctactgccaaggtgctaatgccgaacccctgtgggatctctggtccaaggaaacatctgcacacaggccagggatggcgcttagcttcatctgtgctgcaaactctcatcagtaggcttgctggctctgtgaccttactagctgaactccttaatctctctgcacttcatttttctagtctataaaatggagataacaacagcacctacctcagaagactgttatgaagactctctctccagatcggattcaaccgcacatcatgacagatgttccggctacatttacccaggctgagtgtaatggggataaaccacctgaaaacggtcaacaaacaatcactaaaatcagtgaggaattgactgatgtggacagccccctgccacactacagggtagaacccagtctggaaggtgcactcaccaaaggaagtcaggaggaaagaagaaaattacaagggaacatgctgctcaactcatccatggaggacaaaatgctaaaagaaaacccagaagagaaactctttattgttcataaggctatcacagatctttctctccaagaaactagtgctgatgaaatgacattcagagaagggcatcagtgggagaagattcctctgagtggcagtaaccaggaaataagaagacagaaggagaggattactgagcagcctctcaaagaggaagaagatgaggacaggaagaacaaaggtcaccaggcagctgaaattgaatggctgggatttcgaaaacctagccaagctgacatgttacattctaaacatgatgaggagcagaaggtttgggatgaagaaattgatgatgatgatgatgataattgcaataatgatgaagatgaagttcgagtgatagaatttaagaaaaaacatgaagaggtttctcaatttaaagaggaaggtgatgcaagtgaggactccccactgagcagtgccagttcccaagctgtgacacctgatgagcagccaaccttagggaagaagagtgatatctccagaaatgcttattccagatacaatacaatatcctatcggaaaatcagaaagggaaataccaagcaaagaattgatgaattcgagtctatgatgcatttataaactaactggaactgagaaattctcatgcccactaaaggaaaagctaattctattgccccagggtgcatatttctatgccttatttgagttatcacttggagggaggtggaagttgactctctttttcactgtagaataatgtggaaataaccctagataaaaattcagtctgataacctcaaatcaaaaagctttaaataaattcttgggcatttatcttttaaaacttcactaatatagcattgtgtgataagcactaagcagtcagtcccctgggggaatctggcataattcggctataaatgtagcaatgcttggaaaggtagtcatcaaatgagactatttgaggggactatttgaaatgattctggtatttcttttggtatctttcttcctgtacattggagtgatggaaagtctggtattaaaacctctcttacttttaaacttgattttgcagactctggcaataagccttccaaaattctgtgccttttctattatcaccaaacaatatgttaagtggctttccttggcatctacagagaaaacattctatagccctccttcctaggtgttaccattcactgaatcttctctcagagggagatgagcaattgtcagtcaggataattctgtttgctaaatgttgcctttatgctttcaaactgaattaaacccattgtgaggttgacactgggaggggctagaagattggtgggcagcagactaaagagttatgttggatagttttatttctgtggctgaaaataaaatcttgtctagcacagttaaagtcattaaaaataaaaatgacagctttagcacaattttaagaaaatgcccctctctattaccacattttctcttattaacagtatctcagaataattttctttccttagaaacctgagagaatgctagtcataactgtactagttactatgaaaatggaaataattatcttagaatattttcaaagtagagcgtgagcatgtatttttagtgggagagctctgatagttgttgggaatatataatttactggacctcagcccaaatcaagatgcttaaaattgtacttgtggagcttcactcaaaccaatgtgtcaaataacgtattgaatatttatgaaaagagagactatatttatattcttagatagtttgttccacaatttttcatttcatgcttccatatatattaccctgaactttctatcaccacagataaagattttgttttgccctgcaaataaaaagacaattccttattgtctgaatgtaatacagtcttcattgtactattcaaccctttgtttctttctttttcattttgtgaaaaactccatgttagtcctcttagatgactgcttatttatgtgtaacataaatcccacatattctaatgacaacttctttaatccttccgggtcatatattatatttccatagtatcacatactattatttagttgtttacaagactccaatttgaattcaggattacagtgctcctttcattctttcaaacagataacataaaagttctgttaccctcattctatacaacctatggatttcatgtgttacaatatcagtttccagaataaagtgagggaaatcaggtctttattgataaagttagggagaagattgatgcaataggacaatttccaatttaatttagatcctctaatctttctacatggacaagctgttttcttttctaggttactgataacccctacaattttcgacttaacttcaaaacacagtattgtgttatctatcacataacaggaccatgtttttaacctaccatcaagagcctgtattttgagttattccaacagagatgatggattcctgtagaactagaggtgggtgacctatggttatgtggcacggcaaagcaagtacctcttaagggactctaatatatgctaacgctggtcctcttagctctgtgctctcaccagacaatgaatgaactatgaaagatttagtcaacagaaactattttagggtatgtttagttggtaaatgcttcatgttcatggatgacacaatgtttttgcaaaaaaaccctgaaactattctttggcattggtgtccatggccctataccgccatcttacacgaaagccacagagttgaaagccacagagttgaaagccacagagttaagtgacctcaggtaacataatggtgatggttggccatttgagtctttgtaacctaggaaagacaaaggtctgattcagattgcatgggggatttttaacatatttgaaactcagggggaacatgattaagaacacaaactggtagctacacatgaaggtttacttgagcttttgtgattcaaagttcaggggtggtaaggactctggtaccagggaagagggagaattaatttattgtgcaaatgctggtatttcttacatgattttttgttttcctctgttgctagataaatagaaactaataatagctctatttctctgccaatataaaatctacctttcatataatgctacattgaaggcacagaatttgctaccatctctctctccccctacctaccaaactatccacaatttaaataaagaactgctgtgtctgactt

SEQ ID NO: 2469 - DNA, 1354 bp, Homo sapiens
ggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgcagacagaaggtggagcacagacagacggccagcagtcacagacacaaagtagtgaaaattcagagagtaaatctaccccgaaacggctgcatgtctctaatattcctttccgcttccgggaccctgacctccggcagatgtttgggcagtttggcaaaatcctagatgtagaaataatctttaatgaacgtggctctaagggattcgggttcgtaactttcgagaatagtgctgatgcagacagggccagggagaaattacacggcaccgtggtagagggccgtaaaatcgaggtgaataatgctacagcacgtgtaatgaccaataagaagatggtcacaccatatgcaaatggttggaaattaagcccagtagttggagctgtatatggtccggagttatatgcagcatccagctttcaagcagatgtgtccctaggcaatgatgcagcagtgcccctatcaggaagagggggtatcaacacttacattcctttaatcattcctggcttcccttaccctactgcagccaccacggcagccgctttcagaggagcccatttgaggggcagagggcggacagtatatggtgcagtccgagcggtacctccaacagccatccccgcctatccaggtgtggtttaccaggacggattttacggtgctgacctctatggtggatatgcagcctacagatatgcacagcctgctactgcaaccgcagccaccgctgctgcagccgctgcagccgcttacagtgacggttatggcagggtgtacacagccgacccctaccatgcccttgcccctgccgctagctatggagttggcgctgtggcgagtttataccgaggtggctacagccgatttgccccctactgaagtgacgtgagacccctgcaaatgggacagccccccagttcatgaggcctggctattgcaatatttactagtagaggaactctatagcaagatgaagaggaaaaacaaacaaacaaacaaaaaaaaacacaaaaaaagaaagaatacttttttatacctcactatgttctttgaatatgtatttttcctttaaatttctgcctttaattcttttgttccaaagattgtgcatttttttctttttttt

SEQ ID NO: 2470 - DNA, 759 bp, Homo sapiens
gagagactgccagagaggaagagaaaagaaaggaagaaacattagaaagaaaaaggaaggaaaacggtataaagagagatcaattacccacccttaaatagctagattggggggggaggggggtggaaaagaaagctgtggaggtgtgccccagcacggctgctttgaaaggtttatcatctatccgtttggtttatggagaaaaagaaaatggtaactcagctggaaggctgaagtctttcacctgagctgctgccagttcgctcttctgttcctgggtggttgggagaagagaagagggagggtattttatgctttaattaaagacagataagagagcagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgacagaaggtggagcacagacagacggccagcagtcacagacacaaagtagtgaaaattcagagagtaaatctaccccgaaacggctgcatgtctctaatattcctttccgcttccgggaccctgacctccggcagatgtttgggtttggcaaaatcctagatgtagaaataatctttaatgaacgtggctct

SEQ ID NO: 2471 - DNA, 1507 bp, Homo sapiens
agaaaaacagtccgcgacagctaggcgcgtgagaccggccgcccgcagggctgctctggccgggacccgctggccgggagacgcgaacctgccggaccaccgcgcggggacgacggcggccatgagctcgcggaagctgagcgggccgaaaggcaggaggctcaggtctcccatgtccgtatgcaggggatcctcttactggtctttgccaagtatcagcatttgccctatatccagattctgtctactaaatccacccccactggcctgtttgggtactgggggaacaaaggtggagtcaacatctgcctgaagctttatggctactatgtcagcatcatcaactgccacctgcctccccacatttccaacaattaccagcggctggagcactttgaccggatcctggagatgcagaattgtgaggggcgagacatcccaaacatcctggaccacgacctcattatctggtttggagacatgaactttcggatcgaggactttgggttgcactttgttcgggaatccattaaaaatcggtgctacggtggcctgtgggagaaggaccagctcagcattgccaagaaacatgacccgctgctccgggagttccaggagggccgcctactcttcccgcccacctacaagtttgataggaactccaacgactatgacaccagtgagaaaaaacgcaagcctgcatggaccgatcgcatcctgtggaggctgaagcggcagccctgtgctggccccgacactcccataccgccggcgtcacacttctccttgtctctgaggggctacagcagccacatgacgtacggcatcagcgaccacaagcctgtctccggcacgttcgacttggagctgaagccattggtgtctgctccgctgatcgtcctgatgcccgaggacctgtggaccgtggaaaatgacatgatggtcagctactcttcaacctcggacttccccagcagcccgtgggactggattggactgtacaaggtggggctgcgggacgttaatgactacgtgtcctatgcctgggtcggggacagcaaggtctcctgcagcgacaacctgaaccaggtttacatcgacatcagcaatatccctaccactgaagatgagtttctcctctgttactacagcaacagtctgcgttctgtggtggggataagcagacccttccagatcccgcctggctccttgagggaggacccactgggtgaagcacagccacagatctgagccaggatgggagtgaatcccaggcggaggccagagctggcagccagctctgcctttccactgccgggagtgctgggggcccagcctggccccctgaagagacagccaagtgtcgtccacatactcctcccagagtgagctctaaccaggctcatttgctctctccactactcatctctggaattagccgcttaaatacaggtttttgttgctgagatgtgagtgaaaccagctagtgtgtcaacagtgaagacct

SEQ ID NO: 2472 - DNA, 2738 bp, Homo sapiens
aagtggcaagatggctcccctgcatgtctccggctgatcgctgccgctccgccaatacaatagagccagccactaccagcagcctggccctcttcctccttctccagagagaccaatccagccgaactcggggtttgccgtgaggacttaacgcttatctcttaaaagccagatctgttttagcctccccgcaccaccaccacctccccttccatttaccattttttggatccccggttgctacatctcaattttctctctctggatcgggtggctggggaggaggtggtgggatcttggaacaaggaaggtgtggttttttttctttattttttttaggattttttttgtttggtttttgttatttcttccattccagaaagggataaacagcacttccagggggagaaaaaaaatcatgttatcagaaagcaaagaaggtgaggagaaggaggaagtgaccatggacacaagtgaaaacagacctgaaaatgatgttccagaacctcccatgcctattgcagaccaagtcagcaatgatgaccgcccggagggcagtgttgaagatgaggagaagaaagagagctcgctgcccaaatcattcaagaggaagatctccgttgtctcagctaccaagggggtgccagctggaaacagtgacacagaggggggccagcctggtcggaaacgacgctggggagccagcacagccaccacacagaagaaaccttccatcagtatcaccactgaatcactaaagagcctcatccccgacatcaaacccctggcggggcaggaggctgttgtggatcttcatgctgatgactctcgcatctctgaggatgagacagagcgtaatggcgatgatgggacccatgacaaggggctgaaaatatgccggacagtcactcaggtagtacctgcagagggccaggagaatgggcagagggaagaagaggaagaagagaaggaacctgaagcagaacctcctgtacctccccaggtgtcagtagaggtggccttgcccccacctgcagagcatgaagtaaagaaagtgactttaggagataccttaactcgacgttccattagccagcagaagtccggagtttccattaccattgatgacccagtccgaactgcccaggtgccctccccaccccggggcaagattagcaacattgtccatatctccaatttggtccgtcctttcactttaggccagctaaaggagttgttggggcgcacaggaaccttggtggaagaggccttctggattgacaagatcaaatctcattgctttgtaacgtactcaacagtagaggaagctgttgccacccgcacagctctgcacggggtcaaatggccccagtccaatcccaaattcctttgtgctgactatgccgagcaagatgagctggattatcaccgaggcctcttggtggaccgtccctctgaaactaagacagaggagcagggaataccacggcccctgcaccccccacccccacccccggtccagccaccacagcacccccgggcagagcagcgggagcaggaacgggcagtgcgggaacagtgggcagaacgggaacgggaaatggagcggcgggagcggactcgatcagagcgtgaatgggatcgggacaaagttcgagaagggccccgttcccgatcaaggtcccgtgaccgccgccgcaaggaacgtgcgaagtctaaagaaaagaagagtgagaagaaagagaaagcccaggaggaaccacctgccaagctgctggatgaccttttccgaaagaccaaggcagctccctgcatctattggctcccactgactgacagccagatcgttcagaaagaggcagagcgggccgaacgggccaaggagcgggagaagcggcgaaaggagcaagaagaagaagagcaaaaggagcgggagaaggaagccgagcgggaacggaaccgacagctggagcgagagaaacgtcgggagcacagtcgggagagggacagggagagagagagagaaagggagcgggacaggggggaccgagatcgggatagggaaagggaccgagaacgaggcagggaaagggatcgcagggacaccaagcgccacagcagaagccggagtcggagcacacctgtgcgggaccggggtgggcgccgctagctgggaaaacactagagctgcaggtaccagccactcggccccagggggttatggccacagagggataggcacagtctccaccaccctggagccaagggtctttcacatcacctatccctacatacataccaaatggaaaagtggccatccttttccccccaaacacacccccttaacctatctcttgggacttagcccgaccctccctctcatttcccattaagtctgagaggcaagagctaggttaggcaaggaggtggttggccagagatggggaacagccaggtgccccagtcctctgatttttcctccatcctgcttaccacctccctgggtacttacagccttctcttgggaacagccggggccaggactgggtcacctatgagctgaatcagcatctcctcctgagtcccagggcccctgcagttcccagtctcttctgtcctgcagcccttgcctctttcccacaggttccactttatatccaccttttccttttgttcaatttttatttttattttttttattattaaatgatgtggtctatggaaaaaaaaataaaaat

SEQ ID NO: 2473 - DNA, 1792 bp, Homo sapiens
gctgaggacggggcggggcctcgcgctaacggtcgcgcggccgtcgcacctgcacgaggctgtggcccgagcgtcctgtggagaagccgcgaagcgcgggcgacccgggggtcgggcgggccaggtccgcgaggccgcggcggcagctgtgcaggcccggggagcagccggccgggcgagcctcggattaaaaaaatggcaaactcctttgcagcgaggattttcactaccctttcagatctgcagacaaatatggctaatctgaaagttatcggtatagttattgggaaaacagatgtcaaaggctttccagacagaaaaaatattggatcagaaaggtacactttcagcttcaccattcgggattcaccagcacattttgtaaatgcagcttcctggggcaatgaagattacatcaagtctctttctgacagctttagggttggtgactgtgtgataattgaaaatcctctgatccaaagaaaggaaatagaaagagaagaaaaattcagccctgcaactcctagcaactgtaaactgttgctcagtgagaatcactcaacagtaaaagtttgttccagttatgaagtggacacaaagttactttctttgatacatttacctgttaaagagtctcatgattattattcactgggtgacattgttgcaaatggacacagtcttaatgggaggattattaacgtgcttgcagctgtgaaatcggttggagagccaaaatactttacaacttcagaccggagaaaaggccagaggtgtgaagttagactctatgatgaaacagagtcgtcttttgcgatgacatgttgggataatgaatccattctacttgcacagagctggatgccacgagaaacagtaatatttgcctcagatgtaagaataaattttgacaaatttcggaactgcatgacagcaactgtaatctcaaaaaccattattacaactaatccagatataccagaagctaacattctgctgaattttatacgagaaaataaagaaacgaatgttctggatgatgaaattgacagttatttcaaagaatccataaatttaagtacaatagttgatgtctacacagttgaacaattaaagggaaaagctttgaagaatgaaggaaaagctgatccttcctatggcatcctttatgcctacatttccacactcaacattgatgatgaaactacaaaagtagttcgaaatagatgttccagctgtggttatattgtaaatgaagcatctaacatgtgcacaacttgcaacaaaaactccttggactttaaatctgtctttctcagtttccatgtgctgattgatctgactgatcacacaggcacccttcattcctgtagtctcacaggaagtgttgctgaggagactttgggctgcacgttcgttctatcacacagagcaaggagtggattgaaaattagtgtactctcgtgcaagcttgcagatcctactgaggcaagcagaaacttgtctggacaaaaacatgtttaaaacggtctatcattttgaactctggaaaagtataagagttttaactccctttaaaatggaatattaatttgaaaattatggggaaaattgcattttgtttacatgtggtgaacatgtttctagaaattgttatggtggaggtggtctgggtgagtctgaaggcctctctcatctgacctcccttcttagaaggcctcctactgtctttgccttgtctcctcccaagttggaaaatgtttacatgaattaataaacagatttaatcttc

SEQ ID NO: 2474 - DNA, 969 bp, Homo sapiens
aaggtggcttgggagggaccagttttcctagatgcaggagacagcgtccatagtttcagttcgaagcaactggtggcaaaaggttagcatttaagatggcagggacagcgcgccatgaccgagagatggcgatccaggccaagaaaaagctcaccacggccaccgaccccattgaaagactccgactgcagtgcctggccaggggctctgctgggatcaaaggacttggcagagtgtttagaattatggatgacgataataatcgaacccttgattttaaagaatttatgaaagggttaaatgattatgctgtggtcatggaaaaagaagaggtggaagaacttttccggaggtttgataaagatggaaatggaacaatagacttcaatgaatttcttctcacattaagacctccaatgtccagagccagaaaagaggtaatcatgcaagcttttagaaagttagacaagactggagatggtgttataacaatcgaagaccttcgtgaagtatataatgcaaaacaccacccaaagtaccagaatggggaatggagtgaggaacaagtatttaggaaatttctggataactttgattcaccctatgacaaagatggattggtgacccctgaggagttcatgaactactatgcaggtgtgagcgcatccattgacactgatgtgtacttcatcatcatgatgagaaccgcctggaagctttaagcacatgacctggggaccaggccctgggacagccatgtggctccaaatgactaaatgtcagctcaaaaaccagaatcgtatttgatttcacactcatcctaatgtttttttctgtgtcaaaatattgcattttctggggccaaaaaacaggcagaaataaaagacattgagtagccaactgtgagtttgccttgcctaagactgtttcctttgttctaaaataggacttaaataaaatgagctctgt

SEQ ID NO: 2475 - DNA, 1004 bp, Homo sapiens
gagaaaaggcagaaccagagtagagattgacagtgagctgagccaatcaggctgtgaatctgcagcagtgatcccaggtcctccaattaatactaagagagtggaccagggcccctgaggaagacagatggcagggacagcgcgccatgaccgagagatggcgatccaggccaagaaaaagctcaccacggccaccgaccccattgaaagactccgactgcagtgcctggccaggggctctgctgggatcaaaggacttggcagagtgtttagaattatggatgacgataataatcgaacccttgattttaaagaatttatgaaagggttaaatgattatgctgtggtcatggaaaaagaagaggtggaagaacttttccggaggtttgataaagatggaaatggaacaatagacttcaatgaatttcttctcacattaagacctccaatgtccagagccagaaaagaggtaatcatgcaagcttttagaaagttagacaagactggagatggtgttataacaatcgaagaccttcgtgaagtatataatgcaaaacaccacccaaagtaccagaatggggaatggagtgaggaacaagtatttaggaaatttctggataactttgattcaccctatgacaaagatggattggtgacccctgaggagttcatgaactactatgcaggtgtgagcgcatccattgacactgatgtgtacttcatcatcatgatgagaaccgcctggaagctttaagcacatgacctggggaccaggccctgggacagccatgtggctccaaatgactaaatgtcagctcaaaaaccagaatcgtatttgatttcacactcatcctaatgtttttttctgtgtcaaaatattgcattttctggggccaaaaaacaggcagaaataaaagacattgagtagccaactgtgagtttgccttgcctaagactgtttcctttgttctaaaataggacttaaataaaatgagctctgtaaa

SEQ ID NO: 2476 - DNA, 1990 bp, Homo sapiens
gtccttcccaagaccacacccaggtccagtcattccctaggacttggcagagagctgtactcacagccaagatcacagcaaaatcagcaaagggaaaaggcatgcagagtgaagtccagaggcaaccagacagaagcatccagaatcctctcacagtggggtcacacaccccatgcttaactcccccaacaatgagttgtaacaacagtcaggtgtggtggtgtgtgcctgtagtcccagctacttgggagcctgaggcaggaggatcacttgagtccagcagttcaagactgcagtgagctatgatcataccactgcactccagcctgagtgacagagtgaaactctgtctctaaaatagggctcacctgcttgaggaaacaggaactgcctcggggcagccagccccgccccattgacgtgcagaccttgaatcgaaacccaggctcctgcaggcactggcacagctacagcgagggcctcggccatccaagggtctcccaggccctggtcaccttccaccagcagaagccaattgagccgcgcagggagctgctgacacagccctgcaggcagaaggatcccgcaaacgtggattacgaggatctcttcctctactccaacgcagtggccgaggaagctgcctgcccggtgtctgcccctgaggaggcctccccaaagccagtcctgtgtcaccaatcaaaggaaaggaagccgtcagcagagatgaacagaataaccaccaaggaagccacttcctcctgccccccaaaatcccctcttggagagacccgccagaaactctggaggagcctcaaaatgctccccgagagaggccagagggtccggcagcagaaaagccacctcgccactgtgaacttgtcgtcactcttggatgtccggagatccacggtgatctcaggccctgggaccggaaaaggcagccaagatcactcaggggatcccacctcgggggacagaggctacacggatccctgtgtggccacatctctcaaaagcccctcacagccccaggcaccaaaagacagaaaggtccccaccaggaaggccgagaggtcggtcagctgcattgaggtgaccccaggggacaggagttggcaccaaatggtagtgagagccctatcctcccaggagtccaagccagagcaccagggcttggcagagcctgagaacgaccagctcccggaggagtaccaacaaccgccaccctttgcccctgggtactgctagagaacaggtccaccctggctctgggactcgctgccaggggctgccacactcctgaatgccttaacatttcttccatggccccacaccatggcatccgggggtcttcgggaacccgggaaatggaataaagatgtttttggggtctgttcctgcactcacccatggggtgagctggttattttagcaacaatcatcagagtgacgctgatggtttggggcaccagctatacatcagccccagtgccagaccttctattcattattttacgcctcagagcaaggccctcagggagggtcatcctccatgttttgaagaagagactgaggttcagagaggataagaggcgtgaccaaggccacagagctatgggtgtcagcaccaggatttgaagccaggtgaatccgagcccttttcccatatcatctgtttgttctgttgtctaaaagcacactgcaagccgggctcagtggctcatgcctgtagtcccagcactctgtggggccgaggcaggcagatcgcttgaggtcaggagttcgagaccagcctggccaacatggtgaaaccccgtctatactaaaaaattcaaaaattacccggacgtggtggcgcatgcctgtaatcccagctacttgggagcctgaggcgggagaattgcttgaacccgggaggcagaggttgcagtgagccgagatcgcatcactgcagtccagcctggatgacagagtgagactccatctc

SEQ ID NO: 2477 - DNA, 2114 bp, Homo sapiens
gtgtgtggaggggaccctgtggttagcagcagctatcgcagcgtcggatgttcagagcagcagaagccggcgtcgtcggatgttgtgttgcccgccaccatgagctacacaggctttgtccagggatctgaaaccactttgcagtcgacatactcggataccagcgctcagcccacctgtgattatggatatggaacttggaactctgggacaaatagaggctacgagggctatggctatggctatggctatggccaggataacaccaccaactatgggtatggtatggccacttcacactcttgggaaatgcctagctctgacacaaatgcaaacactagtgcctcgggtagcgccagtgccgattccgttttatccagaattaaccagcgcttagatatggtgccgcatttggagacagacatgatgcaaggaggcgtgtacggctcaggtggagaaaggtatgactcttatgagtcctgcgactcgagggccgtcctgagtgagcgcgacctgtaccggtcaggctatgactacagcgagcttgaccctgagatggaaatggcctatgagggccaatacgatgcctaccgcgaccagttccgcatgcgtggcaacgacaccttcggtcccagggcacagggctgggcccgggatgcccggagcggccggccaatggcctcaggctatgggcgcatgtgggaagaccccatgggggcccggggccagtgcatgtctggtgcctctcggctgccctccctcttctcccagaacatcatccccgagtacggcatgttccagggcatgcgaggtgggggcgccttcccgggcggctcccgctttggtttcgggtttggcaatggcatgaagcagatgaggcggacctggaagacctggaccacagccgacttccgaaccaagaagaagaagagaaagcagggcggcagtcctgatgagccagatagcaaagccacccgcacggactgctcggacaacagcgactcagacaatgatgagggcaccgagggggaagccacagagggccttgaaggcaccgaggctgtggagaagggctccagagtggacggagaggatgaggagggaaaagaggatgggagagaagaaggcaaagaggatccagagaagggggccctaaccacccaggatgaaaatggccagaccaagcgcaagttgcaggcaggcaagaagagtcaggacaagcagaaaaagcggcagcgagaccgcatggtggaaaggatccagtttgtgtgttctctgtgcaaataccggaccttctatgaggacgagatggccagccatcttgacagcaagttccacaaggaacactttaagtacgtaggcaccaagctccctaagcagacggctgactttctgcaggagtacgtcactaacaagaccaagaagacagaggagctccgaaaaaccgtggaggaccttgatggcctcatccaccaaatctacagagaccaggatctgacccaggaaattgccatggagcattttgtgaagaaggtggaggcagcccattgtgcagcctgcgacctcttcattcccatgcagtttgggatcatccagaagcatctgaagaccatggatcacaaccggaaccgcaggctcatgatggagcagtccaagaagtcctccctcatggtggcccgcagtattctcaacaacaagctcatcagcaagaagctggagcgctacctgaagggcgagaaccctttcaccgacagccccgaggaggagaaggagcaggaggaggctgagggcggtgccctggacgagggggcgcagggcgaagcggcagggatctcggagggcgcagagggcgtgccggcgcagcctcccgtgcccccagagccagcccccggggccgtgtcgccgccaccgccgccgcccccagaggaggaggaggagggcgccgtgcccttgctgggaggggcgctgcaacgccagatccgcggcatcccgggcctcgacgtggaggacgacgaggagggcggcgggggcgccccgtgacccgagctcggggcgggcggagcccgcgtggccgaagctggaaaccaaacctaataaagttttcccatcccacc

SEQ ID NO: 2478 - DNA, 1907 bp, Homo sapiens
ggcgatggcggtcgggggtgctggtgggagccgcgtgtccagcgggagggacctgaattgcgtccccgaaatagctgacacactaggggctgtggccaagcaggggtgagggccggacctccacgagcggaatgcggggtccgaactcggggacggagaagggcagactagtcatcccggagaagcaggggtttgatttcctctgcatgcctgtcttccatccgcgtttcaagagggagttcattcaggaacctgctaagaatcggcccggtccccagacacgatcagacctactgctgtcaggaagggactggaatacgctaattgtgggaaagctttctccatggattcgtccagactcaaaagtggagaagattcgcaggaactccgaggcgttggaggtgcagttcatcatcacaggcaccaaccaccactcagagaaggagttctgctcctacctccaatacctggaatacttaagccagaaccgtcctccacctaatgcctatgaactctttgccaagggctatgaagactatctgcagtccccgcttcagccactgatggacaatctggaatctcagacatatgaagtgtttgaaaaggaccccatcaaatactctcagtaccagcaggccatctataaatgtctgctagaccgagtaccagaagaggagaaggataccaatgtccaggtactgatggtgctgggagcaggacggggacccctggtgaacgcttccctgcgggcagccaagcaggccgaccggcggataaagctgtatgctgtggagaaaaacccaaatgccgtggtgacgctagagaactggcagtttgaagaatggggaagccaagtgaccgtagtctcatcagacatgagggaatgggtggctccagagaaagcagacatcattgtcagtgagcttctgggctcatttgctgacaatgaattgtcgcctgagtgcctggatggagcccagcacttcctaaaagatgatggtgtgagcatccccggggagtacacttcctttctggctcccatctcttcctccaagctgtacaatgaggtccgagcctgtagggagaaggaccgtgaccctgaggcccagtttgagatgccttatgtggtacggctgcacaacttccaccagctctctgcaccccagccctgtttcaccttcagccatcccaacagagatcctatgattgacaacaaccgctattgcaccttggaatttcctgtggaggtgaacacagtactacatggctttgccggctactttgagactgtgctttatcaggacatcactctgagtatccgtccagagactcactctcctgggatgttctcatggtttcccatcctcttccctattaagcagcccataacggtacgtgaaggccaaaccatctgtgtgcgtttctggcgatgcagcaattccaagaaggtgtggtatgagtgggctgtgacagcaccagtctgttctgctattcataaccccacaggccgctcatataccattggcctctagccctgcgtgccaagtgtccagagccttggaagcagcttcaggttctgctcctgtagtacagaaggtgcagtacatctatgggctgtgattccccttgcccatcagagaggagcatttcaatctgctttcctgccttacatcaaggtgggcaagggattataattaattgcagggctcaagccaccaatctatgaagacctcaggccagggggtgaggaattagtgctggatttgaagctacgcactcagcctcaagaactccctggaatatccctgagaacatggggtttgaacggattttcagcctttttctgttcttgttttgatggttttgtgtaagaggaaatacaaataaagttatagccctttactgca

SEQ ID NO: 2479 - DNA, 2418 bp, Homo sapiens
agtatcaaggaatcccggcgtggacagcgcgaggagaaagatggcggcgatggcggtcgggggtgctggtgggagccgcgtgtccagcgggagggacctgaattgcgtccccgaaatagctgacacactaggggctgtggccaagcaggggtgagggccggacctccacgagcggaatgcggggtccgaactcggggacggagaagggcagactagtcatcccggagaagcaggggtttgatttcctctgcatgcctgtcttccatccgcgtttcaagagggagttcattcaggaacctgctaagaatcggcccggtccccagacacgatcagacctactgctgtcaggaagggactggaatacgctaattgtgggaaagctttctccatggattcgtccagactcaaaagtggagaagattcgcaggaactccgaggcggccatgttacaggagctgaattttggtgcatatttgggtcttccagctttcctgctgccccttaatcaggaagataacaccaacctggccagagttttgaccaaccacatccacactggccatcactcttccatgttctggatgcgggtacccttggtggcaccagaggacctgagagatgatataattgagaatgcaccaactacacacacagaggagtacagtggggaggagaaaacgtggatgtggtggcacaacttccggactttgtgtgactatagtaagaggattgcagtggctcttgaaattggggctgacctcccatctaatcatgtcattgatcgctggcttggggagcccatcaaagcagccattctccccactagcattttcctgaccaataagaagggatttcctgttctttctaagatgcaccagaggctcatcttccggctcctcaagttggaggtgcagttcatcatcacaggcaccaaccaccactcagagaaggagttctgctcctacctccaatacctggaatacttaagccagaaccgtcctccacctaatgcctatgaactctttgccaagggctatgaagactatctgcagtccccgcttcagccactgatggacaatctggaatctcagacatatgaagtgtttgaaaaggaccccatcaaatactctcagtaccagcaggccatctataaatgtctgctagaccgagtaccagaagaggagaaggataccaatgtccaggtactgatggtgctgggagcaggacggggacccctggtgaacgcttccctgcgggcagccaagcaggccgaccggcggataaagctgtatgctgtggagaaaaacccaaatgccgtggtgacgctagagaactggcagtttgaagaatggggaagccaagtgaccgtagtctcatcagacatgagggaatgggtggctccagagaaagcagacatcattgtcagtgagcttctgggctcatttgctgacaatgaattgtcgcctgagtgcctggatggagcccagcacttcctaaaagatgatggtgtgagcatccccggggagtacacttcctttctggctcccatctcttcctccaagctgtacaatgaggtccgagcctgtagggagaaggaccgtgaccctgaggcccagtttgagatgccttatgtggtacggctgcacaacttccaccagctctctgcaccccagccctgtttcaccttcagccatcccaacagagatcctatgattgacaacaaccgctattgcaccttggaatttcctgtggaggtgaacacagtactacatggctttgccggctactttgagactgtgctttatcaggacatcactctgagtatccgtccagagactcactctcctgggatgttctcatggtttcccatcctcttccctattaagcagcccataacggtacgtgaaggccaaaccatctgtgtgcgtttctggcgatgcagcaattccaagaaggtgtggtatgagtgggctgtgacagcaccagtctgttctgctattcataaccccacaggccgctcatataccattggcctctagccctgcgtgccaagtgtccagagccttggaagcagcttcaggttctgctcctgtagtacagaaggtgcagtacatctatgggctgtgattccccttgcccatcagagaggagcatttcaatctgctttcctgccttacatcaaggtgggcaagggattataattaattgcagggctcaagccaccaatctatgaagacctcaggccagggggtgaggaattagtgctggatttgaagctacgcactcagcctcaagaactccctggaatatccctgagaacatggggtttgaacggattttcagcctttttctgttcttgttttgatggttttgtgtaagaggaaatacaaataaagttatagccctttactgcacgac

SEQ ID NO: 2480 - DNA, 2279 bp, Homo sapiens
gactgaaaatgccgtcggtttcgaaagcggcggcagcggcgctgagcgggtcccccccgcagactgagaagccgacccactacaggtacctgaaggagttcaggacggagcagtgccccctgttttcacagcacaagtgcgcgcagcaccggccgttcacctgcttccactggcacttcctcaaccagcggcgccgcaggcccctccgcaggcgcgacggcaccttcaactacagccccgacgtgtactgctccaagtacaacgaagccaccggcgtgtgccccgacggcgacgagtcacttctcggcgtcctctatcctctgtgggcaccccctccggtgcctgcccccgtgggtgcccccactgtgcaccctttcctagcccggtggttctcgcacgttccctgggaaccagccggcagtgcagatccacgggcctcgtccacaccagctggggggaccacatgggccacgggcctcctaggtgattttgatgcatgtggctcgcagtctcgagaatgtgttaagggggtctggtggaccctccttgggttcaggtgtccctacctgcaccggacgacgggggacacagaacgcaagtaccacctgcgttactacaaaacaggaacctgcatccacgagacagacgcacgtggccactgcgtgaagaatgggctgcactgtgccttcgcgcacggccccctggacctgcggccgcccgtgtgtgacgtcagggagctgcaggcccaggaagccttgcagaacggccagctgggcggcggggaaggggtcccggatctgcagcctggggtcttggccagccaggccatgattgagaagatcctgagcgaggacccccggtggcaagcattgcttccagtcgcgctgctcaggcaccgtgtggcccatttttcagatgccaacttcgtgctgggcagctacaagacggagcagtgcccgaagccgccacgcctgtgccgccagggctatgcgtgcccacactaccacaatagccgggacaggcggcgcaacccccggcggttccagtacaggtccacgccctgccccagtgtgaagcacggggatgagtggggggaaccctcacgctgcgatggcggcgacggctgccagtattgccactcccgcacggagcagcagttccatcccgaggggcctgtcgggagtccggtgtccggggcgttttctgtgttcagtcacgcaggcctggttgcagaccccagtctctggtacccagctgagtggagctggcaccacgtgggccacagccgcaccataaatcctgagggagataaaccctcccgcctgggccccgccccagaaaatatcaagcggggaaatgactttgcctgtgatgggagggcagatgctgcgggaatggccccacatgtgtgcgtgttccctatctacaaatctacaaaatgcaacgacatgcgccaaaccgggtactgcccgcgcggccccttctgtgcctttgcacacgttgagaagagcctggggatggtgaatgaatggggctgtcacgacctccacctcacgagtccttcctccacgggcagcggccagccgggaaatgccaagcggagagactcgccggccgagggtggccctaggggcagcgagcaagacagcaagcagggggtgcgcgctcacggtgtttatgtctttgaacagaaccacctggccgtgtttgcagcggtccacccgccggcccccagcgtgagctccagcgtggcgtccagcctggcgtccagcgccggctccggcagctcctcccccactgcgctgcccgcgccccccgcccgtgccctcccgctcggccccgccagcagcactgtggaggccgtcctcgccctggagcccaccccttcctctcctacatcctctgctgtgcagggtgtggcgggggagctgggcatgggatcaggaggacagggctgctggagccacgtggtgggggccctcgctgcagtccctgcctggacacactctggggacttggagtgggaccccagcaccatcaggacccgcgtcaatgtgggcggcggcccggcggccagacccgcaatgactcttgcccgagagccgcagcttctggtcgttggtggttgccccacacggaactgctcaggcccagctgcaagcccccagcaactcctagacgatgccggccaaggaggccgaggagagagagactcttcccagcggccacttaggccacagaccacacatcggcaggacactagaccagtcccatcctga

SEQ ID NO: 2481 - DNA, 2180 bp, Homo sapiens
tttgaatccccggcggcggcgcggggcggccgcggaccgtgagtcagcattggcggcggccccagcgcgtggcagccgtgcgccgccaaggtgcgggtctcgttactcggcggtcaggagcgggccctcccttaggtgcgccccccgccaggttctgcgttagacctgcatcttagcaatgtgaatattgcatccctagagaaggacctggaagagcaagacggccacgacctgggagcagcaggtcccaggtcgctggccggctctgcacctgtcgccatccccggctccctgcccagagcaccatcgctacactcgccatcctctgcgtccacctcgccgctcggttcgctgtcccagcccctcccagggccggtgggctcctcagccatgacgcctccccagcagccgccacccctgcgttcagagccgggcacactgggctctgcagcctcatcctacagccccctaggtttgaacggtgtccccgggagcatctgggactttgtttccggcagcttctcccccagcccctcccccatcctgagtgccggccccccatcctcttcgagtgcaagtccaaacggagctgagctggcccgggtcaggcggcagctggacgaggccaagaggaagatccggcagtgggaggagtcctggcagcaggtgaagcaggtctgcgatgcctggcagcgagaggcgcaggaggccaaggagcgtgcccgtgtggccgatagcgaccggcagctggcgctgcagaagaaggaggaggtggaggcacaggtgatcttccagctccgcgccaagcagtgtgtggcctgccgggagcgggcccacggtgctgtcctgcggccctgtcagcaccacatcctctgtgagccgtgtgcggccaccgcacctgagtgcccctactgcaagggccagcccctgcagtggtgacctcagcggggacagccacctcctgctgggcaccctggctccagcgctcctcctgaccacggacatgtcgtcactcgcttctggtgccaccgacgtgaggaccgaggctgggagcccttcctgttacacgttatcatgaggctgggagccccgcctgcgcttggcctgacagcctttcctgtcacacgttgtcacctatctagtcctaccgacggtttcaaggtattttcctcaaaaaccttaaatgcaaacccacagaacccgcctgcctgtccctgaggggcctggtgcctccgggatccacgcggcgctgtgatcacagcagtttgtggtcctgacactactgtgactaggccactgggagctggggtctttcaaagcactttgtaaaccgaggaatttagttagaggttataaattgctctaagctgctttctgtttttttttaatatgcgataatatgaagctttatatgtgtactgtgaacttaaatatttcatatcagtttattgtcaattcatagtatgctaaatatattagatttcatattctgaaactagtacttatgaaatgagtgtttatctagtagtaagacctaggatttttacattttccaattaagtgcaaatagtatttataagcagagtgattatggattgagatgtttttaacttgatggaaggagctagttttcctgagcctgtgtgtgcaccaggcactggggctgatgttccagcctcgtggcgtgggagcaggagagctccgtcctgcatttctgtggtccgtggccgctgtttctgtgcgcctgcgcctcggagagcaagtgaaggagcatcatgggttttgttttctcccttaaccctctgaaagacagtttgatactaacaaaaaacgcagcagaggggatccgacgtcagagcttttagaattacttttttaagcagctgtcttctggctgggtgcggtggctcatgcctgtgatcccagcactttgggaggcgggtggatcacctaaggtcaggagttcaagaccagcctggccaacatggtgcaaccccgtcttagtaaaaatacaaaaattggcctggcgtgagagcgggcacctgtagtcccagctactcgggaggctgaggcaggagaatcgcttgaacctgggaggcagaggttgcagtgagccgagatcgcgccaccgcactccagcccgggtgacagagcgagactctggctcaaaaaaaaaaaaa

SEQ ID NO: 2482 - DNA, 500 bp, Homo sapiens
gaggcctgcgcgtgcggtctgcagttcggccgcttcctcttggcgggtgggctgcagctatggagggcgagcctccacctgtggaggagcggcggcggctgcaggaggagctgaacgagttcgtggagagcggctgccggacgttggaggaggtgaccgcgtccctgggctgggacctagatagtctggatcccggggaagaggaggcggcggaggatgaagttgtgatatgtccatacgattccaatcatcacatgcctaaatcatctttggcaaagcacatggcatcttgtagattgaggaaaatgggctataccaaagaagaagaggatgaaatgtataatcctgagtttttctatgaaaatgtgaagataccttcgattactttgaataaggactcacaattccagataattaaacaagctagaactgcagttgggaaagacagtgattgttataatcaaataattggggtgagtataaagaggaattataaaatt

SEQ ID NO: 2483 - DNA, 776 bp, Homo sapiens
atggggacctttgacctgtggacagattacctgggtttggcacacctggttagggctctgagtgggaaagagggtcctgaaaccaggctgagcccccagccagagccagagccaatgctggagccggatcagaagcgcagcctggagtcctcgccagctcccgaacgcctgtgctctttctgcaaacacaacggcgagtcccgggccatctaccagtcccacgtgctgaaggacgaggctggcagggtgctgtgtcccatcctgcgggactacgtgtgtccccagtgcggcgccacacgtgagcgcgcccacacccgacgcttctgcccacttactggccagggctacacctccgtctacagccacaccacccgaaactcggcaggcaagaagctggtccggcctgacaaggcgaagacacaggacacaggccaccgccgaggaggaggaggaggagcaggtttcagaggtgccgggaagtctgagccttcgccctcctgctctccctccatgtccacctaggaggctgcctacacctgggcaagggcacccgggctcggctggatttccaggaagacccaccctatgacgactgcccccactcccagaccctccccccagcctgggattgagccctggggatgacccggggttggcaagggaagagctgaaatcgccctgtccttggggaccccaccctttgtgccatctgccgtttccctagtgctgggcatccagtcagccctcaataaatgcttatgaatggatcaacaaca

SEQ ID NO: 2484 - DNA, 3055 bp, Homo sapiens
atgtccgctttctgcctgggcttggtcggccgcgcttcagcacccgccgagccggacagcgcctgctgcatggagctgcccgccgcggccggggacgcagtccggagtcccgccgccgccgccgccctcatcttccccgggggctccggggagctagaactggcgttagaggaggagctggcgctgctggcggccggggagcggccgtccgaccccggggaacaccctcaggccgagcctgggtctctggccgagggggccggaccgcagccgccgccctcccaggaccccgagctgctgtcggtgatccgacagaaggagaaggatctggtgttggcggcccggctgggtaaggcgctgctcgagaggaaccaggacatgagccggcagtacgagcagatgcataaggagctgacagacaagctcgagcacttagagcaagagaaacatgaattgagaagacgatttgagaaccgagaaggggagtgggaaggccgagtgtcagagctggagagtgatgtgaagcagctacaggatgagttggagaggcagcagattcatctgcgggaagcagatcgagaaaaatcacgggctgtccaggaactgtcggaacagaaccaaaggctattggatcagctcagcagggcatcagaagttgagagacaactctccatgcaggtccacgccctcagagaagactttcgggagaaaaactcatcaaccaaccagcacattatccggctggagagccttcaggccgagatcaagatgctgtcagatcggaaacgggagctggagcatcgtctcagcgctactttagaggaaaatgacctgctccaagggaccgtggaggagctacaggaccgggtgctaatcctggagaggcagggccatgacaaggacctacagctgcaccaaagccagctggagcttcaggaggtgcgtctctcctgccgacagctgcaggtgaaggtggaagaactcactgaggagaggagtctgcagagctctgccgccaccagcacatccctcctgtcagagatcgagcagagcatggaggctgaggagctggagcaggagcgagagcagctgagactgcagctctgggaagcctactgccaggttcgctatctgtgctcacaccttcgaggcaatgacagtgctgactcagccgtctccacggactcctccatggacgagtcttcagaaacctcgtccgccaaggatgtgccagccggcagcttgcgcactgccctcaatgagctcaagagactgatacagagcattgtggatggcatggagcccacggtgacactgctgagtgtggagatgactgccctaaaagaggagagagaccgactcagagtcacttctgaggacaaggagccaaaggagcagcttcagaaggccatcagggaccgcgacgaggccattgcaaagaagaatgctgtggagctggaacttgccaagtgcaggatggatatgatgtctctgaacagccagttgctggatgccattcagcagaaactgaacctctcgcagcagctggaagcttggcaggatgacatgcacagggtcattgaccggcagctgatggacacgcacctgaaagaacggagccagccggctgctgccctctgcaggggccacagcgctgggcggggggatgagcccagcatcgctgaaggcaaacgactcttctcattcttcaggaaaatttaagttgggaggagtcaggccaccaaagatgggtggactggaggcagctggaaaggcggtgcaggcaaggcctcccctgcagcttgcacctcagcagctgccctgcccctcatgctagggccccatgggtccgggagggcctgctccctttcgtcggtggggatggagacctagaggtgggggcctgccttggccactgaaggcttcccttggcccaccgcctggccaagcccacgcctgggcttctccaggaccacgtgcttgagcagggttaggccacctcccagaggggccccttggtgttgggctttgcagctcacacccaacagatcgcagcccacccccaggcactgctgcctccttgattttagcaaatggggaacagaaggaatggaggcccttctctgcatgcctcaggaggcctgagccccaggggcctagacctgtgggggcagcgggccaggcctgagcctccattccttccccagcccctggcccagggtcaaaggagagatggcagcccctcccccgcatgcatgcacctcagctggcaggaggccaagcctctggccgcagggtctaagagccggggcttacccaagctcagctgaggccacccgagccccagggaggaagaaggccctgtccccctgtcgccactgctctccctcccagccttcagtctctgccccttagcagggcctggccaggcagagtgttatcaccagtcatctgcaggctttagccatccagccctttcccctgctcagggctggggttggacggggtctcctcctcccacagctccctcctccacccctcacatacatacataatttcttggcctagccaaacaagtccaggccactgaatggcaccagaggggtctgtggtcagccaccccaccttgagggcagcacaggcaccacggggtggaggggagggggaggctgccggaagcctccagatgctgcctgcctgcctgcagaagcctgcagtggctgctgctcctgcctctgcagccgcccctcctcctccacccaggccccaactcagaggctccgcggcccggccagccctcagctgctcacaaccgattcagtctccctccctccctcacgtggggaaagcacagcagggatgcgcggcaagaatgtacctgtagatgtgtacataccacagtgctgtaattttgtatgtagcaatcatgtaaatacatgtatggattttataatatacatatataaaaatctataaaggcatatttttagaaaaacagcacaccactgcttcttttgaaaatagtctgaataagaataaaatgaatttctacaga

SEQ ID NO: 2485 - DNA, 4487 bp, Homo sapiens
caggaaactccagcacctcctagaacatcttttgtggaatggcacctcatgggggcccttggatcatgtaccccttgtattcaacagtaaacatcttcctataatcattgcttcattaacgataatgtttatcatttaaaagtgcctgtgtgaagtcacttttgctggaaaactgcagcttgggagctttctttgtattcacatcccactcttctgtcaagtacactttaccctgaccttatgagtggatgaagatacctcagttgtctgactttgccaattgcttaatttcagaatttaaaaaggggaaagaaaaacatcctgctaaaatatgaacatctgagtgtcttattttccaacatcgtcaatagctgtgagcgtcagcattaaatattctcccaaggagtgccatgatattgaagtcactttattaataacagctgtatctgcaaaacagtcaagagactcggacgttgaaagccagagatgacactgagcatgcttttattgcggcctaccatctttaagtgggacatattgattgatgagtgattgcctgtccatacactctctcatcatcctgttccttggattggacttcactaagcaatttatcactcaccttcagacttacatgtgggagttttcacaacagtagttttggaatcattagaacttggattgatttcatcatttaacagaaacaaacagcccaaattactttatcaccatggctttgaacgttgccccagtcagagatacaaaatggctgacattagaagtctgcagacagtttcaaagaggaacatgctcacgctctgatgaagaatgcaaatttgctcatccccccaaaagttgtcaggttgaaaatggaagagtaattgcctgctttgattccctaaagggccgttgttcgagagagaactgcaagtatcttcaccctccgacacacttaaaaactcaactagaaattaatggaaggaacaatttgattcagcaaaaaactgcagcagcaatgcttgcccagcagatgcaatttatgtttccaggaacaccacttcatccagtgcccactttccctgtaggtcccgcgatagggacaaatacggctattagctttgctccttacctagcacctgtaacccctggagttgggttggtcccaacggaaattctgcccaccacgcctgttattgttcccggaagtccaccggtcactgtcccgggctcaactgcaactcagaaacttctcaggactgacaaactggaggtatgcagggagttccagcgaggaaactgtgcccggggagagaccgactgccgctttgcacaccccgcagacagcaccatgatcgacacaagtgacaacaccgtaaccgtttgtatggattacataaaggggcgttgcatgagggagaaatgcaaatattttcaccctcctgcacacttgcaggccaaaatcaaagctgcgcagcaccaagccaaccaagctgcggtggccgcccaggcagccgcggccgcggccacagtcatggcctttccccctggtgctcttcatcctttaccaaagagacaagcacttgaaaaaagcaatggtaccagcgcggtctttaaccccagcgtcttgcactaccagcaggctctcaccagcgcacagttgcagcaacacgccgcgttcattccaacagataattctgaaataatcagcagaaacggaatggaatgccaagaatctgcattgagaataactaaacattgttactgtacatactatcctgtttcctcctcaatagaattgccacaaactgcatgctaaataaagatgtagttcttctggacagaccacaactctaagaagctagtgctgctatctcatatatgagtattaaatatggtatgcttagtatattccaacctaagatagttaactacctgagaccagctgtgatgtttaaagacataaaggataaagtttacttttaaagggtttctaaacatagtttctgtcctaggaatattgtcttatctccataactatagctgatgcagaaagtccagccagtttactcatttcgattcagaatatttcaaatttagcaataaacaattagcattagttaaaaaagaaacatattccaagggcaggttcgattctagctctaattactgtcatgtcatttacccactggatcaaagggtatgtttcacttcttgacaatataaatgctgcagcaaagatgagaggtgaagtaaaaccgatacctgtcctgcaggtctaaaatttgaatggaaattcaagcacaagtactggggacacatcaaagtgtggtgtttggtttgcctggagatgccacgttgaatcatgtgattctagattaacattaaatagattgaaaaagaaactttgcacggtatgagcttcataccccaccaaacaaagtcttgaaggtattattttacaagtatatttttaaagttgttttataagagagactttgtagaagtgcctagattttgccagacttcatccagcttgacaagattgagaggcccatgccaacagtctaatctaagagattagtctttcaaactcaccatccagttgcctgttacagaataactcttcttaactaaaaacctagtcaaacaaggaagctgtaggtgaggagatctgtataatattctaatttaagtaagtttgagtttagtcactgcaaatttgactgtgactttaatctaaattactatgtaaacaaaaagtagatagtttcactttttaaaaaatccattactgttttgcatttcaaaagttggattaaagggttgtaactgactacagcatggaaaaaaatagttcttttaattctttcaccttaaagcatattttatgtctcaaaagtataaaaaactttaatacaagtacatacatattatatatacacatacatatatatactatatatggatgaaacatattttaatgttgtttacttttttaaatacttggttgatcttcaaggtaatagcgatacaattaaattttgttcagaaagtttgttttaaagtttattttaagcactatcgtaccaaatatttcatatttcacattttatatgttgcacatagcctatacagtacctacatagtttttaaattattgtttaaaaaacaaaacagctgttataaatgaatattatgtgtaattgtttcaaacatccattttctttgtgaacatattagtgattgaagtattttgacttttgagattgaatgtaaaatattttaaatttgggatcatcgcctgttctgaaaactagatgcaccaaccgtatcattatttgtttgaggaaaaaaagaaatctgcattttaattcatgttggtcaaagtcgaattactatctatttatcttatatcgtagatctgataaccctatctaaaagaaagtcacacgctaaatgtattcttacatagtgcttgtatcgttgcatttgttttaatttgtggaaaagtattgtatctaacttgtattactttggtagtttcatctttatgtattattgatatttgtaattttctcaactataacaatgtagttacgctacaacttgcctaaaacattcaaacttgttttcttttttctgtttttttctttgttaattcatttaaactcattgaaaacatagtatacattactaaaaggtaaattatgggaatcactgaaatatttttgtagattaattgttgtaacattgtctttcttttttttcttttgtttcatgattttgatttttaaaattattagcacacaactattttcagccctttaataatggagcatcaaaaacatcacctgtaaccccaagcaaatatagaagactgtattttttactatgatatccattttccagaattgtgattacaatatgcaaagagtcataaatatgccatttacaataaggaggaggcaaggcaaatgcatagatgtacaaatatatgtacaacagattttgctttttatttatttataatgtaattttatagaataattctgggatttgagaggatctaaaactatttttctgtataaatattatttgccaaaagtttgtttatattcagaagtctgactatgatgaataaatcttaaatgctttgtttaattaaaaaacaaaaatcaccaatatccaagacatgaagatatcagttcaacaaatactgtagttaagagactaactctccacttgtatgggaactacatttcactcttggttttcaggatataacagcacttcaccgaaatattctttcagccataccactggtaacatttctactaaatctttctgtaacacttaaagaattccctcattcattaccttacagtgtaaacaggagtctaatttgtatcaatactatgttttggttgtaatattcagttcactcacccaatgtacaaccaatgaaataaaagaagcatttaaaagga

SEQ ID NO: 2486 - DNA, 3702 bp, Homo sapiens
aggaaatttcggggaaccaaaaaaggctggaagaacatgaagatggagcagtcataaaccacccactcaaggaccatctccttcaggaccatccacacgagactcagattgtctgaattgagctatcgcaacttaatgctaaaagctccttaaagctacagatttatgacatagttccttccaaaatattacatcataaatcattgagaagattaaaaaaaaacacttgaagaaattgtagttttaaacatctctgcatatattttggatagctactaggttactttaactgtcattaaggagcacagacttactgaagctttactggacagaatcctgggaaatcgatatcattataaggttatatttcccagttagcgggtgaagggctggagaccttattgcagtcatggctttcacaaattacagcagtctgaatcgagctcagctaacctttgaatatctgcacacaaattcaaccactcacgaattcttgtttggtgcccttgctgaactggttgataatgcaagagatgctgatgccaccagaatagatatttatgcagaaagacgagaggaccttcgaggaggatttatgctttgctttttggatgatggagcaggaatggatccaagtgatgctgccagtgtgatccagtttgggaagtcggccaagcgaacacctgagtctactcagattgggcagtacgggaatgggttaaaatcgggctcaatgcgcattgggaaggattttatcctgttcaccaagaaggaagacaccatgacctgcctcttcctgtctcgcacgtttcatgaggaagaaggcattgatgaagtgatagtcccactgcccacctggaatgctcggacccgggaacctgtcacagacaatgtagagaaatttgccattgagacagaactcatctataagtactctccattccgcactgaggaggaagtgatgacccagtttatgaagattcctggggacagcggaacattggtgatcatcttcaatctcaaactcatggataatggagagccagaactagacataatctcaaatccaagagatatccagatggcagagacgtccccagagggcacgaagccagagcggcgctcgttccgtgcctatgccgctgtgctctatattgatccccggatgaggatcttcatccatgggcacaaggtgcagaccaagaggctctcctgctgcctgtacaagcccaggatgtacaagtacacgtcaagccgtttcaagacccgtgcggagcaggaggtgaagaaagcagagcacgtagcaaggattgctgaagagaaggcgcgggaggcagagagcaaagctcggacattagaagtacgcctaggtggagacctcacgcgggactccagggtgatgttgcgacaggtccagaacagagccatcactctgcgcagagaagccgatgtcaagaagaggatcaaggaggccaagcagcgagcacttaaagaacctaaggaactgaattttgtttttggtgtcaacattgaacaccgggatctggatggcatgttcatctacaactgtagccgactgatcaaaatgtatgagaaagtgggcccacagctggaagggggcatggcatgtggcggggttgttggggttgttgatgtgccctacctggtcctggagcctacacacaacaaacaggactttgctgatgccaaggagtaccggcacctgctccgagcaatgggggagcacctggcgcagtattggaaggatattgccatcgcccagaggggaatcatcaagttctgggatgagtttggctacctctctgccaactggaaccagcccccatccagtgagctgcgttacaaacgccggagagctatggaaatccccaccaccatccagtgcgatttgtgtctgaaatggagaaccctccccttccagctgagttctgtggaaaaagattaccctgacacctgggtttgctccatgaaccctgatcctgaacaggaccggtgtgaggcttctgaacaaaagcagaaggttcccctgggaacattcagaaaggacatgaagacgcaggaagagaagcagaaacaactgacagagaaaattcgccagcagcaggagaagctggaggcccttcagaaaaccacacccatccgctcccaagcagacctgaagaaattgcccttggaagtgaccaccagaccttccactgaggaacctgtgcgtagacctcagcgtcctcggtcgccccctttacctgctgtgatcaggaacgcccccagcagacccccttctttgccaactcctagaccagccagccagccccgaaaggctcctgtcatcagcagtaccccaaagctccctgctttggcagcccgggaggaggccagcacatctaggctgctccagccacctgaggcaccccgaaagcctgccaacactctcgtcaagactgcatcccgacctgcccctctggtgcagcaactgtcaccatctttactgcccaactccaagagccctcgggaggttccttctcccaaagtcatcaagactccagtggtgaagaagacagagtcacccatcaaactctccccggctacccctagtcggaagcggagtgtcgcagtttctgatgaggaagaagttgaggaggaagctgagaggaggaaggagaggtgcaagcggggcagatttgttgtgaaggaggaaaagaaggactcgaatgagctctcagacagtgctggggaagaggactcggctgacctcaagagagctcagaaagataaagggctgcacgtggaggtgcgtgtgaacagggagtggtacacgggccgtgtcacagccgtggaggtgggcaagcatgtggtgcggtggaaggtgaagtttgactacgtgcccacagacacgacaccaagagaccgctgggtggagaaaggcagtgaggatgtgcggctgatgaaacccccttctccggaacatcagagccttgatacacaacaggagggcggggaggaggaggtgggccctgtggcccagcaggccatagctgtcgcagagccctccacttccgaatgcctccgcattgagcctgacaccactgccctgagcaccaatcacgagaccatcgacctgcttgtccagatcctccggaattgtttacggtacttcctgcctccaagtttccccatctccaagaagcagctgagtgctatgaattcagatgagctaatatcttttcctctgaaggagtacttcaagcaatatgaagtagggctccaaaacctgtgcaattcctaccagagccgtgctgactcccgggccaaggcctccgaggaaagcctgcgcacctccgagaggaagctccgcgagacggaggagaagctgcagaagctgaggaccaacatcgtggcactcctgcaaaaggtgcaggaggacatagacatcaacacagatgatgagctggacgcctacattgaggacctcatcaccaagggggactgaaggcaggagagagagcagctcccctgcccacctgcccctcaaccctgtagctgcagggggaggggacttcattcatgggttggtggtcgcaccttggtttgacttacacgggacatttgtgtttttggaggaaaagataccctgattctttgaatcttccttaagtttataaatatttattttttaaaagaaga

SEQ ID NO: 2487 - DNA, 6333 bp, Homo sapiens
agtgctgagcgaaccggaagtcggtccgcggcgttttctgcccgcggtgcgcagcgctgagtgtcgcggcagcagcctgtgcttgcgcctcaagtctttccgaggggccagtgggcagcgcgggcctcggggtcctggggcgagacgcttgttctaaagacgaaggggaactccctagtgctacaggctgtttcaggaagccaattaattttgtacacataatacttaattaccttctaataattggagcagaagatgaacccaactaatcctttcagtgggcagcagcctagtgctttttcggcgtcttctagtaatgtaggaacacttccatctaagccgccatttcgatttggtcaaccttctctttttggacaaaacagtaccttatctgggaagagctcgggattttcacaggtatccagctttccagcgtcttctggagtaagtcattcctcttcagtgcaaacattagggttcacccaaacctcaagtgttggacccttttctggacttgagcacacttccacctttgtggctacctctgggccttcaagttcatctgtgctgggaaacacaggatttagttttaaatcacccaccagtgttggggctttcccaagcacttctgcttttggacaagaagctggagaaatagtgaactctggttttgggaaaacagaattcagctttaaacctctggaaaatgcagtgttcaaaccaatactgggggctgaatctgagccagagaaaacccagagccaaattgcttctgggttttttacattttcccacccaattagtagtgcacctggaggcctggcccctttctcttttcctcaagtaacaagtagttcagctaccacttcaaattttaccttttcaaaacctgttagtagtaataattcattatctgcctttacccctgctttgtcaaaccaaaatgtagaggaagagaagagaggacctaagtcaatatttggaagttctaataatagcttcagtagcttccctgtatcatctgcggttttgggcgaacctttccaggctagcaaagcaggtgtcaggcaggggtgtgaagaagctgtttcccaggtggaaccacttcccagcctaatgaaaggactgaaaaggaaggaggaccaggatcgctccccaaggagacatggccacgagccagcagaagattcggatcctctgtcccggggcgatcatcctccagacaaacgacctgtccgcctgaatcgaccccggggaggtactttatttggtcggacgatacaggatgttttcaaaagcaataaggaagtaggtcgtctgggcaacaaggaggccaaaaaggaaactggctttgttgagtctgcagaaagtgaccacatggctatcccaggagggaatcagtctgtcctggcaccttcccggattccaggtgtgaataaagaggaagaaactgaaagtagagagaagaaagaagattctctaagaggaactccggcgcgtcagagtaacagaagcgagagcacagacagtcttgggggcttgtctccctctgaagtcacagccatccagtgcaagaacatccctgactacctcaacgacaggaccattctggagaaccattttggcaaaattgctaaagtgcagcgcatctttaccaggcgcagcaaaaagcttgcagtggtacatttctttgatcatgcatctgcagccctggctagaaagaaggggaaaagtttgcataaagacatggctatcttttggcacaggaagaaaataagccccaataagaaacccttttccctgaaggagaagaaaccaggtgacggtgaagtcagcccgagcacagaggatgcaccctttcagcactctcctcttggcaaggccgcagggaggactggtgctagcagcctcctgaataaaagctctccagtgaagaagccaagtcttctaaaggcccaccaattcgagggagactcttttgactcagcctccgagggctccgagggcctcgggccatgtgtgctctccctcagtaccctgataggcactgtggctgagacatccaaggagaagtaccgcctgcttgaccagagagacaggatcatgcggcaagctcgggtgaagagaaccgatctggacaaagcgaggacttttgttggcacctgcctggatatgtgtcctgagaaggagaggtacatgcgggagacccgtagccagctgagcgtgttcgaagtggtcccagggactgaccaggtggaccacgcagcagctgtgaaagagtacagtcggtcctcggcggatcaggaggagcccctgccccacgagctgcggcccttgccagtgctcagcaggaccatggactacctggtgacccagatcatggaccagaaggagggcagcctgcgggattggtatgacttcgtgtggaaccgcacgcgtggcatacggaaggatatcacgcagcagcacctctgtgaccccctgacggtgtccctgattgagaagtgcacccggtttcacatccactgtgcccacttcatgtgtgaggagcccatgtcctcctttgatgccaagatcaataatgagaacatgaccaagtgcctgcagagcctgaaggagatgtaccaggacctgagaaacaagggtgtcttctgtgccagcgaagcggagttccagggctacaatgttctgctcagtctcaacaagggagacatcctaagagaagtacaacagttccatcctgctgttagaaactcatctgaggtgaaatttgctgttcaggcttttgctgcattgaacagtaataattttgtgagatttttcaaactggtccagtcagcttcttacctgaacgcttgtcttttacactgttacttcagtcagatccgcaaggatgctctccgggcgctcaactttgcgtacacggtgagcacacagcgatctaccatctttcccctggatggtgtggtgcgcatgctgctgttcagagactgtgaagaggccaccgacttcctcacctgccacggcctcaccgtttccgacggctgtgtggagctgaaccggtctgcattcctggaaccagagggattatccaagaccaggaagtcggtgtttattactaggaagctgacggtgtcagtcggggaaattgtgaacggagggccattgccccccgtccctcgtcatacccctgtgtgcagcttcaactcccagaacaagtacatcggggagagcctggccgcggagctgcccgtcagcacccagagacccggctccgacacagtgggcggagggagaggagaggagtgtggtgtagagccggatgcacccctgtccagtctcccacagtctctaccagcccctgcgccctcaccagtgcctctgcctcctgtcctggcactgaccccgtctgtggcgcccagcctcttccagctgtctgtgcagcctgaaccaccgcctccagagcccgtgcccatgtactctgacgaggacctggcgcaggtggtggacgagctcatccaggaggccctgcagagggactgtgaggaagttggctctgcgggtgctgcctacgcagctgccgccctgggtgtttctaatgctgctatggaggatttgttaacagctgcaaccacgggcattttgaggcacattgcagctgaagaagtgtctaaggaaagagagcgaagggagcaggagaggcagcgggctgaagaggaaaggttgaaacaagagagagagctggtgttaagtgagctgagccagggcctggccgtggagctgatggaacgcgtgatgatggagtttgtgagggaaacctgctcccaggagttgaagaatgcagtagagacagaccagagggtccgtgtggcccgttgctgtgaggatgtctgtgcccacttagtggacttgtttctcgtggaggaaatcttccagactgcaaaggagaccctccaggagcttcagtgcttctgcaagtatctacagcggtggagggaagctgtcacagcccgcaagaaactgaggcgccaaatgcgggctttccctgctgcgccctgctgcgtggacgtgagcgaccggctgagggcgctggcgcccagcgcagagtgccccattgctgaagagaacctggccaggggcctcctggacctgggccatgcagggagattgggcatctcctgcaccaggttaaggcggctcagaaacaagacagctcaccagatgaaggttcagcacttctaccagcagctgctgagtgatgtggcatgggcgtctctggacctgccatccctcgtggctgagcacctccctgggaggcaggagcatgtgttttggaagctggtgctggtgttgccggatgtagaggagcagtccccagagagttgtggcagaattctagcaaattggttaaaagtcaagttcatgggagatgaaggctcagtggatgacacatccagcgatgctggtgggattcagacgctttcgcttttcaactcacttagcagcaaaggggatcagatgatttctgttaacgtgtgtataaaggtggcccatggcgccctcagtgatggtgccattgatgctgtggagacacagaaggacctcctgggagccagtgggctcatgctgctgcttccccccaaaatgaagagtgaggacatggcagaggaggacgtgtactggctgtcggccttgctgcagctcaagcagctcctgcaggctaagcccttccagcctgcgcttcctctggtggttcttgtgcctagcccaggaggggacgccgttgagaaggaagtagaagatggtctgatgctacaggacttggtttcagctaagctgatttcagattacactgttaccgagatccctgataccattaatgatctacaaggttcaactaaggttttgcaagcagtgcagtggctggtttcccactgcccccattcccttgacctctgctgccagactctcattcagtacgtcgaagacgggattggccatgagtttagtggccgctttttccatgacagaagagagaggcgtctgggcggtcttgcttctcaggagcctggcgccatcattgagctgtttaacagtgtgctgcagttcctggcttctgtggtgtcctctgaacagctgtgtgacctgtcctggcctgtcactgagtttgctgaggcagggggcagccggctgcttcctcacctgcactggaatgccccagagcacctggcctggctgaagcaggctgtgctcgggttccagcttccgcagatggaccttccacccctgggggccccctggctccccgtgtgctccatggttgtccagtacgcctcccagatccccagctcacgccagacacagcctgtcctccagtcccaggtggagaacctgctccacagaacctactgtaggtggaagagcaagagtccctccccagtccatggggcaggcccctcggtcatggagatcccatgggatgatcttatcgccttgtgtatcaaccacaagctgagagactggacgcccccccggcttcctgttacatcagaggcgctgagtgaagatggtcagatatgtgtgtatttttttaaaaacgatttgaaaaaatatgatgttcctttgtcgtgggaacaagccaggttgcagacgcagaaggagctacagctgagagagggacgtttggcaataaagccttttcatccttctgcaaacaattttcccataccattgcttcacatgcaccgtaactggaagaggagcacagagtgtgctcaagaggggaggattcccagcacagaggatctgatgcgaggagcttctgctgaggagctcttggcgcagtgtttgtcgagcagtctgctgctggagaaagaagagaacaagaggtttgaagatcagcttcagcaatggttgtctgaagactcaggagcatttacggatttaacttcccttcccctctatcttcctcagactctagtgtctctttctcacactattgaacctgtgatgaaaacatctgtaactactagcccacagagtgacatgatgagggagcaactgcagctgtcagaggcgacaggaacgtgtctaggcgaacgactaaagcacctggaaaggctgatccggagttcaagggaagaggaagttgcctctgagctccatctctctgcgctgctagacatggtggacatttgagcagcctgacctgtggggagggggtctctcccgaagagtttctgtttttactcaaaataatgttattctcagatgcttgatgcactgttggaaatgtgattaatttaatcatgcagataaaccatttaaatgtca

SEQ ID NO: 2488 - DNA, 1030 bp, Homo sapiens
ggagcccggagctgcagccaccggggagccaggtaccttccgcgagacgtcgaggggcgagtcctagtctcttttctccgcactggaagacttgaacacttccttctctggtctctgtcacccaggctggagtgtagtggcgcaatctcagctggctggagccttgacctccttgggctcaagctatcctcccacctcagcctctcaaatagctgggactacaggcagcaaagcacctgctctgagtggccatggggaagcgatacttctgtgactactgcgaccgctccttccaggacaacctccacaaccgcaagaagcacctgaacgggctgcagcacctcaaggccaagaaggtctggtacgacatgttccgagatgcagctgccatcttgctggatgagcagaacaagcggccctgcaggaagtttctactgacaggccagtgcgactttggctccaactgcagattttcccacatgtcagagcgagacctgcaggagctgagcatccaggtggaggaggagaggcgagccagggagtggctactagatgctcctgagctccccgagggccatctggaggactggctggagaagagagccaagcggctgagctcagccccaagtagcagggctgaacccatcagaaccactgtcttccagtaccccgtgggctggccaccagttcaggagctgcctccatccctgcgggcacccccacctggggggtggcctctgcagcccagagtccagtggggctgagccccttgcccccgactgacccccacgtggtcacttttctcatcagtcacaataggaagccaagcccggttcctgctacgccccatggaggctccgagaccatctgcccagcctcactgaggctcaggacacggccacaccaagtgcagccctcgtcctgggtctgcaccgggcagctctcccctcactctcctccacctgcccccctgcttcttaagaagatgggggagaaaacttccaaatgtttataaagaaagtctgtcacc

SEQ ID NO: 2489 - DNA, 410 bp, Homo sapiens
cagacatcaccatcctcctccccagtaccagcccagccacacgccaccatgtgccacaccagctgctccccagcctgccagccaacctgctgcatacacagcccctgccaggcatcctgctatgtgcccgtgagctgccagtcctccgtgtgcatgcccgtgagctgcacgcgcattgtgtgcgtggctccctcctgccagccctccgtgtgcgtgcccgtgagctgcaggcccatcatatatgtgactccctcttgccaatcttcggggtgctgccagcccccctgcaccactgccctctgcagacccatctcctgcagcaccccttcctgctgctgaccagctgctcctggtacacgggggtacacacctgtatccctccgtgaataagcatctggtggacccccaga

SEQ ID NO: 2490 - DNA, 1255 bp, Homo sapiens
tcacacactcacttacacctcccccagctcacctcctccccaccccagcatggccgcgtccaccatgtccatccgctccagcgcttactccgactcctggcaggtggacgactgcccagagagctgctgtgagcccccctgctgcgccaccagctgctgcgccccggccccctgcctgaccctggtctgcaccccagtgagccgtgtatccagcccctgctgccaggtgacctgtgagcccagcccctgccaatcaggctgcaccagctcctgcacgccctcgtgctgccagcagtctagctgccagccggcttactgcacctcctccccctgccagcaggcctgctgcgtgcccgtctgctgcaagcctgtgtgctgcgtgcccgtctgctgtggggcttcttcgtgctgccaacagtctagctaccagccagcttgctgtgcctcttcctcctgccagccggcctgctgtgtgcccgtctgctgcaaacctgtgtgctgtgcgcccacctgctctgaggattcctattcatgctgccaacagtctagctgccagccagcttgctgcacttcctccccctgccagcagtcctactgtgtgcctgtctgctgtaagcctgtctgctgcaaacccatctgctgtgtgcctgtctgctctggggcttcctctttgtgctgccagcagtctggctgccagccggcttgctgcaccacctcctgctgcagaccctcctcctctgtgtccctcctctgccgccctgtgtgcaggcccgcctgctgcgtgcccgtctcctcctgctgtgcccccacctcctcccgccagcccagctattgccgccaggcctcctgtgtgtcccttctctgccgccctgtgtgctcccgcccggcctgctacagcttctcctcaggccagaagtccagctgctgacggtcatgtcccccagggccagccgggctcaggccccacctccctgccagtccttggacctcccagcccacccagcctcagcacagctcaacacagaaggagcagccccagccacagccgcccagccccggggtctcagatgctcactggctcctccctgacctcccccccgggcaggcgagccctggcttctcctcacggtgcttcctggctgcagaccacaaccctccgctggtcgctggttggggacgggccctcctgacccgggtctcacccccagcagcgtcaccctctgcccctgagcaccaataaagcgtctgcggcccc

SEQ ID NO: 2491 - DNA, 5817 bp, Homo sapiens
ctccgcacccgctccccgctcgggccgaggcgccgcggccgcgcgcccctcctggaggaggaggaggaaggaggcgggaggaggagttgccgagaggagaaggcgagcgcggcagtcgcgccggcgctgggcgaggaagcggagccgggccgcctccggaaaatggctccaaaggttaaatgaagcaggaaaaatacatagatgcagccttgcagcctctccagatgtttggggataatattccagatagaaatattgatcccttggattaggtaactagtcataatgaagaaaattagtcttaaaaccttacggaaatcttttaacttgaataaaagtaaagaagaaactgatttcatggtagtacaacaaccatcgctagccagtgactttggaaaagatgattccttatttggtagctgctatggtaaagatatggccagctgcgatatcaacggtgaagatgaaaaaggcggaaaaaacagatcaaaaagcgagagcctgatgggtacgctaaaaaggcggctttctgcaaaacagaagtcaaaaggcaaggcgggcacaccctctgggagctctgccgacgaggacaccttctcctcctcctcagcacccatagtctttaaagacgtgagagctcagaggccgataaggtccacgtcgctccgcagccatcactacagtcccgcgccgtggcctctgcggcccacaaactccgaggagacctgcatcaagatggaggtgagagtcaaggccttggttcactcttccagcccgagtccagccctgaatggcgtccggaaggatttccacgacctccagtctgagaccacgtgccaggagcaagccaattcactgaagagctcggcttctcataatggagacctgcatcttcacctggatgaacatgtgcctgtcgttattggacttatgcctcaggactacattcagtatactgtgcctttagatgaggggatgtatcctttggaaggatcacggagctattgtctggacagctcttctcccatggaagtctctgcggttcctcctcaagtgggagggcgcgctttccccgaggatgagagtcaggtagaccaggacctagttgtcgccccagagatcttcgtggatcagtccgtgaatggcttgttgattggcaccacgggagtcatgttgcagagcccgagagcgggtcacgatgatgtccctccactctcaccattgctacctccaatgcagaataatcaaatccaaaggaacttcagtggactcactggcacagaagcccacgtggctgaaagtatgcgctgtcatttgaattttgatccgaactctgctcctggggttgcaagagtttatgactcagtgcaaagtagtggtcccatggttgtgacaagccttacagaggagctgaaaaaacttgcaaagcaaggatggtactggggaccaatcacacgttgggaggcagaagggaagctagcaaacgtgccagatggttcttttcttgttcgggacagttctgacgaccgttaccttttaagcttgagctttcgctcccatggtaaaacacttcacactagaattgagcactcaaatggtaggtttagcttttatgaacagccagatgtggaaggacatacgtccatagttgatctaattgagcattcaatcagggactctgaaaatggagctttttgttattcaaggtctcggctgcctggatctgcaacttaccccgtcagactgaccaacccagtgtcccggttcatgcaggtgcgctcgttgcagtacctgtgtcgttttgttatacgtcagtataccagaatagacttaattcagaaactgcctttgccaaacaaaatgaaggattatttacaggagaagcactactgaaagattgagaaccctgcatcttgcactttgggaataagaacaagagattgaaatacagtttacaaactttcattgccatcaaaatcttttgctgccataactatttcagttttatgtgtaaaagagtcatcagtttgtttaggggtggggaagtgtcagcaaggtgtcttgggtttattttggttctttaaaaaagggaagtcttgaggttttagaggtgtgaattatgtttcatcaatgtgcagaataatcacaatgtgaattatcaaattctcctcaatgccccccccgcccagtcctttgctgctatccactgtgatttttatgcattaaaagcacatttcatgtgtattcaaccctaagtaaagttgaatgaaacttaacagaatggaaattgctatgtctttttaaatggtccattttcaaaagacagtgttgaataaacatacctgtgtgataaaacacagaatttacatatacactgaagatgagtttttaatctcttactttaaaaagatttatttagaatcgtgaattgacataatcttgggtaatggaacggagatctgcaacatatcttttaacaacacttttttctaaattatttctaaggttgtgctaattcttttggttgtgaaaagttgaatttttctgttgccttcgttttcatcttctagtttgtctattttaataaatggccttacattaaaaaattgtaaagaaatgtataccaccaatttagaaattgttgccttttctgtaattaaactcgggtacaaattggcataacatgaaaacctatggaactagaattattattaaagaaatattagatgatcatagcttcctgtgatagcatttttttgtgtgttacctatccttttggtaaaatgttttatctgtgatttctttagcttagtcaacattttcttgggtgaacttgattgtcaactaattttcataaatggactggattctcttgcaacattaatgtttataaaaagttttaaattgatttgaatagaaagaaaacattgttttaaagttggatttatatttttcttctatgtagttactataaaagtgtgctggatttgaccaatccttacccccactataaagagaacccgtgatgactttagtttaaaaattgtggaaattgtggagcaatttttctcacaatgtgagaaaaattctaaaccatattagataatgtggaagtcatattgtctatcatatatactgccatttaaaaataggtttttaaaatttagctaagtcttaagtaatttgccgttgctaataattttatctccttgagtcggttgttggggagagatgttatattcaataatttttagttattttgtaatgcagagtgtttattcatttcacagttctgcaatggatgtagtattttgggattgccctgtccagaaaattttcagctacacacctttaaaggaaaatgtttctatctcagatgaaacatgtaatttgggatggttcttcctttgtcacttaaaggaagagataggaaaagtctcttacccactttaaacatgagggtaaaggtttaggtcaaacttactggctttgtcattcaagcatatctgaatcctcacttttttctctttgctttttagggtcagaactgagatattaccaagaaaaggcacaatgccataatattatggtgttatggtattttgacttaaaggggaaaaggtacttaattttggtgggatgttgattgtaccttgttaaaaagactctcattttctcatatgttttctcctaataagatggaatatggagtatactgtaataatataagtgttcattataagctatttggattaagaactattgcagagttgtaagcttgttatcaaattaatgcaagacatttaaactatttttttgcaaaactatttatttttaaaacaacttaaagtatatctagggtgagttaaaagtccctgtgcatctatattagatggcaggttttgtcacagagtcactgtgtattaataataaatgttgaaatggcttctccgtgtctccagaagcatttacatgtcctccttgtgagatcatggtgcacagaggtctttggactgccctgaacccgtcttatgtggacataacctattcccttcgttttctcatcatgccatgtgtttaagatctacccgcttagtgtcaagattattgagattttcatctaaatgtttttaaaattgtattttgtgttttagtggaggacagtcttgatactgttctaattcagaaagccaaattttgatgcgcttttgtatattcataatatatactttaatatgccctattctaatctagtttgaaattgttagattctgatagtataatgataaaatcaaactatttgccaaaaagttaaatttacaagcagaaagatgttttgcgatattttctacttttgtgtagaaagataaccatttggggtaggcagcacaacagaatgtgaaagattggctttatatgatactaacacagtccagttaaaagtggaaacagggaaaagagagagagaaaactcatcatttagtttggtctagacacaatttggttaaattttaggattctattggcagttaacatagatgacatggacacagcctatgagtgctttttaaatacgtgcttctaaaaatctgagctcaaagcaagaaaaagaaaacaggaaagctgtatccatttgccataatagatgaatcagaattgttttctattaaatatttcatcacgaaatatgatggaggccagaagctatttttaggcttactataacactattatgcatttttataaataagaagaaggctgtagaaagtacttgaaaaatatctaattctctttctgtctaaggaaaactctttctacttggtgcaataatctgaaaatttagaaggtcaaaatatgtcacaggaaatgatcatagacctaaaaatagtttttaaggaaaccagctacacggggcaaccaaccatcttgctgttgaagaaaacagttccaaaaggctaaatcattggcataaaggaaacaaaacccaaagtatgcgttgtaattcttgagccagtattactgaaacaggataaaagttataaaatctaacataggttaatgcaatgtctctgctagtgctacaagtctaaaatatctttgtaacaatgctttcagaaatgccagttttaattacatttcacattgtatatgagagatactgctttatgaatgaatcggaataatacattttcatttaaatcttaattgcttttcattaaatgcgaagtcttaatttcaaaatgaaatcacactaccagcaatagacagttttcttgaaaactctaataaggaacaatagccagttccgtaaataactttaaaattctaaaagtgttggtacactagcaatcacaaatatggtttcttttaatacttttttaatcctgtaaagaagggtttttataaacattctttttattaatcagtcataacatggcgaagtgtgtagttgctgtttctgaaaagtgatccaaactctacatccagagattatgaaaaattcttatagaattttgtaacaagtatttacatgttgggtgaaagaaatttcatagtcgttggagtgccatgaaattaatacttgcaattcagattgcggtagtttacactttttctgtatgtttcaaatcaggtgtgtaccatttgtactgagaacaccacagaatgaattatccaaagtccattgattttaatacgtgttttggtttgtaaacaaattatagtaatttcttgcacatttttggaaattaattgtataagaatttatgtatctgcttctagatacagtgtgtaaataaaaaatttcgttcacaagac

SEQ ID NO: 2492 - DNA, 3361 bp, Homo sapiens
ctgccggactgacgggcggccgggcggtgcgcggcggcggtggcggcggggaagatggcggcgtcctccctggaacagaagctgtcccgcctggaagcaaagctgaagcaggagaaccgggaggcccggcggaggatcgacctcaacctggatatcagcccccagcggcccaggcccaccctgcagctcccgctggccaacgatgggggcagccgctcgccatcctcagagagctccccgcagcaccccacgccccccgcccggccccgccacatgctggggctcccgtcaaccctgttcacaccccgcagcatggagagcattgagattgaccagaagctgcaggagatcatgaagcagacgggctacctgaccatcgggggccagcgctaccaggcagaaatcaacgacctggagaacttgggcgagatgggcagcggcacctgcggccaggtgtggaagatgcgcttccggaagaccggccacgtcattgccgttaagcaaatgcggcgctccgggaacaaggaggagaacaagcgcatcctcatggacctggatgtggtgctgaagagccacgactgcccctacatcgtgcagtgctttgggacgttcatcaccaacacggacgtcttcatcgccatggagctcatgggcacctgcgctgagaagctcaagaagcggatgcagggccccatccccgagcgcattctgggcaagatgacagtggcgattgtgaaggcgctgtactacctgaaggagaagcacggtgtcatccaccgcgacgtcaagccctccaacatcctgctggacgagcggggccagatcaagctctgcgacttcggcatcagcggccgcctggtggactccaaagccaagacgcggagcgccggctgtgccgcctacatggcacccgagcgcattgaccccccagaccccaccaagccggactatgacatccgggccgacgtatggagcctgggcatctcgttggtggagctggcaacaggacagtttccctacaagaactgcaagacggactttgaggtcctcaccaaagtcctacaggaagagcccccgcttctgcccggacacatgggcttctcgggggacttccagtccttcgtcaaagactgccttactaaagatcacaggaagagaccaaagtataataagctacttgaacacagcttcatcaagcgctacgagacgctggaggtggacgtggcgtcctggttcaaggatgtcatggcgaagactgagtcaccgcggactagcggcgtcctgagccagccccacctgcccttcttcaggtagctgcttggcggcggccagccccacagggggccaggggcatggccacaggcccccctccccacttggccacccagctgcctgccaggggagacctgggacctggacggccacctaggactgaggacagagagtggggggtgcccacccaccccccccgccccgggcctaccaagcccccgcccttcccaccccggggtcagccggccgtgtgcgtcccccgacagacactgtgaacggaagacagcaggccgcgatcagagtcgctgttcattcagccgcagcctctgggccggggcggcccccaggggccaggagagagccctggagtcccgcagccaccatgcacgctcccagcgtgctgtgtccttcgccactcccacgcgcccgttcctcttccgtcgccctctgtcccctgctctacctctctgtccttgtctggctctcccgtcaccctccctgcctctgtctctcttctggcctgagcctgggcccagccacctcctgacgggtcccctgggtctgcataggtctcccatggcgcaatgagtcagtggcccccagccaggcagtgtgggcattgccactgcggctggacggggctgcgcgctcgcgctctctctctctctctctctctctctttgatctcagggggtcctttttggagtttattgtattttattgtacttggtggggtgtttggggtgggggcggaggagagcttgttctcgtggggttgtcggtaccttcagaaacttttaccaaagtcacgattagctgcttgtggtggggccccaaccgccctcgggcactggggagctgggctggggctgctgctctggggtctccgggggccacagcttggggtgagttgaagacctcaggggatgtggaggggtctgcggggccctggccgcacaggatggccttcagggaaggtggtcttggggcatggtgcagagcaggtgaccggagggaatcggtgacggagcggggccaagggaggggtccggagggagtcagggatggagggcagagggagtggatgtgggggtttgaggacgtgtgacaagctccagcaggggtgggggccgggctgagggtgggggtgcgaggtggtcactcccatcgtgcccctggccgtccctccactcacccacacctggcccagtccacgttgaggtccaggactgggaaggaccgggtgagtgcaccggggacccaggccaggtgccccccggagcctgctggggtggccagagcaggagggggtgtgtttcctttttgtgggtgttgcatgcaaatcaagtggacaagaaaaaataacaaaacaaaaaacaagaaaaaaaaaacacaaaaccccgtaaaatcacaaagaaaatccaacaccaaaggcgcagaagccggctggccgtggtgggggcagcgtaggcgtagcatccctctcctctcacttagcctgttgactcttgttattatcatgatattcacaaaacgccgcatgtttaaaaagtcatagatgtcatcttctctctgcccccagggaggaaagccaccttctcttgccccttggcccctttgtcaggggccaggggtctgccgggtgggggtgccaacaggcctggccctttcctcccctgcatccagccatgggggcctctgcgattgccggaaggttgcatggctggtcccagggccagcacaggcccgaggccgggctgcctggttttatttttatttaactttattttctgttttatgagtgtgtgtccgcccacccccacccccttcagtgttaagtggggagccctgggggagtctctcctgcctcccagcctctcccaagacctcccccctcgtcaccagccatccctctggaccaggcagagggcggaccgggtgggcaggggcctgagggtggctcgggccagcccaccagccaatggacccctcctcaggccgccagtgtcgccctgcccctttttaaaacaaaatgccctcgtttgtaaacccttagacgcttgagaataaaccccttccttttcttcca

SEQ ID NO: 2493 - DNA, 2224 bp, Homo sapiens
agaccagaaacggaagagagcgcgggggatgtgtttggcgtggggcgcactgttcagttgctctcctggatggctttatgtctccgcggtgtttcctagagtctcggcgtttctacctcttcgcaccctttcctgccaccctttgtcccctggaagcccggagacatcagcggctgcaattttgctactcgctgctcggcgtggaactgtcaggacaaaaaataatatccaaagatattttggcactaacggcgctatctgtagcaagaaagttgagcagtgtgaactgttgagacttccaaggagacttcagacaaccaagacagtgtaaaggaaaacagagaaaaagacttgttagacattattaagggcacgaaagttgaattgagcacagtaaatgtacaaacaacaaagccacccaacagaagttcacttaaaagctacaactggcgggcctcaaagagctttaggacatgctccaaagaagagaaatgagcccctgagtcctgagttggtggcagctgcatctgctgctctgttttgacaagcaaacaagccagaactgctcaggcagctccgtagcatgaggaagagtcaggggcacagagagatggagagagacctagttaggaaaaatatattcagggggaagagatgtaatagatttcacattatggcagttactaaagaagcacgtgaacagacacatcaccttcactttgggatatggaatttgataagcagttagccacagaatatgaacaaccccttgagaatgagattgaagaactgatccaggggacaaaagaggggaaactgagagttcccaattaataatgaagcagcttcatatctaagatctctggtggactttttctgcccgtggacgccgctgaagaagcatcgttaaagtctctcttcaccttgccgtcatgtctaagtcagcgtctccaaaagagcccgaacagctgaggaagctcttcattggagggttgagctttgaaacaactgatgagagcctgaggagccattttgagcaatggggaacgctcacagactgtgtggtaatgagagatccaaacaccaagcgctccaggggctttgggtttgtcacatatgccactgtggaggaggtggatgcagctatgaatacaacgccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtaattgaaatcatgactgaccgaggcagtggcaagaaaaggggctttgcctttgtaacctttgacgaccatgactccgtggataagattgtcattcagaaataccatactgtgaagggccacaactgtgaagttagaaaagccctgccaaagcaagagatggctagtgcttcatccagccaaagaggtcgaaggggttctggaaactttggtggtggtcgtggagatggtttcggtgggaatgacaactttggtcgtggaggaaacttcagtggtcgtggtggctttggtggcagctgtggtggtggtggatatggtggcagtggggatggctataatggatttggtaatgatggaagcaattttggaggtggtggaagctacaatgattttggcaattacaacaatcagtcttcaaattttggacccatgaagggaggaaattttggaggcagaagctctggcccctatggcggtggaggccaatactttgcaaaaccacaaaaccaaggtggctatggcgtttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagtgttttaatgtagatttttttttttgcacccatgctgttgattgctaaatgtaatagtctgattgtgacgctgaataaatgtctct

SEQ ID NO: 2494 - DNA, 2202 bp, Homo sapiens
cagggcactgaggagggagttgcgcgcgcgaggcgagggcgatggggccaagaagaaccggggcgatagcgcggcagcggtgacagctgggacccgccgcggtcgggctgccccctcccctcgccccgaccgctcccctgctggtgagggcctgcggaggcggcggcggcggcgcccttggtggcagtggtggcggcggagcagcctcccgggatcgtgtccggagctcgaggagagggtggtgcccggcgagctatgcacgggggcggcggcgtctcctcctgttccgcctcctcagtctcctcggtctcgcagaatccgccggcggcggcggcgccaggacatggagctcgagaacatcgtggccaactcgctgctgctgaaagcgcgtcaaggaggatatggcaaaaaaagtggtcgtagtaaaaaatggaaggagatactgacactgcctcctgtcagccagtgcagtgagcttagacattccattgaaaaggattatagcagtctttgtgacaagcaaccgataggaagacgtctcttcaggcagttctgtgataccaaacccactctaaagaggcacattgaattcttggatgcagtggcagaatatgaagttgccgatgatgaggaccgaagtgattgtggactgtcaatcttagatagattcttcaatgataagttggcagcccctttaccagaaatacctccagatgttgtgacagaatgtagattgggactgaaggaggagaacccttccaaaaaagcctttgaggaatgtactagagttgcccataactacctaagaggggaaccatttgaagaataccaagaaagctcatatttttctcagtttttacaatggaaatggctggaaaggcaacccgtaacaaagaacacatttagacattacagagttctaggaaaaggcggatttggagaggtttgcgcctgtcaagtgcgagccacaggaaaaatgtatgcctgcaaaaagctacaaaaaaaaagaataaagaagaggaaaggtgaagctatggctctaaatgagaaaagaattctggagaaagtgcaaagtagattcgtagttagtttagcctacgcttatgaaaccaaagatgccttgtgcttggtgctcaccattatgaatggaggggatttgaagtttcacatttacaacctgggcaatcccggctttgatgagcagagagccgttttctatgctgcagagctgtgttgcggcttggaagatttacagagggaaagaattgtatacagagacttgaagcctgagaatattctccttgatgatcgtggacacatccggatttcagacctcggtttggccacagagatcccagaaggacagagggttcgaggaagagttggaacagtcggctacatggcacctgaagttgtcaataatgaaaagtatacgtttagtcccgattggtggggacttggctgtctgatctatgaaatgattcagggacattctccattcaaaaaatacaaagagaaagtcaaatgggaggaggtcgatcaaagaatcaagaatgataccgaggagtattctgagaagttttcagaggatgccaaatctatctgcaggatgttactcaccaagaatccaagcaagcggctgggctgcaggggcgagggagcggctggggtgaagcagcaccccgtgttcaaggacatcaacttcaggaggctggaggcaaacatgctggagccccctttctgtcctgatcctcatgccgtttactgtaaggacgtcctggatatcgagcagttctcggtggtgaaagggatctacctggacaccgcagatgaagacttctatgctcggtttgctaccgggtgtgtctccatcccctggcagaatgagatgatcgaatctgggtgtttcaaagacatcaacaaaagtgaaagtgaggaagctttgccattagatctagacaagaacatacataccccggtttccagaccaaacagaggcttcttctatagactcttcagaagagggggctgcctgaccatggtccccagtgagaaggaagtggaacccaagcaatgctgagcaccccggtgcggaccacagagcagaccctggcgccaggaaggagcatgtgttagcgtctcgtcccacctggaattgtaataaatacatctaaataaaacatgccttgggagtgtacagac

SEQ ID NO: 2495 - DNA, 3379 bp, Homo sapiens
agccggcctacaagcttcccccgcccctgagctgtttaaatatgctaatgaaaggatagggcctgaccagtagaacggcgaggcggtgtatcacgtggctcggggacgtgtcaggggcggagcctccgcagcccctgcccgagttaaaaccggagtgtgagagagaaaagcgcttcagtagcgagaggggctgagaaagtggtgacaccgccgggacacgtctgcctctatgaaccagcgcagccatctgggcaccacctacctggacacggccaaaggcgcggtagagaccttcatgaagctccgtgcccgggaccctgccagcagaggagacaggtatatgctggtcactttcgaagagccgccctatgctatcaaggctggatggaaagaaaaccatgcaacgtttatgaatgaattgaaaaaccttcaggctgaaggacttacgactcttggccaatccctaaggacagcttttgatttattaaatttaaatagattagtaactggcatagacaactatgggcagggaagaaacccttttttcttggagccagcaataattatcacaattactgatgggagcaagttgactaccaccagtggagtccaggatgagcttcatttacctcttaattctcctttgcctggaagtgaattgaccaaggaaccttttcgttgggatcagagactctttgcattagtgttgcggttgcctggcaccatgtcagtagaatcagaacagttgacaggtgtgcctttagatgactctgcaatcacaccaatgtgtgaagtgacaggcggccgttcatattctgtgtgttctccaagaatgcttaatcagtgtctggagtccttggtgcagaaagtacaaagtggggtggtaataaactttgaaaaagcaggaccagatccttcccctgtagaagatgggcagccagatatatcaaggccttttggatctcagccttggcatagctgtcacaaactcatatatgtcagaccaaatcctaaaactggggttcctataggtcattggcctgttccagagtctttttggccagatcaaaattcgccaacactaccacctcgtacatctcatcctgtagtgaagttttcctgtacagactgtgaaccaatggttattgataaacttccttttgacaaatatgagttggaaccttcaccactgactcaatttatcctggaaaggaaatctcctcaaacatgttggcaggtgtacgtgagcaatagtgcaaaatacagtgaacttggtcatccttttggttacttgaaagccagtacagcactgaactgtgtcaacttatttgtgatgccttacaattatccagtccttcttcccctcttagatgacttgtttaaagtgcataaagcaaaaccaacattgaagtggagacagtcatttgaaagttatttgaagacaatgcctccctactatcttgggcccttgaagaaagctgttaggatgatgggagcacctaacctaatagcagacagtatggaatatggacttagttacagtgtcatttcatacctcaaaaaactgagtcaacaggccaaaatagaatctgatcgagtcattggatctgtaggcaaaaaagtagtacaggagactggaataaaagtccggagccgatcacatggtttatcaatggcatataggaaagattttcaacaactcctccagggaatttcagaggatgtccctcacagactgctagaccttaatatgaaggaatacactgggttccaagttgctttgctgaataaggatttgaagccacagacatttagaaatgcttatgacataccaagacgaaatcttttggatcacttaacaagaatgagatctaatcttttgaagagcactcgcagatttctgaaaggacaggacgaagatcaagtgcacagtgttcctatagcacaaatggggaactaccaggaatacctcaagcaagtaccttctccactaagagaacttgatcctgatcagccacgaaggttgcatacatttggcaacccctttaagctggataagaagggtatgatgatagatgaagcagatgaatttgtggctggacctcaaaataaacataaacgacccggagaaccaaatatgcaagggatccctaaaagacgtcggtgtatgtctccactactaagaggcagacagcagaatcctgttgtaaacaatcatattgggggaaaaggaccacctgcacctacaactcaagcacagccagatcttattaaacctcttcctcttcataaaatttcagaaaccactaatgattcgataatacatgatgtggttgaaaatcatgttgcagaccaactttcatcagacattacaccaaatgctatggatacggaattttcagcatcttctccagccagtttactggaacggccaaccaatcatatggaggctcttggtcatgaccatttaggaaccaatgacctcactgttggtggatttttagaaaatcatgaggagccaagagataaagaacaatgtgctgaagagaacataccagcatcttcactcaacaaaggaaagaaattgatgcattgcagaagccatgaagaggtcaatactgaactaaaagcacaaataatgaaagagatccgaaagccaggaagaaaatatgaaagaatcttcactttactgaagcatgtgcaaggcagtttacaaacaagactaatatttttacaaaatgtcattaaagaagcatcaaggtttaaaaaacgaatgctaatagaacaactggagaacttcttggatgaaattcatcgaagagccaatcagatcaaccatattaatagcaattaaaagaaaatagaatgtggccacttatttcactatcttcttcaaatacaaagtaaatacaagactgttgtgatcttgcattcattttctgacatgcattgttggctatttgaaatactaaaagcaaatctacagatcctttttccatcattttacagtgaccttttcttcattttggtttatttttgtaatgtgaaaagtatcactctaaaaaacatttttaatttaacaaactaaaaatattcctccaaatctcttgcttgtcattgactcttgcgtgtcaatttccctcaggttctattttcttaaaccaacctttaaaattgtcacctctgttaaggttgaactttgccaaaaaaaaaagaagttactttgtaatttttggggaaaaaagcacatacattaaaactaggtaatgttttgtatatacagttattttggatatattattgtaagttgtacaaatgtattttgaagaatatttaagaaaagcacttttgttattccatcaataaatgctctatttta

SEQ ID NO: 2496 - DNA, 2734 bp, Homo sapiens
aactgttgtggctgccgcattgctcccgccgggctgtagctgagcgcggagcccgtggggaccggtgaggctggctgctggctctaccaggttctgtgctggcatcctgagcactgccaggcacttgaccattgagcagaagatggcagactactcaaacaaactctactatcagttagagcaagaaacagggatccaaacaggttacacaaggacaggctcaatctttctggcccaaactcaggaccgactgatctccctgaagcgcatcaacgcagggctgaatgttataggtatcccttctgagatcatctcccccaagaaagtggccgagcttcaccatctcctcaacgtgcacgacctggtgggggccatgcatgttcccgaggatgcagtggtgtcttccgctgacgtggctcttgccctggcaagtgctgcctcccaaaatggtgttcagatctatgaccggacatctgttcttcatgtaatggtcaaaaaaggtcaagttactggagtggagaccgataaaggacagattgaatgccagtattttgtcaactgtgctggccagtgggcatacgagctgggtctgtccaacgaggagccggttagtatcccgctacatgcctgcgaacacttctacctcctgactcgccccttggagacccctctgcagagcagcacaccaactattgtggatgctgatggaagaatttatattcggaactggcagggtggcatcctgtctgggggctttgagaagaacccgaaaccaattttcactgagggcaagaaccagctggagattcagaatctacaggaagactgggatcactttgagcctctgttgagttcccttctgaggaggatgccagaattagagactctggagatcatgaagttggtgaactgcccagagaccttcacaccagacatgaggtgcatcatgggcgagtctcctgcagtgcagggctactttgtcctggcaggaatgaactctgctggcctttcatttggtggaggagccggaaagtaccttgccgaatggatggtacatggttatccctcagaaaacgtttgggaattggacctgaaacgttttggagccctccagagcagccgcacctttctgcgccaccgggtcatggaagtcatgcctttgatgtatgatctgaaggttccccgctgggacttccagaccggtaggcagttacgcacctctcctctctacgaccggctggatgcacagggagccaggtggatggagaaacatggatttgagaggccaaagtactttgttccccccgacaaggacctcctggcattggagcagagcaagactttctataagccagattggtttgacatcgtggagtctgaagtcaagtgctgtaaggaagctgtgtgtgtcattgacatgtcctctttcacaaagtttgagataacatccactggggatcaggcattagaagttctacagtacctcttctccaatgacctggatgtgcctgtgggccacattgtgcatactggcatgctcaacgagggtggagggtatgaaaatgactgcagcatagcacgactgaacaagcgcagtttcttcatgatctctccaaccgaccagcaggtccactgttgggcctggcttaagaaacacatgccgaaagacagcaacctgctcctggaggacgtcacctggaagtacacagccctcaatctgattggccctcgagctgtggatgtgctgtctgagttgtcctatgcccctatgactccagaccacttcccaagcctcttttgcaaggagatgagtgtgggctatgcaaatgggatccgggtgatgagcatgacgcacacaggagagccaggattcatgctctacatccccatagagtacgccctgcatgtatacaatgaagtgatgagtgttggccagaaatacggaatccggaatgctgggtattacgctcttcgcagtctccgaattgagaagttttttgccttctggggtcaggatataaataacctcaccacgcccctggaatgtggacgagagtctcgggtgaaattagagaagggcatggatttcattggtcgcgacgccctcctgcagcagaagcagaatggagtgtataaacgcctcaccatgttcatcctggacgaccatgattcagacctagacctttggccttggtggggagagcccatttaccggaatgggcagtatgttggcaagaccaccagcagtgcctacagctacagcctggagcgccacgtttgcctgggctttgtgcacaatttttctgaggacacgggggaagagcaagtggtgacagcagatttcatcaaccggggagagtatgagattgacatcgcgggataccgcttccaggccaaggccaagctctaccctgtcgcctccctcttcacccagaagcgccgaaaggatgacatggagctgagtgacttacatgggaagtgatgccaccagggcagcctcacctcctccccatcatcttgtcctagagtgggcgtcaccttggagcttctcttccttccgcctctgttcctcttctggagcctttgcctcccatctcttatctccttgatataattttgaacttgacctactttaaacttttttgctctgcagccttccttgcccttccacctcctcctcctaatattcactctgggctcttcttcccttcccacccctcactcagcttctcgt

SEQ ID NO: 2497 - DNA, 3998 bp, Homo sapiens
cctgcgagattctgtgccccttgtcgggccgcttgtttggctgctgccgtcacctcatggcgacgcgggtagaggaggcagcgcggggaagaggcggcggcgccgaagaggcgactgaggccggacggggcggacggcgacgcagcccgcggcagaagctggaggagagcaggagtgttcagaagcaaatgaagatcctgcagaagaagcaagcccagattgtgaaagagaaagttcacttgcagagtgaacatagcaaggctatcttggcaagaagcaagctagaatctctttgcagagaacttcagcgtcacaataagacgttaaaggaggaaaatatgcagcaggcacgagaggaagaagaacgacgtaaagaagcaactgcacatttccagattaccttaaatgaaattcaagcccagctggagcagcatgacatccacaacgccaaactccgacaggaaaacattgagctgggggagaagctaaagaagctcatcgaacagtacgcactgagggaagagcacattgataaggtgttcaaacataaggaactgcaacagcagctcgtggatgccaaactgcagcaaacgacacaactgataaaagaagctgatgaaaaacatcagagagagagagagtttttattaaaagaagcgacagaatcgaggcacaaatacgaacaaatgaaacagcaagaagtacaactaaaacagcagctttctctttatatggataagtttgaagaattccagactaccatggcaaaaagcaatgaactgtttacaaccttcagacaggaaatggaaaagatgacaaagaaaattaaaaaactggaaaaagaaacaataatttggcgtaccaaatgggaaaacaataataaagcacttctgcaaatggctgaagagaaaacagtccgtgataaagagtacaaggcccttcaaataaaactggaacggttagagaagctgtgcagggctcttcagacagaaaggaatgagctcaatgagaaggtggaagtcctgaaagagcaggtatccatcaaagcggccatcaaagcggcgaacagggatttagcaacacctgtgatgcagccctgtactgccctggattctcacaaggagctgaacacttcctcgaaaagagccctgggagcgcacctggaggctgagcccaagagtcagagaagcgctgtgcaaaagcccccgtccacaggctctgctccggccatcgagtcggttgactaagatgaggtgtgatcactgtattgagagatatattttgtgtataactttctctgttagtagttaactattggttttgtggtgaaaattttcttactttttctaccatatctgtattttcttagaactactggacttatgtggtacaggaggctgcttagcagttttgaatagtttaatctataaattttcctcagctgtgttgcacatcagcctcgttctccctccactggaatgcatgtgttcattgccttgtcctttctctccctgctccttgcacattatcatcctaatgaaaatttcactgacagggccgaccattacaagggaactttgttctgacgatggttccttgatgtgaaaacaatattaatttaaacgtcttagcccccccccccataatattattcagaaaaacaaaataccaaggcgattagttttgtctaataacccatttaaatgccaagtaaaaataaaactcctagtgttgggtcagaagcatatttgattgaaattagctttttgaaaacatttatatctcgggacaaattgagatggccacatgcctagaatcctaagtttcggcagaatatgtatataaagatgtcacttgtggacaaaatagtacatagaggcaaatcactagacaaataagcttagtgtttacgtgactgaacagtcatcctgctttggtttcaggtgtgggatttggaccatgaggggctcccgtagaggatggcggtttgtgtttgattctgatttgggatttcagtacatattctccacttcccatagaaggccacttattctttgaaaactggtgttcatgtttgccgttcaatgaagtcccttgtcaaagacaaggacggtcaattcacgtgtcactttcactaggcagaagtttctccaataccttctggctacttgaaagttactacaaaaattccaccagcaaagtactccaggtttttcaaaagggaattttcattatggatcagtaccaaccgaaattgattttcatttccaaaacaaacactggcaccaacatttttactttgggaagacttggcagagtgttagtcatgatctgttacttacgtgttcagtctgttttctcacccccttcttagttaccatctcttttttaagaagaaaaaagaaaagccacagtattatcaaggtctctacacttggactgggggaaaatttgaaattaagcacataacttttgaattagttctttgtttcaatgttgaatgtggcgcagttatgcagatgattaatcaggctgcactgatggaagttttgactttgtccctggtataatttgcattgaaatgctttatgaaataaaaggttctactagaactgatgttagcacattccactgagcaaaactatcagactgacacttgttaaattgcttactggactgaataaactctgttttgtccagttaaaagggttttctctttgttacaagtgttatttgtaaagtcctgtcacattcatggtcgaaactgggttgaaagaattgaaaattgtccaacagatagatagataggaaaccgcctggagtggaggagggttgtatctaagcctccactatcagtcatgttaattcaaggggccacagtggaggaaaataaatccacaaagtagattatctaattaccatcaaaatgagtcagaagcaaaaaacaccaccctccaacagcctcttaggagtacaccctgttctgctactaaaatactagactcatttccctggtggtgggggggaatgcaggtatagatcagaaatataatccaccttaaaattagtactaatgatcacattatttcacaagaactctgctggatgtacagctcttaacattttattaagccatttgtgtagcccaccacgtttctttgtggtgcttgtcctgtgtggaagattgtaaatcttgggcctgttgcatacttccaagggctttaaagcaatgtgattaacagtacttggcctgctgcttttggcttactttgtatttttagctagatgctattatagtgttgaaaggatatggattctgtctgggatgcatttgttgtcctttcagaacccttcctcccattaccctgtgaataaaaacaaatgggaccccctgagaaggacatcttcctacagtgatcacctcaccagcccagtgttgtggctttgtagcgcaccccgtatctaccatattctagaacactgtaatgctactaggctggcccagaaaaggtttaaatgttgaattcacttaaattgcaattgttgcaccatcatggaatcgtgatgtgtattatttatattggcggtggactccaaggtgtagagaaaacttgggtcttgggtaatatggaccatttcatcctcagacttgttaggagtacatttcttggtcttgagaccagtatttttcagttatgtatgcaactgcctttattacacctggttatcacaattcaattctcaggtgttgcagaaaaatctacctctttcagactgtagatggaaataactgtgaaaaaaatgatgcagatatcttctagtttgtgctaaacacactgctttatttttacagcccacgtctttcatgaggatacgaattgttaagaggcagtctcgttttgcttttcaaagacattttgtagagatttttcactaatgtgaatctgattttatctacttgattctgtatagattaagtaaatatgtatgataaactt

SEQ ID NO: 2498 - DNA, 2100 bp, Homo sapiens
ggctgctgggctggcggggcgcaggccgcgggacccgagcccggggaagcgagagagcggaggcgccgaggatccgattcactccctggggagacctatgggccgaagccgtgtaaatgcgttttaagaggcctcggctccgcaactgccactcctcctcggggtgttgcacaagtttcgaggtcaccggcgaccccccctagcagcgcgcctggctctggcccccgcgaaggaggacggagtttgtgtgttgcatactttctaaggcggcggctgcagcagcggctccatccagcccgtcagctcctcctgcaaggcatggctggctacctgagtgaatcggactttgtgatggtggaggagggcttcagtacccgagacctgctgaaggaactcactctgggggcctcacaggccaccacggacgaggtagctgccttcttcgtggctgacctgggtgccatagtgaggaagcacttttgctttctgaagtgcctgccacgagtccggcccttttatgctgtcaagtgcaacagcagcccaggtgtgctgaaggttctggcccagctggggctgggctttagctgtgccaacaaggcagagatggagttggtccagcatattggaatccctgccagtaagatcatctgcgccaacccctgtaagcaaattgcacagatcaaatatgctgccaagcatgggatccagctgctgagctttgacaatgagatggagctggcaaaggtggtaaagagccaccccagtgccaagatggttctgtgcattgctaccgatgactcccactccctgagctgcctgagcctaaagtttggagtgtcactgaaatcctgcagacacctgcttgaaaatgcgaagaagcaccatgtggaggtggtgggtgtgagttttcacattggcagtggctgtcctgaccctcaggcctatgctcagtccatcgcagacgcccggctcgtgtttgaaatgggcaccgagctgggtcacaagatgcacgttctggaccttggtggtggcttccctggcacagaaggggccaaagtgagatttgaagagattgcttccgtgatcaactcagccttggacctgtacttcccagagggctgtggcgtggacatctttgctgagctggggcgctactacgtgacctcggccttcactgtggcagtcagcatcattgccaagaaggaggttctgctagaccagcctggcagggaggccccactaccaccccctcacattgctacttgtgctgcctctgaaccctcccctcctgcagaggaaaatggttccacctccaagaccatcgtgtaccaccttgatgagggcgtgtatgggatcttcaactcagtcctgtttgacaacatctgccctacccccatcctgcagaagaaaccatccacggagcagcccctgtacagcagcagcctgtggggcccggcggttgatggctgtgattgcgtggctgagggcctgtggctgccgcaactacacgtaggggactggctggtctttgacaacatgggcgcctacactgtgggcatgggttcccccttttgggggacccaggcctgccacatcacctatgccatgtcccgggtggcctgggaagcgctgcgaaggcagctgatggctgcagaacaggaggatgacgtggagggtgtgtgcaagcctctgtcctgcggctgggagatcacagacaccctgtgcgtgggccctgtcttcaccccagcgagcatcatgtgagtgggcctcgttccccccggagaatcccagcggggcctcagagatgcatctgggagaggtggggaagatggcaggcaagggtacccttggccaggactctggtgcccaccctgccacccccgcgctccacctgcagtgtttctgccctgtaaataggaccagtcttacactcgctgtagttcaagtatgcaacataaatcctgttccttccagctgtgtctgcctcctctgcagtgcaaggggcctggtcagccaggtgtgggggtgttcttggggtctcctttggtctccttcccacctttgtaaatataatgcaaataaataaatatttaggttttt

SEQ ID NO: 2499 - DNA, 3824 bp, Homo sapiens
gcttttgctcggacctggagtaatgagagtggacgtttgattccaacaggatggcccatttctccagcgaggaccaggcgatgctgcaggcgatgctgaggcggttgttccagagcgtgaaggagaaaatcacgggtgccccttccctggagtgtgccgaagagattcttttacatctggaggaaactgatgaaaattttcacaactatgaatttgtgaaatacctcaggcagcatataggcaacactttgggttctatgattgaagaagaaatggaaaaatgcacatctgatcggaatcagggtgaagaatgcggctatgatacagttgtacagcaggtcactaaaagaactcaagaatctaaagagtacaaagaaatgatgcattacctgaagaacattatgatagctgtggtcgagtctatgattaacaagtttgaagaagatgagacacgaaatcaagaaaggcagaaaaaaatccaaaaggagaaaagccatagttaccgcacagacaattgctctgatagtgattcatcattgaatcagagttacaaattttgtcaaggaaaattacaattgattttagaccagttggatcctgggcaacctaaagaggtgagatatgaagccttgcaaacattatgttcagctcctccatctgatgtcctcaactgtgaaaattggactactctctgcgaaaaactgaccgtgtctctttcagatcctgatcctgtgtttagtgaccggattttaaaattctgtgcacagacatttttgctttctccattacatatgaccaaggaaatttatacaagcttagctaagtatttggagtcatactttctttctagggaaaatcatattcctactctttcagctggtgtagatataactaatcctaatatgactcgcttacttaaaaaggttcgtcttctaaatgaatatcagaaagaagctccatctttctggattcgtcatccagagaagtatatggaagaaattgtggagagtactttgtccttgttaacagttaaacataatcaaagccatgttgtctcacaaaagattttggatccgatctacttttttgcattagttgataccaaggctgtgtggttcaaaaagtggatgcatgcacattatagcagaactacagtattaagacttcttgaaacgaaatataagtctctggtaactacagccattcaacagtgtgttcagtactttgaaatgtgtaagactaggaaagctgatgaaactttgggacattcaaagcattgcagaaacaagcagaaaactttctactacttaggacaagaattacaatatatttatttcattcactcactgtgccttttaggaagattattgatctataaacaaggcagaaaactatttcctattaagctgaagaataaaaaaggtttggtatccctcatagatctgcttgttctttttacccaacttatctattactcaccaagttgtccaaagatgacatcagctgcccattcagagaattactctcctgcaagtatggtgactgaagttctgtggatactcagtgatcaaaaagaatgtgcagtggaatgcttatataacaacattgtaatagagacacttcttcagcctattcacaatttaatgaaaggaaatgaggcatctccaaattgctctgagacagctttaattcatatagctggtattttggcaagaattgcatctgtagaagaagggcttattttactcctttatggagcaaatatgaactcttctgaagaaagtcctacaggtgctcatataattgcccagttttcgaaaaaacttctcgatgaagatatttctatattttctggatcagaaatgttgcctgtggttaaaggagcttttatttctgtgtgtcgtcacatatatagtacatgtgaaggtttgcaggtgttaatcacttataatttgcatgaatctatagcaaaggcatggaaaaagacaagtttgctatcagaaagaattcctactccagtagagggttctgattctgtttcttcagtaagccaggaatcccaaaacattatggcttgggaagataatttgttagatgatttactacattttgctgccacccccaaaggattactacttcttcaaagaacaggtgctatcaatgaatgtgtgacatttatattcaatcgatatgcaaaaaaattacaggtcagcaggcataaaaaatttggctatggagttttggttacacgagtggcatcaacagcagcaggtggcattgcactaaaaaagtcagggtttattaatgaacttataactgaattatggtccaatctggaatatggaagagatgatgttagggtaacccatcccagaactactccagtggatcctattgaccgaagctgtcaaaagtcttttttagcactggtgaacttgttatcctatcctgctatttatgagcttgtaaggaatcaagatcttcctaataaaacagaatattctcttcgtgaagtcccaacatgtgttattgatattattgatagacttataattttgaattctgaagctaagattcgttctttattcaactatgaacaatcacatatctttggtctaagggactttataattgatggcttatcagtggagagaaatcatgttcttgttagaataaatcttgttggtgggccattggaacggattttgcctccgaggttactcgaaaagagtgataatccatatccttggccaatgttttcatcatatccattgccaaactgctatctgtcagacattacaagaaatgctggtataaaacaagacaatgatcttgacaagcttttattatgcctcaaaatatctgataaacaaactgaatggatagaaaactgccaaagacaattttgcaaaatgatgaaagccaaacctgatataatcagtggagaggccttaatagaattacttgaaaaatttgtgcttcatctcactgaaagcccatctgaatgctacttcccttcagtggagtatacagctactgatgcaaatgtgaagaatgaaagtctttcatctgtgcagcagcttggcattaaaatgactgtcaggtatggcaaattcctcagtctcttaaaagatggtgcagaaaatgatcttacctgggttttaaagcattgtgagagattcctgaaacagcagcaaacttccataaaatcttctcttctctgcctgcaagggaattatgctggccatgactggtttgtatcttctctgttcatgataatgttgggagacaaagaaaaaacattccaatttcttcatcaattctccaggcttctgacttctgcttttctttggttgccaaggctacatatttctagttaccttcctaatgacactgtagaatctggcatccatccagtatatttttgcagcacccattatattgaaatgctactgaaggctgagttgcctcttgtgttttcagcttttcacatgtctggttttgcaccatcacagatttgcctgcaatggataacccagtgtttttggaattacttagattggatagaaatctgccattatattgctacttgtgttttccttggtcctgattatcaagtgtatatctgtatagctgtattcaaacatttacagcaagacattctacagcacactcagactcaagatctgcaagttttcctaaaagaagaagcactgcatgggtttcgagtgagtgattattttgaatacatggaaattttggaacaaaactaccgaacagtgctgctgagagacatgcggaacattagactgcagagcacatag

SEQ ID NO: 2500 - DNA, 1073 bp, Homo sapiens
aagatggcgactccctatgttactgacgagaccggcggcaagtatatcgcgtcaacacagcgacctgacgggacctggcgcaagcagcggagggtgaaagaaggatatgtgccccaggaggaggtcccagtatatgaaaacaagtatgtgaagtttttcaagagtaaaccagagttgcccccagggctaagccctgaggccactgctcctgtcaccccatccaggcctgaaggtggtgaaccaggcctctccaagacagccaaacgtaacctgaagcgaaaggagaagaggcggcagcagcaagagaaaggagaggcagaggccttgagcaggactcttgataaggtgtccctggaagagacagcccaactccccagtgctccacagggctctcgggcagcccccacagctgcatctgaccagcctgactcagctgccaccactgagaaagccaagaagataaagaacctaaagaagaaactccggcaggtggaagagctgcagcagcggatccaggctggggaagtcagccagcctagcaaagagcagctagaaaagctagcaaggaggagggcgctagaagaggagttagaggacttggagttaggcctctgaggcctttggggaatagggaatggactgcagaacaaaccgtggggctctctggggtctgggggaatacgggcaacagcagtcaggaggggtaccccccatactggcttacttccacctcctgcggcccagctctgtcctccagagcctagcgtctccctcaatccttcccttttcttcccaacttctactttttggactttccccctcccattcccagtgttcaaaatctcagtgactaccccaggtacctttgctgctgatttgggtgtcttgtttaaaagaaaatcaggtgggtgggaatctcttggagaactgaggctgagggtagagggagtatgcccaagtcttggagtcttggttcctgttcgcggtgtttatgggttatttccctctccatccctcattttttttttttttttaaaaaaagcaaaaatgagaataaacacaagtagacatgt

SEQ ID NO: 2501 - DNA, 1119 bp, Homo sapiens
cagtcgccccggcaacagccgcctccctcgcgtcccccactccccctctgtctctccaaggaaaactaggcccctgcgcggccaacgcccaggatccgcaagctgcgcgcccacgagtttcagcacccatttggactttcacaatcagagatggcagcggtaaaggcatcaacatcgaaagctaccaggccttggtattctcatccggtatatgcaagatactggcaacattatcatcaagcaatggcttggatgcaaagccatcacaatgcctacaggaaggccgtggaatcctgtttcaatcttccatggtacttaccttctgcgcttcttccccaaagctcttacgataatgaggctgcgtatcctcagtccttctatgaccatcatgtggcctggcaggactacccctgcagttcttcacatttcagaagatctgggcagcatccacgttacagcagtaggatccaggcatccacaaaagaagaccaagctttgtccaaagaggaagagatggagactgagtcagatgcagaggtagaatgtgacctgagcaatatggaaatcactgaagagctccgccagtactttgcagagaccgagaggcatagagaagaacgacggcggcagcagcagctggatgcagagcgcctggacagctatgtgaacgctgaccacgacctgtactgcaacacccgccggtcggtagaagccccaactgagaggcctggtgagcggcgccaggccgagatgaagcgtttgtacggggacagtgctgccaagatccaagccatggaggccgcggtgcagctgagctttgacaagcactgtgaccgaaagcagcccaagtactggccggtcatccccctgaagttctgagctcagggcacagggtacccagcctctccttcttccttttgggtacacgctctttatctctccttctgtacatttcttagggaaaggggactttgtactggggtacaggcatgttcaccacagtcccagtgggcctgtcacggggtggatgtactatgccagccacttggaggtctgcaggacatgttctgttgccaacatgataaattttctcctgacataaaataattttgcatatac

SEQ ID NO: 2502 - DNA, 2160 bp, Homo sapiens
ggccgggttgccagattacgggaaagccatttaagaagttcctggaataatattagtcagagtaatataggatctgcaggaagtgtctcaagatagttggaaaagaagaatttctagactcttcatcaagatcttcatttatacagctgttaaatccaaggctactttggtgaaagcatgaataaaaatacatctactgtagtatcacccagtctacttgaaaagatggtcgtttgaagccaggagatcaacttgtctcagtcaacaaggaatctatgattggtgtatcatttgaagaagcaaaaagcataattaccggagccaagttgagtactaggttagaatctgcttgggagatagcattcataagacaaaaatccgacaacattcagccagaaaatctgtcatgtacatcacttatagaagcttcaggagaatatggacctcaagcctcaacattaagtcttttttcttctcctcctgaaatactaatcccaaagacctcatccactcccaaaacaaataatgacattttatcttcttgtgagataaaaactggatacaacaaaacagtacagattccaattacttcagaaaacagtactgtgggtttgtctaatacagatgttgcttctgcctggactgaaaattatgggctacaagaaaagatctccctaaatccctctgttcgctttaaggcagagaaactggaaatggctctaaattatcttggtattcagcccacaaaggaacaacaccaagccctgagacagcaagtacaagcagactcaaaagggacagtgtcttttggagattttgtccaggttgccagaaacttgttttgcttgcagttggatgaagtaaatgttggtgcacatgaaatttccaatatattagattcacagcttcttccttgtgattcttcagaagcagatgaaatggaaaggctcaagtgtgaaagagatgatgccttgaaagaagtaaatacacttaagtggccagggcagaattagatgaagagccaataaagcaagtcgtggcaattttggatcctgtgagttctttgggaaatacattttttttcatgtgcagggctattcttaagggacatcatgttttgctaacgtaatttggaattaatattattttagagaggaaaaaaacacacatatcccaaatatactgtaacatttttcttctctttttttgtttgtttggttttttgattcttgtttttgttttgtgtttttgagacagggtcgcactctgtcgcccaggctggagtgcaatactgcaatcacgtctcactgcagcctcaacctcctgggttcaagtgattctcccacctcaacctcccaagtaactgggacaacatgtccatgccaccatgctcaactaatttttttttaaatttttattttgtagagatggtgtctcactattttgttcagactggtctcaaacacctgggctcaaatgacccacctacctcagcctctcaaagtgctgggattacaggtgtgagccaccatgtctggccttgattctctttatgtggtttcattctgtttttagaagaatattacatttaaattatatcctaatttttatagaaagctatattttccaaatctttaggaaaagcaacataactacttgatttaccactaattcgtcataggcacatatttttaaaattattttattaaataaggtatagtatattgataattatttaatttttattaaatagaaaatatttacaccaaaaggaaagaaaatttgttttgctaccttagtttttataatctcaacctctagaggaagccattgttgcaaatatattatttatcttttcatagatttttctctacacagaaaattatattttttaaaaataggcagggcatgatggctgacacctttaatcgcagtactttgggaggctgaggcaagaggattacttgagctcaggagtttaacatcagcctgggcaacatagcaggaccccatctctactatttaaaacataaaaacaaaaataaataaatatatgtatatgtggggacagggagtatgtgagaaatttctgtactttcccttcaattttgctatgaatccaaaactgcttcaaaaaataataaagccttaaaaaatttt

SEQ ID NO: 2503 - DNA, 1234 bp, Homo sapiens
attgtgggttgctgggcggcccggtctcggagaagaggggagagtggcgggccgctgaataagcttccaaaatgatggattctcagctggtagctggtgttgcattcaagaagactttctcttacgctgggtttgaaatgcaacccaaaaagtaccacaatcccaagattgcccttttgaatgtcgagctcgagttgaaagctgagaaagacaatgctgagataagagtccacacagttgaggattatcaggcaattgttgatgctgagtggaacattctctatgacaagttagagaagatccatcattctggagccaaagttgtcttgtccaaactccccattggggatgtggccacccagtactttgctgacagggacatgttctgtgctggccgagtacctgaggaggatctgaagaggacaatgatggcctgtggaggctcaatccagaccagtgtgaatgctctgtcagcagatgtgctgggtcgatgccaggtgtttgaagagacccagattggaggcgagaggtacaatttttttactggctgccccaaggccaagacatgcaccttcattctccgtggcggcgccgagcagtttatggaggagacagagcggtccctgcatgatgccatcatgatcgtcaggagggccatcaagaatgattcagtggtggctggtggcggggccattgagatggaactctccaagtacctgcgggattactcaaggactattccaggaaaacagcagctgttgattggggcatatgccaaggccttggagattatcccacgccagctgtgtgacaatgctggctttgatgccacaaacattctcaacaagctgcgggctcggcatgcccaggggggtacatggtatggagtagacatcaacaacgaggacattgctgacaactttgaagctttcgtgtgggagccagctatggtgcggatcaatgcgctgacagcagcctctgaggctgcgtgcctgatcgtgtctgtagatgaaaccatcaagaacccccgctcgactgtggatgctcccacagcagcaggccggggccgtggtcgtggccgcccccactgagaggcaccccacccatcacatggctggctggctgctgggtgcacttaccctccttggcttggttacttcattttacaaggaaggggtagtaattggcccactctcttcttactggaggctatttaaataaaatgtaagacttc

SEQ ID NO: 2504 - DNA, 2914 bp, Homo sapiens
agcctgcgcttcggaagcatggatgtgcgcctgcgctgcgctagggcgcggcgggcggtttgaattttgcttacagagtcccgtctcaccatcctgggcttccaacggagactgcggtatccgcagctggagacccagcggcgagtagccttttgctcccggacggacttgaggttggagtctgtgtgttggggaccctgcctttggaagcgcccgagaggcttaaaggatggcctcgtcagatctggaacaattatgctctcatgttaatgaaaagattggcaatattaagaaaaccttatcattaagaaactgtggccaggaacctaccttgaaaactgtattaaataaaataggagatgagatcattgtaataaatgaacttctaaataaattggaattggaaattcagtatcaagaacaaaccaacaattcactcaaggaactctgtgaatctcttgaagaagattacaaagacatagaacatcttaaagaaaacgttccttcccatttgcctcaagtaacagtaacccagagctgtgttaagggatcagatcttgatcctgaagaaccaatcaaagttgaagaacctgaacccgtaaagaagcctcccaaagagcaaagaagtattaaggaaatgccatttataacttgtgatgagttcaatggtgttccttcgtacatgaaatcccgcttaacctataatcaaattaatgatgttattaaagaaatcaacaaggcagtaattagtaaatataaaatcctacatcagccaaaaaagtctatgaattctgtgaccagaaatctctatcacagatttattgatgaagaaacgaaggataccaaaggtcgttattttatagtggaagctgacataaaggagttcacaactttgaaagctgacaagaagtttcacgtgttactgaatattttacgacactgccggaggctatcagaggtccgagggggaggacttactcgttatgttataacctgagtcccttgtgaacttttgaacataccaacagggtatagagtatagaggctatttctataattttcttatatataatttttttaacttttaatcttttttgtttccttttttttttttttgagacaggatcttgctttgtcacccaggggcttgctttgtcacgcaggctagagtgcagtggcgcaaacatggctcactgcagcctcaacctcccaggctcaagtgatcctcccacctcagccccctgaatggctgggactacaagcgtgcgccaccatgcctggctaatttttgtattttttggagagatggggtttcaccatgttgcctaggctggtcttgagctcctgagctcaaacaatccaccctcctcagcctcccaaagtgctgggattacaggcttgagccaccacacctgacctattcttgtttcttataaaaataaaacttttttggataaagcttatttcttgtttttttctttttctttttttttttttttgagacagtctcgctctttcacccaggccggactgcagcggcgctatctcggctcactgcaaactctgcctcccaggttcacgccatcctcctgcctcagcctcctgagtagctgggactacaggcacctgccaccacgcccagctaattttttgtatttttagtagagatggggtttcaccgtgttagccaggatggtctcgatctcctgacctcatgatccgcccacctcggcctcccaaagtgctgggattacaggcgtgagccaccgcgcccggccaacttatatattttcaagattcacctcctctcaccaaatatttaactacctgctgaatacgcctctgtactaggcacataatggaactaaaaaatgctcatgtccagtttttgtgttgagtgaacaatgctgcagaccctaataagattgggtacagatcggcatgcgcctgtagtcccagctactcaggagaattgcttgaacctaggaggtggaggttgcagtgagccgagatcgtgccactgcactccagtctgggcaacagagcgagactccatctcagaaaaaaagaaaaaaagactgggtacagatgtgatattggaagaaaaagatcaagctgatgaggttaggatacccaggccctttggacttaaagatcactagtgtctaaattccatcgatggcatttcagtctataggtaaacttcctggaagctggatttggagacagtttatcatctgattattgggctttcgtataggtccttagggagcagcttacctgaaatgcatttagtgtacaccagtctgtaaacttcaacctgtaatgaaagtgtaataaatgtacattgagttgatgtgataatgtgatataataagaaatatatatttgatcttcctatctagttccttgttcagagctcctaaaacccttgtaatttccaaagtgatggagtacatcttttgttctagtatttggtctttgaccccagttcctgacacaaagctcctaaattcctttaaatttcccagtgataggagaattttttgttctaatgaggtcactcttgatgggcacctggataactcaggatgggggctgctcacaaagaccacatcatgattggaagtttcaaactttcagtctcccacctccagagaggggagaggggctggagatttgtgtcaataatccatcaggcctatgtcaacaagacataatccgttaactatggagttcagggagcttcagggttggcaaacattttgatgtgccaggaaggtgacgcactccagctttatgaagtcagcaagtcctgtgctcaggatgcttctggaccttgccccaggtaccccttcatgtggctgttgttcatctgtatcctttgtagtagccttaaaataaactgttaaac

SEQ ID NO: 2505 - DNA, 1241 bp, Homo sapiens
atttctgctgttttcttctagttgtttcacagtttatttttctcagaagaatcttcagaaaacaagaaacatcatcccatttgaggactgctgtgagacacacagttttcaggatgacacacagaatgctgagttccaagtgatctgtcacctgacaatcgactggatgagtaagattacaagtctttgaaattaaatgacacactaaattaactgaagacaagaggaggaggaaagactggattggctaaactctaacacagagaaagaataaaagtgcattccaccttttatacagatattttcccacaattagctaacttgataattgcctatctattaagataaacaataacaaggaaatagcttttatgtggtgacaacagctcctcagctgagtataaaagtggacatgggataaggagattcccacattcgaaaaactcactgtcttggaaacctacctagaacctccaccctctgacaccatggttaactcttgttgtggctctgtctgctctgaccagggctgtgatcaaggcctctgccaagagacctgctgccgccccagctgctgccagaccacctgttgctgccccagctgtgttgtatccagctgctgccgcccatcctgctctcagactacctgctgccagaccacttgctgtcgccccagctgctgccacccagtctgttgtcagaccacctgccgccccagctgtggtgtgtccagctgctgccgcccactctgctgtcagaccacctgccaccccagctgtggtatgtccagctgctgccgtccactctgttgtcagaccacctgccgccccagctgtggtgtgtccagctgctgccgtccactctgctgtcagaccacctgctgccgtgcaacttgctgccgccccagctgctgtggatcctcttgttgaacctcatattggactatcaaccatgagccagtcaccatcccatgatatgaaagtgtcatttatatcaacttgtccatgtgttaaatggccatcagctttattatcctgttattccactaagtaactggtgaaagggcatccatctacatttaataccactcatttttcccatggatctcttcccagcagcattcagacctcagatgcatgatgcagttagactaagcctctaagtttctgactgttatgcttgatttgaccttcaaaattacatattaactgttcttcaataaatattatcttaatatcagt

SEQ ID NO: 2506 - DNA, 1683 bp, Homo sapiens
ctgaaggtctggtgatagctgggtgcaggaatattgtgcaggagggctatgtgtcctggaccatgaagaaggatgacttctgactgctcctccacacactgctctcctgagtcctgtggcacggcttccggttgtgcacctgcctcaagctgctccgtggaaacagcttgtctccccggtacctgtgctacatcccgatgtcagactccaagcttcctatccaggtctcgcgggctgactggttgcctcctgccatgctactttactgggagttgtaatagtccctgcttggtggggaactgtgcctggtgtgaggatggggtgttcactagcaatgagaaggagacgatgcagttcctgaatgacagactcgccagctatctggagaaggtgcgcagcctggaggagaccaacgcagagctggaatccaggatccaagaacaatgtgaacaggatatcccaatggtgtgcccggattatcagcgttacttcaacaccattgaagatctccaacaaaagatcttatgcacgaaagcagagaattctagacttgctgtacagcttgacaactgcaaactggccactgatgactttaagtcaaagtacgagagtgaactgtcccttcgccagctgttagaggctgacatcagcagcctgcatgggatcctggaggaactgaccctgtgcaaatctgatctggaggcccatgtggagtctctgaaggaagatctcctttgccttaagaaaaaccatgaagaggaagtcaacttgcttcgtgaacagcttggcgaccgcctcagtgtggagctggacactgcccccacccttgacctcaacagggtcctggatgagatgcgctgtcagtgtgaaacggtgcttgccaacaatcgcagagaagctgaagaatggttggctgttcagacagaagagctgaatcagcagcaactgtccagcgcggagcagctgcagggctgccagatggagatcttggaactgaaacgcacagccagtgctctggaaattgagctccaagcacagcaaagcctgacagaatctctggaatgcaccgtggcagaaaccgaggcccagtacagctcccagctggcccaaattcagtgtctgatcgataacctggagaaccagctggccgagatccgctgcgacctggagcgacagaaccaggagtaccaggtgctcctggacgtgaaggcccggctggagggtgagatcaacacgtactggggcctgctggacagcgaggacagcaggctttcctgtagcccatgttcgaccacatgcacctcgagcaacacttgtgagccatgctcagcctatgtcatctgcactgttgaaaactgctgcttgtgaatgttaaggacagcaggtagaggaatcaaagccagcagcatcctagaaaggagatggggcttcaaccagggacatccaaaccggaagcacaaatccaggaggctctcatatcctggaattgccctccaggtatcctcagtctttctgctttactatttcctctccttccggcttatttgtggtatactggaagcccataaagcattcttgctcatctccaaataaaacgtgttttattcctttagcgtggtaaatatagctctatggctgattactgttgatagaatattcattttatggcaaggaaatcatcta

SEQ ID NO: 2507 - DNA, 1021 bp, Homo sapiens
tgctcctctacctgctctactctcaatccgccagaatcatgggctgctgtggctgttctggaggctgtggctctggctgtgggggctgtggctccggcagtgggggctgtggctctggctgtgggggctgtggctccagctgctgtgtgcccatttgctgctgcaagcctgtgtgctgctgtgtgccagcctgttcctgctccagctgtggctcctgtgggggctccaaagggggctgtggctcttgtgggagctccaagggtgggtgtggttcttgtggctgctcccagtccaactgctgtaagccctgctgctcctcctcaggctgtgggtcattctgctgccagtccagctgctccaaaccctgctgctgccaatccagctgctgccagtccagctgctgcaagccctgctgctgccaatccagctgctgccagtctagctgcttcaagccctgctgctgccagtccagctgctgtgtccccgtgtgctgccagtgtaagatctgaggctctggacccagaccttcaggtttctcctctttggtgaaagcatttcttatggtttctctgaatcagttcatcccacacatcatcctgaggcacctgcacctgctctagctcatcatccatgcatgcacctctttccatggctcggctctcctctaggccctgccttcagcttcctcactccggaaacatgtgtttccttgatgcaggaggtgttcttccctggacgccatggtgttccctgcacttgggtgtggaccatcttcttcttctccctgggctgactgagatgctaggtctgaccccacaaggccaggccgacattcctgagtgatcactaagaaccagtttctcaaccaccactgggattctgggtcctcctgggctgctgcctgttctcctgtgacccacctgtgagcaagaaggtctccttccttcctgttgtctccatctatttaaaaaaaaaatgaatgaatttccttgcaataaagcctctcatgtctgtaaaccaa

SEQ ID NO: 2508 - DNA, 1058 bp, Homo sapiens
gatccaccctcaatctaccagaatcatgggctgctgtggctgctccggaggctgtggctccggctgtgggggttgtggctccggctgtgggggctgtggctccggctgtgggggctatggctctggctgtgggggctgtggctccagctgctgtgtgcccgtctgctgctgcaagcccgtgtgctgctgtgtgccagcctgttcctgctccagctgtggctcctgtgggggctccaagggggactgtggctcttgtgggggctccaaagggggctgtggttcctgtgggggctccaaggggggctgtggctcctgtgggggctccaaggggggctgtggttcttgtgggggctccaaggggggctgtggctcctgtgggggctccaaaggtggctgtggttcctgtgggggctccaaggggggctgtggttcttgtggctgctcccagtgcaattgctgtaagccctgctgctgctcctcaggctgtggatcctgctgccagtccagctgctgcaatccctgctgctgccagtccagctgctgtgtccccgtgtgctgccagtctagctgctgcaagccctgctgctgtcagtccagctgctgtgtccccgtgtgctgccagtgtaagatctgaggctctgaacccagaccttcaggtttcacctgtttggtgaaagcatttgttatgatttccctgaattaattcatcccacgcatcctccctgaggcacctgccccttctccagctcatcatccatgcacgcacctccttccatggctcagctctccactgggccctgccttcagcctcctcactccggaaatgcatgtttccttgatgcaggaggtggccttgcctggacgcgggcacccagccaactgccatggtgttccctgcacttgggtgtggaccatcttcttcttctccctcggctgactgagatgcaaggtctgaccccacaaggccaggccaatgttgctcagtgatcactaagaaccagcttctcaaccaccattgggaccctggatcctccagggccgctcgctgcctgttctcc

SEQ ID NO: 2509 - DNA, 898 bp, Homo sapiens
cctctacctgctccaccctcaatccaccagaaccatgggctgctgtggctgttccgaaggctgtggctccggctgtgggggctgtggctccggctgtgggggctgtggctctggctgtgggggatgtggctccagctgctgtgtgcccgtctgctgctgcaagcccgtgtgctgctgtgtgccagcctgttcctgctccagctgtggctcctgtgggggctccaagggaggctgtggctcctgtgggggctccaaggggggctgtggctcttgtgggggttctaaggggggctgtggttcttgtggctgctcccagtgcagctgctataagccctgctgctgctcctcaggctgtgggtcatcctgctgccagtccagctgctgtaagccctgctgctgccagtccagctgctgtaagccctgctgctgttcctcaggctgtgggtcatcctgctgccagtccagttgctgcaatccctgctgctcccagtctagctgctgtgtccccgtgtgctgccagtgtaagatctgaggctctggactcaggtctcatgtgagtcctgctaaccccattttccgaagctgtgacctgtccttcatcgttgagccccaaaccactgctcagggtccattcctcactataagatgaagccatatctgcctgccttttcctaaggagagtccaccctaattaatgtccattccctcctaacaaattctcttcccaagtcaactgcaactgcggctgaatcacccctcacccgctagccttgcctttgcttgtgtattcagaggcctgagctcctgaacccacttgaagtcctgtcttttccagctggagcagctgggcatgagtgtcccacctgcaacaaggtgggcgtttaagaggcttccttgg

SEQ ID NO: 2510 - DNA, 5060 bp, Homo sapiens
cgggagcccaggcgggcaggccgctggggtcggggctgcacgtacgagagccgggacgcccgggttcagagcgaaggaggaggcatggcttcggtgttcatgtgtggcgtggaggacctgctgttcagcggcagccgcttcgtatggaacttgaccgtgtccacgctgcggagatggtacacggagaggctgcgggcttgccaccaggtgctgcggacgtggtgcgggctgcaggacgtgtaccagatgacagaaggcaggcactgccaggtgcacctcctggatgataggagactggagctgctggttcagcccaaacttctagcaagagagttgctggacctagtggcttcacatttcaacctgaaagaaaaggagtattttggaataacattcatagatgacacaggtcagcagaactggctgcagttagatcaccgagttcttgaccacgatttgcccaagaaaccaggcccaaccattttgcactttgctgtgaggttttacattgagagcatatcgtttttaaaggataaaaccaccgtggagctgtttttcctgaatgcaaaggcctgtgtgcacaaggggcaaatcgaagtagagagcgaaaccatcttcaagttagcagcgtttattttacaggaagccaagggagattataccagtgatgaaaatgccaggaaagatttaaagacattaccagcctttccaaccaaaactcttcaggagcatccatcccttgcctactgtgaggacagggtaattgagcattatttgaaaatcaaaggtctcactcgaggtcaagctgtggttcagtatatgaaaatagtagaagctctaccgacttacggtgtccattattatgcagtaaaggataagcaaggacttccttggtggcttggaataagctataagggaattggccaatatgatatacaagacaaggtgaagcctcggaagttattccaatggaaacagctggagaacttatatttccgtgagaaaaaatttgctgttgaagttcatgatccacgaaggatttcagtttcaagaagaacctttgggcaaagtggcttgtttgtgcaaacatggtatgctaactcttctctcatcaagtccatttgggtaatggcaattagtcagcatcagttttacttggaccggaagcaaagcaaagcaaaaattccttcagccaggagtttagatgagattgcaatggatttgacagagacaggaacacaaagggcctccaagctggtgacactggagacgaaaagtcagttcatcatggcaagtaatggcagtttaatctcctcaggttctcaagactcagaagttagtgaagagcaaaagagagaaaaaatccttgaactaaagaagaaggagaaactattacaagaaaaacttctgaaaaaagttgaggagcttaagaagatctgtctgcgggaggctgagctcacaggcaaaatgccaaaggagtatcccctgaacataggcgagaagcctcctcaggtcagaagacgtgtgggtactgcgttcaaattagatgacaacttgctgccgagtgaagaagatcctgctttgcaagaactggagagtaattttctaatacaacaaaagctggtggaagctgcaaagaaacttgccaatgagccagacctttgtaaaactgtgaagaaaaagcgaaagcaagattacacagatgcgatgaaaaagcttcaggagattgaaaatgcaataaacgaataccgaattaggtgtggaaagaaacccagccagaaagcaacagtgttaccagaagacataatcccctcagagagtagctctttgtctgacaccaccacctatgatgatcccagtgatgccttcacttttcctgggcagcgatcaagttcagtacctcattctccaagaattcttccccccaagtctcttggtattgagcgaatccatttcagaaagtcgtccatcaatgaacagtttgtggataccaggcagtccagagaaatgctgtccacacacagcagcccttacaaaactctggagaggcggccccagggaggacgaagcatgcccaccacgccagttcttacccgaaacgcctacagcagcagccacttggaacccgaatcttcatctcagcactgccgccagcggagtggaagcctggagtcccagtcccacctgctctccgagatggacagcgataagccatttttctccctctccaaatcccaaagaagcagcagcacagaaatcctcgatgacgggtcttcttatacaagccaatcaagcacagagtattactgtgtgacaccagttaccggcccctattacaccacccagaccctggacactcgcaccaggggtcggaggaggtcaaagaaacagaatgtttctacttcaaattcaggaagcatgcccaacctagcacaaaaggatagtttgaggaatggtgtttactcaaagagtcaggagccaccgtcttccagttactacattgccgggtacacaccctatgcagagtgtgacttttattacagtggtggttatgtctatgagaatgacaccgagggacagtatagtgtcaacccttcctaccggtcctcagcccactatggatatgagcgccagagggactacagcagatcctttcacgaagatgaggtcgaccgggtaccccataacccatatgcaactctccggctgccaaggaaggctgctgcaaaatcggagcacatcaccaaaaacatccacaaggccttagttgccgagcacttgcgtggctggtaccagcgggcctctgggcagaaggatcagggacacagcccgcagaccagctttgactcagacaggggatcacagagatgcctggggtttgcggggctgcaagtaccttgttctccaagcagtcgtgcatcctcgtactcttcagtgtcttctacaaatgcttctgggaactggaggacccagttaaccatagggctgtcggattacgagactccagcacattcttcttacaccagctgctatggcaatgtctataatcctttaccctctccaagcagacaatacacagaaatcagtcaactggatggtacagatggaaaccagctggaagacaacctggagagtagtgagcagagactcttttggcatgaagattcaaagcctggaacattagtctgaactgcagttggacctcctgaccaagcactgcgttctcacactagtgtgccttgcaaattgtatttgtcttccgagaggatgttcgttttagaaacctaaagacatcaaaggttgaagagaagacttagttgccctggaagtgaatcagtgaatcacacaccaagccccacaaagcccctaaaggaggatttggcctttcaaactctaggcactaacgtaactgtagggtctgcccacatgttgaagtattgccaagagaggactcagtgtgaagccttcatcaatagcaagcactttttaagggagtaaaagttgttaaaggcaaacctcaaaaacatgaaagggcattcaggatgtcccatggcaataagaacaggggaaatctcagagcacaattcagcaggatgagagaaggggaaccagaagctccggagtcattgctcacttcagagtttgaattcgtgagctgacaaagagtaacatgctctttctacacagacatggacaatttagacagtattggaaaattacttgaagctggattttcatgaagttctgaatgagtgtaaatgttttttaggatactataaagagtgatgtttttcataagcaccataaaatgggttctggaaaaactgattaccttagcatcctgtaatataacttatggtagcagattggggaaaatgaagcagcccactgaataattgacaaagtctgcttggagaacattctaaggtacaatatcatggagctcctttttcctttctccactaattgcgtgatgagctattgttctggctgttaattctccaactcggctgtcatttgaagtggcagacttaatatggaaagtttttataattatgagtttgaaaaagcattttaagatgatacagaaagtatccaaaacaacagaaaaaaaaagccacgtcattttagatgaattgcgtgccttaaaatggtgaacgttagaaaattaaacaagtctggattccacaagtagttccaagtcaccaagtgacaaaaacaaggttaacattaaaaaagaaaaacaacaacaacgacaaaaagctccaagctgcagtggatttaattatgaggctaaaactacctcatactttccttggaagaactaattagctatggtttattgtagggttttgtttgtttgttttttaaagcaaatgatttccatattccagattgatcttttttgtcatctttgcttcaaaattacataaaaggtgctcctttcccccttcttttatacaagtttcttgttcatattgtgaatagaaaagtttctgaacaacttttttggaacattttctatctatattccaaagcatgtaatatatacataaaaacgatttgttaaactggtccttagtcatttgtataattagaaatgaagtttgggaaaaaattttggaaaaaagacaagcaaaaaaaaataacttattccttttttgcatatttgtatagccttctagaatcagaaataacctttttgcatattcttttattgttctgacttttcaagacctattatttttttacataggtcaataaacaaaaggtgtgctactgaaaatgtttacgttttcttccatttatgtcaggggttcatgtgaagcaggtcgcagtgctctacttcaagtaatcatattgggcaaggcttcggatttttatttatagtattaccgtattttattaattccgggatgtacatttttaaatatttacattaaaaacatggttcatctttttattgatggcatattctacttgaattggcagttttttcttaatagtacattaaaaataatgctgtgtcttacaataaagttgccttagaattgatgaaa

SEQ ID NO: 2511 - DNA, 1604 bp, Homo sapiens
cggcgcgatgaccacgctacgggcctttacctgcgacgacctgttccgcttcaacaacatgtgagtgacacgcgcctagggccagccgctcttggccgggcctcgcttcccggccccgccagctccggccccagccgcgccttcccggccggaccccaagcccggacggggacccgcgagaaccaccccccgccggccaacgtgggcgcctccctggggccacagggtccagggagaggtgggcctggagtcgacgcacgccggccttggcgaccttggccgaggtgctcaaactttgtctctggaccctgcgagctggcaggttctggggcagcgctcgggcctccgctcgtggtcgctgtcaggaggcgctggggtgatggggcgagctggagacgcggcctggagcccacgacctgggcttctcgccctgccctactgcttgctggttcgtggccgggccgcgcctcttctgggcagagggcaccgccgacggccaggccgcagagggggcttgcgaggatcggaagctggtcagcagctgttgggatgtgtacatcgtgaagcccacctggtggccgtggttaaattgtatccaaatgaaatgacactgatcactgcgtcccctgcagcagatgctgtctcagtcatgtaacttggatccacttacagaaacttatgggattcctttctacctacaatacctcgcccactggccagagtatttcattgttgcagaggcacctggtggagaattaatgggttatattatgggtaaagcagaaggctcagtagctagggaagaatggcacgggcacgtcacagctctgtctgttgccccagaatttcgacgccttggtttggctgctaaacttatggagttactagaggagatttcagaaagaaagggtggattttttgtggatctctttgtaagagtatctaaccaagttgcagttaacatgtacaagcagttgggctacagtgtatataggacggtcatagagtactattcggccagcaacggggagcctgatgaggacgcttatgatatgaggaaagcactttccagggatactgagaagaaatccatcataccattacctcatcctgtgaggcctgaagacattgaataaccctgggcagtggttcttaggcagatactctagatgctttatggacaatattattttcattggatgattctggagctctattaggagaaaagtaatcattttaggtcttaaagacttcaagaaaatacaggttatcaatttattttaaatctcattgtttccagttagcaatatcatacctattaaagctgttcattgtaacaaaattcaatcaaaaaggcagctaggtcagaaggaaacataccactctcatggttcatagtattcactgtatgtatgctagggaaaagacttgctccagtctcctcctcagttctgtgcctgagaaccactgctgcatatatttgtttttaaattttgtattgaactgttaattgaagctttaaaagcatatatgaaatgtataaatctaagatgtataatacattattgactctatgaatgttttctgaagtttgttagtcattt

SEQ ID NO: 2512 - DNA, 412 bp, Homo sapiens; identical to SEQ ID NO: 2104

SEQ ID NO: 2513 - DNA, 2866 bp, Homo sapiens
tccattccaaataaaatctataacaaattaggtatagaaagaatatacctcaaaataaagagatatgttctttataagctataggacaatcccatggttaacattattgtcaatggtgaaattttggaattgtttttaagatttattataagaaaaagatgcccactctcactacttctttcaacaccgtattggaaatcctgctcagaatctaagacaagagaaaaaagagcatttaaataagaaacaacaagttcttctattcatggagattaacgctcaggtttttgcagattagatttaacagcatgaaatctgtaccatccaggaatcaaaggatataggactttagggcatcaattattaagaggctataggaaagcagaaatgctcctggatgtttccattgtccacacacaaaatttcaacagaccagccccaggaagtaaaggcacattcctgactactgttagttgatgagcttttcaccaaaagcagagatgtgagacctggcaggtttcaaagacccctcaagtgctccataccttgaaattcacttccacaaagctagaacaccatctgttcctgagggatcaggttatcgtctgtttcttttaggcactggccagtcaggctttagtggacacgaagccacagatttttagtgtaaaatgcctaatctatcataatctttaggtagatatttggaggcctgcacacttaaatgggttggtgaaatgtcataccagacacatggctgggaattgggtttttctcctccgctcttagcagcacctttgtaacccagtgattacccccctcatggctccacggccacatccgcaaaaagggtactggtgaacgtgacattttcacgaagccacagcccatggtcactccctgcaaagctctgaacttgcgcattcccaggccaggccgtggttgtctttccaaggcggctcagcttgtgctttgcttggagagagcggagggcagcagcacagtgacagcgtctgggacctcagaccagtttccacagccacttatgaaagcagacggctccatgggctggaggaggtgggacgctctggaaagaactcgggtgcgagtgggaaagaaaatcgagctgagcagctggaagtcgaagtcgcgtgagtgaggaccagacactctcgatttaggcaaaggcggggtgcacttcccaacaacacatcctcctcactggcgagaccaggcctgcccttcaagttcctctcctgatttaatccccttggcgagggtttggcatgaaatcaatggccagcaagcttggtaaacgaagccgcctacaccgccctccccctccctgcacggccgcgccccgcctccgctcctgtctcaatctgggattgtcctcctgtagccccaccatccaccgtggggaacggtggagagactacaactcccagtatgcaccgcgatgcgcgcctcaccctgcatctcccagcccgcagccagctggcatcctagaccctctgccctgcgaccaacagccgggagcggaccagacaccagaactcccggaacggttgaagacggttccgctccctgtcccgcctttcgcagcccagcagtttcgccctgcggagaggagccttgctgtttccaaatctctcctgctgaagagacattggagctagggcggctagtttcacctggtaattgtgacaccctgtctcctcgagctgcaggcttttatgcttgtcatgttcgaagtttgataccttgcagatcaacaaagggccggtggcctctcactgcctccgcggcagggttgtcaagtttttcaggttaagtactgcacgactactcgcttctgaaactgatagacactgcctcagctccgtgcagggcagacgcacaagagcagaatctccgtgggacatctctctggagcatcaatattactgcagtatttggaagaaacaaatttaaataagttctaaggtgaagaatggaacatttaagacaagtctggaaagtcatctgcctttaataactgtcgtttgtccttaacgtcagactttctccaagaccaaaactctaagaacttatttccattcttacaaatagtaaaaatgataaatcatatcaagtcaattgaaagtcctgcctgctgctttcctaaattgcaatatggccttggtatggttttatttgtacttttgtgggggattcgtggatctttagattaaaaaaaaaaaaataggtttttgaacaatttttgcaagtttgcagctgttagttattgatttatttttccaacccatctaattcttctgtctctctcctctcctcaggctcaataattccatgggtctctaaggctgtgtttattttctttaaattttgttgatttacttttatactccatttgattttttctatctctcaccttttctcagactcagtcatcccacaggtctgtaaggctctgttcattttctttaaacttcttttttttttcctctcctcagattggataaattatattgctatgtctctgtttctgaactatagaaaagctcaaaattattatttttatttctcattttttatatggctattttttctctgctgatgtttcacatctattcatttatgagaatattttcctttgccctcatgagcgtgtttataatagctgccttcaaattcttgtctgccgtttacatcttggacatcttggagatggctactgcctgctttttatcttgtgtatttattacattttcacgtgtcttcacgcatcccttgaattggaaattgtgccctggagactgtatacaagactggattaaaaagactggattctgttttgtccctg

SEQ ID NO: 2514 - DNA, 666 bp, Homo sapiens
ttaatggacctggacagtggtgatgttaagagaagagtacatttatttgaaacccagagaaggacaaaagaagaagatccaataattccctttagtgatggacccatcatctcaaaatggggtgcgatttccagatcttcccgtacaggttaccataccacagatcctgtccaggccactgcttcccaaggaagtgcgactaagcccatcagtgtatcaggtggagttcatatggcaacgaggccacatcatcagcacactatgttgaaagggacagattcattgttactgatttatctggtcatagaaagcattccagtactggggaccttttgagccttgaacttcagcaggccaagagcaactcattacttcttcagagagaggccaatgctttggccatgcaacagaagtggaattccctggatgaaggccgtcaccttaccttaaaccttttaagcaaggaaattgaactaagaaatggagaggtaaagaaactgaacctttcggcttcatgcttaatgtatttgttttctgctgctgcatcttggttataccattactgagtgcattttggtgtgcctatctctgatggatgattgattgcttttaaaacttataacagaaataaaattgtaatcccagatttcttaaataattctttaa

SEQ ID NO: 2515 - DNA, 412 bp, Homo sapiens; identical to SEQ ID NO: 2104

SEQ ID NO: 2516 - DNA, 2867 bp, Homo sapiens
tccattccaaataaaatctataacaaattaggtatagaaagaatatacctcaaaataaagagatatgttctttataagctataggacaatcccatggttaacattattgtcaatggtgaaattttggaattgtttttaagatttattataagaaaaagatgcccactctcactacttctttcaacaccgtattggaaatcctgctcagaatctaagacaagagaaaaaagagcatttaaataagaaacaacaagttcttctattcatggagattaacgctcaggtttttgcagattagatttaacagcatgaaatctggtaccatccaggaatcaaaggatataggactttagggcatcaattattaagaggctataggaaagcagaaatgctcctggatgtttccattgtccacacacaaaatttcaacagaccagccccaggaagtaaaggcacattcctgactactgttagttgatgagcttttcaccaaaagcagagatgtgagacctggcaggtttcaaagacccctcaagtgctccataccttgaaattcacttccacaaagctagaacaccatctgttcctgagggatcaggttatcgtctgtttcttttaggcactggtcagtcaggctttagtggacacgaagccacagatttttagtgtaaaatgcctaatctatcataatctttaggtagatatttggaggcctgcacacttaaatgggttggtgaaatgtcataccagacacatggctgggaattgggtttttctcctccgctcttagcagcacctttgtaacccagtgattacccccctcatggctccacggccacatccgcaaaaagggtactggtgaacgtgacattttcacgaagccacagcccatggtcactccctgcaaagctctgaacttgcgcattcccaggccaggccgtggttgtctttccaaggcggctcagcttgtgctttgcttggagagagcggagggcagcagcacagtgacagcgtctgggacctcagaccagtttccacagccacttatgaaagcagacggctccatgggctggaggaggtgggacgctctggaaagaactcgggtgcgagtgggaaagaaaatcgagctgagcagctggaagtcgaagtcgcgtgagtgaggaccagacactctcgatttaggcaaaggcggggtgcacttcccaacaacacatcctcctcactggcgagaccaggcctgcccttcaagttcctctcctgatttaatccccttggcgagggtttggcatgaaatcaatggccagcaagcttggtaaacgaagccgcctacaccgccctccccctccctgcacggccgcgccccgcctccgctcctgtctcaatctgggattgtcctcctgtagccccaccatccaccgtggggaacggtggagagactacaactcccagtatgcaccgcgatgcgcgcctcaccctgcatctcccagcccgcagccagctggcatcctagaccctctgccctgcgaccaacagccgggagcggaccagacaccagaactcccggaacggttgaagacggttccgctccctgtcccgcctttcgcagcccagcagtttcgccctgcggagaggagccttgctgtttccaaatctctcctgctgaagagacattggagctagggcggctagtttcacctggtaattgtgacaccctgtctcctcgagctgcaggcttttatgcttgtcatgttcgaagtttgataccttgcagatcaacaaagggccggtggcctctcactgcctccgcggcagggttgtcaagtttttcaggttaagtactgcacgactactcgcttctgaaactgatagacactgcctcagctccgtgcagggcagacgcacaagagcagaatctccgtgggacatctctctggagcatcaatattactgcagtatttggaagaaacaaatttaaataagttctaaggtgaagaatggaacatttaagacaagtctggaaagtcatctgcctttaataactgtcgtttgtccttaacgtcagactttctccaagaccaaaactctaagaacttatttccattcttacaaatagtaaaaatgataaatcatatcaagtcaattgaaagtcctgcctgctgctttcctaaattgcaatatggccttggtatggttttatttgtacttttgtgggggattcgtggatctttagattaaaaaaaaaaaaataggtttttgaacaatttttgcaagtttgcagctgttagttattgatttatttttccaacccatctaattcttctgtctctctcctctcctcaggctcaataattccatgggtctctaaggctgtgtttattttctttaaattttgttgatttacttttatactccatttgattttttctatctctcaccttttctcagactcagtcatcccacaggtctgtaaggctctgttcattttctttaaacttcttttttttttcctctcctcagattggataaattatattgctatgtctctgtttctgaactatagaaaagctcaaaattattatttttatttctcattttttatatggctattttttctctgctgatgtttcacatctattcatttatgagaatattttcctttgccctcatgagcgtgtttataatagctgccttcaaattcttgtctgccgtttacatcttggacatcttggagatggctactgcctgctttttatcttgtgtatttattacattttcacgtgtcttcacgcatcccttgaattggaaattgtgccctggagactgtatacaagactggattaaaaagactggattctgttttgtccctg

SEQ ID NO: 2517 - DNA, 2983 bp, Homo sapiens
gataaatgcggagggacggtccagctttagctctctgctcgccgccgccgctgtcgccgccacctcctctgatctacgaaagtcatgttacccaacaccgggaggctggcaggatgtacagtttttatcacaggtgcaagccgtggcattggcaaagctattgcattgaaagcagcaaaggatggagcaaatattgttattgctgcaaagaccgcccagccacatccaaaacttctaggcacaatctatactgctgctgaagaaattgaagcagttggaggaaaggccttgccatgtattgttgatgtgagagatgaacagcagatcagtgctgcagtggagaaagccatcaagaaatttggagcttataccattgctaagtatggtatgtctatgtatgtgcttggaatggcagaagaatttaaaggtgaaattgcagtcaatgcattatggcctaaaacagccatacacactgctgctatggatatgctgggaggacctggtatcgaaagccagtgtagaaaagttgatatcattgcagatgcagcatattccattttccaaaagccaaaaagttttactggcaactttgtcattgatgaaaatatcttaaaagaagaaggaatagaaaattttgacgtttatgcaattaaaccaggtcatcctttgcaaccagatttcttcttagatgaatacccagaagcagttagcaagaaagtggaatcaactggtgctgttccagaattcaaagaagagaaactgcagctgcaaccaaaaccacgttctggagctgtggaagaaacatttagaattgttaaggactctctcagtgatgatgttgttaaagccactcaagcaatctatctgtttgaactctccggtgaagatggtggcacgtggtttcttgatctgaaaagcaagggtgggaatgtcggatatggagagccttctgatcaggcagatgtggtgatgagtatgactactgatgactttgtaaaaatgttttcagggaaactaaaaccaacaatggcattcatgtcagggaaattgaagattaaaggtaacatggccctagcaatcaaattggagaagctaatgaatcagatgaatgccagactgtgaaggaaaatataaaaaaaaagtcgactgctatgctcaaaaagtaaaaaaagctcaacagttaaaatctaatgtttgttttctttcctgttatattataaggatatgcacgtttgttctggaaaagatagaatttgtctctaaaagacttgaaattgtaattaaaatggcaagctaatcaaacataagcttcattaagtgggattctaagacagtctgtgtttttatatttcaagggtttaaccctttgagccttacatctcattcactgtctttctccaagaaaagtattttgggcggacagtcagatcaagcagtaaaattagctctttcaaatcttcttgtcatgtaaaatgaagctagtctgttttaaaatttttagttttggattgtatactaatgaaaatcttaatgatgtttttgatttttatatacttattttaaagaaaatcttatatagtacattttacaaaaattataaaaaatgaattagtactggcgaggactaaatgaaacaataatttttcattttgataactagctttccaggtggacttagccataggaaaatattactaatgtaatttaacaaattgctgcatgtattccatttaaaaatatgtttaaattgtcctaaaacaaaataattttctccctaggagtatgcatttggctacagtgttttgaaacagaaaccttagaataggtcattggtatgggctgaactgtgtatcccccaattcatttgttgaggtcctaactcccatttcttttgaatgtgactgttcggagatgaggcctttaaagaggtgacttaagttcaaaggaggctgttagtctaatccaacatggtgtcctttggacataagagataccagcaatgtgtgcacagaacaaagaccaggagaggacacagtgagaaggcagttatctgcaagcaaagagagaggcttcagaagaaacaaaatcaccagcaccttgatctttgacttctaatctccagaatagtgagaaataaatttctgttgttaagccgtccactgtgggaggccgacgcaggaggattgcttgaggccaggagttcaaggccagcctggacaacatagtaagaccctatctctacccccctaataaattaatttaaaaagccccccaatctgtggtattttattatggcagccctagcaagctaatacagtggtttgagaggctgggagggttgaggggaagataaacttttaaaaagctcttatctttcatttcaatcagttaaaaatacttgctcagtgtaacaattttgcttctcagcttccactctaatattgttgtgccattaagcaatttagctaatcctgacatttcttagattcataatgttaggagcatttaatctgtattttacaagttaggaagcagaggatcagagatgggaaaggactagcccaaggccaacattaacaagccctctaacaaaaactttacaatacatttatgttgaatggaactccaagatctcacctctccatccaggaatggagtccatgtaatcaaagtgaacttaaaaataggacagtttcaacaagtcaggagattcacagcaactgatcaaagggagtccagtcaacgtgagcaagcgtgattatgatgaggaagccccctctgctttaatccacacaaggaacgtaacctgaagtaacctgatgttaaccaatctgctgtgtctactatgctgtttccttgttcctgctagtgctgctttacaaatgcagaccattctatcatacctggcggggcttctgttttattttgtaggctggatgctacccagttcatgaatcgctaataaaagccaattagatcttta

SEQ ID NO: 2518 - DNA, 3350 bp, Homo sapiens
agggaccaggcttgggaggcgacgaagaggaacgctgggcgcaggaggcccactgcatacgcaggcgcactcggcgatcccggcttttccgcgcgcagttcccgcacaggcatcggggggggcaggggcggggcaggggcggggataaatgcggagggacggtccagctttagctctctgctcgccgccgccgctgtcgccgccacctcctctgatctacgaaagtcatgttacccaacaccgggaggctggcaggatgtacagtttttatcacaggtgcaagccgtggcattggcaaagctattgcattgaaagcagcaaaggatggagcaaatattgttattgctgcaaagaccgcccagccacatccaaaacttctaggcacaatctatactgctgctgaagaaattgaagcagttggaggaaaggccttgccatgtattgttgatgtgagagatgaacagcagatcagtgctgcagtggagaaagccatcaagaaatttggaggaattgatattctggtaaataatgccagtgccattagtttgaccaatacattggacacacctaccaagagattggatctgatgatgaacgtgaacaccagaggcacctaccttgcatctaaagcatgtattccttatttgaaaaagagcaaagttgctcatatcctcaatatcagtccaccactgaacctaaatccagtttggttcaaacagcactgtgcttataccattgctaagtatggtatgtctatgtatgtgcttggaatggcagaagaatttaaaggtgaaattgcagtcaatgcattatggcctaaaacagccatacacactgctgctatggatatgctgggaggacctggtatcgaaagccagtgtagaaaagttgatatcattgcagatgcagcatattccattttccaaaagccaaaaagttttactggcaactttgtcattgatgaaaatatcttaaaagaagaaggaatagaaaattttgacgtttatgcaattaaaccaggtcatcctttgcaaccagatttcttcttagatgaatacccagaagcagttagcaagaaagtggaatcaactggtgctgttccagaattcaaagaagagaaactgcagctgcaaccaaaaccacgttctggagctgtggaagaaacatttagaattgttaaggactctctcagtgatgatgttgttaaagccactcaagcaatctatctgtttgaactctccggtgaagatggtggcacgtggtttcttgatctgaaaagcaagggtgggaatgtcggatatggagagccttctgatcaggcagatgtggtgatgagtatgactactgatgactttgtaaaaatgttttcagggaaactaaaaccaacaatggcattcatgtcagggaaattgaagattaaaggtaacatggccctagcaatcaaattggagaagctaatgaatcagatgaatgccagactgtgaaggaaaatataaaaaaaaagtcgactgctatgctcaaaaagtaaaaaaagctcaacagttaaaatctaatgtttgttttctttcctgttatattataaggatatgcacgtttgttctggaaaagatagaatttgtctctaaaagacttgaaattgtaattaaaatggcaagctaatcaaacataagcttcattaagtgggattctaagacagtctgtgtttttatatttcaagggtttaaccctttgagccttacatctcattcactgtctttctccaagaaaagtattttgggcggacagtcagatcaagcagtaaaattagctctttcaaatcttcttgtcatgtaaaatgaagctagtctgttttaaaatttttagttttggattgtatactaatgaaaatcttaatgatgtttttgatttttatatacttattttaaagaaaatcttatatagtacattttacaaaaattataaaaaatgaattagtactggcgaggactaaatgaaacaataatttttcattttgataactagctttccaggtggacttagccataggaaaatattactaatgtaatttaacaaattgctgcatgtattccatttaaaaatatgtttaaattgtcctaaaacaaaataattttctccctaggagtatgcatttggctacagtgttttgaaacagaaaccttagaataggtcattggtatgggctgaactgtgtatcccccaattcatttgttgaggtcctaactcccatttcttttgaatgtgactgttcggagatgaggcctttaaagaggtgacttaagttcaaaggaggctgttagtctaatccaacatggtgtcctttggacataagagataccagcaatgtgtgcacagaacaaagaccaggagaggacacagtgagaaggcagttatctgcaagcaaagagagaggcttcagaagaaacaaaatcaccagcaccttgatctttgacttctaatctccagaatagtgagaaataaatttctgttgttaagccgtccactgtgggaggccgacgcaggaggattgcttgaggccaggagttcaaggccagcctggacaacatagtaagaccctatctctacccccctaataaattaatttaaaaagccccccaatctgtggtattttattatggcagccctagcaagctaatacagtggtttgagaggctgggagggttgaggggaagataaacttttaaaaagctcttatctttcatttcaatcagttaaaaatacttgctcagtgtaacaattttgcttctcagcttccactctaatattgttgtgccattaagcaatttagctaatcctgacatttcttagattcataatgttaggagcatttaatctgtattttacaagttaggaagcagaggatcagagatgggaaaggactagcccaaggccaacattaacaagccctctaacaaaaactttacaatacatttatgttgaatggaactccaagatctcacctctccatccaggaatggagtccatgtaatcaaagtgaacttaaaaataggacagtttcaacaagtcaggagattcacagcaactgatcaaagggagtccagtcaacgtgagcaagcgtgattatgatgaggaagccccctctgctttaatccacacaaggaacgtaacctgaagtaacctgatgttaaccaatctgctgtgtctactatgctgtttccttgttcctgctagtgctgctttacaaatgcagaccattctatcatacctggcggggcttctgttttattttgtaggctggatgctacccagttcatgaatcgctaataaaagccaattagatctttacataa

SEQ ID NO: 2519 - DNA, 1566 bp, Homo sapiens
acaaagcggttggttgcggcagggactacaccggtgtatcatgggagcggcccgggctacacgttaaaaacactaaggggagcgcgcgaagctgaacttggcgctcgatgggggccgttagccgccctagagcgcgcggagccgcagaggcgtagctggactacaacgcagtgcatctcgggaggccaactcgactggactgggtgagaggacagaggtggctcgatgggcggcccgaaggccggggatcatggcgggaaggcgggcccagacaggttcagccccgccccgacccgccgctccccaccccccggccggcctcgcgtgccttcccgcagcactgccgtccccgggatgctgagcgcccaccgtctccccgcagccccctcatgcccggctgcgagctgcccgtgggcacctgcccggacatgtgcccggccgccgagcgcgcccagcgcgaaagggagcaccgcctgcaccgcttggaggtggtgccgggttgccgccaggacccgccccgcgcggatccgcagcgcgcggtgaaggagtacagccgacccgccgccggcaagccccggcccccgcccagccagttgcgtccgccctccgtgctgctggccaccgtgcgctacctggccggtgaggtggcggagagcgccgacatcgcccgcgccgaggtggccagcttcgtggcagaccgcttgcgagctgtgctcctggacctggcgctgcagggagcgggcgacgccgaggcagctgtggtgctggaggcggcgctggccacgctgctgaccgtagtggcgcggctcgggcccgacgcggcgcggggacccgcggacccggtgctgctgcaggcccaggtgcaggagggcttcggctcgctgcggcgctgctacgcgcggggcgccgggccgcacccccgccaacccgccttccagggcctctttctgctctataacctgggctcggtggaagccctgcatgaggttctacagctgcctgctgccctgcgcgcctgcccgcccctccgcaaggccttggcggtagatgctgccttccgagagggcaatgctgcccgcctgttccgtctgctccagaccctgccctacctgccaagttgcgctgtgcagtgccatgtgggccatgcccgccgggaagccctggcccgcttcgctcgtgcctttagcacccccaagggccagaccttgcctctgggcttcatggtcaacctcttggccctggatggactcagggaagcacgggacctgtgccaggcccacgggctgcccttggacggagaggagagagttgtgttcctgaggggtcgctacgtggaggaagggctaccgcctgccagtacgtgcaaggtgttagtggagagcaaacttcgaggacgtaccctggaggaggtggtcatggcagaggaggaagatgagggcacggacagacctgggtccccagcctgaggagggagcgtgagcctcccagagccccaggactgggccagagcacttaggtttctttttccatggtttccaggtaataaaaggaacttgttttgttggt

SEQ ID NO: 2520 - DNA, 393 bp, Homo sapiens
gagccgagccgagccgagctgggggcgcagagcgcgggaggcggcggcggcgcggagcccagatggagtttccctcttgttgcccgagccagagtacagtggtgtgatctcggttcactgcaacctctgcctcccaggttcaagcgattctcctgcctcagcctcccgagtggctgggattacaggtggctccgctgccggatgggagtgccccagtgtgctggatgaagctggcgcatgcaccatgtcatcatgtgtctctagccagcccagcagcaaccgggccgccccccaggatgagctggggggcaggggcagcagcagcagcgaaagccagaagccctgtgaggccctgcggggcctctcatccttgagcatccacctgggcatgga

SEQ ID NO: 2521 - DNA, 6072 bp, Homo sapiens
agaaaggaaaaaagacaacgaggaaaaaggaggtgtccgggtagggcaacgcggcgacacccgaggcctggtggtggcggcggatcgagatattcaaggctgaagcagctacggaacggcagcggcggcggtcggacaaactgactgaccgagccgggtggtggcgggagcagcgggagcagccggaacgatgccggccgtgagcctcccgcccaaggagaatgcgctcttcaagcggatcttgaggtgttatgaacataaacagtatagaaatggattgaaattctgtaaacaaatactttctaatcccaaatttgcagagcatggagaaaccttggctatgaaaggattaacattgaactgtttggggaaaaaggaagaagcttatgaattggttcgtagaggtttgagaaatgacttgaagagtcatgtgtgttggcacgtttatggccttcttcagaggtcagacaagaagtatgatgaagccattaagtgttacagaaatgcactaaaatgggataaagacaatcttcaaatcttaagggacctttccttactacagattcaaatgcgagatcttgagggttacagggaaacgaggtatcagttacttcagcttcgacctgcgcagagagcatcatggattggttatgctattgcttaccatttattagaagattatgaaatggcagcaaagattttagaagaatttaggaaaacacaacagacatcccctgacaaggtggattatgaatatagtgaactactcttatatcagaatcaagttcttcgggaagcaggtctctatagagaagctttggaacatctttgtacctatgaaaagcagatttgtgataaacttgctgtagaagaaaccaaaggggaacttctgttgcaactatgtcgtttggaagatgctgcagatgtttatagaggattgcaagagagaaatcctgaaaactgggcctattacaaaggcttggaaaaagcactcaagccagctaatatgttagaacggctaaaaatttatgaggaagcctggactaaatatcccaggggactggtgccaagaaggctgccgttaaactttttatctggtgagaagtttaaagaatgtttggataagttcctaaggatgaatttcagcaagggttgcccaccagtcttcaatactttaagatcattatacaaagacaaagaaaaggtggcaatcatagaagagttagtagtaggttatgaaacctctctaaaaagctgccggttatttaaccccaatgatgatggaaaggaggaaccaccaaccacattactttgggtccagtactacttggcacaacattatgacaaaattggtcagccatctattgctttggagtacataaatactgctattgaaagtacacctacattaatagaactctttctcgtgaaagctaaaatctataagcatgctggaaatattaaagaagctgcaaggtggatggatgaggcccaggccttggacacagcagacagatttatcaactccaaatgtgcaaaatacatgctaaaagccaacctgattaaagaagctgaagaaatgtgctcaaagtttacaagggaaggaacatcagcggtagagaatttgaatgaaatgcagtgcatgtggttccaaacagaatgtgcccaggcttataaagcaatgaataaatttggtgaagcacttaagaaatgtcatgagattgagagacattttatagaaatcactgatgaccagtttgactttcatacatactgtatgaggaagattacccttagatcatatgtggacttattaaaactagaagatgtacttcgacagcatccattttacttcaaggcagcaagaattgctatagagatctatttgaagcttcatgacaacccccttacagatgagaataaagaacacgaagctgatacagcaaacatgtctgacaaagagctaaagaagctacgtaataaacaaagaagagctcaaaagaaagcccagatagaagaagagaaaaaaaatgcagaaaaagaaaagcagcagagaaatcagaaaaagaagaaggatgatgatgatgaggagataggaggtccaaaagaagaacttattccagagaaactggccaaggttgaaactccattggaagaagctattaaatttttaacaccgttgaagaacttggtgaagaacaagatagagactcatctttttgcctttgagatttactttaggaaagaaaagtttcttttgatgctacaatcagtaaagagggcatttgctattgattctagtcatccctggcttcatgagtgtatgattcgtctctttaatactgtgtgtgaaagtaaagatttatctgatacagttagaacagtattaaaacaagaaatgaatcgtctttttggagcaacgaatccaaagaattttaatgaaacttttctgaaaaggaattctgattcattgccacacagattatcagctgccaaaatggtatattacttagatccttctagtcagaagcgagctatagagttggcaacaacacttgatgaatctctcactaacagaaacctccagacatgtatggaggtattggaagccttgtatgatggtagcctaggagactgtaaagaagctgctgaaatttatagagcaaattgtcataagcttttcccttatgctttggctttcatgcctcctggatatgaagaggatatgaagatcacagttaatggagatagttctgcagaagctgaagaactggccaatgaaatttgaacatcactaaacaagcaaatggaatgactttggaccatatctagtatataatatttttgtcacgcacctgctgcattgctctaacttacacagaatgagaggagtaaatgttcttgccttcaaatagtgttttacgttttttatcctgctgaaaaagtatatataaaatatctaacattacaggatagaggttcagtttcttaaaaaattaaagctgctaaaattgagtggttaaaaaagataccttatcctattcctccccacccacccatgtttttaaactaatttatataaaatctggaggctgttacagctaacaaagcaggtgtgtggcagaaatattactttaaatttgtcttgtgagattttactatatctcagacagcataaatgctgttttagcactggattctttcactgagcacaaagagttgttggggctttagcatctgactgattttgttacggggttgattctgaccataggaagtatgcaatgtgaatcactatttacagagaaacctacaacagatgcttgatgttgtagaaactgggacatatagataccaagcaaaattataagaaacctataaggtgttcaatacgcttgtgtttccaaaattcactgtacatgatcagtttggtgttcttgtaccacagtttttaactgaaggaaccagttgtaacagtctcaattttaactaaaacttgaagaactaaaacaacaatgcaaacctttcagcattgtttggccaaacttgttaaaactgtaatgcaagaaccaaatgcactgtgatgtggcaccaactaattagcaagcatgaatttttcacccaagagtgaaaaaaggaaaatctaccatggcttgaagttaaagagcagaactcctgactaccattctatgactgatcaaaagactaatagttaaaaacctcagcaggccttgttcacgatatgcagaaaaaaaagtgctgcagtttagatacctctggaatttttccacagtgtcacaggtttgtaatacttgaagccctacatttctaagaatatatttcttgctcagttgtttcaggcaagcccaagactttgtaatttttaaagggcccaagattttttttttttttttttttttcaaataacagaccagcttctttttcttgcagttacagatgtaatttcctttttgttgtcaaacataaggtaccaaatatgatgcaataaattgttttgaaaaacagttgtgtgaatatttcaactaatctgtgttgggcttctgtgaaatacacaggtggaaacagaggtgcaagccagaggcaatgtaatatgctgtaaggctagtgcagatgggagctttttagaaggggctaagtgctggtgtcagggaaattccataatgaagtagaatgctgctcctgcattaagatttcattgagggcaaggctggtggcaggtactatgaatgtaattcataatttaaaaggaaaactaaaaactattttgatttgggaaaatgagccttaatttgttaaacctatacactgagaactagcctcaggcttaatattctcattgcatttgcaagatctgagcaaataagattaagtaaaacaaatcaattgtatatataattgacctttttgtggaacatgtagtttatagaaagtatactctaaagggaatttgccgaagaccttttactgattgaacagttgtgctacaatcaacttttcatagtacatgacctgcattccacatctcagtctaacagtttagtagtgatgtaaagagaagtacaaaccgaactccagtgctttgttatgttttattaactggccctgtctcaggaacatcttaacagatggcaaaaaaacaaaaactttttttcaactcctatgagtggcaactgaagttcttattgttgggaaagaacactagtcctacctctgccactaatgaggtgtttggaggaggtaccagccatataatagggggtgtatgtgtgaattttgtttaaactctactgtatattgaaatgaaattcatttatttgtcttgacaatgttcaaatgatgtagattgtcttagaatgaatattcataagtactcagaactcttaagatgcagatgccacccgtgaggagctaaattcctaatgtgtattgtattccaacccaattttactggaactattgaataaatcttttattttctttcaggtttacttgatagtggatacattggtgtcagaggaccttgactgggttcattttatgtccagacatcacccctgaaacactgtactgtactatcttgctctgagtagtatcaactggatcgtctcatatttgcctcattcatcctattaatttcaaatgatactgtgggggaaaaacagggttagaaaaacaagtggaaaaaatggagtgatgttgtaatctaaacaagtgccttatgtttattgctaagaactggtgttaccaacccttttgagaagaaagggtctcttgacctgtattaacataggaaagtaaagttctttttgtttttctttatattcagctactcttgtcatttctcgttgaaaaactaaaatctgactaggttagtttactcagctttaattagatagttgagtcatatattttcaacatttttctgtatcgtatttattatgcacaaaaataaagtgtgatctctaatagcatggctaaaggtaatgccaatattagtgaatagctttgctgtgggctttatcaggcccttgtttttcacagtgttgtttgtactccatggtgtattgctattagagctgtgaaatgaaagctgtgactttatgaagagatcaaaaaaagtgtggtccagattcaggtaggttgtggtaagttcagggaagtcttgtatgatttctaagaatatttcagttaccatgtatagtatttgggaaaagctgtaatgtaaaatattggactttgttgcaagataggtatatacttgtgtcagataattaaagccttaaattttgaaatgaatctttgagatttcaaagaaagactgacctttcaaatagaaggcggtctttctattctagctaatgccccacttctttaagttataaacaaagtttcatgataccattctgctatcatctaaactttgctgaactctactgccaacctacattaaaaacaaagtcccacgaaatggctgtgttacaccatagtgagcagaaacttaaattttgttctaattttgatggttgaaaaatttcaacctgtagcaataaa

SEQ ID NO: 2522 - DNA, 2309 bp, Homo sapiens
cgcggccccaagcggttcccgagcccaggcccgcgccgagcccaggtcctagagcagctccagcaggatggcggctccagcgtctctaaggcctgcagggggtccagccccatggggggcgccctaggcctccgacagctccccatctgtgctcctgcctgccggccatcctcaggccactcgccatgggcggctgcttctccaaacccaaaccagtggagctcaagatcgaggtggtgctgcctgagaaggagcgaggcaaggaggagctgtcggccagtgggaagggcagcccccgggcctaccagggcaatggcacggcccgccacttccacacggaggagcgcctgtccacccctcacccctaccccagccctcaggattgcgtggaggctgctgtctgccacgtcaaggacctcgagaatggccagatgcgggaagtggagctgggctgggggaaggtgttgctggtgaaggacaatggggagttccacgccctgggccataagtgtccgcactacggcgcacccctggtgaaaggcgttctgtcccgtggtcgggtgcgctgcccctggcacggcgcctgcttcaacatcagcactggggacctggaggacttccctggcctggacagtctacacaagttccaggtgaagattgagaaggagaaggtgtacgtccgggccagcaagcaggccctacagctgcagcgaaggaccaaggtgatggccaagtgtatctctccaagtgctgggtacagcagtagcaccaatgtgctcattgtgggtgcaggtgcagctggcctggtgtgtgcagagacactgcggcaggagggcttctccgaccggatcgtcctgtgcacgctagaccggcaccttccctacgaccgtcccaagctcagcaagtccctggacacacagcctgagcagctggccctgaggcccaaggagtttttccgagcctatggcatcgaggtgctcaccgaggctcaggtggtcacagtggacgtgagaactaagaaggtcgtgttcaaggatggcttcaagctggagtacagcaagctgctgctggcaccagggagcagccccaagactctgagctgcaaaggcaaagaagtggagaacgtgttcactatccggacgccagaggatgccaatcgcgtggtgaggctggcccgaggccgcaacgtggtcgtcgtgggagccggcttcctggggatggaggtggccgcttacctgacggagaaggcccactctgtgtctgtggtggagctggaggagacgcccttcaggaggttcctgggggagcgcgtgggtcgagccctcatgaagatgtttgagaacaaccgggtgaagttctacatgcagacggaggtgtctgagctgcggggccaggagggaaagctgaaggaggttgtgctgaagagcagcaaggtcgtgcgggctgacgtctgcgtggtgggcattggtgcagtgcccgccacaggcttcctgaggcaaagcggcatcggtttggattcccgaggcttcatccctgtcaacaagatgatgcagaccaatgtcccaggcgtgtttgcagctggcgatgctgtcaccttcccccttgcctggaggaacaaccgcaaagtgaacattccacattggcagatggctcatgctcaggggcgcgtggcagcccagaacatgttggcgcaggaggcggagatgagcactgtgccctacctctggaccgccatgtttggcaagagcctgcgctacgcgggctacggagaaggcttcgacgacgtcatcatccagggggatctggaggagctgaagtttgtggctttttacactaaaggcgacgaggtgatcgccgtggccagcatgaactacgatcccattgtgtccaaggtcgctgaggtgctggcctcaggccgtgccatccggaagcgggaggtggagactggcgacatgtcctggcttacggggaaaggatcctgagctcacatgcagtagacttgggcaggcaaagggggcaccaagggcacaggccaagccttgggggcaggtgccaatctccagtcccaggatcccccagggcagaacctgagccctcccagtgcttgccttcagccacctggctcccctcctgggaggcctctgctggatccagaagatgctcaaccctcaaggcctctgctgccactgacagctggcactggaggcaggacaagccctgcctcttctccctctattgggactggtcccctgaagaaccctgcaacacgttaaacattaccgtaaaattaaaacgcacaaatttgcaga

SEQ ID NO: 2523 - DNA, 2387 bp, Homo sapiens
agtgcaaacgcagcgccagacacgccccgcccgcgcctccccgcccccccgcgcccgcggccccaagcggttcccgagcccaggcccgcgccgagcccaggtcctagagcagctccagcaggatggcggctccagcgtctctaaggcctgcagggggtccagccccatggggggcgccctaggcctccgacagctccccatctgtgctcctgcctgccggccatcctcaggccactcgccatgggcggctgcttctccaaacccaaaccagtggagctcaagatcgaggtggtgctgcctgagaaggagcgaggcaaggaggagctgtcggccagtgggaagggcagcccccgggcctaccagggcaatggcacggcccgccacttccacacggaggagcgcctgtccacccctcacccctaccccagccctcaggattgcgtggaggctgctgtctgccacgtcaaggacctcgagaatggccagatgcgggaagtggagctgggctgggggaaggtgttgctggtgaaggacaatggggagttccacgccctgggccataagtgtccgcactacggcgcacccctggtgaaaggcgttctgtcccgtggtcgggtgcgctgcccctggcacggcgcctgcttcaacatcagcactggggacctggaggacttccctggcctggacagtctacacaagttccaggtgaagattgagaaggagaaggtgtacgtccgggccagcaagcaggccctacagctgcagcgaaggaccaaggtgatggccaagtgtatctctccaagtgctgggtacagcagtagcaccaatgtgctcattgtgggtgcaggtgcagctggcctggtgtgtgcagagacactgcggcaggagggcttctccgaccggatcgtcctgtgcacgctagaccggcaccttccctacgaccgtcccaagctcagcaagtccctggacacacagcctgagcagctggccctgaggcccaaggagtttttccgagcctatggcatcgaggtgctcaccgaggctcaggtggtcacagtggacgtgagaactaagaaggtcgtgttcaaggatggcttcaagctggagtacagcaagctgctgctggcaccagggagcagccccaagactctgagctgcaaaggcaaagaagtggagaacgtgttcactatccggacgccagaggatgccaatcgcgtggtgaggctggcccgaggccgcaacgtggtcgtcgtgggagccggcttcctggggatggaggtggccgcttacctgacggagaaggcccactctgtgtctgtggtggagctggaggagacgcccttcaggaggttcctgggggagcgcgtgggtcgagccctcatgaagatgtttgagaacaaccgggtgaagttctacatgcagacggaggtgtctgagctgcggggccaggagggaaagctgaaggaggttgtgctgaagagcagcaaggtcgtgcgggctgacgtctgcgtggtgggcattggtgcagtgcccgccacaggcttcctgaggcaaagcggcatcggtttggattcccgaggcttcatccctgtcaacaagatgatgcagaccaatgtcccaggcgtgtttgcagctggcgatgctgtcaccttcccccttgcctggaggaacaaccgcaaagtgaacattccacattggcagatggctcatgctcaggggcgcgtggcagcccagaacatgttggcgcaggaggcggagatgagcactgtgccctacctctggaccgccatgtttggcaagagcctgcgctacgcgggctacggagaaggcttcgacgacgtcatcatccagggggatctggaggagctgaagtttgtggctttttacactaaaggcgacgaggtgatcgccgtggccagcatgaactacgatcccattgtgtccaaggtcgctgaggtgctggcctcaggccgtgccatccggaagcgggaggtggagctgtttgtgctgcacagcaagactggcgacatgtcctggcttacggggaaaggatcctgagctcacatgcagtagacttgggcaggcaaagggggcaccaagggcacaggccaagccttgggggcaggtgccaatctccagtcccaggatcccccagggcagaacctgagccctcccagtgcttgccttcagccacctggctcccctcctgggaggcctctgctggatccagaagatgctcaaccctcaaggcctctgctgccactgacagctggcactggaggcaggacaagccctgcctcttctccctctattgggactggtcccctgaagaaccctgcaacacgttaaacattaccgtaaaattaaaacgcacaaatttgcagatc

SEQ ID NO: 2524 - DNA, 1923 bp, Homo sapiens
tgctgcgtggaaccgccgagttcccagcgcttgagaaggaaaattctggatctgttatctgtgaggaggccactccgttgacagttgtgtaaaactctgctgctttccccagctccaacctctctggtcttcaacaacactatcatcagggaaaacgtgggggaagatgaaccagccgtgcaactcgatggagccgagggtgatggacgatgacatgctcaagctggccgtcggggaccagggcccccaggaggaggccgggcagctggccaagcaggagggcatcctcttcaaggatgtcctgtccctgcagctggactttcggaacatcctccgcatagacaacctctggcagtttgagaacttgaggaagctgcagctggacaataacatcattgagaagatcgagggcctggagaacctcgcacacctggtctggctggatctgtctttcaacaacattgagaccatcgaggggctggacacactggtgaacctggaggacctgagcttgttcaacaaccggatctccaagatcgactccctggacgccctcgtcaagctgcaggtgttgtcgctgggcaacaaccggattgacaacatgatgaacatcatctacctccggcggttcaagtgcctgcggacgctcagcctctctaggaaccctatctctgaggcagaggattacaagatgttcatctgtgcctaccttcctgacctcatgtacctggactaccggcgcattgatgaccacacaaaaaagcttgcggaggctaagcaccagtacagcatcgacgagctgaagcaccaggagaacctgatgcaggcccagctggaggacgagcaggcgcagcgggaggagctagagaagcacaagactgcgtttgtggaacacctgaatggctccttcctgtttgacagcatgtacgctgaggactcagagggcaacaatctgtcctacctgcctggtgtcggtgagctccttgagacctacaaggacaagtttgtcatcatctgcgtgaatatttttgagtatggcctgaaacagcaggagaagcggaaaacagagcttgacaccttcagtgaatgtgtccgtgaggccatccaggaaaaccaggagcagggcaaacgcaagattgccaaattcgaggagaagcacttgtcgagtttaagtgccattcgagaggagttggaactgcccaacattgagaagatgatcctagaatgcagtgctgacatcagtgagttgttcgatgcgctcatgacgctggagatgcagctggtggagcagctggaggagactataaacatgtttgaaaggaacattgttgacatggtaggactgtttatcgaaaatgtccaaagcctgatggctcagtgccgggacctggagaatcaccaccacgagaagctcctggagatctctatcagcaccctggagaagattgtcgagggcgacctggacgaggacctgcctaacgacctgcgcgcgggtcgtttccaaaagttcaattatgtggaggcttctggcactttctaagagaagcagttacaggtagaggttgaagtctgagatttcccctggaggtcttcttaaccttagagtctgtataatgagtactgtgggggtgttggaaccaccatttctgatcctgcacaatgccatccggtttgcaccagcacatccactgatgaatggtcacaaaatcagcagggtcggcctgaggaacctggctccatccctggggtctgcacgctaagaaggctctcccggatgtctgcgctgggtcccgcggcagcatgtctatgtctctggaaggagtgtgggcatcaagggcccagacagagatactatgttgtcagggcccagacagagatactatgttgtcagggcctgctttagtgcatgcatcattcactcca

SEQ ID NO: 2525 - DNA, 2046 bp, Homo sapiens
gtgtttcaccacacggagatgtggtcacgtgacttgtcaactttcacccaggatgtctcccttctgacttccccttagcaaccaagtcgcggcgcttggttccccagcaaccgggagacgcgtctgctgcgtggaaccgccgagttcccagcgcttgagaaggaaaattctggatctgttatctgtgaggaggccactccgttgacagttgtgtaaaactctgctgctttccccagctccaacctctctggtcttcaacaacactatcatcagggaaaacgtgggggaagatgaaccagccgtgcaactcgatggagccgagggtgatggacgatgacatgctcaagctggccgtcggggaccagggcccccaggaggaggccgggcagctggccaagcaggagggcatcctcttcaaggatgtcctgtccctgcagctggactttcggaacatcctccgcatagacaacctctggcagtttgagaacttgaggaagctgcagctggacaataacatcattgagaagatcgagggcctggagaacctcgcacacctggtctggctggatctgtctttcaacaacattgagaccatcgaggggctggacacactggtgaacctggaggacctgagcttgttcaacaaccggatctccaagatcgactccctggacgccctcgtcaagctgcaggtgttgtcgctgggcaacaaccggattgacaacatgatgaacatcatctacctccggcggttcaagtgcctgcggacgctcagcctctctaggaaccctatctctgaggcagaggattacaagatgttcatctgtgcctaccttcctgacctcatgtacctggactaccggcgcattgatgaccacacaaaaaagcttgcggaggctaagcaccagtacagcatcgacgagctgaagcaccaggagaacctgatgcaggcccagctggaggacgagcaggcgcagcgggaggagctagagaagcacaagactgcgtttgtggaacacctgaatggctccttcctgtttgacagcatgtacgctgaggactcagagggcaacaatctgtcctacctgcctggtgtcggtgagctccttgagacctacaaggacaagtttgtcatcatctgcgtgaatatttttgagtatggcctgaaacagcaggagaagcggaaaacagagcttgacaccttcagtgaatgtgtccgtgaggccatccaggaaaaccaggagcagggcaaacgcaagattgccaaattcgaggagaagcacttgtcgagtttaagtgccattcgagaggagttggaactgcccaacattgagaagatgatcctagaatgcagtgctgacatcagtgagttgttcgatgcgctcatgacgctggagatgcagctggtggagcagctggaggagactataaacatgtttgaaaggaacattgttgacatggtaggactgtttatcgaaaatgtccaaagcctgatggctcagtgccgggacctggagaatcaccaccacgagaagctcctggagatctctatcagcaccctggagaagattgtcgagggcgacctggacgaggacctgcctaacgacctgcgcgcgggtcgtttccaaaagttcaattatgtggaggcttctggcactttctaagagaagcagttacaggtagaggttgaagtctgagatttcccctggaggtcttcttaaccttagagtctgtataatgagtactgtgggggtgttggaaccaccatttctgatcctgcacaatgccatccggtttgcaccagcacatccactgatgaatggtcacaaaatcagcagggtcggcctgaggaacctggctccatccctggggtctgcacgctaagaaggctctcccggatgtctgcgctgggtcccgcggcagcatgtctatgtctctggaaggagtgtgggcatcaagggcccagacagagatactatgttgtcagggcccagacagagatactatgttgtcagggcctgctttagtgcatgcatcattcactcc

SEQ ID NO: 2526 - DNA, 2014 bp, Homo sapiens
gagacagggtcttcctatgttgcccgggctggtcttgaactcctgaactcaagcagtccttccacctcggcctcccaaagagctgggattacaggtgaaaattctggatctgttatctgtgaggaggccactccgttgacagttgtgtaaaactctgctgctttccccagctccaacctctctggtcttcaacaacactatcatcagggaaaacgtgggggaagatgaaccagccgtgcaactcgatggagccgagggtgatggacgatgacatgctcaagctggccgtcggggaccagggcccccaggaggaggccgggcagctggccaagcaggagggcatcctcttcaaggatgtcctgtccctgcagctggactttcggaacatcctccgcatagacaacctctggcagtttgagaacttgaggaagctgcagctggacaataacatcattgagaagatcgagggcctggagaacctcgcacacctggtctggctggatctgtctttcaacaacattgagaccatcgaggggctggacacactggtgaacctggaggacctgagcttgttcaacaaccggatctccaagatcgactccctggacgccctcgtcaagctgcaggtgttgtcgctgggcaacaaccggattgacaacatgatgaacatcatctacctccggcggttcaagtgcctgcggacgctcagcctctctaggaaccctatctctgaggcagaggattacaagatgttcatctgtgcctaccttcctgacctcatgtacctggactaccggcgcattgatgaccacacaaaaaagcttgcggaggctaagcaccagtacagcatcgacgagctgaagcaccaggagaacctgatgcaggcccagctggaggacgagcaggcgcagcgggaggagctagagaagcacaagactgcgtttgtggaacacctgaatggctccttcctgtttgacagcatgtacgctgaggactcagagggcaacaatctgtcctacctgcctggtgtcggtgagctccttgagacctacaaggacaagtttgtcatcatctgcgtgaatatttttgagtatggcctgaaacagcaggagaagcggaaaacagagcttgacaccttcagtgaatgtgtccgtgaggccatccaggaaaaccaggagcagggcaaacgcaagattgccaaattcgaggagaagcacttgtcgagtttaagtgccattcgagaggagttggaactgcccaacattgagaagatgatcctagaatgcagtgctgacatcagtgagttgttcgatgcgctcatgacgctggagatgcagctggtggagcagctggaggagactataaacatgtttgaaaggaacattgttgacatggtaggactgtttatcgaaaatgtccaaagcctgatggctcagtgccgggacctggagaatcaccaccacgagaagctcctggagatctctatcagcaccctggagaagattgtcgagggcgacctggacgaggacctgcctaacgacctgcgcgcgctttttgtcgataaagatacgattgttaatgctgtcggggcatcgcacgacatccacctcctgaagattgacaatcgagaagatgagctggtgaccagaatcaactcttggtgtacacgtttaatagacaggattcacaaggatgagatcatgaggaaccgcaagcgcgtgaaggagatcaatcagtacatcgaccacatgcagagcgaactggacaacctggaatgtggcgacatcctagactagatgaatgtcagccacaggagcttcttcaaaacatagcaccagccccagccaggagaaggaagtgcacacgcctcacccgcacctctagagagttgctgggcatctctcaaccgcgatccccaacaccattcttcccccacccctggaaaaacttccaaaagtagagaaaataaaggactcatttcacatttcccctactcataaaaaaaaaaaaaaaa

SEQ ID NO: 2527 - DNA, 2008 bp, Homo sapiens
ccttagcaaccaagtcgcggcgcttggttccccagcaaccgggagacgcgtctgctgcgtggaaccgccgagttcccagcgcttgagaaggaaaattctggatctgttatctgtgaggaggccactccgttgacagttgtgtaaaactctgctgctttccccagctccaacctctctggtcttcaacaacactatcatcagggaaaacgtgggggaagatgaaccagccgtgcaactcgatggagccgagggtgatggacgatgacatgctcaagctggccgtcggggaccagggcccccaggaggaggccgggcagctggccaagcaggagggcatcctcttcaaggatgtcctgtccctgcagctggactttcggaacatcctccgcatagacaacctctggcagtttgagaacttgaggaagctgcagctggacaataacatcattgagaagatcgagggcctggagaacctcgcacacctggtctggctggatctgtctttcaacaacattgagaccatcgaggggctggacacactggtgaacctggaggacctgagcttgttcaacaaccggatctccaagatcgactccctggacgccctcgtcaagctgcaggtgttgtcgctgggcaacaaccggattgacaacatgatgaacatcatctacctccggcggttcaagtgcctgcggacgctcagcctctctaggaaccctatctctgaggcagaggattacaagatgttcatctgtgcctaccttcctgacctcatgtacctggactaccggcgcattgatgaccacacaaaaaagcttgcggaggctaagcaccagtacagcatcgacgagctgaagcaccaggagaacctgatgcaggcccagctggaggacgagcaggcgcagcgggaggagctagagaagcacaagactgcgtttgtggaacacctgaatggctccttcctgtttgacagcatgtacgctgaggactcagagggcaacaatctgtcctacctgcctggtgtcggtgagctccttgagacctacaaggacaagtttgtcatcatctgcgtgaatatttttgagtatggcctgaaacagcaggagaagcggaaaacagagcttgacaccttcagtgaatgtgtccgtgaggccatccaggaaaaccaggagcagggcaaacgcaagattgccaaattcgaggagaagcacttgtcgagtttaagtgccattcgagaggagttggaactgcccaacattgagaagatgatcctagaatgcagtgctgacatcagtgagttgttcgatgcgctcatgacgctggagatgcagctggtggagcagctggaggagactataaacatgtttgaaaggaacattgttgacatggtaggactgtttatcgaaaatgtccaaagcctgatggctcagtgccgggacctggagaatcaccaccacgagaagctcctggagatctctatcagcaccctggagaagattgtcgagggcgacctggacgaggacctgcctaacgacctgcgcgcgctttttgtcgataaagatacgattgttaatgctgtcggggcatcgcacgacatccacctcctgaagattgacaatcgagaagatgagctggtgaccagaatcaactcttggtgtacacgtttaatagacaggattcacaaggatgagatcatgaggaaccgcaagcgcgtgaaggagatcaatcagtacatcgaccacatgcagagcgaactggacaacctggaatgtggcgacatcctagactagatgaatgtcagccacaggagcttcttcaaaacatagcaccagccccagccaggagaaggaagtgcacacgcctcacccgcacctctagagagttgctgggcatctctcaaccgcgatccccaacaccattcttcccccacccctggaaaaacttccaaaagtagagaaaataaaggactcatttcacatttcccctactcataaaaaaaaaaaaaaaa

SEQ ID NO: 2528 - DNA, 2853 bp, Homo sapiens
cctccctccagtctccggatctccctcggtccctctctcctcctcttcctctctctggacgcccggctcctccgcaccccctcccccgggggtcccgcggccttgctccctaccctcacctcaagacgaccatggccaccatcccagactggaagctacagctgctagcccggcgccggcaggaggaggcgtccgttcgaggccgagagaaagcagaacgggagcgcctgtcccagatgccagcctggaaacgagggctcctggagcgccgccgggccaagcttgggctgtcccctggggagcctagccctgtgctagggactgtagaggctggacctccagacccggatgagtctgcggtccttctggaggccatcgggccagtgcaccagaaccgattcatccggcaggagcggcagcagcagcagcagcaacaacaacggagtgaagagctgctagcagagagaaagcctgggcctctggaggcccgggagcggagacccagccctggggagatgcgggatcagagccccaagggaagagagtcaagagaagagagactaagtccgagggagaccagagagaggaggctggggatagggggagcccaagagttgagcctgaggcctctggaggctcgggactggaggcaaagcccaggagaggtgggagacaggagctcccgactgtcagaggcatggaaatggaggctgagtcctggagaaactccagagcggagtctgagactagcagagtctcgagagcaaagccccaggagaaaagaggtggaaagtagactgagcccaggggaatctgcctaccagaagttgggcctgacagaggcccataaatggagacctgactccagagagtctcaggaacagagtttggtacaactggaggcaacagagtggaggctgaggtcaggagaagaaagacaagactactcggaagaatgtgggagaaaagaagagtggccagttccaggggtagctccaaaagagactgcagagctgtccgagaccctgacaagggaggcccaaggcaacagttccgcaggagtggaggcagcagagcagaggcctgtggaagatggcgagaggggcatgaagccaacagaagggtggaaatggaccctgaactccgggaaggctcgagaatggacacccagggacatagaggctcaaactcagaaaccagaacctccagagtcagcagagaagcttctggaatctcccggtgtggaggctggagaaggggaggctgagaaggaggaggcgggggctcagggcaggcctctgagagccctgcagaactgctgctctgtgccctcccccctcccaccagaggacgctgggactggaggcctgagacagcaggaagaggaagcagtggagctccagcccccaccaccagcccctctgtctcccccacccccagccccaactgccccccaacctcctggggatcccctcatgagccgcctgttctatggggtgaaggcagggccaggggtgggggccccccgccgcagtggacacaccttcaccgtcaacccccggcggtctgtgccccctgcgaccccagccaccccaacctctccagccacagttgatgctgcagtcccgggggctgggaagaagcggtacccaactgccgaggagatcttggttctggggggctacctccgtctcagccgcagctgccttgccaaggggtcccccgaaagacaccacaaacagcttaagatctccttcagcgagacagccctggagaccacgtaccaatacccctccgagagttcggtactggaggagctgggcccggagcctgaggtccccagtgcccccaaccctccagcagcccaacccgacgacgaagaggatgaggaagagctgctgctgctgcagccagagctccagggcgggctgcgcaccaaggccctgattgtggatgagtcctgccggcggtgaccatcttccaacatagggatatacctccctccttcttataactgaagatcctggagcccggaagattcagggcagacagaccctgataatgagcctggcagggaagggcaaccaacatcttgtaacttgctttccccaccctgtttctgggggcagagccaattgcccaatttctaccctaatccaaagtccctggtgtgggtggggttaaacgtgctggtgcatcctaggtcatccaagagtgagcgccaagtcctgagaaggggcacagaactccctggagggtggagatggagcacctgccccccatggcagggtacactctccccacagccttcctccccaccatcccgtggggactctcgggatttaagcactcgtctctctgggaggcccagaccccactccatttataggcacatctccttcatttcctaggtcactgcccctttgtttacagctcctgcctcctcccttgaccacagcctggtttacaaattccatcagctcccagccccacctgccaaagtcccaggtttacaagccacgcttacttgctgtgtctgcgtggaattctctcctctgtcccctccagtctcctcattggagtgacctgaaggtgtggcttcctccactttttctcagtattactttgccttagttttccccaagagggaaggctggaactcttaactctgtaccccttgatagttatttaattctgtttctcctagtggttcacaattgaactgaattgagatggtgtcgggtggctaaggagacacctcacctctccttccccattgtgccgcctttatcaattgcctgttttgttttgtttgttttttaactttccataataaaatggagttctcttcaa

SEQ ID NO: 2529 - DNA, 740 bp, Homo sapiens; identical to SEQ ID NO: 1924

SEQ ID NO: 2530 - DNA, 884 bp, Homo sapiens
atcttgagtgagggcacgctctccttagaggggcggaacagtttttggcaccttatcgcgagcggcagcttatgcaagagtgacttaaaaaagaaaggcaggtccggggccaggggctaagtagcggtgcggtttctttttctggattagtttccccatcttgcctaaaaatgtcctagtctagtctttttagcagaactccactccctaaacatgtcagaactacacttcccatcaagggtcagaaagaaacttccggcacagtcttttcccagcattccttgtttacttccgggtttattactactgaaggaagaacgccagatcagaaaagggagctcaggtaccttccagagagtgagacccagcgcccttgtctcgcacccagtaggctttcatccccgccatggcggagctgatccagaagaagctacagggagaagtggagaaatatcaacagctacagaaggacttaagtaaatccatgtcggggaggcagaaacttgaagcacaactaacagaaaataatatcgtgaaagaggaactggccctgctggatgggtccaacgtggtctttaaacttctgggtccggtgctagtcaaacaggagctgggggaggctcgggccacagtagggaagaggctggactatatcacagctgaaattaagcgatacgaatcccagcttcgggatcttgagcggcagtcagagcaacagagggagacccttgctcagctgcagcaggagttccagcgggcccaggcagcaaaggcaggggctcctggcaaggcctgaccccatggtggggggaggggaggggaggggagggaatgaggcagctctaggatctatactgtagctaataaaatgtaaaaacacctgg

SEQ ID NO: 2531 - DNA, 7396 bp, Homo sapiens
attgctggagcgcaggcggcggagaggatgactgccgctgccattctctcttgagctagcgagccgccgccaccctccaccctcccccggcagggcggagaggagcggccggagtcagcgatggtgcccggcgaggagaaccaactggtcccgaaagaggatgtgttttggagatgcagacaaaatatctttgatgaaatgaagaagaaatttttacagatagaaaatgctgctgaagaacctagagtcttatgtattatacaagatactactaattcaaagacagtgaatgaacggatcactttaaatttaccagcatctactccagtcagaaagctctttgaagatgtggccaacaaagtaggctacataaatggaacctttgacttggtgtggggaaatggaatcaatactgctgatatggcaccactggatcataccagtgacaagtcacttctcgacgctaattttgagccaggaaagaagaactttctgcatttgacagataaagatggtgaacaacctcaaatactgctggaggattccagtgctggggaagacagtgttcatgacaggtttataggtccgcttccaagagaaggttctgggggttctaccagtgattatgtcagccaaagctactcctactcatctattttgaataaatcagaaactggatatgtgggactagtaaaccaagcaatgacttgctatttgaatagccttttgcaaacactttttatgactcctgaatttaggaatgcattatataagtgggaatttgaagaatctgaagaagatccagtgacaagtattccataccaacttcaaaggctttttgttttgttacaaaccagcaaaaagagagcaattgaaaccacagatgttacaaggagctttggatgggatagtagtgaggcttggcagcagcatgatgtacaagaactatgcagagtcatgtttgatgctttggaacagaaatggaagcaaacagaacaggctgatcttataaatgagctatatcaaggcaagctgaaggactacgtgagatgtctggaatgtggttatgagggctggcgaatcgacacatatcttgatattccattggtcatccgaccttatgggtccagccaagcatttgctagtgtggaagaagcattgcatgcatttattcagccagagattctggatggcccaaatcagtatttttgtgaacgttgtaagaagaagtgtgatgcacggaagggccttcggtttttgcattttccttatctgctgaccttacagctgaaaagattcgattttgattatacaaccatgcataggattaaactgaatgatcgaatgacatttcccgaggaactagatatgagtacttttattgatgttgaagatgagaaatctcctcagactgaaagttgcactgacagtggagcagaaaatgaaggtagttgtcacagtgatcagatgagcaacgatttctccaatgatgatggtgttgatgaaggaatctgtcttgaaaccaatagtggaactgaaaagatctcaaaatctggacttgaaaagaattccttgatctatgaacttttctctgttatggttcattctgggagcgctgctggtggtcattattatgcatgtataaagtcattcagtgatgagcagtggtacagcttcaatgatcaacatgtcagcaggataacacaagaggacattaagaaaacacatggtggatcttcaggaagcagaggatattattctagtgctttcgcaagttccacaaatgcatatatgctgatctatagactgaaggatccagccagaaatgcaaaatttctagaagtggatgaatacccagaacatattaaaaacttggtgcagaaagagagagagttggaagaacaagaaaagagacaacgagaaattgagcgcaatacatgcaagataaaattattctgtttgcatcctacaaaacaagtaatgatggaaaataaattggaggttcataaggataagacattaaaggaagcagtagaaatggcttataagatgatggatttagaagaggtaatacccctggattgctgtcgccttgttaaatatgatgagtttcatgattatctagaacggtcatatgaaggagaagaagatacaccaatggggcttctactaggtggcgtcaagtcaacatatatgtttgatctgctgttggagacgagaaagcctgatcaggttttccaatcttataaacctggagaagtgatggtgaaagttcatgttgttgatctaaaggcagaatctgtagctgctcctataactgttcgtgcttacttaaatcagacagttacagaattcaaacaactgatttcaaaggccatccatttacctgctgaaacaatgagaatagtgctggaacgctgctacaatgatttgcgtcttctcagtgtctccagtaaaaccctgaaagctgaaggattttttagaagtaacaaggtgtttgttgaaagctccgagactttggattaccagatggcctttgcagactctcatttatggaaactcctggatcggcatgcaaatacaatcagattatttgttttgctacctgaacaatccccagtatcttattccaaaaggacagcataccagaaagctggaggcgattctggtaatgtggatgatgactgtgaaagagtcaaaggacctgtaggaagcctaaagtctgtggaagctattctagaagaaagcactgaaaaactcaaaagcttgtcactgcagcaacagcaggatggagataatggggacagcagcaaaagtactgagacaagtgactttgaaaacatcgaatcacctctcaatgagagggactcttcagcatcagtggataatagagaacttgaacagcatattcagacttctgatccagaaaattttcagtctgaagaacgatcagactcagatgtgaataatgacaggagtacaagttcagtggacagtgatattcttagctccagtcatagcagtgatactttgtgcaatgcagacaatgctcagatccctttggctaatggacttgactctcacagtatcacaagtagtagaagaacgaaagcaaatgaagggaaaaaagaaacatgggatacagcagaagaagactctggaactgatagtgaatatgatgagagtggcaagagtaggggagaaatgcagtacatgtatttcaaagctgaaccttatgctgcagatgaaggttctggggaaggacataaatggttgatggtgcatgttgataaaagaattactctggcagctttcaaacaacatttagagccctttgttggagttttgtcctctcacttcaaggtctttcgagtgtatgccagcaatcaagagtttgagagcgtccggctgaatgagacactttcatcattttctgatgacaataagattacaattagactggggagagcacttaaaaaaggagaatacagagttaaagtataccagcttttggtcaatgaacaagagccatgcaagtttctgctagatgctgtgtttgctaaaggaatgactgtacggcaatcaaaagaggaattaattcctcagctcagggagcaatgtggtttagagctcagtattgacaggtttcgtctaaggaaaaaaacatggaagaatcctggcactgtctttttggattatcatatttatgaagaagatattaatatttccagcaactgggaggttttccttgaagttcttgatggggtagagaagatgaagtccatgtcacagcttgcagttttgtcaagacggtggaagccttcagagatgaagttggatcccttccaggaggttgtattggaaagcagtagtgtggacgaattgcgagagaagcttagtgaaatcagtgggattcctttggatgatattgaatttgctaagggtagaggaacatttccctgtgatatttctgtccttgatattcatcaggatttagactggaatcctaaagtttctaccctgaatgtctggcctctttatatctgtgatgatggtgcggtcatattttatagggataaaacagaagaattaatggaattgacagatgagcaaagaaatgaactgatgaaaaaagaaagcagtcgactccagaagactggacatcgtgtaacatactcacctcgtaaagagaaagcactaaaaatatatctggatggagcaccaaataaagatctgactcaagactgactctgatagtgtagcattttccctgggggagttttggttttaattagatggttcactaccactgggtagtgccattttggccggacatggttggggtaacccagtgacaccagcactgattggactgccctacaccaatcagaagctcagtgcccaatgggccactgttttgactcggaatcatgttgtgcactatagtcaaatgtactgtaaagtgaaaagggatgtgcaaaaaaataaaaaaaaacaacaaaaaaagctaaccttctattagaaaaggggacaggggaatgagtaaacttcttttattgcggacaaatgtgcacatagccgctagtaaaactagcctcaaacaggatgctcatagcttaataataaaagctgtgcaaaggccatgaatgaatgaattttctgtttatttcactgatgcacacattacctcattgacaattcagaagtaaatccaacgtgtgttgactcttggaaagcagcaaaaacaggagctgaagaaaagaaattcttggaaccagccgtaacccagtaaggaattgtgaagttgtgtttttattttgtttcattttttgcagagtattaagaacattattctggaacatcagaacgtttcccttagaccgatcccagcaggtggcagctcagattgctgcagtgttgtaattataactgattgtacttaagttatggatgtagagaatatgtttcattcatttattcagcatgtaaataaaattgatcctgttgagttatcataattgcagttcaactatctgccatgattattcttttcacgtatcattcattctgtacatttgtgtacattgagaagtatagcaatctatgtaaatgtaatcctcagtgaggttcctcagtgctaggtcccataggattgtcgttgcccttgttaatgaggtttctctgttcagcggcttcaatttttttctctttgtacatctagttttgaagatttacttcaagtttgaatcttctagaatgcttgtaagtccagttttaatttttagagtcaatttgtagttacatgtagtttaacttttgggaaacgtcttaacattgttctgaataaacttgctaatgaggtcaggtcatggtacagactgatgcagtcaacatgatttcattgcagagtttattagtatcagcaagtttttgctttgctaaataaaagtactcaatgaacacaattctacataaattttgacataccatctaatttataaaaatcaataaaaaaggttttggtaaaactttttcatgccagatgctgtttacaacaatgaacatgccaataaaacatttgttcattctgttgtgttattttagtcattaaacttctgtggatgaagaatctgggttaagaatagatttgtcatctttaaatatgacattttgtaatgtgtattggatatctcatttctatgataaaggtatatttacagtaaagttctcataagagaaatgaaaagctgtgttaatatctaactttggggaaccctgtcagtatttcagatccgatttttaccctttttttcttataagaaagataaaattagaaaatactgttagcaaatgtggctctgccatttgaatataatcaccgagaattccatgtcttaaaagtctcctggaatccacaatgaaaaaaaaaatcttttctaaggtatttttctggctaatttttatttgaagaaagctatagcatttagcgaaatttgactgaagtaatgttctgagtttgcattagtgggattggtgatgttctcagaagaaaattggaaacacttgtgatgaattgtctttcagatcacttagattttctgatgtaagaggacagctgtttggttctgatacaggcctgcttacttgggatgtagggttagtaaatggggtttctgctttaaaggactgacttgctatcacacaaaagaggcagacttgtaaacacaatgggctttggagtttggtctgattgggtttggtttagtattcctatgagcgtaaatggtaaaattcttctgatacccactctttagactgtgccttctgctctgttctttgttttatgtttaactgctgtttctaattgcaggtgtattacagatacaaataagagtaaagaaaatatatttcattatagaaaagaaaaaattaaaagcttcttgcttttcagtgcctgatagagtgaaaacacaaagttgcactttaataatttcaataaaagctaatctgtgtcagcctccctctgcttcagagagtcaggtgagcatccataacctaacaggcagagccctagcgatgtggatcaagtttcctgagcccgggggcggtggagcctcatgatctcttatcttttgaggctgaggcaggtcacatgcaacaaattgtgaccctgctccccacaagtcatgcaaaggttttgaagagcttttaccgtggggcagatgaacttgtgtcaaccatgcacaccctgtgagaaccaagtacctgtgtttctaaggcgggcactcaaggtgaggggtgcattctggccaaagaaacaaaagctgtggtttcaggaccatgccgtgtgtagctgatctgtacgggacgtgtatgtaaggaagagcaatcatgatagataagaacagtgtgtgaagcagccttcacactagagtgtttggtcatctcttataatgtaagggaaggtactttaaaattctgggaagatgcgatgaactcatgtcccagtcagaaaataatccaatgaaataagcattggttgccaggccacagttaggaattgtattgtgatacatctagaggccaagagagcaggagagagctaccaacttacactgtggtttaagctaaatgaccgcacagcatcatagcattgcagtgttgttactaaatctggaagtgacctgtgaatgtatggaatacaataaagtcttttattctggttcatttgctagtacttcctttttgattggatactgtagttcttcctctggattttattttgttcagcgtcaaggccctaattttgcaaatgtagtctaaaccacattacgtggactagaggatactctgaattagcaagttttttgtttgctgaataaaactattccatctt

SEQ ID NO: 2532 - DNA, 661 bp, Homo sapiens
acggcttacccgggctccgacagcggctgcaggtctccaagttgcggccgctggagcccgagccatgcggaccgcggaccgggaggcgcgcccggggcttccgtccctgctgctgctgctgctggccggggccgggctgtcagccgcctcgcccccagcagcgccgcgcttcaacgtgagcctggactcggtccccgagctgcgctggctgcccgtgctgcggcactacgacttggacttggtgcgcgccgcgatggcgcaagtcatcggggacagagtccccaagtgggtgcacgtgttaatcggaaaagtggtcctggagctggagcgcttcctgccccagcccttcaccggcgagatccgcggcatgtgtgacttcatgaacctcagcctggcggactgccttctggtcaacctggcctacgagtcctccgtgttctgcaccagtattgtggctcaagactccagaggccacatttaccatggtcggaatttggattatccttttgggaatgtcttacgcaagctgacagtggatgtgcaattcttaaagaatgggcagattgcattcacaggaactacttttattggctatgtaggattatggactggccagagcccacacaagtttacagtttctggtgatgaacgagaccctcac

SEQ ID NO: 2533 - DNA, 1731 bp, Homo sapiens
acggcttacccgggctccgacagcggctgcaggtctccaagttgcggccgctggagcccgagccatgcggaccgcggaccgggaggcgcgcccggggcttccgtccctgctgctgctgctgctggccggggccgggctgtcagccgcctcgcccccagcagcgccgcgcttcaacgtgagcctggactcggtccccgagctgcgctggctgcccgtgctgcggcactacgacttggacttggtgcgcgccgcgatggcgcaagtcatcggggacagagtccccaagtgggtgcacgtgttaatcggaaaagtggtcctggagctggagcgcttcctgccccagcccttcaccggcgagatccgcggcatgtgtgacttcatgaacctcagcctggcggactgccttctggtcaacctggcctacgagtcctccgtgttctgcaccagtattgtggctcaagactccagaggccacatttaccatggtcggaatttggattatccttttgggaatgtcttacgcaagctgacagtggatgtgcaattcttaaagaatgggcagattgcattcacaggaactacttttattggctatgtaggattatggactggccagagcccacacaagtttacagtttctggtgatgaacgagataaaggctggtggtgggagaatgctatcgctgccctgtttcggagacacattcccgtcagctggctgatccgcgctaccctgagtgagtcggaaaacttcgaagcagctgttggcaagttggccaagactccccttattgctgatgtttattacattgttggtggcacgtccccccgggagggggtggtcatcacgaggaacagagatggcccagcagacatttggcctctagatcctttgaatggagcgtggttccgagttgagacaaattacgaccactggaagccagcacccaaggaagatgaccggagaacatctgccatcaaggcccttaatgctacaggacaagcaaacctcagcctggaggcacttttccagtgagcaagaagaacccatcaggtgattgtcaggcctctgagcccaagctaagccatcatatgccctgtgacctgcacgtatacatccagatggcctgaagcaactgaagatccacaaaagaagagaaaatagccagttcctgccttaactgatgacatttcaccattgtgatttgttcctgccccaccctaactgatcaattgactttgtgacaagacaccctccccacccttgcaataatgtactttgtgatattcccccgcccttgtgaatgtactttgtacgatacaccctccccacccttgagaaggtactttgtaatatcctctccgcccttgagaatgtactttgtaagatccacttcctgcctgcaaaaaattgctccgaactccaccgtctatcccaaacctataagaactaatgataatcctaccaccctttgctgactccttttttggactcagcccacgtgcacccaggtgattaaaaagctttattgctcacatgaagcctatttggtggtctcttcacacagatgtgtgtgacagtgataacagtgtcacgtggtttaactacaatgtgtccagatattgaattttgtttaagcctgcttgggatttgttgtgctccccaaatttcaagtttgtgtcttttgttcaattttggaaaatagtcagctatctcagaattgctcacct

SEQ ID NO: 2534 - DNA, 7011 bp, Homo sapiens
atggcggcggcggcggggaatcgcgcctcgtcgtcgggattcccgggcgccagggctacgagccctgaggcaggcggcggcggaggagccctcaaggcgagcagcgcgcccgcggctgccgcgggactgctgcgggaggcgggcagcgggggccgcgagcgggcggactggcggcggcggcagctgcgcaaagtgcggagtgtggagctggaccagctgcctgagcagccgctcttccttgccgcctcaccgccggcctcctcgacttccccgtcgccggagcccgcggacgcagcggggagtgggaccggcttccagcctgtggcggtgccgccgccccacggagccgcgagccgcggcggcgcccaccttaccgagtcggtggcggcgccggacagcggcgcctcgagtcccgcagcggccgagcccggggagaagcgggcgcccgccgccgagccgtctcctgcagcggcccccgccggtcgtgagatggagaataaagaaactctcaaagggttgcacaagatggatgatcgtccagaggaacgaatgatcagggagaaactgaaggcaacctgtatgccagcctggaagcacgaatggttggaaaggagaaataggcgagggcctgtggtggtaaaaccaatcccagttaaaggagatggatctgaaatgaatcacttagcagctgagtctccaggagaggtccaggcaagtgcggcttcaccagcttccaaaggccgacgcagtccttctcctggcaactccccatcaggtcgcacagtgaaatcagaatctccaggagtaaggagaaaaagagtttccccagtgccttttcagagtggcagaatcacaccaccccgaagagccccttcaccagatggcttctcaccatatagccctgaggaaacaaaccgccgtgttaacaaagtgatgcgggccagactgtacttactgcagcagatagggcctaactctttcctgattggaggagacagcccagacaataaataccgggtgtttattgggcctcagaactgcagctgtgcacgtggaacattctgtattcatctgctatttgtgatgctccgggtgtttcaactagaaccttcagacccaatgttatggagaaaaactttaaagaattttgaggttgagagtttgttccagaaatatcacagtaggcgtagctcaaggatcaaagctccatctcgtaacaccatccagaagtttgtttcacgcatgtcaaattctcatacattgtcatcatctagtacttctacgtctagttcagaaaacagcataaaggatgaagaggaacagatgtgtcctatttgcttgttgggcatgcttgatgaagaaagtcttacagtgtgtgaagacggctgcaggaacaagctgcaccaccactgcatgtcaatttgggcagaagagtgtagaagaaatagagaacctttaatatgtcccctttgtagatctaagtggagatctcatgatttctacagccacgagttgtcaagtcctgtggattccccttcttccctcagagctgcacagcagcaaaccgtacagcagcagcctttggctggatcacgaaggaatcaagagagcaattttaaccttactcattatggaactcagcaaatccctcctgcttacaaagatttagctgagccatggattcaggtgtttggaatggaactcgttggctgcttattttctagaaactggaatgtgagagagatggccctcaggcgtctttcccatgatgtcagtggggccctgctgttggcaaatggggagagcactggaaattctgggggcagcagtggaagcagcccgagtgggggagccaccagtgggtcttcccagaccagtatctcaggagatgtggtggaggcatgctgcagcgttctgtcaatggtctgtgctgaccctgtctacaaagtgtacgttgctgctttaaaaacattgagagccatgctggtatatactccttgccacagtttagcggaaagaatcaaacttcagagacttctccagccagttgtagacaccatcctagtcaaatgtgcagatgccaatagccgcacaagtcagctgtccatatcaacactgttggaactgtgcaaaggccaagcaggagagttggcagttggcagagaaatactaaaagctggatccattggtattggtggtgttgattatgtcttaaattgtattcttggaaaccaaactgaatcaaacaattggcaagaacttcttggccgcctttgtcttatagatagactgttgttggaatttcctgctgaattttatcctcatattgtcagtactgatgtttcacaagctgagcctgttgaaatcaggtataagaagctgctgtccctcttaacctttgctttgcagtccattgataattcccactcaatggttggcaaactttccagaaggatctacttgagttctgcaagaatggttactacagtaccccatgtgttttcaaaactgttagaaatgctgagtgtttccagttccactcacttcaccaggatgcgtcgccgtttgatggctattgcagatgaggtggaaattgccgaagccatccagttgggcgtagaagacactttggatggtcaacaggacagcttcttgcaggcatctgttcccaacaactatctggaaaccacagagaacagttcccctgagtgcacagtccatttagagaaaactggaaaaggattatgtgctacaaaattgagtgccagttcagaggacatttctgagagactggccagcatttcagtaggaccttctagttcaacaacaacaacaacaacaacaacagagcaaccaaagccaatggttcaaacaaaaggcagaccccacagtcagtgtttgaactcctctcctttatctcatcattcccaattaatgtttccagccttgtcaaccccttcttcttctaccccatctgtaccagctggcactgcaacagatgtctctaagcatagacttcagggattcattccctgcagaataccttctgcatctcctcaaacacagcgcaagttttctctacaattccacagaaactgtcctgaaaacaaagactcagataaactttccccagtctttactcagtcaagacccttgccctccagtaacatacacaggccaaagccatctagacctaccccaggtaatacaagtaaacagggagatccctcaaaaaatagcatgacacttgatctgaacagtagttccaaatgtgatgacagctttggctgtagcagcaatagtagtaatgctgttatacccagtgacgagacagtgttcaccccagtagaggagaaatgcagattagatgtcaatacagagctcaactccagtattgaggaccttcttgaagcatctatgccttcaagtgatacaacagtaacttttaagtcagaagttgctgtcctgtctcctgaaaaggctgaaaatgatgatacctacaaagatgatgtgaatcataatcaaaagtgcaaagagaagatggaagctgaagaagaagaagctttagcaattgccatggcaatgtcagcgtctcaggatgccctccccatagttcctcagctgcaggttgaaaatggagaagatatcatcattattcaacaggatacaccagagactctaccaggacataccaaagcaaaacaaccgtatagagaagacactgaatggctgaaaggtcaacagataggccttggagcattttcttcttgttatcaggctcaagatgtgggaactggaactttaatggctgttaaacaggtgacttatgtcagaaacacatcttctgagcaagaagaagtagtagaagcactaagagaagagataagaatgatgagccatctgaatcatccaaacatcattaggatgttgggagccacgtgtgagaagagcaattacaatctcttcattgaatggatggcagggggatcggtggctcatttgctgagtaaatatggagccttcaaagaatcagtagttattaactacactgaacagttactccgtggcctttcgtatctccatgaaaaccaaatcattcacagagatgtcaaaggtgccaatttgctaattgacagcactggtcagagactaagaattgcagattttggagctgcagccaggttggcatcaaaaggaactggtgcaggagagtttcagggacaattactggggacaattgcatttatggcacctgaggtactaagaggtcaacagtatggaaggagctgtgatgtatggagtgttggctgtgctattatagaaatggcttgtgcaaaaccaccatggaatgcagaaaaacactccaatcatcttgctttgatatttaagattgctagtgcaactactgctccatcgatcccttcacatttgtctcctggtttacgagatgtggctcttcgttgtttagaacttcaacctcaggacagacctccatcaagagagctactgaagcatccagtctttcgtactacatggtagccaattatgcagatcaactacagtagaaacaggatgctcaacaagagaaaaaaaacttgtggggaaccacattgatattctactggccatgatgccactgaacagctatgaacgaggccagtggggaacccttacctaagtatgtgattgacaaatcatgatctgtacctaagctcagtatgcaaaagcccaaactagtgcagaaactgtaaactgtgcctttcaaagaactggccctaggtgaacaggaaaacaatgaagtttgcatgactaaattgcagaagcataattttatttttttggagcactttttcagcaatattagcggctgaggggctcaggatctattttaatatttcaattattcttccatttcatatagtgatcacaagcagggggttctgcaattccgttcaaattttttgtcactggctataaaatcagtatctgcctcttttaggtcagagtatgctatgagtagcaatacatacatatatttttaaaagttgatacttctttatgacccacagttgacctttattttcttaaataccagggcagttgtggctcattgtgcattttactgttggcccattcatttcgtttttggaaattatggttttgtattttcatgtttatttacattcatttttgtttattcagggaaagctgatctttttttcaaaccagaaaaaaaaaatgaactagatatgaagtagagttcattaaatatcttgctattgtcagagtttttaaaatatagacttaattttgtttttttaaattggaatacaataaagtactacctacatttgagtcagtcaccactcttattgtgcaggttaagtacaagttaactaaaaataaactgtcctctctggtgcaactcacaaccaagatcaagattaccttaaaatttatttgaattttttagatgttttggttgtcaaactgtaggaaacttcacaacatttaagtcttactctgtatgtaacaatccatcattcaccttcactactggtagtaacatagagctgccattttccttttaccatgcatcatctctttacagtaggcctggcagatcattttttaaaaagattattcaactaccaatcagtaatgtttttaaacagtacatttgctttgaacttggaaaatgtgttcagaaagaaaaatggaattgaatttcatttatacactaattccttggattttgcacagttacctaacggttttagtctggagttaaattcagatgcatggaatcctgaaggaaaatggtagctttttaatctttttgtgtgtgtgtgagtcttttaaatcaagtactgattaactattaagtacaactttgagattttagttttaactcttcagaagccagtgtgaaatagaattggttattctcaaagactcaggataaactaaataagctatatatagagtacatttaaaatgtacaacacaaattggaaataaaataagttacaagataagtttacagggatatattgcttacaatttttaaaaggcagtttgttttttatgtgaatatgtttcttagtgaaattttacattcctttgttttggaagattggcgatatttgaagagttaaaaatagtacagaaatgtgaagtttggtatctctaaatgtgttgtacttgactttcttttttattttgtttttttttttttttgactacttagaattttcacaattctaataagattgtttccaagtctctcatgtgcaagctttaaaggatgcactcttgccattttatgtactggaagatcattggtcagatgaatactgtgtctgacaaaaatgtaaactgtataaactgaggaacctcagctaatcagtattactttgtagatcaccatgcccaccacatttcaaactcaaactatctgtagatttcaaaatccattgtgtttgagtttgtttgcagttccctcagcttgctggtaattgtggtgttttgttttttgttttgttttcaatgcaaatgtgatgtaatattcttattttctttggatcaaagctggactggaaattgtatcgtgtaattatttttgtgttcttaatgttatttggtactcaagttgtaaataacgtctactactgtttattccagtttctactacctcaggtgtcctatagatttttcttctaccaaagttcactttcacaatgaaattatatttgctgtgtgactatgattcctaagatttccagggcttaagggctaacttctattagcaccttactgtgtaagcaaatgttacaaaaaaaaaaaaaaaaaatctctgggttaagaaaatttggcttaaatgtatcctttgttattttaaatatattgagatattttaattaaaatttttaccccattgaaccgattttatagtatttgtacctattttggtgtttttgtctttatagtaaataaaagtttttgaacaaa

SEQ ID NO: 2535 - DNA, 3436 bp, Homo sapiens
agttgctgccatggagtcagccgggctagagcagctcctacgggagctgctgctaccggacaccgagcgcatccgtcgggccacggaacagctccagatcgttcttcgggcccccgccgctttgccggctctctgcgacctgctagcctcggcggccgacccccagacgactgaacacccgctggcgacggctggcggcggagcaacgggagagcctcaagtccctgatcctgacggccctgcagagagaaacagagcactgtgtgagcctcagcctggcccagctctcagccaccatttttcgaaaggaaggcttggaggcctggccacagcttttgcagctgcttcagcacagtacccacagcccccacagcccagagagagagatggggcttttgctgctaagtgtggtggtgacctcccggcccgaggccttccaaccccaccaccgggagcttcttcggcttctgaatgagactcttggtgaggtgggctctcctgggctgctcttctactccctgcgcactctgaccaccatggctccctacctcagcactgaagatgtgcctctcgctcggatgttggtgcccaagctgatcatggccatgcagactctgatccccatagatgaggcaaaggcctgtgaggcccttgaggctttggatgaactgttggagtcagaggtgccggtcatcaccccctacctctctgaagtcctcacattctgcctggaggtagctagaaatgtggccctgggcaatgcgatacgcatacgtattctctgctgcctcactttcttggtcaaagtcaagagcaaggccttactgaagaatcgtctcctgccacccttgctgcacacccttttccccattgtggctgctgagcccccaccaggccagttggatcccgaggaccaggattcagaagaggaagagttggagattgagctgatgggggagactcccaagcatttcgctgtacaagttgtggacatgctggcactacacctgccccccgagaagctctgtccccagctgatgcccatgttggaagaggctttgcggagcgagagcccataccagcgcaaggactcctggtgctggccgtgctgtctgacggagctggcgaccacatcaggcagagactgctgcccccactgctgcagattgtgtgcaagggcctggaggacccctcgcaagttgtacgcaatgctgcgctgtttgccctgggccagttctcagaaaacctacagccccatatcagcagctattcaagggaggtaatgccactgctcctcgcctacttgaagtcggtgcctcttggacacacacaccacctagccaaggcctgctatgccctggagaattttgtggagaacctagggcccaaggtgcagccctaccttccggagcttatggaatgcatgctgcagcttctgaggaaccccagcagtccccgggccaaggagctggctgtgagcgccctgggagccattgctacggctgcccaggcctcgctgctgccctacttccctgccatcatggagcacctgcgggaattcctgttaacaggccgtgaggaccttcagcctgtgcagatccagagcctggagacactgggggtgctggcacgagcagtgggggagcccatgaggccgctggctgaggaatgctgccagctgggtctgggcctctgcgaccaggtagacgaccctgacttgcggcgctgcacgtacagcctatttgcagccttatcgggtctgatgggtgagggcctggcgccccacttggaacagatcaccacgctcatgctgctgtcactgcgttccaccgagggcattgtgcctcagtatgacgggagcagctccttccttctgtttgacgatgagagtgatggggaagaagaggaggagctcatggatgaggatgtggaagaagaggatgactcagagatctcagggtacagcgtggagaatgccttcttcgatgagaaggaagacacctgtgctgccgtgggggagatctctgtgaacaccagtgtggccttccttccatacatggaaagtgtctttgaagaagtatttaaactgctggagtgccctcacctgaatgtgcggaaggcagcccatgaggctctgggtcagttttgctgtgcactgcacaaggcctgtcaaagctgcccctcggaacccaacactgctgctttgcaggctgccctggcccgagtcgtgccatcctacatgcaggcagtgaacagggagcgggaacgccaggtggtgatggccgtgctggaggccctgacaggggtgctccgcagctgtgggaccctcacactgaagccccctgggcgcctcgctgagctctgtggcgtgctcaaggctgtgctgcagaggaagacagcctgtcaggatactgacgaggaggaggaagaggaagatgatgatcaggctgaatacgacgccatgttgctggagcacgctggagaggccatccctgccctggcagccgcggctgggggagactcctttgccccattctttgccggtttcctgccattattggtgtgcaagacaaaacagggctgcacagtggcagagaagtcctttgcagtggggaccttggcagagactattcagggcctgggtgctgcctcagcccagtttgtgtctcggctgctccctgtgctgttgagcaccgcccaagaggcagaccccgaggtgcgaagcaatgccatcttcgggatgggcgtgctggcagagcatgggggccaccctgcccaggaacacttccccaagctgctggggctcctttttcccctcctggcgcgggagcgacatgatcgtgtccgtgacaacatctgtggggcacttgcccgcctgttgatggccagtcccaccaggaaaccagagccccaggtgctggctgccctactgcatgccctgccactgaaggaggacttggaggagtgggtcaccattgggcgcctcttcagcttcctgtaccagagcagccctgaccaggttatagatgtggctcccgagcttctgcgtatctgcagcctcattctggctgacaacaagatcccaccagacaccaaggccgcactgttgctgctcctgacgttcctggccaaacagcacaccgacagctttcaagcagctctgggctcactgcctgttgacaaggctcaggagctccaggctgtactgggcctctcctagactgcaggctgcagccagtccagagagaatagagcctgcccaggccttaagaccacctctcagcccagttcagttctgccttaccaaagattctgagactcatacccatttggagccagccccacttgctgccttacagggctgtccctgaggctggatctgttacaaatgagtcatgacatcatactgtaataaaagcagcttgttttctgcttg

SEQ ID NO: 2536 - DNA, 2232 bp, Homo sapiens
atagcagggggacagacagagggggtgggggtggatttggtgttgagttgagggcagagtgtgggactggaaagggacggccagaggactttgcttctaggatacctcccaaatcctctggccctggccctcccatgcattagcaccatcccttctccctagacaaatgggtgtgataccagaaggaccactgtgggtgtcgggctcagatgacaatttgtcgggcacgagcggtatggaagtggacgaccgcgtgtcggcgctggagcagcggctgcagttacaggaagacgagctggcggtcctaaaggcggcgctggcggatgctctgcgtcgcctgcgggcatgcgaagaacagggagcggcgctacgcgcgcggggcacccccaagggccgggcgcctccgcgcttaggcaccactgcctcggtgtgtcagctcttgaaaggccttcccaccaggacgccccttaatggctcgggacccccgcggcgcgtgggtggctatgccacgtccccatcctctcccaagaaggaggcgacctccgggcgcagcagtgtccgccgctacttgtcaccagagcgcctcgcctcggtgcgccgtgaggacccccgcagccggaccacatcctccagcagcaactgtagcgccaaaaaggaaggcaaaaccaaagaagttatcttcagtgtggaggatggctccgtgaaaatgttcctgaggggccgccctgtgcccatgatgatcccagacgagctggcacccacctacagcctggacacacgctcggagctgccttcttgccggctcaagctggagtgggtctatggctaccgtggccgagactgccgggccaacctttatttgctgcccaccggggagatagtgtactttgtggcctccgtagccgtgctatacagcgtggaggagcagaggcagcgacactacctgggacacaacgatgacatcaaatgcttggccatccacccagatatggtcaccatcgccacgggacaggtggcgggaaccactaaggaagggaagccgctgccgccccacgtgcgcatctgggactcagtttccctctccaccttacacgtgctgggcttgggggtgtttgacagagccgtgtgctgtgtgggcttctccaaatctaatggaggcaacctgctgtgtgcagtggatgaatccaatgatcacatgctctcggtgtgggactgggccaaggagaccaaggtggtggatgtcaagtgctccaatgaggctgtattggtggccaccttccaccccacggaccccactgtgcttatcacctgcgggaaatctcacatctacttctggaccttggaggggggcagcttgagcaagcggcaaggcctctttgagaaacatgagaaaccgaagtatgtgctgtgtgtgacctttttggaaggtggcgacgtggtcacgggggactctggggggaacctctatgtttggggcaaaggtgggaaccgtatcacacaggcggtgctgggcgcccacgacggcggcgtgtttgggctctgcgccctgcgggacgggacgctggtgtctggagggggccgtgatcggcgggtggtcctctggggttctgactacagcaagctgcaggaagtggaggtccctgaggactttggccctgtgcgcaccgtggcagagggccacggagacacactgtacgtggggaccacccgcaattccatcctgcagggctccgtgcacacaggcttctcactgctggtccagggccatgtggaagagctgtggggcctggccacacaccccagtcgggcccagtttgtgacctgcgggcaggataagctggtgcatctatggagctcagattcccaccagcccctgtggagcaggatcatcgaggtggagtctcgctctgtcacccaggctggagggcaatggcacgatctcggctcactgcaacctccgcctcccgggttcaagtgattcttctgcctcagcctcccgagtagctgggattacaggaccctgcccgctcagccggcttccaccccagtggctctgtcctggctgtgggtacagtgactggcagatggctgctgctggacacggagacccatgacctggtggctatccacacagacggcaatgaacagatctcagtggtcagcttctccccagacggggcgtacctggccgtgggctcccacgacaacttggtgtacgtgtacacggtggac

SEQ ID NO: 2537 - DNA, 5068 bp, Homo sapiens
ggttcgggtagcggggacgcgcacgcaccttgcgcgtcttcgcccctcctgcggttgccaggcaaccggccccggaagttgcggcaggtgcgtccgcagcgggcgccgctagccagcggaagatggcggagggcggaggccctgagcccggcgagcaggagaggaggtcttccgggccgcggcctccgagcgcgcgggatttgcagttggccttggcagaattgtatgaagatgaagtgaagtgcaaatcttccaagtctaatagacctaaagccacagtcttcaagagcccacggacaccacctcaacggttttactcaagtgaacatgaatacagtggattaaatatagttcgaccttcaactgggaaaattgtgaatgaacttttcaaagaggcaagggaacatggggctgtccctctgaatgaagccacaagagcttcaggtgatgataaatctaagtcatttacaggtggaggatacagattgggtagttctttttgtaagcggtctgaatatatctatggagaaaatcagctgcaagatgttcagattttgcttaaactgtggagcaatggtttcagtttagatgatggagaattgagaccttacaatgaaccaacaaatgctcaatttctggagtctgttaagagaggagagattcccctggagcttcagcgccttgttcatggtggccaagtgaatttggatatggaggatcatcaggatcaagaatacataaaacctagattgaggttcaaggcttttagtggagaagggcaaaaacttggaagccttacacctgaaatagtcagtacaccttcctctccagaagaggaggataaatcaatacttaatgcagttgttcttattgatgattcagtgccaacaacaaaaattcaaatcaggttagcagatgggagtcgtttgatacaaagattcaatagtacacacaggatcctggatgtccggaactttattgtacagtctcgtcctgaatttgcggctcttgactttattcttgtgacttcatttccgaataaagagctaacagatgaaagcctgacactgctagaagcagatattcttaacactgtgttactccagcaactaaaataatattgttcctgtccatgcagtagcatgtgggaatagatgatgtgccgtattaataaggacaatacttcagcattaaaaacagccaaattatttttattatttttacagataaattttggttttattgttattctgtcttccaatctgaatatagacaaatttggattaggaatagaccttgagataagtatgtttgagtttttagttgaaggactggcttatgttgatagtttttggatttctaggcaaatgagttgttacatgcttagtgttaatgtaacaacatttgtttgcagagaaaaatgaacaaaacccctttttgataaatgcatttggtaaaatttgcactaaagtttcttgatgcagcattgaccaacagccattaagaaatcttttgatcaaataagttgaaaatttgtctataatatatactgaaacgtgtcttttgattttgaaattgtttgatcatacaataattatttctcctattaagattttacacatcctttttacttactgatttagatatattactagtatcagaaactacagttttgccttgtattttacagaattatgactgttgtgaacttaaacagaaacacataaaggtcagcaattctttttttttttttttttgatatggagttttgctcttgttgcccaggctggagtgcaatggcataatttctgctcaccgcaacctccgcctcccaggttcaaaagattctcctgccttagcctcccaagtagctgggattacaggcatgcgccaccatgcctggctaatttttgtacttttgctagagacagcgtttctctgtgttgatcaggctggtctcgaactccgaacctcaggtgatccacccacctcagcctcccaaagtgctgggattacaggcatgagccaccacgcccagcctaaaggtcagcagttcttaagaagatatggtaaacagcaacaatattttaaaatcaagtaattacagttcctcccagagcttgcgttgatcacattcatttattcattcaacacatttttctaggaaactcactgtatacactaaacactattctgtgtgctcaacctagaatgtcttctccagaacaagactagtgtagaaatacaggaatgtaaattctgtcagacggactagatctaaagaattaccagcataaatgtttgcatttctgctgaagccagaagcttttccttcttcctagacaccatttcatccttaattattacttctggttagttttccattgccaccataacaagttacaaaatgtggcttaaaatagcacaaatttattatcttcacaattctgtaggttaggagtccaggttaagagtttcgcggtgccaagatcaatttgttggcagggttgcattctgttaggaggctctacaggagaatcatttccttgtcattccaccttctacaggacatcctcattccttggcttgtgacctccttcttccatcttaaaaaccagtgctgtttcatctctatgacccttctgttaccacatctctctgacaccagtgtggagaggttctctgcaggactcatgattaaatgaggcccaccggatatccaatctaggcttatctccttgtcttgaaatccatagtaaccttaattacatctgcaaaatctcttttaccatctaaggttacatacaggtttggagattaggacattaacattttacatggaacattattcttgcctactacagttcccacccaccccccgctccactcctgtgttaaagattcagattcatcacaaataaatttacatcactcataggtgctcaaaagtcacaatccattattacagcatcaactctaaatccaaaatcttatctgagtctcaccaactcaaaagtctcaaatctcacattgaagccatctaaattaagtttgggagaggatctgtgtgtgatttctgggacataattccaactgtgcacttgtgaacctagaaaacaagttatctgttcccaagtatgatggcatgacaggcagacaataatagttacacacgttcctgttcaaaaagcagaaacagatggaaaaaggagccatcagcaccaatcaatttacaaaaccagcgaggcacccttctttaagtttcaaggcctgggagtaatcttcagctcactgctgttctctgggcttgttgactgtctcagagtcatctttactttttcacaaaaggtagcacacgtttgcagctgagtatcaacttatcagtttgttcttcttttatattctctaaagctttctgttaaaaatggtggtgcttctgctgctataacgttgtcaagaaacttgtgggtcttttacatatgtcacagggatgcactcatttagataggaggctcctcacgtatctttcctggaaaatcctgtctctgtttttggctttttctgaaatagctgagaggatctatgattcacacccttaatatcttcaaagagtcttgtgtgtgacctgatattcagaccttttgatgtttctgaagtattagcaaaaggttatacagccatatcttcatcactttctctagagtaaaggctgtcctgacggtgaatcttagttttagtggcttttgccatttgaataggccgcgaatttcccaaatcatcaagtcctggtttctttatatttaacaggtcttccctcaatctacctctttccacattttactataatcagcaagaagacagcaggctgtaccttccacagcttgcttggaaatatcctcagctaaatattgaagtcatcacttaaaagttctgctttacacataacggcaggacacaactcagcttagcttttcgccactatgtaacaaggactcctttcctccacttctccagtaacatattcctcattttttaccaacagtctattcatgatgatttagatattctatggcaatcgaggtattctctattatgctcctttcttcaaggccgccctagcattaacattccatatttctactaacagtctgtttaaggcagtttagcttcttttctggcatgctcctcagaattcttccagcctccacctactgcccaattccagagccacttttctacttttaggtatttgttacagcagcacctcaagtacctagaaaactcttttatgcctgcttctctgccagatgacttgaatatggtactagatttggaattcacctttctccagggtcactgtttatttcaaagaggtgaatttacctgtgctagggttttcacactgggagtgctaccagaactaccacaggatgaaagtggtgagcccaccactgcagagaagttttctcagtgccgtaatatagaggaattctcaaaataagccctactccttttcacttactgaaaacaacttggataatgtgtaacagccagccccatttcaaaaagattaccaggggtaaaacaactttttcatgggtcaaaatcatcttccgaagaaaatgatttcttaaaagaattgaacattgtaaatcaaagggcattgtcctgttttggattaacaaaacaggaaaaataaccaatccttgtaaaattatttgaaattttcttgtttttatcagttgagtgcctatagatgcacatacaaaaacaactgccatttttgtatataatagtcttccaagatagagatttacattaggagagaattaaacatccaggagggatgaacagtatttcatgtgtgctatgtagtgttttgcttcattgagagtcattttcatgaattatttttactactgcagtcatcttaaatttataatcatctcaaaaaagatgtcacaatgaacagacaaccatctgtgaggtcagtcattttgcatgatgtatgtaatcaaaaagtttgaaatgtctgcttactaataaagaatgttttcactgaaactta

SEQ ID NO: 2538 - DNA, 4940 bp, Homo sapiens
gccgcagccggcggaggaggcagtagcgggggactcgatggaccgcggctggcaattccaggaatggatggaggtgctttaactgatacaagtctcacagattcctattttagcaccagctttattggagtcaatggatttggaagccctgtagaaacaaaatatcccctgatgcagagaatgactaatagtagcagctccccaagccttctaaatgacagtgccaagccatattcagcccatgatcctctaacatcacctgcttcatccttgtttaatgactttggtgccctcaacatctctcagagacgaaagacaccaaatcctactgcaagcgagtttattcctaaaggaggatcaacctccaggctgagtaacgtgtcccagtcaaatatgtctgccttctctcaagttttctctcacccatccatgggaagccctgctactgctggattagcgccaggaatgtcgttgtctgctgggtcttcccctcttcattcccccaagattactccacatacttctcctgctcccagaagaagaagtcacactccaaatccagcaagttacatggtgccttctagtgcctctacatctgttaataatcctgtttctcagactccgtcttctggtcaggtgatccaaaaggaaactgttggtgggacgacttacttctatacagacacaactccagcacctttgactggaatggtgtttccaaactatcatatttatcctccaactgcacctcacgttgcttatatgcaaccgaaagcaaacgcaccttccttcttcatggctgatgaactccgacaggagctgatcaacagacatttaataacaatggctcaaattgatcaagcagatatgccagcagttcctacagaggttgacagctaccatagcctattccctctagaaccactgccacctcccaaccggatacagaaatcaagtaattttggatatattacatcttgctacaaagctgtaaacagcaaagatgatctgccatattgccttcggaggatacatggttttcgtcttgttaacacaaagtgcatggtgttggtcgacatgtggaagaaaattcaacactcaaatatcgtaactttgcgtgaagtatttaccactaaagcatttgctgagccctctcttgtgtttgcatatgatttccatgctggaggagaaactatgatgagcagacactttaatgaccctaatgctgatgcctacttcaccaagagaaagtggggtcagcacgagggaccattgcccaggcagcatgctggattattgccagaatctcttatttgggcatatattgtccaactaagttctgcattgcgtaccattcatacagcaggtttggcatgtcgagttatggatccaacaaagattctgataactggcaaaacaaggttgcgagtaaattgtgttggagtttttgatgttttaacatttgataacagtcaaaataataatccattggcattaatggcccagtaccagcaagcagatctgatatcattaggaaaagttgtgttggctttggcttgcaactctttggcaggaattcagcgagagaatttacagaaagccatggaactggtgacaatcaactattcctctgacctgaagaatctgattttgtatttgttgactgaccaaaacaggatgcgaagtgtaaatgacatcatgcccatgattggtgctcgattttatactcaattggatgctgctcaaatgagaaatgatgtcatagaggaagaccttgcaaaggaggttcaaaatggaagactgtttaggctcctagcaaaattgggaacaatcaatgagaggccggagtttcagaaggatcccacttggtcagagactggagaccgttatctgttgaaactctttagggatcatctttttcatcaggtgacagaagcaggtgctccctggattgacctcagtcatataatttcttgtcttaacaagctagatgctggtgtgccagaaaaaataagcctgatttccagagatgagaagagtgtacttgtggtgacctacagtgacttaaagcgctgctttgaaaatacttttcaagaactgattgcagctgcaaatggtcagttgtagtatttgctaaaaaagcacgcaggacatggctaaagaccttaaccaatagcaaattgcactacagctgaacttttcatcatctcattcacatttgggaaacgaacaggagatgagcaaagctgcttgcacttcagtcaggtacactgttacttgaaaggaagaatgtttcacttacccaagagctatggctgccattggaggctgttatctgtgaagaatttattttagatttaggagcaccatcaggtgaatgatgttcctgcttttgttttttccacttgtatatgcactaattttaattttttaaagactttttctgatctttgaacttttgccacattgtatacttataatgggaaactttgcaaggacatttttgggaagcaatgctgggcagcgtttttgccattgagggttgcagaatttgctctttttgggatgggttgccctgaataacattacggaccaggtaaataatttcatagaagttcagtatagtacgtaattcttgtaagagtatcgtatgcaagctctctgtatgccacccactgttagttcaaattgagatttttgttttgttttgttcttaagaacataccaagaaaataccagtgaattgttggatatgaattccctgttagttgatttaaatcctttctgaataaagatcagataaacagtaactgaaggagcatgtatagctctttccttcaaattcaactagagcctttttaaaaagacatttgcctgctagtcagatacatttacatttatgcaaattttttaaataggagaaaattaagaaattgtgttaaaggcctaaagttcaggagtgtattactttaggttctttccagtttgctggtttttttttttttttttttttttttttttgggcgggggggaggtttatgaagttttgctctttgaaccacagctttattatggtcctttacactggagacagacacagagacactgttcagaagatgaactaaactcagcagtggtctggtatcaagagctttctgatgttttacagcctgaatttggagggataacgatctgctgtgcctttgcagtcactgcttagcccaaagtaatagtacttttgataataactcactctgtgcgatattcctgaataagtccatctcaaaagtttgggattttcctcctcttaactttcttaatatttggacatgcagttgtcgccaaacttgggtattcatggaatttctagtaaatgaaatacctatactttgatactgaagactgccaaatacataggaattttctttcttaaaaaacagtaatgaagactatatctcctttcccagcactgaatgttttactagcactgggtgctcaccatgcaactgaagaaaatgtggaaactcaaaaggtcaggacagacttccaagcacttgcaactgatgttactgtcttcaattttaataattacacatatttgtatatttcagagaagtttttaatatttctctgtccactttttataagctttaaaatgattttctctgccttgagatttgcatcaagaaaaagcacctctcttcacctgaaagctttgaagactagagacacgctttacacgttttaacaagtatattgagtccacgtttggtagcatcagttgttgagttaaaaagaaaattattgcatttgatctggatggattttaaaagaatataatgttcaatattaaaaggataattcacatttgccaccataatgttcttttttatgtaaaaagaagaacttggagacattaacatgaaaaagtcttttatcattagctcatgtatttgaggaagagcagctgtctttttatatgttttttgacaaatcatattgtattcttttgtacaaaaaagaactacttgtattctagaagaaatatgaaatgcttaatttataagcgggctggagattttttccaatattgttttctttgaaaatgaaaggggatcatctattttagttttggggtctgggaactttttgaaaatttaatttgtggaccaatgttttgtgaaagctaaagagggcaggggttaaaatagggcttgaatttctcattctgtatagaccagcaaacttccctgtgcaaggcaagtttacatcacaaatccaagaatgtttgcatcctaaatgctagtttgcttcagcccctagttaacctcaggacttggtttgcatataaaaggtagacagctgatatgttttcatgaataaatattgtcagccagaaaaggttggtgtcaggtaatgcatatttttttaagctttgttttatatttatttttcatttagtttttattgggaatggttttcaaagaactctcagttctgcctaggtgtttttgggggagccctgttttccatagtgtaattccatttaagaggttgtctaaaagtctttttaattaatagaaagattttaatatccaagagtagtcaaattaaggatataaactttccacaccttcctgtcgtgacagataaaagcacagaaaggacaacccttgaaatcatgtaacgttggtcatttcaatattttgtacctgttttaaattctgttagtgtatttacttcattgtaaatatttttgagggtacctttgtattttgcttttgaccttggttctgtgatttggatgtcaacaacttccctaaaaagcaccagtgtgttaggttctaatgtcatgacccaatttgtgttattcatctttaatcctgttttcagtctctatgtgtacagcagtatttttaataaagaattacagagataaa

SEQ ID NO: 2539 - DNA, 7607 bp, Homo sapiens
agatttgaatacttcactgaggcgagccgggcgttgtgagcggactgctagaggcggctgtctgtttccgctctaaggaaactcagagcgtgtggaccccaaacaagtctgcgcaaaatttgtcgaggaggtttgccgcggcagaaaagttttcttcaaaaatggatggggtgtcttcagaggctaatgaagaaaatgacaatatagagagacctgttagaagacggcattcttcaatattgaaacccccaaggagtcctcttcaggacctcagaggtgggaatgaaagagttcaggaatccaatgctttgagaaataagaaaaactctcgtcgagtcagctttgcagatactataaaggtattccagacggagtctcatatgaaaatagtgagaaagtcagaaatggaagaaacagaaacaggagaaaatcttcttttgatacagaataagaaattagaagataattactgtgaaattactgggatgaacacattgctttctgctcccattcatacccagatgcaacagaaggagttttcaattatagaacatacccgtgaaaggaaacatgcaaatgaccagacagtcattttttcagatgaaaaccagatggacctgacatcaagtcacactgtaatgattaccaaaggccttttagataatcccataagtgaaaagtccaccaagatagataccacatcatttctagctaatttaaagcttcacaccgaggactcaagaatgaaaaaagaagtaaatttttccgtggatcaaaacacttcttcagaaaataaaatagatttcaatgacttcataaaaagattgaaaacaggaaaatgtagtgcttttcctgatgtgcctgataaagaaaattttgagatacctatttattccaaggaaccgaacagtgcctcttctacacatcaaatgcatgtatctcttaaggaagatgaaaataacagtaatattactaggctctttagagaaaaagatgatgggatgaatttcacccagtgtcatacagccaatattcagacattgattcccacatccagtgagaccaactcacgggaatctaaaggtaatgatattacaatttatggcaatgactttatggacttgacatttaaccacactttgcagatcttacctgcaacaggtaatttttctgaaatagaaaatcaaactcagaatgccatggatgtaacaacaggttatggaactaaagcttcaggaaataaaacagtttttaagagtaaacaaaatactgcttttcaagacctttccataaactctgcagacaaaatacatattaccagaagtcatattatgggggcagaaactcacatagtctcacagacttgtaatcaggatgccagaatattagccatgaccccagaatctatatattctaatccatctattcaaggttgtaagactgttttctattctagttgtaatgatgccatggaaatgaccaaatgtctctcaaatatgagagaggagaaaaatttgctaaagcatgacagtaattatgctaaaatgtattgcaatccagatgctatgtcttctctcacagagaaaactatttattccggagaggagaacatggacattaccaagagtcatacagttgcaatagataatcaaatttttaaacaagatcaatcaaatgtgcaaatagcagctgcaccaacacccgaaaaagaaatgatgctccaaaatcttatgaccacatcagaagatgggaaaatgaatgtaaattgtaactcagttcctcatgtatctaaggaaagaatacagcagagcctgtcaaatcctttgtctatttcattgactgatagaaagactgaactcttatcaggtgaaaatatggatttgactgaaagtcacacaagtaacttaggaagtcaggttcctcttgcagcttataatctagcaccggagagtaccagtgaatctcactctcagagcaaaagctcttcagatgaatgtgaagaaattaccaaaagtcgtaatgaaccatttcagcgatcagacataatagccaaaaacagcttaaccgacacctggaacaaagacaaagattgggttttgaagattttgccctaccttgataaagattctcctcagtcagctgattgtaatcaggagatagcaacaagccataatatagtctactgtggtggagttcttgataaacaaataactaatagaaatacagtatcatgggaacaatctttgttttctaccacaaagccattattttcatcaggacagttctctatgaaaaatcatgatactgctataagtagtcatacagtgaaatctgtactaggccagaattctaaactggctgagccactgaggaaaagtttaagcaatcccacacctgactattgccatgacaagatgattatatgttcagaggaagagcaaaatatggatctaacaaagagccacactgtcgtcattggatttggtccttctgaactacaagaacttggtaaaactaatttagaacacactactggccagctaacaacaatgaacagacagatagctgtaaaagttgaaaaatgtggtaaaagtcccatagaaaaaagtggagtgcttaaatctaactgtattatggatgtgttagaggacgaaagtgtacagaaacctaaatttccaaaggaaaagcaaaatgtcaaaatttggggaaggaaaagtgttggtggaccaaaaattgataagactattgtattttcagaagacgataagaatgatatggatatcactaagagttatacaatagaaataaaccatagacctttattagagaaacgtgattgtcatttggtgccattggcaggaacttctgaaactattttatatacatgtaggcaggatgacatggagatcactagaagtcacacaactgccttagaatgtaaaactgtctcaccagatgaaataactactaggcctatggacaaaactgtagtgtttgtagataatcatgttgaactagaaatgacagagtcccatactgttttcattgactaccaagaaaaggaaagaacagacagacctaactttgaactatcccaaaggaaaagcctaggaacaccaacagtgatatgtactcctactgaggagagtgttttctttccaggaaatggtgaaagtgaccgtctagtagcaaatgacagccagctaacccctctggaggaatggtctaataataggggccctgtagaggtagctgataacatggaattgtctaaatcagccacttgcaaaaacatcaaagatgtacaaagtcctggatttctgaatgaacctctatcaagcaaaagtcagagaagaaaaagccttaagctaaaaaatgacaagaccattgtattttcagagaatcataaaaatgatatggatattacccagagttgtatggtggaaatagataacgaaagtgccctggaggataaagaggacttccatttggcaggggcttctaaaactattttgtattcatgtgggcaggatgacatggagatcactaggagtcacacaactgccttagaatgtaaaactctcctgccaaatgaaatagctattaggcccatggacaaaaccgtattgttcacagataattacagtgatctggaagtcaccgattcccatactgttttcattgactgtcaagccacagagaaaatacttgaagaaaaccctaaatttggaataggaaaaggaaaaaacttgggtgtttcctttcctaaggataatagctgtgttcaagaaatcgctgaaaaacaagcactggctgtaggaaacaaaatagttcttcacaccgagcaaaagcaacaactctttgctgctactaatagaactactaatgaaatcatcaaatttcatagtgctgctatggatgaaaaggtcatagggaaagttgtagaccaggcctgtacattggaaaaagcgcaagttgaaagctgtcagttaaataatagagatagaagaaatgtggactttacaagtagtcatgcaactgctgtttgtggatccagtgataattattcctgtttaccaaatgttatttcctgtactgataatttggagggtagtgccatgctcttatgtgataaagatgaggaaaaagccaattattgcccagtgcaaaatgatcttgcttatgcaaatgattttgccagtgaatattacttggaatctgagggacagcctctctctgctccttgtcctttgttagagaaggaagaagttattcaaaccagtaccaaaggacagttagactgtgttataacactgcacaaagatcaagatctgattaaggatccacgaaatctattggctaatcaaactttagtatatagtcaagatctgggggagatgactaaacttaattcaaagcgagtatcttttaagcttccaaaggatcaaatgaaagtctatgttgatgacatttatgttattcctcagcctcatttctcaaccgaccaacctccattacctaaaaaaggacagagtagtatcaataaagaagaagtaatactgtctaaagctggaaataagagtttaaatattatagaaaattcctctgcacccatatgtgaaaacaagcccaaaatactcaatagtgaggaatggtttgctgcagcctgtaaaaaagaactgaaggaaaatattcaaacaactaactataatacagctctagatttccacagtaactcagacgtaactaagcaagtcattcaaactcatgtcaatgctggagaagcaccagatcctgtaattacatctaatgttccatgttttcatagtatcaaaccaaatctgaataatttgaatggaaaaactggagagtttttagcctttcaaactgttcatctaccaccccttccagagcaattacttgaattaggaaataaggcacacaatgatatgcatatagtgcaagctacagaaatacataatattaacataatctccagcaatgctaaagatagtagagatgaggaaaataaaaagtctcataatggagctgaaaccacctctctaccgccaaagacagtttttaaagataaagtaaggagatgttctttgggaatctttttgcctagattgcccaacaagagaaattgtagtgtcactggtattgatgacctggaacagattccagcagacacaactgatataaatcacttagaaactcagccggtctctagcaaagattcaggcattggatctgttgcaggtaaactgaacctaagtccttctcaatatataaatgaggaaaatcttcctgtatatcctgatgagatcaattcttcagactctattaacatagaaactgaggaaaaggccttgattgagacataccaaaaagagatttcaccatatgaaaataaaatgggaaaaacttgcaatagccaaaaaagaacgtgggtacaagaagaagaagatattcataaggagaaaaaaatcagaaaaaatgagattaagtttagtgatacgacacaagatcgggagatttttgatcaccatactgaagaggatatagataaaagtgctaacagtgtattgataaaaaacctgagcaggaccccatctagttgcagcagctctctggattcaatcaaggctgatgggacctctctggacttcagcacttaccgcagtagtcaaatggaatcacagtttctcagagatactatttgtgaagagagcttgagggagaaactccaagatgggagaataacaataagggagttctttatacttctccaggtccacatcttgatacagaaaccccgacagagcaatctcccaggcaattttactgtaaacacaccacctactccagaagacctgatgttaagtcaatatgtttaccgacccaagatacagatttatagagaagattgtgaggctcgtcgccaaaagattgaagaattaaagctttctgcatcgaaccaagataagctgttggttgatataaataagaacctgtgggaaaaaatgagacactgctctgacaaagagctgaaggcctttggaatttatcttaacaaaataaagtcatgttttaccaagatgactaaagtcttcactcaccaaggaaaagtggctctgtatggcaagctggtgcagtcagctcagaatgagagggagaaacttcaaataaagatagatgagatggataaaatacttaagaagatcgataactgcctcactgagatggaaacagaaactaagaatttggaggatgaagagaaaaacaatcctgtggaagaatgggattctgaaatgagagctgcagaaaaagaattggaacagctgaaaactgaagaagaggagcttcaaagaaatctcttagaactggaggtacaaaaagagcagacccttgctcaaatagactttatgcaaaaacaaagaaatagaactgaagagctactggatcagttgagcttgtctgagtgggatgtcgttgagtggagtgatgatcaagctgtattcacctttgtttatgacacgatacaactcaccatcacctttgaagagtcagttgttggtttccctttcctggacaagcgttataggaagattgttgatgtcaattttcaatctctgttagatgaggatcaagctcctccttcctcccttttagttcataagcttattttccagtacgttgaagaaaaggaatcctggaagaagacatgtacaacccagcatcagttacccaagatgcttgaagaattctcactggtagtgcaccattgcagactccttggagaggagattgagtatttaaagagatggggaccaaattataacctaatgaacatagatattaataataatgaattgagacttttattctctagctccgcagcatttgcaaagtttgaaataactttgtttctctcagcctattatccatctgtaccattaccttccaccattcagaatcacgttgggaacactagccaagatgatattgctaccattctatctaaagtgccactggagaacaactacctgaagaatgtagtcaagcaaatttaccaagatctgtttcaggactgccatttctaccactagacccttggaccaccattggaacaaccaagcagaatgtacttgatattatttcagggtcccattgctgttcagcctttgtttttacgtcattacaagctgagtaaaattccttctgatgatgttatagttaatctgtatgttttttatatctctgcagaatgatggtgatgaagtctggatggtaggcctcatagcctactatcaacttactcatctttgtaccaaaggtttaagtaataggacacttaggaaaaatgtctcctaactaaactagtgctttctgctttagtacaagccctaaggattaacttaagtataagaagtgttatcactgacaagaacattagccattttcccataactagatagagctatgattttttaggttgcctggcttctgcctagcagatatttctggagtagaaatgtatctgtctacaaactattatcctttttctccgttactaaaatgctattaagagaaagtagggctgg

SEQ ID NO: 2540 - DNA, 1128 bp, Homo sapiens
tgctcctctacctgctccaccctcaatccaccagaaccatgggctgctgtggctgctccggaggctgtggctccggctgtggaggccgtggctccggctgtgggggctgtggctccggctgtggaggctgtggctctggctgtgggggctgtggctccggctgtggaggctgtgggggctgtggctccggctgtgcgggctgtgggggatgtggctccggctgctgtgtgcctgtctgctgctgcaagcccatgtgctgctgtgtgccagcttgttcctgctccagctgtggcaaagggggctgtggctcttgcgggggctccaagagaggctgtgtctcctgtggggtgtccaagggggcctgtggctcctgtggggggtccaaggggggctgtggctcctgtggggggtccaaggggggctgtggctcctgtggggggtccaaggggggctgtggctcctgtggggggtccaaggggggctgtggttcttatggctgctcccagtccagctgctgcaagccctgctgctgctcctcaggctgtgggtcatcctgctgccagtccagctgctgtaagccttactgctgccagtccagctgctgtaagccctactgctgccagtccagctgctgtaagccctgtagctgcttctcaggctgtggatcatcctgctgccaatccagctgctacaagccctgctgctgccagtccagctgctgtgtccccgtgtgctgccagtgtaagatctgaggctctgactgcagactgcaggtggcctgactggtgaagggcccggctgcccagcttccttgccctgggttctctggtgctccactgtctccactgtgtcctcactggcttcatccactccacaccagtgctcccgaaactgactgaggaccccttctggctcattgcctactacttctcctgaacttcctctccctgctcctcactcatttaagatccaaagcggcccactgaggccccagaggcagatcagaccccttagaccctgacagctgctccttctttcaggagtgtgatcgaccctcaatctctctggctgtctgtatatcaagactgaatcctgaccctctaaataaacaaagtctctaagcacaaa

SEQ ID NO: 2541 - DNA, 899 bp, Homo sapiens
gggctcagagaactccacacctgcacacctccctctcacctgctcctctacctgctccaccctcaacccaccagaaccatgggctgctctggctgctctggaggctgtggctccagctgtgggggctgtggctccagctgtgggggctgtggctccggctatgggggctgtggctccggctgctgtgtacctgtctgctgctgcaagcccgtgtgctgctgtgtgccagcctgttcctgctccagctgtggctcctgtgggggctccaagggggtctgtggctcttgtgggggctgcaaggggggctgtggctcctgtggaggctccaaggggggctgtggctccagctgctgtgtgcccgtctgctgctcctccagctgtggctcctgtgggggttccaagggggtctgtggatttcgtgggggctccaaggggggctgcggttcttgtggctgctcccagtgcagctgctataagccctgctgctgctcctcaggctgtgggtcatcctgctgccagtccagctgctgcaagcccagctgctcccagtccagctgctgtaagccctgctgttcccagtccagctgctgtaagccctgctgctgctcctcaggctgtgggtcatcctgctgccagtccagctgctgcaaaccctgctgttcccagtccagctgctgtaagccctgctgctgctcctcaggctgtgggtcatcctgctgccagtccagctgctgcaagccctgctcctcccagtccagctgctgtgtcccaatttgctgccagtgcaagatctgaggctctgcccacaaacctcagtgggtcctacagatccgggctctccaggaatgattgcagctgtgtcctgaattcctgaagcacgtctctgaatctgtcctcct

SEQ ID NO: 2542 - DNA, 2384 bp, Homo sapiens
cctgctcgttcctgacagaattaacggcacagccaacaagatgaacggagctttggatcactcagaccaaccagacccagatgccattaagatgtttgtcggacagatcccccggtcatggtcggaaaaggagctgaaagaactttttgagccttacggagccgtctaccagatcaacgtcctccgggaccggagtcagaaccctccgcagagtaaaggttgttgtttcgtaacattttatacaagaaaagctgcacttgaggcccagaatgcactgcacaatattaaaactttacctgggatgcatcatcccattcagatgaaacctgcagatagtgaaaagtccaacgctgtggaagacagaaaattgttcataggaatggtatcgaagaaatgtaatgagaacgacatcagggtgatgttctctccatttggccagatagaagaatgccggatcctccggggacctgatgggctgagtcgaggctgtgcgtttgtcacattttctacaagggcaatggcacagaatgcaatcaaagccatgcatcagtctcagaccatggagggctgctcttcacctatcgtggtgaagtttgctgacactcagaaggacaaagagcaaaggcgcctccagcagcagctcgctcagcagatgcagcagctcaacactgccacctgggggaacctgacagggctgggcggactgaccccacagtatctggcgctcctgcagcaggccacctcctccagcaacctgggtgcgttcagcggcattcaacaaatggcaggcatgaatgctttacagttgcagaacctggcgacgctggctgctgctgcagctgcggcccagacctcagccaccagcaccaatgcaaaccctctctctaccacgagcagcgccctgggagccctcacgagtcccgtggctgcttcaacccccaactccactgctggtgcagccatgaactccttgacctctctcgggactctgcaaggactggctggagccactgttggactgaataatattaatgcactagcagttgctcaaatgctctcaggtatggcggctctgaatggaggacttggcgccacaggcttgacgaatggcacggctggcaccatggacgccctcacccaggcctactcaggaattcaacagtacgcagccgccgcgctgcccactctgtacagccagagcctgctgcagcagcagagcgctgcaggcagccagaaggaaggtccagagggggcaaacctctttatttaccaccttccacaggaatttggagaccaggacattctgcagatgttcatgccttttggaaatgttatctctgctaaagtcttcattgacaaacagaccaatctgagcaagtgctttggttttgttagctacgacaatccagtctctgcacaagctgctatccaagctatgaatggctttcagatcggcatgaaacgcttgaaggtgcagctgaagcgttccaaaaacgacagcaaaccttactgatcctaaccccagaggctccctgctctcattttagctttcttaggacatcttcatgcccgttagttcatcgtttgcctagcatgtccctgtggcgtctcaaaaaaaagtttcatcgtcccgtcattgtttctgatgtctttctgacctcacatcatatttggttctcctactgacctttgatctagtttgacctttgaaatttgcatgtgacctcatctagctatgaattctgggaagtcaatgtgaaaaacattgctgcattcatgcaagactgaaatttattattagacaaattcattatagaaaaaacctgtggcaaaaacgtttctttcttattttttttcttttcctaaaacagacttgaaagtattatacagggattggcattcttcccggtcactggtaacaatagcaatatgtgtccagggacacagaatgttggtttctaacagactacttccaaaaacagtttgagaaaaaaactgtctgattttaagtctctagaggtctgtaatagtttttacatttttcaggcagtgtaaagttttttgataaggccattttaggtggctcactttctcattaagatatatatatagaaccactttttgtagattagtataagaaaaatatttaccctgttttggggcaaatgctacctatttgtgtcaccttttgctgaactcacagttagacaatccatggtttaatgcacatgaaattacctatattttatactgtttcaatgtacaggagaaaggttactgtaaactgtgttatgttggtgcttctgtgaattaagttgtggtttcatcatgagtcttaatgttctttgttgataagacaagtttagaattggtttacttaatac

SEQ ID NO: 2543 - DNA, 6104 bp, Homo sapiens
cttttgactagtgttttaatgccatcatttggctattttattagatcaccagagaagagagaacctattgccttaataagaaaatctgatgtatcaagaggtaatttggaaaaagaaatggctcatcttaaccatgatctatattcaggagatttaaatgaacagtcccaggcacagctaagtgaaggatcaattacacttcaggttgaagcagtagagagtacttcacaagtggatgaaaatgatgtgacgttaacggctgataaaggcaaaacagaggacactttcttcatgagcaacaaaccccaaagatacaaagacaagctaccagatagtggtgattctatgcttaggatcagcaccattgcttcagccattgcagaggcatcagttaatactgatccttcccaacttgctgcaatgatcaaggcactttcaaataaaaccagagacaagacttttcaggaagatgagaaacaaaaggactattctcatgtgcgtcatttcttacctaatgatttagaaaaaagtaatggatccaatgcacttgatatggagaaataccttaaaaaaacagaagttagtagatatgaaagtgcattggaaaacttttcaagggctagtatgtctgatacttgggatttatctttgcccaaagaacaaactactcaagacattcatccggtggacttaagtgctactagtgtaagtgtgagggcaccagaagaaaacacagcagctattgtttatgttgaaaatggagagagtgagaatcaagagtcatttagaaccataaactcctcaaattcagttacaaatagagagaataacagtgcagtagttgatgtgaagacatgttccattgacaacaaattacaagatgttggtaacgatgaaaaagctacctcaatttccactccatctgatagttattcatcagtgaggaaccccagaataacatccctttgtctgttaaaagactgtgaagaaatacgagataacagagaaaatcagaggcaaaatgagtgtgtcagtgaaataagcaacagtgagaagcatgtgacttttgaaaaccatcgcatagtctcacctaaaaatagtgatttgaaaaatacctctcctgagcatggtggacgtggctcagaggatgagcaggagagcttcagaccttccacgtcaccactgagtcattcttctcctagtgaaatttctggaacgagttcatcagggtgtgcgttagagtcctttggttcagcagctcagcagcagcagcctccctgtgagcaggagttgtctcccttggtgtgctcgcctgctggggtgagcaggctgacgtatgtgtctgaaccagagagctcctatcctaccacagccacagatgatgccctggaggaccgcaagagtgatatcaccagcgagttgagtaccacaattattcaaggcagtccagccgcattggaggaacgggctatggaaaaattgagagaaaaagttccatttcagaatagaggaaaaggaacattatcatctattatccagaataactctgatacaagaaaagcaactgaaactacttctctgagtagcaagcctgaatatgtaaaacctgactttagatggagtaaagatccttcctccaaaagtggaaatctgttggaaaccagtgaggtaggttggacatcaaaccctgaggaattggacccgatcaggctggctctcctgggcaagtcaggtctgagctgtcaggtggggtcagccacatcacaccctgtgtcctgccaggagcctatagatgaagatcaaagaataagtcctaaagataagtcaactgctggccgtgagttcagtggccaggtttctcatcagaccacctctgaaaaccagtgtactcctattcccagcagcacagttcacagctctgtggctgacatgcagaacatgcctgctgctgtgcacgcactcttgacacaaccctctctcagcgctgctccttttgctcagcggtatttgggaacactcccttcaactggaagcaccaccttgcctcagtgccatgctggcaatgccacagtctgtggcttctcaggaggccttccctatccagctgttgcaggagagcctgtgcagaactctgtggctgtgggaatttgtctaggatcaaatatcggctctggatggatgggtacctcttccctctgtaacccatattctaataccttaaatcagaacctgctaagcacaacaaaaccttttcctgtgccgtctgttggtacaaactgtggaattgaaccatgggattcaggagtgacatcaggattggggagtgtccgagtgcccgaggagttgaagcttcctcatgcttgctgtgtcgggatcgcttcccagaccctcctcagtgtgcttaatccaactgaccgctggctgcaagtcagcattggggtcctcagcattagtgttaatggtgaaaaggtggatctttcaacatatcgttgtttagttttcaagaataaagccatcataagacctcatgccacagaagagataaaagtgctttttataccatccagtcctggggttttcagatgcacattcagtgttgcttcttggccatgttcgacagatgctgagaccatcgtacaggcagaagctttggccagcaccgtcactctcactgccattgccgagagtcctgttattgaggtagaaacagaaaagaaagacgttcttgattttggtgacttgacttatggaggctggaaagccctcccactaaaattgataaaccgaacgcatgccactgtgccaattagactgattattaatgctaacgctgtagcctggcgctgtttcacgttttccaaggaatccgtccgagctcctgtggaagttgctccttgcgctgatgtggtcactcggctagcaggcccttctgtggtcaaccacatgatgcctgctagttatgatggacaggatccagaatttctgatgatttgggttcttttccatagtccaaagaaacagatcagctcttcagatattctggactcagcagaagaattctcggcaaaagttgatatcgaagttgacagcccaaaccctacgcccgttcttagaagtgtgagtctccgagcaagagcaggaatagctaggatccatgctcccagggacttgcagacgatgcatttcttggccaaagtggcttcctcaagaaagcagcacttacctttgaaaaatgctgggaacattgaagtttatttggatatcaaggtcccagaacaaggaagtcacttttcagtggatccaaagaatctactccttaaacctggagaagaacatgaggttattgtttcatttactccaaaggatcctgaagcctgcgaggaaaggatcttgaaaatatttgtgcagccatttggacctcagtatgaggtagtgttaaaaggcgaagtcatttcttcaggaagtaaacctctgtcacctggaccttgcttagatattccatcgattttgtccaacaaacaatttctggcttggggaggagtccctctaggtagaacacagcttcagaaactagctttaagaaataattctgcatctacaactcaacatttacgactgcttattagaggacaagatcaggactgctttcagcttcagaacacttttggttcagaacagcgattgaccagtaactgtgagatcagaattcacccaaaggaagacattttcatctctgtattatttgcacctactcgattatcttgcatgttggctagactagaaatcaaacaacttggaaatcgatcacaaccaggcattaagttcacaatacctttgtctggatatggaggaacaagcaatcttattttggaaggcgttaaaaaattatctgacagttacatggtaacagtgaatggcttagtacctggcaaagaaagtaaaattgttttttctgtccgcaacactggctcccgagcagcttttgttaaagcagtaggttttaaggattctcagaaaaaagttttgctggatcctaaagtattgaggatttttccagataaatttgtactcaaggaaagaacacaagaaaatgttactttaatatataatccatcagacagaggaatcaataataaaactgcaacagaactatcaactgtatacttatttggtggagatgaaatttcaagacagcagtatcgcagggccctgttacataaaccagagatgataaaacagatacttccagaacatagtgtgcttcaaaacattaattttgttgaagcatttcaagatgagctattagtaactgaagtatatgatcttccccaacgacctaatgatgttcagctcttttatggaagcatgtgtaaaattatactttcagtaattggagaattcagagattgcatttctagcagagaattccttcagccttcttccaaagctagcttggaatctacaagcgacttgggagcttctgggaaacatggtggcaacgtctctttggatgttttaccagtcaaaggtcctcagggttctcctcttctctcacgggcggctcgcccgcctctggatcagctggcctccgaagagccgtggactgtcctacccgagcacttgattctggtagctccttctccttgtgacatggcaaaaactggacgtttccagattgtgaataactctgtgaggttactgagatttgagctgtgctggccagcgcattgcctcacagtcacgccgcagcatggatgtgtcgcgccagagagtaaactacaaattcttgtgagtcctaattcctccttatccacaaaacagtcaatgttcccgtggagtggtttgatctatatacactgtgacgatggacagaagaaaattgtgaaagttcaaattcgagaagatttaactcaagtggaacttttaactcgtttgacctccaaaccatttggaattctttccccagtatctgagccttcagttagtcatttggtcaaaccaatgacaaaaccgccttccacaaaagttgaaataagaaacaagagtattacttttcctacaacagaacctggtgaaacttcagagagctgtctagaactcgagaatcatggcaccacagacgtgaaatggcatctgtcatctttagcgccaccttatgtcaagggagttgatgaaagtggagatgtttttagagctacctatgcagcattcagatgttctcctatttctggtctgctggaaagccatgggatccaaaaagtctccatcacatttttgcccagaggtaggggggattatgcccagttttgggatgttgaatgtcaccctcttaaggagcctcacatgaaacacacgttgagattccaactctctggacaaagcatcgaagcagaaaatgagcctgaaaacgcatgcctttccacggattccctcattaaaatagatcatttagttaagccccgaagacaagctgtgtcagaggcttctgctcgcatacctgagcagcttgatgtgactgctcgtggagtttatgccccagaggatgtgtacaggttccggccgactagtgtgggggaatcacggacacttaaagtcaatctgcgaaataattcttttattacacactcactgaagtttttgagtcccagagagccattctatgtcaaacattccaagtactctttgagagcccagcattacatcaacatgcccgtgcagttcaaaccgaagtccgcaggcaaatttgaagctttgcttgtcattcaaacagatgaaggcaagagtattgctattcgactaattggtgaagctcttggaaaaaattaactagaatacatttttgtgtaaagtaaattacataagttgtattttgttaactttatctttctacactacaattatgcttttgtatatatattttgtatgatggatatctataattgtagattttgtttttacaagctaatactgaagactcgactgaaatattatgtatctagcccatagtattgtacttaacttttacaggtgagaagagagttctgtgtttgcattgattatgatattctgaataaatatggaatatattttaatgtggtatatcc

SEQ ID NO: 2544 - DNA, 108 bp, Homo sapiens
atgtgctactacggaaactactatggcggctatggctatggaggcctgggctgtggctatggctcctgctgtggctgtggcttccgcagactgggctgtggctatggc

SEQ ID NO: 2545 - DNA, 849 bp, Homo sapiens
cagctgaactcacatctcccgtcaacatgtcctacaactgctgctctggaaacttctcctcccgctcctgtggtgactacctgcgctacccagcatcctcacgtggcttttcctaccccagcaatctggtctacagcactgacctctgctctcccagcacctgccagctgggttcctctctctataggggctgtcaggagatctgctgggagcccaccagctgccagacgtcctatgtggagtccagcccctgccagacctcctgctaccgccccagaacctccttgctctgcagtccttgcaagacgacttactctgggtctctaggctttggatccagcagctgccgctccctgggctatggatcgaggagctgctactcagtgggctgtgggtccagtggtgtcagatccctgggttatggaagctgtggcttcccttccctcggctatggatctggattctgccgcccaacctacttggcttctaggagctgccagtctccttgttacagaccagcctatggatcaaccttctgcagatcaacttgctgaatttccagaccttttaagcaaagtgtctcagtctctacgtagagctgttatcataggcatttccagcaatgtgagctaacccctcttactactagctcttcatcctttctctggcatcaagtactggctggacaggctagttctttcagactgtgaaattaatgaatgagcaaaatatagagtcaaatgtctataattttgaaacaagtgattcgttatcacgtaagttcatcttataaagtatatggaagttcagttttgtttcacgtaataaattcatttactgttgattcca

SEQ ID NO: 2546 - DNA, 581 bp, Homo sapiens
tttccaggggtcactctggcttcgactccgtcgctctcaattcgtcaccaggaggaagacggagctggctgcccagcccaaaggcccatgaggggatgcagttatgggctctgtcgccgtggagatagagtgtcgctttgttgcccaggctagtcttgaacttctggcctcaagccgtcctcccacctcgatctcccaaagtgttgggattacaggcattgttattttgtgtcagtaagtaatccataaagtgccaacatgggaaagaaacggacaaagggaaaaactgttccaatcgatgattcctctgaaactttagaacctgtgtgcagacacattagaaaaggattggaacaaggtaatttgaaaaaggctttagtgaatgtggaatggaatatctgccaagactgtaagactgacaataaagtgaaagataaagctgaagaagaaacagaagaaaagccttcagtttggctgtgtcttaaatgtggccatcagggctgtggcagaaattctcaggagcagcatgccttgaagcactatctgacgccaagatctgaacctcactgtctggttcttag

SEQ ID NO: 2547 - DNA, 2960 bp, Homo sapiens
ataatgccgcgttccggaagttattgctttccaggggtcactctggcttcgactccgtcgctctcaattcgtcaccaggaggaagacggagctggctgcccagcccaaaggcccatgaggggatgcagttatgggctctgtcgccgtggattgttattttgtgtcagtaagtaatccataaagtgccaacatgggaaagaaacggacaaagggaaaaactgttccaatcgatgattcctctgaaactttagaacctgtgtgcagacacattagaaaaggattggaacaaggtaatttgaaaaaggctttagtgaatgtggaatggaatatctgccaagactgtaagactgacaataaagtgaaagataaagctgaagaagaaacagaagaaaagccttcagtttggctgtgtcttaaatgtggccatcagggctgtggcagaaattctcaggagcagcatgccttgaagcactatctgacgccaagatctgaacctcactgtctggttcttagtttggacaactggagtgtatggtgttacgtatgtgataatgaggtccagtattgtagttcaaaccagttgggtcaagtggttgattatgtcagaaaacaagccagcattacaactccaaagccagagaaagataatggaaatattgaacttgaaaataaaaaattagaaaaagagagtaagaatgaacaagagagagaaaagaaggaaaacatggctaaagagaatcctcccatgaattctccttgccaaataaccgtgaaaggactcagtaatttgggaaacacatgtttcttcaatgcagttatgcagaacttgtcacaaacaccagtgcttagagaactactaaaagaagtgaaaatgtctggaacaattgtaaaaattgaaccacctgatttggcattaacagaaccattagaaataaaccttgagcctccaggccctcttactttagccatgagccagtttcttaatgagatgcaagagaccaaaaagggggttgtgacaccgaaagaactcttttctcaggtctgtaaaaaagcagtgcggtttaaaggctatcagcagcaagacagccaggagctgcttcgctacttattggatgggatgagagcagaagaacaccaaagagtgagtaaaggaatacttaaagcatttggtaattctactgaaaagttggatgaagaactaaaaaataaagttaaagattatgagaagaaaaaatcaatgccaagttttgttgaccgcatctttggtggtgaactaactagtatgatcatgtgtgatcaatgcagaactgtctccttggttcatgaatctttccttgatttgtccctcccagttttagatgatcagagtggtaagaaaagtgtaaatgataaaaatctgaaaaagacagtggaggatgaagatcaagatagtgaggaagaaaaagataacgacagttacataaaagagagaagtgatattccttctggaacaagtaagcacttacagaaaaaagcaaagaaacaagccaaaaagcaagccaagaaccaacgaagacaacaaaaaattcaaggaaaagttcttcatttaaatgatatttgtactattgaccatcctgaagacagtgaatatgaagctgaaatgtcacttcaaggagaagtaaatattaaatccaaccatatttcacaagagggtgttatgcataaagaatattgtgtcaaccagaaagatttgaatggccaagcaaaaatgatcgaaagtgtaactgacaatcaaaaatccacagaggaagtagatatgaaaaatatcaacatggataatgatctggaggttttaacatcttctcccactaggaatttaaatggtgcctacctaacggaagggagcaatggagaagtggacatttccaatggtttcaaaaacctaaatttgaatgctgctcttcatcctgatgaaataaatatagagattctgaatgatagtcatactcctggaacaaaggtgtatgaggttgtaaatgaagatccagaaactgctttctgtactcttgcaaacagggaagttttcaatactgatgagtgttcaatccaacattgtttatatcagttcacccgtaatgagaaacttcgagatgcgaataaactgctttgtgaagtatgcacacggagacagtgtaatggaccaaaggcaaatataaaaggtgaaaggaagcatgtttacaccaatgccaaaaagcagatgctaatttctcttgctcctcctgttcttactcttcatttaaagagatttcagcaggctggttttaacctacgcaaagttaacaaacacataaagtttccggaaatcttagatttggctcctttttgcacccttaaatgtaagaatgttgcagaagaaaatacaagggtactctattccttatatggagttgttgaacacagtggtactatgaggtcggggcattacactgcctatgccaaggcaagaaccgcaaatagtcatctctctaatcttgttcttcacggtgatattccacaagattttgaaatggaatcaaaagggcagtggtttcacatcagcgacacacatgtgcaagctgtgcctacaactaaagtactaaactcacaagcgtacctcctattttatgagagaatactgtaataatatcaaaagcactttttctggaaacacatttatggcttttataatggctgaaataacgataaaaaaagactaattaaaatcatgttcacttaacattaaatacatgccagaagaaatcatgtttatttaaatattgaagggaaaaatacctaaaaatgtacaaaggttttatattgtcatagtggtttttattcctgctttgtttctggaaaggaaatcctgaattacttaagtactttgtgtttaatatatctgggtgatggatcacaacacatcaataaactgacttaccctaaaa

SEQ ID NO: 2548 - DNA, 2963 bp, Homo sapiens
ataatgccgcgttccggaagttattgctttccaggggtcactctggcttcgactccgtcgctctcaattcgtcaccaggaggaagacggagctggctgcccagcccaaaggcccatgaggggatgcagttatgggctctgtcgccgtggattgttattttgtgtcagtaagtaatccataaagtgccaacatgggaaagaaacggacaaagggaaaaactgttccaatcgatgattcctctgaaactttagaacctgtgtgcagacacattagaaaaggattggaacaaggtaatttgaaaaaggctttagtgaatgtggaatggaatatctgccaagactgtaagactgacaataaagtgaaagataaagctgaagaagaaacagaagaaaagccttcagtttggctgtgtcttaaatgtggccatcagggctgtggcagaaattctcaggagcagcatgccttgaagcactatctgacgccaagatctgaacctcactgtctggttcttagtttggacaactggagtgtatggtgttacgtatgtgataatgaggtccagtattgtagttcaaaccagttgggtcaagtggttgattatgtcagaaaacaagccagcattacaactccaaagccagcagagaaagataatggaaatattgaacttgaaaataaaaaattagaaaaagagagtaagaatgaacaagagagagaaaagaaggaaaacatggctaaagagaatcctcccatgaattctccttgccaaataaccgtgaaaggactcagtaatttgggaaacacatgtttcttcaatgcagttatgcagaacttgtcacaaacaccagtgcttagagaactactaaaagaagtgaaaatgtctggaacaattgtaaaaattgaaccacctgatttggcattaacagaaccattagaaataaaccttgagcctccaggccctcttactttagccatgagccagtttcttaatgagatgcaagagaccaaaaagggggttgtgacaccgaaagaactcttttctcaggtctgtaaaaaagcagtgcggtttaaaggctatcagcagcaagacagccaggagctgcttcgctacttattggatgggatgagagcagaagaacaccaaagagtgagtaaaggaatacttaaagcatttggtaattctactgaaaagttggatgaagaactaaaaaataaagttaaagattatgagaagaaaaaatcaatgccaagttttgttgaccgcatctttggtggtgaactaactagtatgatcatgtgtgatcaatgcagaactgtctccttggttcatgaatctttccttgatttgtccctcccagttttagatgatcagagtggtaagaaaagtgtaaatgataaaaatctgaaaaagacagtggaggatgaagatcaagatagtgaggaagaaaaagataacgacagttacataaaagagagaagtgatattccttctggaacaagtaagcacttacagaaaaaagcaaagaaacaagccaaaaagcaagccaagaaccaacgaagacaacaaaaaattcaaggaaaagttcttcatttaaatgatatttgtactattgaccatcctgaagacagtgaatatgaagctgaaatgtcacttcaaggagaagtaaatattaaatccaaccatatttcacaagagggtgttatgcataaagaatattgtgtcaaccagaaagatttgaatggccaagcaaaaatgatcgaaagtgtaactgacaatcaaaaatccacagaggaagtagatatgaaaaatatcaacatggataatgatctggaggttttaacatcttctcccactaggaatttaaatggtgcctacctaacggaagggagcaatggagaagtggacatttccaatggtttcaaaaacctaaatttgaatgctgctcttcatcctgatgaaataaatatagagattctgaatgatagtcatactcctggaacaaaggtgtatgaggttgtaaatgaagatccagaaactgctttctgtactcttgcaaacagggaagttttcaatactgatgagtgttcaatccaacattgtttatatcagttcacccgtaatgagaaacttcgagatgcgaataaactgctttgtgaagtatgcacacggagacagtgtaatggaccaaaggcaaatataaaaggtgaaaggaagcatgtttacaccaatgccaaaaagcagatgctaatttctcttgctcctcctgttcttactcttcatttaaagagatttcagcaggctggttttaacctacgcaaagttaacaaacacataaagtttccggaaatcttagatttggctcctttttgcacccttaaatgtaagaatgttgcagaagaaaatacaagggtactctattccttatatggagttgttgaacacagtggtactatgaggtcggggcattacactgcctatgccaaggcaagaaccgcaaatagtcatctctctaatcttgttcttcacggtgatattccacaagattttgaaatggaatcaaaagggcagtggtttcacatcagcgacacacatgtgcaagctgtgcctacaactaaagtactaaactcacaagcgtacctcctattttatgagagaatactgtaataatatcaaaagcactttttctggaaacacatttatggcttttataatggctgaaataacgataaaaaaagactaattaaaatcatgttcacttaacattaaatacatgccagaagaaatcatgtttatttaaatattgaagggaaaaatacctaaaaatgtacaaaggttttatattgtcatagtggtttttattcctgctttgtttctggaaaggaaatcctgaattacttaagtactttgtgtttaatatatctgggtgatggatcacaacacatcaataaactgacttaccctaaaa

SEQ ID NO: 2549 - DNA, 2745 bp, Homo sapiens
agtggcgggaggctgtgagctgagcggtggggtctgcgtacgcctggagtccttccccgctgtgctcagcatggaccctatccggagcttctgcgggaagctgcggtctctggccagcacgctggactgcgagacggcccggctgcagcgagcgctggacggagaggaaagcgactttgaagattatccaatgagaattttatatgaccttcattcagaagttcagactctaaaggatgatgttaatattcttcttgataaagcaagattggaaaatcaagaaggcattgatttcataaaggcaacaaaagtactaatggaaaaaaattcaatggatattatgaaaataagagagtatttccagaagtatggatatagtccacgtgtcaagaaaaattcagtacacgagcaagaagccattaactctgacccagagttgtctaattgtgaaaattttcagaagactgatgtgaaagatgatctgtctgatcctcctgttgcaagcagttgtatttctgagaagtctccacgtagtccacaactttcagattttggacttgagcggtacatcgtatcccaagttctaccaaaccctccacaggcagtgaacaactataaggaagagcccgtaattgtaaccccacctaccaaacaatcactagtaaaagtactaaaaactccaaaatgtgcactaaaaatggatgattttgagtgtgtaactcctaaattagaacactttggtatctctgaatatactatgtgtttaaatgaagattacacaatgggacttaaaaatgcgaggaataataaaagtgaggaggccatagatacagaatccaggctcaatgataatgtttttgccactcccagccccatcatccagcagttggaaaaaagtgatgccgaatataccaactctcctttggtacctacattctgtactcctggtttgaaaattccatctacaaagaacagcatagctttggtatccacaaattacccattatcaaaaacaaatagttcatcaaatgatttggaagttgaagatcgtacttcgttggttttaaattcagacacatgctttgagaatttaacagatccctcttcacctacgatttcttcttatgagaatctgctcagaacacctacacctccggaagtaactaaaattccagaagatattctccagaaattccagtggatctatccaacacagaaactgaacaaaatgagatgaaagccgagctggaccgattttaacattcacattgccctgcctctgtccccctttaaacgttgacccattttaaagacaaacatgaacattaacatcataatatgctttttatgaagtttcaataaggtttaaccttagtcttgttgacatgtagcccagtcattcactctttaaggattattagtgtttcattgatactaaattacccagcttaatcaacagaatggtttaagtagtaccaggaagtaggacaagtaatttcaaaaatataaaggtgtttgctactcagatgaggccgcccctgaccttctggccagagagacattgctgccagccagctctgccttcccatcatctcctttcaggaccgtcccacaccttttacttgctcagtgctgtctgaagatgcagttgctgtttgcaaacaacaggaacaccagttaaactaattaggaaaagagggagatttccaggcctgggtaactatatactgtgaccattggaggtagagacaggtctcaacagttggaaccaggaactctgctgtcaggttgagagttttgtttctcttccagcttttcactgtgtgggggtcttttctcttatgtcagctctttctatcacatggcagctgacctctcacgctccactctgcagcttggacacccagtagaccctgaatttcactctctctaaaaggttctgagggctcatcctgggccaggggccctcctgtgcactgttagctatggccacgggagcctccagagctgcctggtagcttcaggttgacctgcttatcaggcctacgatccttctgatttaagtacagctggaaagtattatctaattaagttcatgatagtgcttttggagaacttgtcaaattacagccaatgagaaaataaggacctagcatactgtggagaaccattaaaaatttgagaagaaacaacaagtattatgtcaacttacttcaaaggcgtagttttgggaatttgatgcagtaaagattaccctgttttatgattgttccttgaaagtcaaatgggggacctgtccattgtgctctattaatcttgtcagaaaactgtcaccaaaacaaaacttgagtttgtccttgttctaggagttactgggtagttgtaagtattatttttattaaatataatgtaaaataaaatgttaagatacttagttttgtttttcaaagtaaagctgtagtcagccttatgtatgccattgactctgaaatgtataccagcctttcactgtgtaccgtgtgtatataaatccacagaaccggatgagctgcttagggagggaatatattcaaagtgtaccaaggaccaaatcctggagttctcccaactttagaggatggaaaggggcagagtaatctagcaaaggagactgaggccagtgaagtaggaagaaagtatttcaaggagagtgatgattctgtgaatattgctgagaattcaaataaaaagaggactgagaactga

SEQ ID NO: 2550 - DNA, 1551 bp, Homo sapiens
aatcccagacagcgcacggcgggaggctgtcgttgggcgtgcgcagctgcagcggcggttgaggtcaagtagtagcgttgggctgcggcagcggaggagctcaacatgcgtgagtgtatctctatccacgtggggcaggcaggagtccagatcggcaatgcctgctgggaactgtactgcctggaacatggaattcagcccgatggtcagatgccaagtgataaaaccattggtggtggggacgactccttcaacacgttcttcagtgagactggagctggcaagcacgtgcccagagcagtgtttgtggacctggagcccactgtggtcgatgaagtgcgcacaggaacctataggcagctcttccacccagagcagctgatcaccgggaaggaagatgcggccaataattacgccagaggccattacaccatcggcaaggagatcgtcgacctggtcctggaccggatccgcaaactggcggatctgtgcacgggactgcagggcttcctcatcttccacagttttgggggtggcactggctctgggttcgcatctctgctcatggagcggctctcagtggattacggcaagaagtccaagctagaatttgccatttacccagccccccaggtctccacggccgtggtggagccctacaactccatcctgaccacccacacgaccctggaacattctgactgtgccttcatggtcgacaatgaagccatctatgacatatgtcggcgcaacctggacatcgagcgtcccacgtacaccaacctcaatcgcctgattgggcagatcgtgtcctccatcacggcctccctgcgatttgacggggccctgaatgtggacttgacggaattccagaccaacctagtgccgtacccccgcatccacttccccctggccacctacgccccggtcatctcagccgagaaggcctaccacgagcagctgtccgtggctgagatcaccaatgcctgcttcgagccagccaatcagatggtcaagtgtgaccctcgccacggcaagtacatggcctgctgcatgttgtacaggggggatgtggtcccgaaagatgtcaacgcggccatcgccaccatcaagaccaagcgcaccatccagtttgtagattggtgcccaactggatttaaggtgggcattaactaccagccccccacggtggtccctgggggagacctggccaaggtgcagcgggctgtgtgcatgctgagcaacaccacggccatcgcggaggcctgggctcgcctggaccataagttcgatctcatgtatgccaagcgggcctttgtgcactggtacgtgggagaaggcatggaggagggggagttctctgaggcccgcgaggacctggcagctctggagaaggattatgaagaggtgggcgtggattccgtggaagccgaggctgaagaaggtgaagaatactgaggggagggtgtggtgggttctccactccactgccacccccagcgtggctgctttcaagttctttgcaattaaaggttctgtataaaaccaaga

SEQ ID NO: 2551 - DNA, 5178 bp, Homo sapiens
gcggccgccgtggccctcacagtcggcgtttcgccgcctgcccgcggtgcccgcgcacgccggccgccatcgccttcgcgcctggctggcgggggcgctgtcctcccaggccgtccgcgccgctccctggagctcggcggagcgcggcagccagggccggcggaggcgcgaggagccgggcgccaccgccgccgccgccgccgccgccgcgggggccatgaccgtggagcagaacgtgctgcagcagagcgcggcgcagaagcaccagcagacgtttttgaatcaactgagagaaattacggggattaatgacacccagatactacagcaagccttgaaggatagtaatggaaacttggaattagcagtggctttccttactgcgaagaatgctaagacccctcagcaggaggagacaacttactaccaaacagcacttcctggcaatgatagatacatcagtgtgggaagccaagcagatacaaatgtgattgatctcactggagatgataaagatgatcttcagagagcaattgccttgagtttggccgaatcaaacagggcattcagggagactggaataactgatgaggaacaagccattagcagagttcttgaagccagcatagcagagaataaagcatgtttgaagaggacacctacagaagtttggagggattctcgaaacccttatgatagaaaaagacaggacaaagctcccgttgggctaaagaatgttggcaatacttgttggtttagtgctgttattcagtcattatttaatcttttggaatttagaagattagttctgaattacaagcctccatcaaatgctcaagatttaccccgaaaccaaaaggaacatcggaatttgccttttatgcgtgagctgaggtatctatttgcacttcttgttggtaccaaaaggaagtatgttgatccatcaagagcagttgaaattcttaaggatgctttcaaatcaaatgactcacagcagcaagatgtgagtgagtttacacacaaattattagattggttagaagatgccttccaaatgaaagctgaagaggagacggatgaagagaagccaaagaaccccatggtagagttgttctatggcagattcctggctgtgggagtacttgaaggtaaaaaatttgaaaacactgaaatgtttggtcagtacccacttcaggtcaatgggttcaaagatctgcatgagtgcctagaagctgcaatgattgaaggagaaattgagtctttacattcagagaattcaggaaaatcaggccaagagcattggtttactgaattaccacctgtgttaacatttgaattgtcaagatttgaatttaatcaggcattgggaagaccagaaaaaattcacaacaaattagaatttccccaagttttatatttggacagatacatgcacagaaacagagaaataacaagaattaagagggaagagatcaagagactgaaagattacctcacggtattacaacaaaggctagaaagatatttaagctatggttccggtcccaaacgattccccttggtagatgttcttcagtatgcattggaatttgcctcaagtaaacctgtttgcacttctcctgttgacgatattgacgctagttccccacctagtggttccataccatcacagacattaccaagcacaacagaacaacagggagccctatcttcagaactgccaagcacatcaccttcatcagttgctgccatttcatcgagatcagtaatacacaaaccatttactcagtcccggatacctccagatttgcccatgcatccggcaccaaggcacataacggaggaagaactttctgtgctggaaagttgtttacatcgctggaggacagaaatagaaaatgacaccagagatttgcaggaaagcatatccagaatccatcgaacaattgaattaatgtactctgacaaatctatgatacaagttccttatcgattacatgccgttttagttcacgaaggccaagctaatgctgggcactactgggcatatatttttgatcatcgtgaaagcagatggatgaagtacaatgatattgctgtgacaaaatcatcatgggaagagctagtgagggactcttttggtggttatagaaatgccagtgcatactgtttaatgtacataaatgataaggcacagttcctaatacaagaggagtttaataaagaaactgggcagccccttgttggtatagaaacattaccaccggatttgagagattttgttgaggaagacaaccaacgatttgaaaaagaactagaagaatgggatgcacaacttgcccagaaagctttgcaggaaaagcttttagcgtctcagaaattgagagagtcagagacttctgtgacaacagcacaagcagcaggagacccagaatatctagagcagccatcaagaagtgatttctcaaagcacttgaaagaagaaactattcaaataattaccaaggcatcacatgagcatgaagataaaagtcctgaaacagttttgcagtcgaaacctgaaaatactacaagccaaccactttctaatcagcgagttgtagaggtggcgatccctcatgtagggaaatttatgattgaatcaaaggagggggggtatgatgacgagatcatgatgacaccgaacatgcaaggtattatcatggcgataggtaaatccaggagtgtatatgacaggtgtggccctgaagcagggttctttaaggcaattaagttggaatatgcaaggttggttaagttggcccaagaagacaccccaccagaaaccgattatcgtttacatcatgtagtggtctactttatccagaaccaggcaccaaagaaaattattgagaaaacattactagaacaatttggagatagaaatttgagttttgatgaaaggtgtcacaacataatgaaagttgctcaagccaaactggaaatgataaaacctgaagaagtaaacttggaggaatatgaggagtggcatcaggattataggaaattcagggaaacaactatgtatctcataattgggctagaaaattttcaaagagaaagttatatagattccttgctgttcctcatctgtgcttatcagaataacaaagaactcttgtctaaaggcttatacagaggacatgatgaagaattgatatcacattatagaagagaatgtttgctaaaattaaatgagcaagccgcagaactcttcgaatctggagaggatcgagaagtaaacaatggtttgattatcatgaatgagtttattgtcccatttttgccattattactggtggatgaaatggaagaaaaggatatactagctgtagaagatatgagaaatcgatggtgttcctaccttggtcaagaaatggaaccacacctccaagaaaagctgacagattttttgccaaaactgcttgattgttctatggagattaaaagtttccatgagccaccgaagttaccttcatattccacgcatgaactctgtgagcgatttgcccgaatcatgttgtccctcagtcgaactcctgctgatggaagataaactgcacactttccctgaacacactgtataaactctttttagttcttaacccttgccttcctgtcacagggtttgcttgttgctgctatagtttttaacttttttttattttaataactgcaaaagacaaaatgactatacagactttagtcagactgcagacaataaagctgaaaatcgcatggcgctcagacattttaaccggaactgatgtataatcacaaatctaattgattttattatggcaaaactatgcttttgccaccttcctgttgcagtattactttgcttttatcttttctttctcaacagctttccattcagtctggatccttccatgactacagccatttaagtgttcagcactgtgtacgatacataatatttggtagcttgtaaatgaaataaagaataaagttttatttatggctacctatgtgtttgtaagcaggtatattgtatattagtgtattagtaatactagataaatgaattttgtctggggattaagattggatagttaatagattaatacaatcttttaattctgctctaatgctagcaaattggaaaatgtttaagtctttgacacttaaatttatctatatttttaacaaagttcttgaacttagtatggcaccggaacctgttttgaattcagtcaggtttttactcaagtaagtggttgattttttttaagtcaaactacactgaaacttttatccttttcttagattaatcttactttttaaatgtatttacaatatacagcaaggtgattatttcaagagaatcccaaagtacttgaataagggctattgtaaaatttaaaagaaatatttatatatacacatatatacacatacacacatgtatatatatattcttcataatggaggacaatgttttgcaatatataaatcattctatttttgtaaattgtatatcactttaattgaaaatgttctctactaattaatactgtgaaacaaaattgatgttgtttaactagaagttatgagtatcttaactgcctttattccttttcaaaaaggaaaaagctgtagaacattttgtagatgaaactactgtttaagattaatgaattaatattgtgaatgaaaatcaaaatccatactttaaaggtaatcatgttactaacaacctatttttgaattcataaaaatttctttataaatgatgttttgtgaacatagtaaaatagaccattatactatgtgtatgtttgatacagcgtcgccaaaactagtgttctttattagtgcctctcacaaaagatcctggatggaggagtaagatgaaatattatgctattatatgatgctgtttgtaaaggtattaatgtactagtaaggtgttaatgacaaggaattagtactattcctgttgtaaagttagattttgcatattgtatctatcaaaatatgtttgggtttagattttaagttgtctactgagcagatttctgcattggttttccagtcctgttaaaagtttagaaacttcatatgtgtcatcacagcttttgtaaagaaagtatccttaatattttatgacattct

SEQ ID NO: 2552 - DNA, 2378 bp, Homo sapiens
agtccgccgtccgccctccgcgcccgcgccgctagcatgaccgacgcgctgttgcccgcggccccccagccgctggagaaggagaacgacggctactttcggaagggctgtaatccccttgcacaaaccggccggagtaaattgcagaatcaaagagctgctttgaatcagcagatcctgaaagccgtgcggatgaggaccggagcggaaaaccttctgaaagtggccacaaactcaaaggtgcgggagcaagtgcggctggagctgagcttcgtcaactcagacctgcagatgctcaaggaagagctggaggggctgaacatctcggtgggcgtctatcagaacacagagattttatcctggaacattacagtgaagatggctatttatatgaagatgaaattgcagatcttatggatctgagacaagcttgtcggacgcctagccgggatgaggccggggtggaactgctgatgacatacttcatccagctgggctttgtcgagagtcgattcttcccgcccacacggcagatgggactcctgttcacctggtatgactctctcaccggggttccggtcagccagcagaacctgctgctggagaaggccagtgtcctgttcaacactggggccctctacacccagattgggacccggtgtgatcggcagacgcaggctgggctggagagtgccatagatgcctttcagagagccgcaggggttttaaattacctgaaagacacatttacccatactccaagttacgacatgagccctgccatgctcagcgtgctcgtcaaaatgatgcttgcacaagcccaagaaagcgtgtttgagaaaatcagccttcctgggatccggaatgaattcttcatgctggtgaaggtggctcaggaggctgctaaggtgggagaggtctaccaacagctacacgcagccatgagccaggcgccggtgaaagagaacatcccctactcctgggccagcttagcctgcgtgaaggcccaccactacgcggccctggcccactacttcactgccatcctcctcatcgaccaccaggtgaagccaggcacggatctggaccaccaggagaagtgcctgtcccagctctacgaccacatgccagaggggctgacacccttggccacactgaagaatgatcagcagcgccgacagctggggaagtcccacttgcgcagagccatggctcatcacgaggagtcggtgcgggaggccagcctctgcaagaagctgcggagcattgaggtgctacagaaggtgctgtgtgccgcacaggaacgctcccggctcacgtacgcccagcaccaggaggaggatgacctgctgaacctgatcgacgcccccagtgttgttgctaaaactgagcaagaggttgacattatattgccccagttctccaagctgacagtcacggacttcttccagaagctgggccccttatctgtgttttcggctaacaagcggtggacgcctcctcgaagcatccgcttcactgcagaagaaggggacttggggttcaccttgagagggaacgcccccgttcaggttcacttcctggatccttactgctctgcctcggtggcaggagcccgggaaggagattatattgtctccattcagcttgtggattgtaagtggctgacgctgagtgaggttatgaagctgctgaagagctttggcgaggacgagatcgagatgaaagtcgtgagcctcctggactccacatcatccatgcataataagagtgccacatactccgtgggaatgcagaaaacgtactccatgatctgcttagccattgatgatgacgacaaaactgataaaaccaagaaaatctccaagaagctttccttcctgagttggggcaccaacaagaacagacagaagtcagccagcaccttgtgcctcccatcggtcggggctgcacggcctcaggtcaagaagaagctgccctcccctttcagccttctcaactcagacagttcttggtactaatgtgaggaaacaaacatgttcaggccctgaacatttccggtgctgactcggccttaaacgtttgtgccataatggaaaatatctatctatctgttctcaaatcctgtttttctcatagtgtaaactcacatttgatgtgtttttatgaaggaaagtaaccaagaaacctctaggaattagtgaaaaaagaacttttttgaggtgtgttactatactgctgtaagttatttattatataaagtattgtaaatagaatagtgttgaagatatgaaatatggctatttttaatggtgacaattatgacttttagtcactattaaattggggttacctatatcagtacaatttgtagttgt

SEQ ID NO: 2553 - DNA, 4309 bp, Homo sapiens
aacgtccgcgggcgcggggtgtgtcgggtgtcgacggcggcgctttgcggccggtcgtgcgggtcgggcgcgggcgggcgcggcggcagtggcgcgcacaggtgattgactggccagctgcctgaaggagcgccaggtcctccttgctggcaggtggcgaagcccattggggcggcggtgcagaccgcggcggcggctgcggcggtctggctcgggaggcgttcctggggccaaggccatggccccgcggctgcagctggagaaggcggcctggcgctgggcggagacggtgcggcccgaggaggtgtcgcaggagcacatcgagaccgcttaccgcatctggctggagccctgcattcgcggcgtgtgcagacgaaactgcaaaggaaatccgaattgcttggttggtattggtgagcatatttggttaggagaaatagatgaaaatagttttcataacatcgatgatcccaactgtgagaggagaaaaaagaactcatttgtgggcctgactaaccttggagccacttgttatgtcaacacatttcttcaagtgtggtttctcaacttggagcttcggcaggcactctacttatgtccaagcacttgtagtgactacatgctgggagacggcatccaagaagaaaaagattatgagcctcaaacaatttgtgagcatctccagtacttgtttgccttgttgcaaaacagtaataggcgatacattgatccatcaggatttgttaaagccttgggcctggacactggacaacagcaggatgctcaagaattttcaaagctctttatgtctctattggaagatactttgtctaaacaaaagaatccagatgtgcgcaatattgttcaacagcagttctgtggagaatatgcctatgtaactgtttgcaaccagtgtggcagagagtctaagcttttgtcaaaattttatgagctggagttaaatatccaaggccacaaacagttaacagattgtatctcggaatttttgaaggaagaaaaattagaaggagacaatcgctatttttgcgagaactgtcaaagcaaacagaatgcaacaagaaagattcgacttcttagccttccttgcactctgaacttgcagctaatgcgttttgtctttgacaggcaaactggacataagaaaaagctgaatacctacattggcttctcagaaattttggatatggagccttatgtggaacataaaggtgggtcctacgtgtatgaactcagcgcagtcctcatacacagaggagtgagtgcttattctggccactacatcgcccacgtgaaagatccacagtctggtgaatggtataagtttaatgatgaagacatagaaaagatggaggggaagaaattacaactagggattgaggaagatctagcagaaccttctaagtctcagacacgtaaacccaagtgtggcaaaggaactcattgctctcgaaatgcatatatgttggtttatagactgcaaactcaagaaaagcccaacactactgttcaagttccagcctttcttcaagagctggtagatcgggataattccaaatttgaggagtggtgtattgaaatggctgagatgcgtaagcaaagtgtggataaaggaaaagcaaaacacgaagaggttaaggagctgtaccaaaggttacctgctggagctgagccctatgagtttgtctctctggaatggctgcaaaagtggttggatgaatcaacacctaccaaacctattgataatcacgcttgcctgtgttcccatgacaagcttcacccggataaaatatcaattatgaagaggatatctgaatatgcagctgacattttctatagtagatatggaggaggtccaagactaactgtgaaagccctgtgtaaggaatgtgtagtagaacgttgtcgcatattgcgtctgaagaaccaactaaatgaagattataaaactgttaataatctgctgaaagcagcagtaaagggcagcgatggattttgggtggggaagtcctccttgcggagttggcgccagctagctcttgaacagctggatgagcaagatggtgatgcagaacaaagcaacggaaagatgaacggtagcaccttaaataaagatgaatcaaaggaagaaagaaaagaagaggaggaattaaattttaatgaagatattctgtgtccacatggtgagttatgcatatctgaaaatgaaagaaggcttgtttctaaagaggcttggagcaaactgcagcagtactttccaaaggctcctgagtttccaagttacaaagagtgctgttcacagtgcaagattttagaaagagaaggggaagaaaatgaagccttacataagatgattgcaaacgagcaaaagacttctctcccaaatttgttccaggataaaaacagaccgtgtctcagtaactggccagaggatacggatgtcctctacatcgtgtctcagttctttgtagaagagtggcggaaatttgttagaaagcctacaagatgcagccctgtgtcatcagttgggaacagtgctcttttgtgtccccacgggggcctcatgtttacatttgcttccatgaccaaagaagattctaaacttatagctctcatatggcccagtgagtggcaaatgatacaaaagctctttgttgtggatcatgtaattaaaatcacgagaattgaagtgggagatgtaaacccttcagaaacacagtatatttctgagcccaaactctgtccagaatgcagagaaggcttattgtgtcagcagcagagggacctgcgtgaatacactcaagccaccatctatgtccataaagttgtggataataaaaaggtgatgaaggattcggctccggaactgaatgtgagtagttctgaaacagaggaggacaaggaagaagctaaaccagatggagaaaaagatccagattttaatcaaatcatgcatgcattttcagttgctccttttgaccagaatttgtcaattgatggaaagattttaagtgatgactgtgccaccctaggcacccttggcgtcattcctgaatctgtcattttattgaaggctgatgaaccaattgcagattatgctgcaatggatgatgtcatgcaagtttgtatgccagaagaagggtttaaaggtactggtcttcttggacattaatctttgaatacttgctgactgctaagaaatgaccagaggggaagaggagtttgacatgttagggcattaaagcaaaggtggatttaagaattaaaccattacatgccccttccaaaaggcagaaatccattcaaacgtgactgtcccaaatgccttatgtcaaataaagcagattgcactgatggacatcagacttgaaggaaatgtttccaattttatatttaaggggggtggtgggtgggagggggcaagtaaagacggaacaagtttagtagcagtaatagtaaatcatgtttacatatgagatttatagtcgtgggaggggaataaagttctgttatatttccttgctcgagtttcataccagatgcgttggtccataaaggattgtatcaagtagatgggacaacattctgctctgaacgaaaagtaattttagagacataacctgcttaccaatgcctgtctttgattcatattctactttcaataaagcatgaaagtgaagaacttgtcctaagtgtggaaaagtgtcttcagatttagactcttctccatgtcagctgcagcgccacccgccttacacctgcccggccgtctgtctcttggtattgggtaaaggagggggcacctgcatgtctcctgcaatgagcaaggaattatgtctcatgttttgacttcagaggctttttgctttggtgcatttcagaaaggatggagaacatttattatgtgtgaaagcatcctcttccggttttgctgttattcaaaagtgggaaatgtacctggcacgtttgaaaataaaaaatctgactacctatcagaagagtaaatcagactgaagtacatttggataacacaaggtttctataaaatttgttcttcctgtcctccatgtcactgtttcttggacctcagttctctttttgaaagcattattccaaaatgccctgagagggtctcttagatcattgtttaaaaaaggaaaaaagtatatggatgtgctgtccatccaactcaggattatcattcttagcaacacgtaaccgaagcaatattcttaagaatattgaaggggtttttttaattgaacttaagactggagtttttcctttgaaa

SEQ ID NO: 2554 - DNA, 873 bp, Homo sapiens
agctcaacccccagcacggctgcatccaccatgtccgtctgctccagcgacctgagctatggcagccgcgtctgccttcctggttcctgtgactcttgctccgactcctggcaggtggacgactgcccagagagctgctgtgagcccccctgctgcgccccggccccctgcctgagcctggtctgcaccccagtgagccgtgtatccagcccctgctgccgagtgacctgtgagcccagcccctgccaatcaggctgcaccagctcctgcacgccctcgtgctgccagcagtctagctgccagccggcttgctgcacctcctccccctgccagcaggcctgctgcgtgcccgtctgctgcaagactgtctgctgcaagcctgtgtgctgtatgcccgtctgctgtgggccttcttcttcatgctgccagcagtctagctgccagccagcttgctgcatctcctccccgtgtcaacagtcctgctgtgtgcccgtctgctgcaagcccatctgctgtgtgcctgtctgctctggggcctcctctctgtgctgccagcagtctagctgccagccagcttgctgcaccacctcctgctgcagaccctcctcctccgtgtccctcctctgccgccctgtgtgcagacccgcccgccgcgtgcccgtcccctcctgctgtgtccccacctcctcctgccagccaagctgcggccgcctggcctcctgcgggtccctcctctgccgccccacatgttcccgcctggcctgctgaggcctctgctcaggccagaagtccagctgctgccaggcatgtcccccagggccactgggcactatgagtcccccacctctcccactactggcccctcggctgctc

SEQ ID NO: 2555 - DNA, 1238 bp, Homo sapiens
ctccaccagttcaaccccagcatggccgcgtccaccatgtccgtctgctccagcgacctgagctacggcagccgcgtctgccttcctggttcctgtgactcttgctccgactcctggcaggtggacgactgcccagagagctgctgtgagcccccctgctgcgccccggccccctgcctgagcctggtctgcaccccagtgagccgtgtgtccagcccctgctgcccagtgacctgtgagcccagcccctgccaatcaggctgcaccagctcctgcacgccctcgtgctgccagcagtctagctgccagctggcttgctgtgcctcctccccctgccagcaggcctgctgcgtgcccgtctgctgcaagactgtctgctgcaagcctgtgtgctgtgtgtccgtctgctgtggggattcttcatgctgccagcagtctagctgccagtcagcttgctgcacctcctccccctgccagcaggcctgctgtgtgcccgtctgctgcaagcctgtctgctctgggatttcctcttcgtgctgccagcagtctagctgtgtgagctgtgtgtccagcccctgctgccaggcggtctgtgagcccagcccctgccaatcaggctgcaccagctcctgcacgccctcgtgctgccagcagtctagctgccagccaacttgctgcacctcctccccctgccagcaggcctgctgcgtgcccgtctgctgcgtgcctgtgtgctgtgtgcccacctgctctgaggattcctcttcatgctgccagcagtctagctgccagccagcttgctgcacctcctccccctgccagcacgcctgctgtgtgcccgtctgctctggggcttccacatcatgctgccagcagtctagctgccagccggcttgctgcaccgcctcctgctgcagaccctcctcctccgtgtccctcctctgccaccctgtgtgcaagtccacctgctgcgtgcccgtcccctcctgtggtgcctctgcctcctcctgccagcccagctgctgccgcacggcctcctgtgtttccctcctctgccgccccatgtgctcccgccctgcctgctacagcctctgctctggccagaagtccagctgctgacagccctggatgtgatccggagtcccttcccaccaggggctgacctcccagctgccccagcaagctctgccctctctggctttgacaccctcagaagatggggcaggctctttgtctta

SEQ ID NO: 2556 - DNA, 1150 bp, Homo sapiens
ccagctcacgtcttccccaccccagcatggccgcgtgcaccatgtccgtctgctccagcgcttgctctgactcctggcgagtggacgactgcccagagagctgctgtgagcccccctgcggcaccgccccctgcctgaccctggtctgcaccccagtgagctgtgtgtccagcccctgctgccaggcggcctgtgagcccagcccctgccaatcaggctgcaccagctcctgcacgccctcgtgctgccagccggcttgctgcgcctcctccccctgccagcaggcctgctgcgtgcccgtctgctgcaagcctgtgtgctgcctgcccacctgctctaaggattcctcttcatgctgccagcagtctagctgccagccaacttgctgtgcctcttcctcctgccagcagtcctgctgtgtgcctgtctgctgcaagcccgtgtgctgtgtgcccacctgttctgaggattcctcttcatgctgccagcattctagctgccagccgacttgctgcacctcctccccctgccagcagtcctgctacgtgcctgtctgttgcaagcctgtctgcttcaaacccatctgctgtgtgcccgtctgctctggggcttccacttcatgctgccagcagtctagctgtcagccggcttgctgcaccacctcctgctgcagaccctcctcctccgtgtccctcctctgccgccccatatgcaggcccgcctgctgcgtgcccatctcctcctgctgtgcccctgcctcctcctaccaggccagctgctgccgcccggcctcctgcgtgtccctcctctgccgccccgcgtgctcccgcctggcctgctgaggcctctgctcaggccaggagtccagttgctgatgtgcacatcccccagggccaactggtcctgactcgggttaggaggttgcccccgcttgggacggggcccccatgtgctgaggtgacccccccctccatactcccaggaatctccatcctcgaagctccccagctcctgcctcccagcaggggcccacctgcctgttgggtcccctgtcctccctcccagcttctctgccccaggtcacttggcctcgacttgaacctgtcagcacctcctcctgctccccaataaactccccttggtcgcctga

SEQ ID NO: 2557 - DNA, 1382 bp, Homo sapiens
agctcaacccccagcacagcagcatccaccatgtccgtctgctccagcgacctgagctacagcagccgcgtctgccttcctggttcctgtgactcttgctccgactcctggcaggtggacgactgcccagagagctgctgcgagcccccctgctgcgcccccagctgctgcgccccggccccctgcctgagcctggtctgcaccccagtgagccgtgtgtccagcccctgctgcccagtgacctgcgagcccagcccctgccaatcaggctgcaccagctcctgcacgccctcgtgctgccagcagtctagctgccagctggcttgctgtgcctcctccccctgccagcaggcctgctgcgtgcccgtctgctgcaagactgtctgctgcaagcctgtgtgctgtgtgcccgtctgctgtggggattcttcatgctgccagcagtctagctgccagtcagcttgctgcacctcctccccctgccagcaggcctgctgtgtgcccatctgctgcaagcctgtctgctctgggatttcctcttcgtgctgccagcagtctagctgtgtgagctgtgtgtccagcccctgctgccaggcggtctgtgagcccagcccctgccaatcaggctgcatcagctcctgcacgccctcgtgctgccagcagtctagctgccagccggcttgctgcacctcctcctcctgccagcaggcctgctgcgtgcccgtctgctgcaagactgtctgctgcaagcctgtgtgctctgaggattcctcttcatgctgccagcagtctagctgccagccggcttgctgcacctcctctccctgccagcaggcttgctgtgtgcctgtctgctgcaagcctgtgtgctgcaagcctgtcggctctgtgcccatctgctctggggcttcctctctgtgctgccagcagtctagctgccagccagcttgctgcacctcctcccaaagccagcagggctgctgcgtgcccgtctgctgcaagcctgtgagctgtgtgcctgtttgctctggggcttcctcttcatgctgccagcaatctagctgccagccagcttgctgcaccacctcctgctgcagaccctcctcctccgtgtccctcctctgccgccccgtgtgcaggcccgcctgctgcgtgcccgtcccttcctgctgtgctcccacctcctcctgccaacccagctgctgccgcccagcctcctgcgtgtccctcctctgacgccccgtgtgctcccgcccagcctgctgaggcctccgctcaggtcagaagcccagctgctgatggacacgccccccagtgccagccaggctcaggtcccacctgaaagctgatagtcgcgtcctgaattgctcctgcactttgac

SEQ ID NO: 2558 - DNA, 1215 bp, Homo sapiens
tcactcactcacacctcccgcagctcacctcctccccaccccagcatggccgcgtccaccatgtccgtctgctccagcgcttgctccgactcctggcaggtggatgcctgcccagagagctgctgtgagccccactgctgcgccctcagctgctgcgccccggccccctgcctgaccctggtctgcaccccagtgagccgtgtgtccagcccctgctgccaggcagcctgtgagcccagcccctgccaatcaggctgcaccagctcctgcacgccctcgtgctgccagcagtctagctgccagccggcttgctgcacctcctccccctgccagcaggcctgctgcgtgcccgtctgctgcaagcctgtgtgctgcctgcccacctgctctaaggattcctcttcatgctgccagcagtctagctgccagccaacttgctgtgcctcttcctccagccagcagtcctgctgtgtgcctgtttgctgcaagcctgtgtgctatgtgcccacctgctctgaggattcctcttcatgctgccagcagtctagctgccatccagcttgctgcacctcctccccctgccagcaggcctgctgcgtgcccgtccgttgcaagcctgtctgctgcaagcccatctgctgtgtgcccgtctgctctggggcttccacttcatgctgccagcagtctagctgccagccggcttgctgcaccacctcctgctgcagaccctcctcctccgtgtccctcctctgccgccctgtatgccggcccgcctgctgtatgcctgtctcctcctgctgtgcccctgcctcctcctgccaggccagctgctgccgcccggcctcctgcgtgtccctcctctgccgccccgcgtgctcccgcccggcctgctgaggcctctgctcaggccaggagtccagctgctgatgggcacccgccctgggccagctgggctcagttcctgacctgggttaggtggcttcccccacctaggacgggtccccgtgtctcccctgtgctgaggtgaccccccctccttgctcccaggagcctccatccttgcagctccccagctcttgccttccagcaggtgcccacctgcctgctaggtcccctgtcctccctcccagcttctctgctctgggtcacttggcctcgacttgaacctctcagcacctcctcctgctccccaataaactctccttggtcacctga

SEQ ID NO: 2559 - DNA, 891 bp, Homo sapiens
atggcttccagtccgctgccagggcccaacgacatcctgctggcgtcgccgtcgagcgccttccagcccgacacgctgagccagccgcggccagggcacgccaacctcaaacccaaccaggtgggccaggtgatcctctacggcattcccatcgtgtcgttggtgatcgacgggcaagagcgcctgtgcctggcgcagatctccaacactctgctcaagaacttcagctacaacgagatccacaaccgtcgcgtggcactgggcatcacgtgtgtgcagtgcacgccggtgcaactggagatcctgcggcgtgccggggccatgcccatctcatcgcgccgctgcggcatgatcaccaaacgcgaggccgagcgtctgtgcaagtcgttcctgggcgaaaacaggccgcccaagctgccagacaatttcgccttcgacgtgtcacacgagtgcgcctggggctgccgcggcagcttcattcccgcgcgctacaacagctcgcgcgccaagtgcatcaaatgcagctactgcaacatgtacttctcgcccaacaagttcattttccactcccaccgcacgcccgacgccaagtacactcagccagacgcagccaacttcaactcgtggcgccgtcatctcaagctcaccgacaagagtccccaggacgagctggtcttcgcctgggaggacgtcaaggccatgttcaacggcggcagccgcaagcgcgcactgccccagccgggcgcgcaccccgcctgccacccgctcagctctataagaacaaggagcatagctttttcatcacagactctgatgcttctggaggagatttttggagagaaagatcaggaggattatatgcgaataaatgaggacaacatttggttatga

SEQ ID NO: 2560 - DNA, 6196 bp, Homo sapiens
gctctgctcgttgagtgaagaaaatccaccggcatcgcctgagccccgctaccgagaagggcgccgcttcctccggggagggggataaagatcccccgccgccggcccatgaggatattgccgtgaaaggcacagcgactgcagcaggaaccggacccggcaccggagcggcggcggcggcggcagcagcggtaccgcctcctcacccggcggcggcagcagcggcggcggcggcggcggcggcggcggcggcggcagcggtcccccctcctcacccgaacatcagggccctccagactcaggcgccccaacaaattcctagaggacctgtgcaacaacctcttgaggatcgaatcttcactcccgctgtctcagcagtctacagcacggtaacacaagtggcaagacagccgggaacccctaccccatccccttattcagcacatgaaataaacaaggggcatccaaatcttgcggcaacgcccccgggacatgcatcgtcccctggactctctcaaaccccttatccctctggacagaatgcaggtccaaccacgctggtataccctcaaacccctcagacaatgaattcacaacctcaaacccgttctccggtaattttctccccttcccagtttttccagaggcctcaaatacagcctcctagagctaccatcccgaacagcagtccttccattcgtcctggtgcacagacacccactgcagtgtaccaggctaatcagcacatcatgatggttaaccatctgcccatgccgtacccagtgccccaggggcctcagtactgtataccacagtaccgtcatagtggccctccttatgttgggcccccccaacaatatccagttcaaccaccggggccaggtcctttttatcctggaccaggacctggggacttccccaatgcttatggaacgcctttttacccaagtcagccggtgtatcagtcagcacctatcatagtgcctacgcagcaacagccgcctccagccaagagagagaaaaaaactataagaattcgggatccaaaccagggaggtaaagacataacagaggagattatgtctggaggtggcagcagaaatcctactccacccataggaagacccacgtccacacctactcctcctcagctgcccagccaggtccccgagcacagccctgtggtttatgggactgtggagagcgctcatcttgctgccagcacccctgtcactgcagctagcgaccagaagcaagaggagaagccaaaaccagatccagtgttaaagtctccttccccagtccttaggctagtcctcagtggagagaagaaagaacaagaaggccagacatctgaaactactgcaatagtatccatagcagagcttcctctgcctccatcacctaccactgtttcttctgttgctcgaagtacaattgcagcccccacctcttctgctcttagtagccaaccaatattcaccactgctatagatgacagatgtgaactctcatccccaagagaagacacaattcctatacccagcctcacatcttgcacagaaacatcagaccctttaccaacaaatgaaaatgatgatgatatatgcaagaaaccctgtagtgtagcacctaatgatattccactggtttctagtactaacctaattaatgaaataaatggagttagcgaaaaattatcagccacggagagcattgtggaaatagtaaaacaggaagtattgccattgactcttgaattggagattctcgaaaatcccccagaagaaatgaaactggagtgtatcccagctcccatcaccccttccacagttccttcctttcctccaactcctccaactcctccagcttctcctcctcacactccagtcattgttcctgctgctgccactactgttagttctccgagtgctgccatcacagtccagagagtcctagaggaggacgagagcataagaacttgccttagtgaagatgcaaaagagattcagaacaaaatagaggtagaagcagatgggcaaacagaagagattttggattctcaaaacttaaattcaagaaggagccctgtcccagctcaaatagctataactgtaccaaagacatggaagaaaccaaaagatcggacccgaaccactgaagagatgttagaggcagaattggagcttaaagctgaagaggagctttccattgacaaagtacttgaatctgaacaagataaaatgagccaggggtttcatcctgaaagagacccctctgacctaaaaaaagtgaaagctgtggaagaaaatggagaagaagctgagccagtacgtaatggtgctgagagtgtttctgagggtgaaggaatagatgctaattcaggctccacagatagttctggtgatggggttacatttccatttaaaccagaatcctggaagcctactgatactgaaggtaagaagcagtatgacagggagtttctgctggacttccagttcatgcctgcctgtatacaaaaaccagagggcctgcctcctatcagtgatgtggttcttgacaagatcaaccaacccaaattgccaatgcgaactctggatcctcgaattttgcctcgaggaccagactttacaccagcctttgctgattttggaaggcagacacctggtggaagaggcgtacctttgttgaatgttgggtcacgaagatctcaacctggccaaagaagagaacccagaaagatcatcacagtttctgtaaaagaagatgtacacctgaaaaaggcagaaaatgcctggaagccaagccaaaaacgagacagccaagccgatgatcccgaaaacattaaaacccaggagctttttagaaaagttcgaagtatcttaaataaattgacaccacagatgttcaatcaactgatgaagcaagtgtcaggacttactgttgacacagaggagcggctgaaaggagttattgacctggtctttgagaaggctattgatgaacccagtttctctgtggcttacgcaaacatgtgtcgatgtctagtaacgctgaaagtacccatggcagacaagcctggtaacacagtgaatttccggaagctgctactgaaccgttgccagaaggagtttgaaaaagataaagcagatgatgatgtctttgagaagaagcagaaagaacttgaggctgccagtgctccagaggagaggacaaggcttcatgatgaactggaagaagccaaggacaaagcccggcggagatccattggcaacatcaagtttattggagaactctttaaactcaaaatgctgactgaagccatcatgcatgactgtgtggtgaagctgctaaagaaccatgatgaagaatccctggagtgcctgtgtcgcctgctcaccaccattggcaaagacttggactttgaaaaagcaaagccacgtatggaccagtactttaatcagatggagaaaattgtgaaagaaagaaaaacctcatctaggattcggttcatgcttcaagatgttatagacctaaggctgtgcaattgggtatctcgaagagcagatcaagggcctaaaactatcgaacagattcacaaagaggctaaaatagaagaacaagaagagcaaaggaaggtccagcaactcatgaccaaagagaagagaagaccaggtgtccagagagtggacgaaggtgggtggaacactgtacaaggggccaagaacagtcgggtactggacccctcaaaattcctaaaaatcactaagcctacaattgatgaaaaaattcagctggtacctaaagcacagctaggcagctggggaaaaggcagcagtggtggagcaaaggcaagtgagactgatgccttacggtcaagtgcttccagtttaaacagattctctgccctgcaacctccagcaccctcagggtccacgccatccacgcctgtagagtttgattcccgaaggaccttaactagtcgtggaagtatgggcagggagaagaatgacaagccccttccatctgcaacagctcggccaaatactttcatgaggggtggcagcagtaaagacctgctagacaatcagtctcaagaagagcagcggagagagatgctggagaccgtgaagcagctcacaggaggtgtggatgtggagaggaacagcactgaggctgagcgaaataaaacaagggagtcagcaaaaccagaaatttcagcaatgtcagctcatgacaaggctgcattatcagaagaggaactggagaggaagtcgaaatctatcattgatgaatttctacacattaatgattttaaggaagccatgcagtgtgtggaagagctgaatgcccagggcctactacatgtttttgtgagagtgggagtggagtccaccctggaaaggagccagatcaccagggatcacatgggccaattactctatcagctggtacagtcagaaaaactcagcaaacaggactttttcaaaggtttttcagaaactttggaattggcagatgacatggccattgatattccccatatttggttgtaccttgctgaactggtgacccccatgttaaaagaaggtggaatctccatgagagaacttaccatagaatttagcaaacctttacttcctgttggaagagctggggtcttgctatctgaaatattgcacctactatgcaaacaaatgagccataagaaagtgggagccttatggagggaggctgacctcagctggaaggactttttaccagaaggagaagatgtacataattttcttttggagcagaagttggacttcatagagtctgacagtccctgttcctctgaagcactttcaaagaaagaactgtctgccgaagagctgtataagcgactcgagaaactcattattgaggacaaagcgaatgatgaacagatctttgactgggtagaggctaatctagacgaaatccagatgagttcacctacattccttagagctttaatgactgctgtttgtaaagcagctattatagccgactcttctaccttcagagtggacactgctgttatcaagcagagagtgccgatcttactcaagtacctagactcagatacagagaaggaactgcaagcactttatgcactacaagcatcgatagtaaaacttgatcaacctgccaatttgctgcggatgttttttgattgtctatatgacgaggaggtgatctccgaggatgccttctacaaatgggagagcagcaaggaccctgcagagcagaatgggaagggcgtggctctgaaatctgtcacggcattcttcacgtggctgcgggaagcagaagaggagtctgaggataactaaaacttcaaatacacaaaatgaaacaaaagaaacaatttaagtatttttttaaaaagtttcacgtcttcgccaatcacagtgcagcaaggccaattctcgcagaaacccccacgtgtgcacgagtgggagaggggaaagagaaaaaaaggtgatcatggaggaaaaaggtactggataaaagtaaacttcaaaccttagggcgggagcactaaaaccaaaatacatgtattatttatagaaaatattttctgttttaatcttttctttttaaacaaggactcatacttaaaaaaatgtttagcaaaaaaaaaaaaagttgagaacttttaatttattttaaggactgcaaatgccagtgtaattttttaatttgcagtttctgtaaacaacttgtataatagaaaagcagagaaataaatttccctccccttcaagatgcacctcatgtttgttttaaggtatagcatttagtccagatttgagaaagtttggggtgaacaaggtaagaaagatttttttttttttggcatcaaatctttctgcctgcctctcagcttgcttcagaaaatttaaaaaatcacaatagtaatcaaaacatacataacattgaaacagaaggaaatgctgtggaccacagaactccaagaattgtttaaaaaaaaaaaagtgctaccctgagaaaagtactcttaatactcttgaaatctttagagcaactttaaggcttgtaaatacatagaacaaatatttaaaaaaacaaaaagaaattgactcagtactatttcttttcactttgaaaatataaagaacaaaataaagacaaacattgcaagttt

SEQ ID NO: 2561 - DNA, 6175 bp, Homo sapiens
ctgctcgttgagtgaagaaaatccaccggcatcgcctgagccccgctaccgagaagggcgccgcttcctccggggagggggataaagatcccccgccgccggcccatgaggatattgccgtgaaaggcacagcgactgcagcaggaaccggacccggcaccggagcggcggcggcggcggcagcagcggtaccgcctcctcacccggcggcggcagcagcggcggcggcggcggcggcggcggcggcggcggcagcggtcccccctcctcacccgaacatcagggccctccagactcaggcgccccaacaaattcctagaggacctgtgcaacaacctcttgaggatcgaatcttcactcccgctgtctcagcagtctacagcacggtaacacaagtggcaagacagccgggaacccctaccccatccccttattcagcacatgaaataaacaaggggcatccaaatcttgcggcaacgcccccgggacatgcatcgtcccctggactctctcaaaccccttatccctctggacagaatgcaggtccaaccacgctggtataccctcaaacccctcagacaatgaattcacaacctcaaacccgttctccgtttttccagaggcctcaaatacagcctcctagagctaccatcccgaacagcagtccttccattcgtcctggtgcacagacacccactgcagtgtaccaggctaatcagcacatcatgatggttaaccatctgcccatgccgtacccagtgccccaggggcctcagtactgtataccacagtaccgtcatagtggccctccttatgttgggcccccccaacaatatccagttcaaccaccggggccaggtcctttttatcctggaccaggacctggggacttccccaatgcttatggaacgcctttttacccaagtcagccggtgtatcagtcagcacctatcatagtgcctacgcagcaacagccgcctccagccaagagagagaaaaaaactataagaattcgggatccaaaccagggaggtaaagacataacagaggagattatgtctggaggtggcagcagaaatcctactccacccataggaagacccacgtccacacctactcctcctcagcagctgcccagccaggtccccgagcacagccctgtggtttatgggactgtggagagcgctcatcttgctgccagcacccctgtcactgcagctagcgaccagaagcaagaggagaagccaaaaccagatccagtgttaaagtctccttccccagtccttaggctagtcctcagtggagagaagaaagaacaagaaggccagacatctgaaactactgcaatagtatccatagcagagcttcctctgcctccatcacctaccactgtttcttctgttgctcgaagtacaattgcagcccccacctcttctgctcttagtagccaaccaatattcaccactgctatagatgacagatgtgaactctcatccccaagagaagacacaattcctatacccagcctcacatcttgcacagaaacatcagaccctttaccaacaaatgaaaatgatgatgatatatgcaagaaaccctgtagtgtagcacctaatgatattccactggtttctagtactaacctaattaatgaaataaatggagttagcgaaaaattatcagccacggagagcattgtggaaatagtaaaacaggaagtattgccattgactcttgaattggagattctcgaaaatcccccagaagaaatgaaactggagtgtatcccagctcccatcaccccttccacagttccttcctttcctccaactcctccaactcctccagcttctcctcctcacactccagtcattgttcctgctgctgccactactgttagttctccgagtgctgccatcacagtccagagagtcctagaggaggacgagagcataagaacttgccttagtgaagatgcaaaagagattcagaacaaaatagaggtagaagcagatgggcaaacagaagagattttggattctcaaaacttaaattcaagaaggagccctgtcccagctcaaatagctataactgtaccaaagacatggaagaaaccaaaagatcggacccgaaccactgaagagatgttagaggcagaattggagcttaaagctgaagaggagctttccattgacaaagtacttgaatctgaacaagataaaatgagccaggggtttcatcctgaaagagacccctctgacctaaaaaaagtgaaagctgtggaagaaaatggagaagaagctgagccagtacgtaatggtgctgagagtgtttctgagggtgaaggaatagatgctaattcaggctccacagatagttctggtgatggggttacatttccatttaaaccagaatcctggaagcctactgatactgaaggtaagaagcagtatgacagggagtttctgctggacttccagttcatgcctgcctgtatacaaaaaccagagggcctgcctcctatcagtgatgtggttcttgacaagatcaaccaacccaaattgccaatgcgaactctggatcctcgaattttgcctcgaggaccagactttacaccagcctttgctgattttggaaggcagacacctggtggaagaggcgtacctttgttgaatgttgggtcacgaagatctcaacctggccaaagaagagaacccagaaagatcatcacagtttctgtaaaagaagatgtacacctgaaaaaggcagaaaatgcctggaagccaagccaaaaacgagacagccaagccgatgatcccgaaaacattaaaacccaggagctttttagaaaagttcgaagtatcttaaataaattgacaccacagatgttcaatcaactgatgaagcaagtgtcaggacttactgttgacacagaggagcggctgaaaggagttattgacctggtctttgagaaggctattgatgaacccagtttctctgtggcttacgcaaacatgtgtcgatgtctagtaacgctgaaagtacccatggcagacaagcctggtaacacagtgaatttccggaagctgctactgaaccgttgccagaaggagtttgaaaaagataaagcagatgatgatgtctttgagaagaagcagaaagaacttgaggctgccagtgctccagaggagaggacaaggcttcatgatgaactggaagaagccaaggacaaagcccggcggagatccattggcaacatcaagtttattggagaactctttaaactcaaaatgctgactgaagccatcatgcatgactgtgtggtgaagctgctaaagaaccatgatgaagaatccctggagtgcctgtgtcgcctgctcaccaccattggcaaagacttggactttgaaaaagcaaagccacgtatggaccagtactttaatcagatggagaaaattgtgaaagaaagaaaaacctcatctaggattcggttcatgcttcaagatgttatagacctaaggctgtgcaattgggtatctcgaagagcagatcaagggcctaaaactatcgaacagattcacaaagaggctaaaatagaagaacaagaagagcaaaggaaggtccagcaactcatgaccaaagagaagagaagaccaggtgtccagagagtggacgaaggtgggtggaacactgtacaaggggccaagaacagtcgggtactggacccctcaaaattcctaaaaatcactaagcctacaattgatgaaaaaattcagctggtacctaaagcacagctaggcagctggggaaaaggcagcagtggtggagcaaaggcaagtgagactgatgccttacggtcaagtgcttccagtttaaacagattctctgccctgcaacctccagcaccctcagggtccacgccatccacgcctgtagagtttgattcccgaaggaccttaactagtcgtggaagtatgggcagggagaagaatgacaagccccttccatctgcaacagctcggccaaatactttcatgaggggtggcagcagtaaagacctgctagacaatcagtctcaagaagagcagcggagagagatgctggagaccgtgaagcagctcacaggaggtgtggatgtggagaggaacagcactgaggctgagcgaaataaaacaagggagtcagcaaaaccagaaatttcagcaatgtcagctcatgacaaggctgcattatcagaagaggaactggagaggaagtcgaaatctatcattgatgaatttctacacattaatgattttaaggaagccatgcagtgtgtggaagagctgaatgcccagggcctactacatgtttttgtgagagtgggagtggagtccaccctggaaaggagccagatcaccagggatcacatgggccaattactctatcagctggtacagtcagaaaaactcagcaaacaggactttttcaaaggtttttcagaaactttggaattggcagatgacatggccattgatattccccatatttggttgtaccttgctgaactggtgacccccatgttaaaagaaggtggaatctccatgagagaacttaccatagaatttagcaaacctttacttcctgttggaagagctggggtcttgctatctgaaatattgcacctactatgcaaacaaatgagccataagaaagtgggagccttatggagggaggctgacctcagctggaaggactttttaccagaaggagaagatgtacataattttcttttggagcagaagttggacttcatagagtctgacagtccctgttcctctgaagcactttcaaagaaagaactgtctgccgaagagctgtataagcgactcgagaaactcattattgaggacaaagcgaatgatgaacagatctttgactgggtagaggctaatctagacgaaatccagatgagttcacctacattccttagagctttaatgactgctgtttgtaaagcagctattatagccgactcttctaccttcagagtggacactgctgttatcaagcagagagtgccgatcttactcaagtacctagactcagatacagagaaggaactgcaagcactttatgcactacaagcatcgatagtaaaacttgatcaacctgccaatttgctgcggatgttttttgattgtctatatgacgaggaggtgatctccgaggatgccttctacaaatgggagagcagcaaggaccctgcagagcagaatgggaagggcgtggctctgaaatctgtcacggcattcttcacgtggctgcgggaagcagaagaggagtctgaggataactaaaacttcaaatacacaaaatgaaacaaaagaaacaatttaagtatttttttaaaaagtttcacgtcttcgccaatcacagtgcagcaaggccaattctcgcagaaacccccacgtgtgcacgagtgggagaggggaaagagaaaaaaaggtgatcatggaggaaaaaggtactggataaaagtaaacttcaaaccttagggcgggagcactaaaaccaaaatacatgtattatttatagaaaatattttctgttttaatcttttctttttaaacaaggactcatacttaaaaaaatgtttagcaaaaaaaaaaaaagttgagaacttttaatttattttaaggactgcaaatgccagtgtaattttttaatttgcagtttctgtaaacaacttgtataatagaaaagcagagaaataaatttccctccccttcaagatgcacctcatgtttgttttaaggtatagcatttagtccagatttgagaaagtttggggtgaacaaggtaagaaagatttttttttttttggcatcaaatctttctgcctgcctctcagcttgcttcagaaaatttaaaaaatcacaatagtaatcaaaacatacataacattgaaacagaaggaaatgctgtggaccacagaactccaagaattgtttaaaaaaaaaaaagtgctaccctgagaaaagtactcttaatactcttgaaatctttagagcaactttaaggcttgtaaatacatagaacaaatatttaaaaaaacaaaaagaaattgactcagtactatttcttttcactttgaaaatataaagaacaaaataaagacaaacattgcaagttt

SEQ ID NO: 2562 - DNA, 3731 bp, Homo sapiens
cttggcccgggctgctgggagtccccggcggggcgggggtcagctctggtcccgttggtcctgggcgcggcgccatggcctccgaggcggtgaaggttgtcgtgcgctgccgtcccatgaaccagcgggagcgagagctgcgctgccagcccgtggtgactgtggactgcgcgcgcgcccagtgctgcatccagaacccgggcgccgccgacgagccgcccaagcagttcaccttcgacggcgcctaccacgtggaccacgtcaccgagcagatctacaacgagatcgcctatccgctggtggagggcgtcactgagggctacaatggcaccatctttgcctacggccagacaggcagcgggaagtccttcaccatgcagggcctgccggatccgccctcccagagaggcatcatccccagggccttcgagcacgtgttcgagagcgtccagtgtgcagagaacactaagttcctggtccgggcctcctacctggagatctacaatgaagatgtccgggacctccttggggctgacaccaagcagaagctggagctgaaggagcacccagagaagggcgtgtacgtgaaggggctgtccatgcacacggtgcacagcgtggcccagtgtgagcacatcatggagactggctggaagaaccgttcggtcggctacacgctgatgaacaaggattcctcacgctcgcactccatcttcaccatcagcatcgagatgtctgccgtggatgagcggggcaaggaccacctccgggcgggcaagctgaacctggtggacctggcgggcagcgagcggcagtccaagaccggggccacgggcgagcggctcaaggaggccaccaagatcaacctgtcgctctcggcactgggcaatgtcatctcggcgctggtggacgggcgctgtaagcacgtcccctaccgtgactcgaagctgacgcggctgctgcaggactcactgggcggcaacaccaagacgctcatggtggcctgcctgtcgcctgcggacaacaactacgatgagacactcagcacgctgcgctacgccaaccgggccaagaacatcaggaacaagccgcgcatcaatgaggaccccaaggatgcgctgcttcgcgagtaccaggaggagatcaagaagctcaaggccatcctgacacagcagatgagccccagcagcctgtcagccctgctgtccaggcaggtgcccccagaccctgtgcaggtggaggagaagctgttgccccaacctgtgatccagcatgacgtggaggccgagaagcagctgatccgggaggagtatgaagagcgcctggcccggctgaaagccgactataaggccgagcaggagtctcgggccaggctggaggaagacatcactgccatgcgcaactcatatgacgtcaggctgtccacgctggaggagaacctgcggaaggagacagaggctgtcctgcaggtgggagtcctctacaaggctgaggtcatgtccagggctgagtttgccagcagcgctgagtacccgcctgcttttcagtatgagacagtggtgaaacccaaggtcttctccacgactgacactctgcccagtgacgatgtctccaagactcaggtttcctccaggtttgcggagctgcccaaggtggaaccctccaaatctgagatttctctgggctccagtgagtcatcctcgctcgaagaaacctctgtgtccgaggctttccctgggcctgaggagccctccaacgtggaggtctccatgcccactgaggagtccaggagcagatacttcctggatgagtgcctcgggcaggaggccgctgggcacctgctgggggaacagaactacctcccgcaagaggagccgcaggaggtgcccctgcaggggttactaggcctgcaggacccgtttgccgaggtggaagccaagctggccagactctcctccaccgtggccaggacagatgcaccccaggcagacgtccccaaggtccctgtgcaggtccctgcgccgacagacctgctggagcccagtgatgccaggcccgaagccgaggcggctgatgacttcccgcccaggcctgaggtagatctggcctcggaagtggccttagaggtggtgcggacagcagagcctggcgtgtggttggaggctcaggccccggtggccctggtggctcagcctgagcccctgccggccacagctggtgtgaagagggagagcgtgggcatggaggtggcagtgctgactgatgacccgctgcccgttgtggaccagcagcaggtgctggcccgtctgcagctgttggagcagcaggttgtgggtggagagcaggccaagaacaaggacctgaaggagaagcacaagcggcgcaagcgctacgcagacgagcgcaggaagcagctggtggctgccctgcagaactcggatgaggacagcggggactgggtgctgcttaacgtctacgactccatccaggaggaagtgcgggccaagagcaagctgctggagaagatgcagaggaagcttcgggcagcagaggtggagatcaaagatctgcagtccgagtttcagctggagaagatcgattacttggccaccatccgccggcaggagcgtgactccatgctcttgcagcagctcctggagcaggtgcagcccctgattcgcagggactgtaactacagcaacctggagaagattctgcgtgagtcctgctgggacgaagataacggcttctggaagatcccacatcccgtcatcacaaaaaccagcctcccagtagtttcaactgggccacagaacaaaccagcccgcaaaacctctgcagcagacaatggcgagccgaacatggaggacgaccgctacaggctcatgctcagtcggagcaacagtgaaaacattgccagcaactacttccgatctaagcgggccagccagatcctcagcacagacgccaggaagagcctcacacatcacaactcgccaccaggcctcagctgcccactcagcaacaactctgccatcccacccacccaggcccctgaaatgccccagccccggcccttccgcctcgagtccctcgacatccctttcaccaaggccaagcgtaagaaaagcaaaagcaactttggcagtgagcctctgtgagcacagctgcttgccattgcctgccttataggcatgtagagactgccaggccctcccagggcagccccaaccaggtctcctcccacctgccacacagcgctccggggcctgagggctccctcagccctgggaagacacattcccttccctgttccccagagagcccacctccgccctgggcaggagcccctcggaggctgtatagtcctccttagagaggcctgctccagctgttcataccacatcagtgtttccgtctgctcacctgccacagagcccacacccatgcccaccagtgttggtctttgcctcaaagcctgagacctgcttcacggccttcaccagccctgatggagagggcagcagctgccacgtggaggaagctcaatatcagctgggaaggaactgtgcctctgtctgactggccccacttcctaagcactgccctgccccatggggtggcacaggggtcccacagcaggtcttcctgcactgcccacccctggctggtctgtggcccaaggaaggccactccacattaagctgcccaataaactgcttttaagataa

SEQ ID NO: 2563 - DNA, 1544 bp, Homo sapiens
gtgcttatgagataaacgacagggtaactgtccacattggtcccagtttatgagggagaagagatcataatctacaaaaatttgcaaggtgaccaggggaaaagagtacggcgcctcatctcccagagatcttccttggagaccctggaagatattgaggagaacgcccctctccggagatgtcgaactctctcaggttcacccagaccaaagaattttaagaagattcattttatcaagaacatgcggcaacacgataccaggaatggcagaatagtccttatcagtggcagaagatccttctgtagtatattttcagtgctgccgtatcgcgacagtacccaagtcggggacttgaagttggacggaggaagacaatcaactggtgcagtgagtttgaaagagatcattggtctggaaggtgtggagctgggtgctgatgggaagactgtttcctatacccaatttctgttacccacaaatgcctttggagcccggagaaataccatagactccacctcctctttctcccagttccgtaacctgagccaccgcagcctctccataggccgggcaagcggcacccaggggagcctcgacacaggtagtgacctgggagactttatggactatgacccaaatctcttggatgacccccagtggccttgtggcaaacacaaacgcgttctgatcttcccttcctacatgacaacagtgattgactacgtgaagccctcggatctcaagaaggacatgaacgagaccttcaaggagaagtttcctcacattaagctgacactcagcaaaattaggagtctgaaacgagagatgcggaagcttgcgcaggaggactgtggccttgaggagcccacggtggccatggccttcgtctactttgaaaagctcgccctcaaggggaaactcaacaaacagaaccggaagctgtgtgctggggcatgtgtgctgttagcagccaaaattggaagtgacctcaaaaaacacgaagtcaagcatttaattgacaaactggaagagaagttccggctgaacaggcgagaactgattgcctttgaattcccggtgttagtggccttggaattcgccctccacttgcccgagcacgaagtcatgccccactacagacggctggtccagagttcctagcactggccccgaggacagccaagggccatttcttctcagcttggtggagcagcacttacttactactggaaatgaaaaaaagtagaactcagaataccagacttttcttcctctcgacatagtttggggagaagcagtactagaaactttccaaggagtcttgggtgtgtagccaagaggagccatgagctatggactcctcaagcacgggaagaggaggtgtgtgctgagaacagagaggccctgccctctgtccactagcgagaatccctagctgccccagcccagtctttctccccggcattcacaaactttgcaagcgtggtccagggccttctccagatctgttccaacttggagtgtgaagggcttgagcatac

SEQ ID NO: 2564 - DNA, 4246 bp, Homo sapiens
agggctccacagtcgttccgccacctcccagtcgggttgcggcggaggccgttcctggctttgtagctcgctcaagatggcggcgcagccaccccgcgggatacgcctcagcgcgctttgcccgaagtttttacatacaaattctactagtcacacctggccattcagtgcagttgctgaattaatagataatgcttatgatcctgatgtgaacgctaaacaaatatggattgacaaaacagtgataaatgaccatatatgcttgacattcaccgacaatgggaatggtatgacttctgataaattacataaaatgctaagctttggcttcagtgacaaagtcaccatgaatggtcatgtcccagttggattatatgggaatggcttcaagtcgggttctatgcgtctgggtaaagacgcaatcgtttttaccaaaaatggagaaagcatgagcgtgggccttttgtctcagacctacttggaagtcataaaagcggagcatgttgttgttccaatagtggcattcaacaagcaccgacagatgattaatttagcagaatcaaaagccagccttgctgcaattctggaacattctctgttttccacggaacagaagttactggcagaacttgatgctattataggcaagaaggggacgaggatcatcatttggaatcttagaagctacaaaaatgcaacagagttcgattttgaaaaggataaatatgatatcagaattcccgaggatttagatgagataacagggaagaaggggtacaagaagcaggaaaggatggaccagattgcccctgagagtgactattccctgagggcttattgcagtatattatatctaaagccaagaatgcagatcatcctacgtggacagaaagtgaagacacagctggtttcgaagagtcttgcctacatcgaacgtgatgtttatcgaccaaaatttttatctaaaacagtgagaattacctttggattcaactgcagaaataaagatcattatgggataatgatgtatcacagaaatagactcatcaaagcttatgaaaaagttggatgtcagttaagggcaaacaacatgggtgttggagtggttggaattatagagtgtaatttccttaagccaactcataataaacaagatttcgactatactaatgagtacagacttacaataacagcactaggagaaaagctgaatgattactggaatgaaatgaaagtgaagaaaaatacagaatatcctctaaatttgccagttgaagatatacagaagcgtcctgatcagacatgggttcagtgtgatgcctgtctaaagtggcggaaattacctgatgggatggatcaacttcctgaaaaatggtattgctccaataaccctgacccacagttcagaaattgtgaggttccagaagaacctgaagatgaggatttggtacatcccacttatgaaaaaacctacaaaaagaccaacaaggaaaaattcaggatcagacaaccggaaatgatccctcggattaatgctgaactgttgtttcggccaactgctctttcaactccaagcttttcttctcctaaggaaagtgttccaagaagacatctttcagaaggaacaaattcttatgcgacaagacttctaaataatcatcaagttccacctcagtctgaacctgagagcaacagcttgaaacggagactttctactcgttcctcaattttgaatgcaaagaatcggagattgagtagtcagtttgaaaattcagtttataaaggtgatgatgatgatgaagatgtcatcatcttagaagaaaacagtacccccaaacctgcagtagatcatgatattgacatgaaatcagaacagagtcacgttgagcaaggtggtgttcaggttgagtttgtgggtgacagtgaaccttgtggccagactggttcaacaagcacctcatcatcccgatgcgaccagggaaatactgcagctacccagactgaagtaccaagtttagttgttaaaaaagaagaaactgttgaagacgagatagacgtaagaaatgatgcagtgattctgccctcctgtgtagaagctgaagcaaagatacatgaaacccaggaaaccaccgataaatctgcagatgatgcaggctgccaattacaagaactgagaaaccagctactccttgtcactgaggaaaaagagaattataaaagacagtgtcatatgtttactgatcaaatcaaagtgttacaacagaggatactagaaatgaatgacaagtatgttaagaaagaaacttgccatcagtccactgaaaccgatgctgtatttttacttgaaagtattaatggcaaatctgaaagtccagaccatatggtatctcagtatcagcaagctttggaagaaatagaaaggctgaaaaaacaatgtagtgctttgcaacatgtaaaggctgaatgcagccagtgttccaataatgagagtaaaagtgaaatggatgagatggctgtgcagcttgacgatgtgtttagacaactggacaaatgcagtattgagagggaccagtataaaagtgaggttgaattgctggaaatggaaaagtcacaaatccgttcacagtgtgaagaactcaaaactgaagtagaacagttaaaatctacaaatcaacagacggcaacagatgtttcaacatcaagtaacattgaggagtctgtaaatcatatggatggagaaagcctcaaactccgatctcttcgagttaacgtaggacaactgctggctatgattgtgcctgatcttgatcttcagcaagtgaattacgatgttgatgtagttgatgagattttaggacaagttgttgaacaaatgagtgaaatcagtagtacttaaagtatatgttatgtaagataaaatatttgctcaattcttttggttgtacagctttcaaaatataattaattttgttttatagatatgataggcaacagactgaaaaccataatctttactgtattctatgcattcaaatgtggtcacaaatattgtggacacattatcttatgttttgaaatacctgtgaattgttggcattgagcagctgaagctaactcatgactctgttttgaatgtaaatatttgtaattaagcctgcacatatttttttattgccctagagtactcaagtgtttttcaccaagagcttttcaggttgcccctaagctttgtgcaattttttctggttccccaaagtgtatttttctctaagtcgagggctatgccataatacaaatggaaatgttacctttgattttcttataaaggagtttaaataggatttttaaataatgtagtaacactcctgatacaactctggttataagtgaattgagcattaatgtttcttttgtataaattcctgtcctgaaatattttattcatgaaaataaggtaagcaaaaaccaactccattttgccaggattttgttgtgctgagattgccaatcacggttaaacacaaagtgtttttatagaatgaagaaacagtctttaacagaaaaaaggtattgaaatattaaatggccaccaagtttactttgaagcccatttttggctgtttagtcagcatgaagtgggcatgataattttttaatatttctttttgtgaaatttcctgtacagccttttgtaggattactacaggttaatgtgagttgaggaagacagtctttctcaaacaatactacataccttttattatattacaaacctaagtgttttatatcctagagtcaaggaacaaatttccttaggattatagtattacatgccataaaatactatgctttattggtcccatgttttgtgcaattttaaagagatggctttctattaagtataaactatgtatatataagaaccatattttccacaactaaaatgtgcattattttttccaaagttttatcattgctatttatttttacctttgtttttgaacattcaatccgttcattttgtatgtatgcttaatacgtgtcggtcatatacagtattgaatttttactgtatagtaattctggaaagagcaaataaatgaagattgtttttatttgcctgataaagtaattgaaagtgtatttttggtatgaagctggttttctgtcacaattgtaatttcccaaattttaaaatatcttataataaaataaaaatatatgatggctaactgttcaaatgcta

SEQ ID NO: 2565 - DNA, 3390 bp, Homo sapiens
ctggcggttctacctccgagggttcgcccgcccttggttttccttacaccttagcctttggctcctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttactctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagatcaccatttcaggtcactgctggatatcagttgcctgtatataattatcaggcatttcctgcttatccaaattcaccatttcaagtcgccactggatatcagttccctgtatacaattatcagccatttcctgcttatccaagttcaccatttcaggtcactgctggatatcagttgcctgtatataattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaaattcagcagttcaggtcaccactggatatcagttccatgtatacaattaccagatgccaccgcagtgccctgttggggagcaaaggagaaatctgtggaccgaagcatacaaatggtggtatcttgtctgtttaatccagagaagagactgataaattccgttgttactcaagatgactgcttcaagggtaaaagagtgcatcgctttagaagaagtttggcagtatttaaatctgttggatcctctcagctatctagtttcatgggaagttgctggttttgaatattaagctaaaagttttccactattacagaaattctgaattttggtaaatcacactgaaactttctgtataacttgtattattagactctctagttttatcttaacactgaaactgttcttcattagatgtttatttagaacctggttctgtgtttaatatatagtttaaagtaacaaataatcgagactgaaagaatgttaagatttatctgcaaggatttttaaaaaattgaaacttgcattttaagtgtttaaaagcaaatactgactttcaaaaaagtttttaaaacctgatttgaaagctaacaattttgatagtctgaacacaagcatttcacttctccaagaagtacctgtgaacagtacaatatttcagtattgagctttgcatttatgatttatctagaaatttacctcaaaagcagaatttttaaaactgcatttttaatcagtggaactcaatgtatagttagctttattgaagtcttatccaaacccagtaaaacagattctaagcaaacagtccaatcagtgagtcataatgtttattcaaagtattttatcttttatctagaatccacatatgtatgtccaatttgattgggatagtagttaggataactaaaattctgggcctaattttttaaagaatccaagacaaactaaactttactgggtatataaccttctcaatgagttaccattcttttttataaaaaaaattgttccttgaaatgctaaacttaatggctgtatgtgaaatttgcaaaatactggtattaaagaacgctgcagcttttttatgtcactcaaaggttaatcggagtatctgaaaggaattgtttttataaaaacattgaagtattagttacttgctataaatagatttttatttttgttttttagcctgttatatttccttctgtaaaataaaatatgtccagaagaggcatgttgtttctagattaggtagtgtcctcattttatattgtgaccacacagctagagcaccagagcccttttgctatactcacagtcttgttttcccagcctcttttactagtctttcaggaggtttgctcttagaactggtgatgtaaagaatggaagtagctgtatgagcagttcaaaggccaagccgtggaatggtagcaatgggatataatacctttctaagggaaacatttgtatcagtatcatttgatctgccatggacatgtgtttaaagtggctttctggcccttctttcaatggcttcttccctaaaacgtggagactctaagttaatgtcgttactatgggccatattactaatgcccactggggtctatgatttctcaaaattttcattcggaatccgaaggatacagtctttaaactttagaattcccaagaaggctttattacacctcagaaattgaaagcaccatgactttgtccattaaaaaattatccatagtttttttagtgcttttaacattccgacatacatcattctgtgattaaatctccagatttctgtaaatgatacctacattctaaagagttaattctaattattccgatatgaccttaaggaaaagtaaaggaataaatttttgtctttgttgaagtatttaatagagtaaggtaaagaagatattaagtccctttcaaaatggaaaattaattctaaactgagaaaaatgttcctactacctattgctgatactgtctttgcataaatgaataaaaataaactttttttcttca

SEQ ID NO: 2566 - DNA, 5847 bp, Homo sapiens
ggcattatgcaattatattactaaggctgctacctgcccatgcccctctcctcctcctggtttggaactaccctccccatctgctgctatatttatctgccttcttggccataaaaggctggttgtgtggcctgacattcgactgcctgaccacatgcattatttttgaactggcccccagggtcctgtctttagccctgcctcttaacattgtcttggattcaacctaggtggagtcttcattctctcatccagctcctcggcctcatcggaacatttccaccaccattactcctttggaaactggtggcccggttccttcaaggggcacaggatgtctttgcctttttatcagaggtgccaccagcactatgatctcagctaccgcaacaaggacgtgcgcagcaccgtgagtcactaccagcgggagaagaaacgctccgccgtctacacccagggctccacggcctacagcagccgctcctccgccgcgcaccgccgggagtccgaggccttccgtcgggcgtccgcctcctcctcccagcagcaggcctcgcagcacgccctgagctctgaagtcagtcggaaggcagcctcagcctacgattatggctcctcccatggacttacagattccagtctgctgttagatgattattcatccaagttgagccccaaaccaaagagagccaagcacagcctactgtctggagaagagaaagaaaatttgcccagtgactacatggtacccattttctcaggacgtcaaaagcatgtcagtggaattactgatacggaagaagaaagaattaaagaagctgctgcttatatagcccagaggaatcttcttgctagtgaggaaggaatcacaacatctaaacagtccacggcatccaagcagaccacggcatctaagcagtccacggcatccaagcagtccacagcatccaagcagtccacggcatccaggcagtccacggcatccaggcagtctgtggtttccaaacaggccacatccgctcttcaacaggaagaaacttctgaaaagaagtcaaggaaagttgtgattcgagaaaaggcagaacgcctgtccctgaggaaaacattagaagaaaccgagacatatcatgccaagctgaatgaagaccatcttctccatgctcctgagtttatcattaaacctcgctcccacacggtttgggagaaggagaatgtaaaattgcattgctccatagcaggctggccagaacctcgtgtcacgtggtataaaaaccaggtgccaataaatgtccatgcaaaccctggaaagtatattattgagagtcgatatgggatgcacactctggagattaatggatgtgattttgaagatacagctcagtaccgggcctcggcgatgaatgttaaaggagagctttcggcatatgcttcagttgtggtaaaaaggtataagggagagtttgatgagactcgcttccacgctggggcttccaccatgcccctcagctttggtgtgaccccatatggttatgcatcccggtttgagatccactttgatgacaaatttgatgtgtcttttgggagagagggagagacaatgagtctaggctgtcgtgttgtcatcactcctgaaattaaacatttccagccagagatccagtggtacagaaacggagtacctctttctccatcaaaatgggtgcaaacactttggagtggagagcgggcaacgctgacattttcccatctcaacaaagaagatgaaggcctctatacaatccgtgtacggatgggagaatattatgaacaatatagtgcttatgtctttgttcgagatgctgatgcagagattgaaggagccccagctgctcccttggatgtgaagtgcttggaggccaacaaagattatatcatcatctcctggaaacagccagctgtcgatggagggagtcctattctcggatattttattgataagtgtgaggtgggcacagatagctggtcgcagtgcaatgacacacctgtgaagtttgctcgttttcctgtcactggattgatcgaaggtcgttcctatatcttccgagttcgagctgtgaataaaatgggaataggtttcccatctcgagtttccgagcccgtggctgctctggatccggctgagaaagctagacttaaaagtcgcccctcagcaccctggactggacagatcattgttactgaagaggaaccttcagagggtattgtgcctggccccccgacagacctctctgtcactgaggccacccggagctatgtggtgctcagctggaagccccctggccagcgtggtcatgagggcattatgtactttgtggaaaagtgtgaggcaggaacagaaaactggcagcgagtgaacacggagctccctgtgaagtctccccgctttgctctgtttgacttggccgaggggaaatcctactgtttccgtgtccgctgttctaattctgcaggagttggtgagccctcagaggcaacggaggtgactgtggtaggggacaaacttgatatccccaaggctcctggcaaaatcatcccaagcagaaacacagacacctcagtggtagtttcgtgggaggagtccaaagatgccaaagagctggtcgggtactacatagaggcgagcgttgctggctctggcaagtgggagccctgtaacaacaaccccgtgaagggctcacgattcacttgtcatggattagtgactggtcagagttatattttccgggtcagagcagtcaatgcagctggacttagtgaatattcccaggattcagaagctattgaagtcaaagctgctattgggggaggagtgtctccagatgtgtgtcccgcactgagcgatgagcctggtggactaaccgcctccagggggcgcgtgcatgaagcctccccgccaaccttccagaaagatgctttgcttggcagcaaacctaacaaaccttcactacccagtagctctcaaaacctgggccaaacagaagtgagtaaagtaagtgaaacagttcaggaagagcttaccccgccaccacagaaagcggctcctcaggggaaaagtaagtctgaccccctgaaaaagaagacagacagagcaccaccatctccaccctgtgatatcacctgtcttgaaagttttcgtgactcaatggttcttggatggaagcaaccagataagattggaggggcagaaattactggctattatgtgaactatcgcgaggtcattgatggggtaccaggaaaatggagagaagccaatgtcaaggctgtcagtgaggaggcatacaagattagcaacttgaaggaaaacatggtgtatcagttccaagtggcagccatgaacatggctgggctgggcgcgccctccgcagtaagcgaatgcttcaaatgtgaagagtggaccatcgccgtcccaggaccaccgcacagtctcaagtgtagtgaagtcaggaaagactcactggttctccagtggaagccgccagtccactccgggcggactccggtcactggttacttcgtggacttgaaggaggccaaggccaaagaagaccagtggcgagggctcaatgaggcggctattaaaaacgtatacctgaaggttcgaggcctcaaggagggcgtcagctacgtgttccgtgttcgagccataaaccaggcgggagttgggaagccatctgaccttgctggccctgttgtggcagagacccgtccaggaaccaaagaggttgttgtaaatgtggatgatgatggagtcatttcattgaacttcgagtgtgataagatgactccaaagtccgagttctcctggtccaaagattatgtatccactgaggactctccacgattggaagtcgaaagcaagggcaacaagacgaaaatgaccttcaaagaccttgggatggatgacttgggtatttactcttgcgatgtaacagacactgatggaatagcatcaagctacttaatagatgaggaagaattgaaacgtttacttgctctcagccatgaacacaagttcccaactgtcccagttaaatcagagttggcagttgaaattttggagaaaggccaggtccggttttggatgcaggctgagaaactgtctggcaatgccaaagtcaactacatatttaacgagaaggaaatttttgaaggcccgaaatataaaatgcatattgaccgaaacactggcatcatcgaaatgttcatggaaaagctacaggatgaggatgagggaacgtacactttccagcttcaagatggaaaagcaactaaccattctactgttgttctcgttggagatgttttcaaaaagctccagaaagaagctgaattccagcggcaagaatggatcaggaaacaaggtcctcactttgttgagtatttgagctgggaagtgactggtgaatgtaatgtactattgaaatgcaaggtggcaaatattaagaaggagactcatattgtgtggtacaaagatgagagggagatatcagtggatgaaaagcatgactttaaggatggtatatgtaccctgcttataacagagttttccaagaaagatgctgggatttatgaagttatcctgaaagatgaccgaggaaaagataagagcagactgaagcttgtggatgaagcctttaaggaactgatgatggaagtatgcaaaaaaatagctttgtctgctacagacctgaaaatccagagcacagccgagggcatccaactgtactcttttgtaacttactatgtggaggatttgaaagttaactggtcccacaatgggtccgccattaggtactcagacagagttaagaccggggtcactggagagcagatctggctacaaatcaacgagcccaccccgaatgacaaagggaagtatgtcatggagctctttgatggcaaaactggacatcagaagacagtggatctctctggacaagcatacgatgaggcctatgctgaattccagaggttgaaaaagagccttttatttcagaaagatcgtgcccgggtgttgggaggtctcccagacgtggtcaccatccaggaggggaaggcccttaatctcacttgcaacgtgtggggagacccgcctccggaggtgtcgtggttgaagaacgagaaggccctggcctcagacgaccactgcaacctcaagttcgaggctgggaggaccgcgtacttcaccatcaacggcgtgagcaccgctgactcgggcaaatacgggctggttgtgaagaacaagtatggctcggagaccagcgacttcaccgtcagcgtgttcatcccagaggaggaggcgaggatggccgccttggagtccctgaaaggtggcaagaaggccaagtgaccggaggtgcgaggagagccagccggcctgtgtgacttgggtgtgaatggtttgggttaaggatgagacgtcttcatgctttctcctccctattattttctggcttgaggggaaaataatgtcaggtctttcactcatataaaaaagcaccaactaatgacactttaattgtttttctttatctacaaaattatgtgttaagaaaataccattcatagcatgaagattaggaaacagttttaaggagaagacttgaatgaagttggagggacattgaatgatggtcagagggcagacgaatgtgtcgtggggcgaattgggatttgctgcagctgtgaagccatggccgtgtctcgtgtgttgttacagaggtgatgtgcttttcgacgggcgcctcgtggcttggaacctcctctgtatgaataaacagttttcacgtctgtcctcttccccga

SEQ ID NO: 2567 - DNA, 9884 bp, Homo sapiens
agaatgcagcgcatggcgcgtcattgaagagagaccatgatggcggcggcgctggggcccccagaagtgatcgctcagctggagaacgcggctaaagttctgatggcaccaccttccatggtcaataatgaacaacgccagcatgcagagcacatattcttatcatttaggaaatcaaaatcaccatttgcagtttgcaagcatattttggaaactagtaaagtggactatgtcctctttcaagctgccacagccataatggaagcagttgtccgagagtggattctcttggaaaaaggtagcatcgagtctctgcgaacattccttttaacctatgtcttacaaaggcccaaccttcaaaagtatgttcgggaacagattctactagcagtagcagtaattgtaaaaagaggatcattagataaatcaattgactgcaaaagcatttttcatgaagtcagccagttgattagtagtggcaatcccactgtgcaaactctggcctgttctattctgactgcgctattgagtgaattttcaagttcaagtaaaactagcaacattggattgagcatggaattccatggtaactgcaaaagagtttttcaggaagaagaccttcgtcagatcttcatgttaactgttgaagttctgcaggagttcagcaggcgggaaaacctcaatgctcagatgtcttcagtatttcagcgttaccttgcactcgccaatcaagtcttgagctggaactttcttcctccaaaactgggcagacattatatagctatgtttgaatcctcgcaaaatgtgctgttgaagccaacagagtcctggcgggagactcttctggacagcagagttatggagcttttcttcacagtacatcgaaaaatcagagaagattcagatatggcacaagattctctgcagtgccttgcccagttagcttctcttcatggacccatcttcccagatgaaggatcacaagttgattatctagcacacttcattgagggattactgaatactatcaatggaattgaaatagaagattctgaagctgtggggatctccagcattatcagcaacctgataaccgtgttcccacgaaatgttttaactgccattccaagtgaacttttctcctcctttgttaactgcctcacacacctcacttgttcttttgggcgaagtgctgcattggaagaagtgcttgataaagatgacatggtatacatggaagcatatgataaattgttggagtcctggttaactttggttcaagatgacaaacatttccataaaggcttttttacccaacatgcagttcaagttttcaattcctatattcagtgccacctagctgctccagatggcacaagaaatttgactgccaatggtgtggcctctcgtgaggaggaagaaataagtgaacttcaagaggatgatcgagaccagttttctgatcaactggccagtgtaggaatgctaggaagaattgctgcagaacactgtatacctcttctgacaagtttattagaagaaagagtaacaagactccatggtcagttacaacgacatcagcaacagttacttgcttcaccgggttcaagcactgttgacaacaaaatgcttgatgatctctatgaagatattcactggcttattttagttacaggctacctcttagctgatgatactcagggagagactccgctaatacctccagaaataatggaatattccattaagcattcatctgaagttgacattaatacaacacttcaaattttgggatctccaggagaaaaggcttcttccatcccagggtacaacagaacagattctgtgattaggctgttgtctgccattctcagagtttcagaagttgaatctcgagcaataagagcagatctcactcatctactaagtccccagatgggcaaagatattgtttggtttttaaaacgctgggcaaagacttatctcctggtggatgaaaaactgtatgatcagataagtctgccattcagtacagcgttcggagcagatacagagggttctcagtggataattggctacctcttacaaaaagtcatcagtaacctctcagtctggagtagtgagcaggaccttgcaaatgacactgtgcagctccttgtcactttggtggaaagaagagaaagggcaaacttagtaattcaatgtgagaactggtggaatttagctaagcagtttgcaagccgaagcccacctcttaatttcttgtcaagtcctgtgcagaggacattgatgaaggctctagtcttaggaggttttgcacatatggacacagaaaccaaacagcagtattggacagaggttcttcagccacttcagcagcgattcttaagagtgataaaccaagaaaacttccagcagatgtgtcagcaagaggaagtcaagcaggaaatcactgccacactagaggccctgtgtggcattgctgaggctacccagattgacaacgtagcaatcctgtttaattttttaatggacttccttaccaattgcattggattgatggaagtttacaagaataccccagagactgtcaatctcattatagaagtttttgttgaagttgcacataaacagatatgctatcttggagagtccaaagctatgaacttatatgaagcctgccttactttgttgcaagtgtattctaagaataatttagggcggcaaagaatagatgttacagcagaagaagagcaataccaagacctgcttctcattatggaacttcttactaacctgctgtcaaaagaattcatagatttcagtgatacagatgaagtgtttagaggacatgagccaggtcaagcagcaaacagatctgtgtcagcagcggatgttgtgttgtatggagtaaacctaattctgcccttgatgtcacaggatctcttgaagtttccaaccctttgtaatcagtactacaaattaatcacatttatctgtgagatttttcctgaaaaaataccacagcttcctgaggatctgtttaaaagtctgatgtactccctagaattaggaatgacatcaatgagttcggaggtttgccagctttgcctggaggccttgacaccgttagctgaacagtgtgcaaaagcacaagaaacagactcaccactttttctagcaacacggcactttcttaagctggtttttgatatgctggttttgcaaaagcacaacacagagatgaccactgcggctggcgaagctttctacacgttggtgtgtttgcaccaggctgaatattctgaactggtcgaaacattactatcaagtcagcaagacccagttatttaccagagattagcagatgccttcaacaagctcactgcaagcagcactcctcctacgctggatcggaagcagaagatggccttcttaaagagtttagaagaatttatggcaaatgttggtggtctcctttgtgtaaaataaacaacagaactttatgcttaatttagatcctttctgcaaagtgcactgaattgctgaaagttgacttgagtcttgtcctattcctcagttcatttggccattttggattttggagagcctgaaactttgatatgtatgtaatacagtgaaacaggagaggtcaacttggcatcagcttctgctgttaagtgttagccacaatctgtcatatatatgtcttttagattctgaatggtgatttaaaattttcaaaatgaaattccatatatgtgcaaacagatatgggcaccacgaaatacatatgcagtgccttttttccttttaacataggtggctagccaaagtttagaatttttgtcattaaatatgaaatggatatatgctaggcagtgtttctcaaaatctccatagatcgcctgcatcacttgaggagctggtgaaaaggcagattcttaggcccaactgtagaccttcagagtcagaatgtctggttgttgggcccaggagtcttcatgttaataagcttctccctttcgtcaccccaaaagttttgaatcaatgaaagagacattgaaaactcttaagaggttttgtgctttctagcttttcctccctttgatgattgggttttataattcagcaggaaggggaaacatcaccaggggtttgttggctttttcttagcttgctttcttgcttgcttgctttcttgcttttcttgctttctgtctctctctttcttttctctctctctctcacatcaacccagtgctgcaggttttgtgtaatacaagtcactaatcatactctgatgcctgaacttgaggaggaaaatacatgtatatttttgttccgtaaaaataaccttaggaactgtagccatttcattgccttaattttaagaggaaaatacaaaaacagctgatttgttttagtaagaaaccacgtcttgatgcttcagagttggtttagggtgttagctgctatgaacctgttgcccctttcgatcgtgtatttatgtaggtttatcagtgaaatgaaaggcttgtttccgtctagtctaactttttgagtgtgtttctatccagccacatagcccatatctactctaaatggcttgcttaagcaataattattttaaaggatgtgaatcactgattcacacagactattgcacgttggggcattaggggcaataattcttatccagacatgggagccagtgaatttaatttcagagattaaaaattcactttagatcctctagtttgatctcttaatcaggatttttatacagctgccaggctcccctaattcagtgtgccagcttacaatgtggaaatgaaagctaatttatacacagcaggcatatgaaactccactcattgcagtactttcacagcacagtgacaggtagaggactctggcacaggtgcactcatgaaactctgcttccaccatgttcctgacacctatctattaaaccattctgcaaatacggtttttctacctgattgcatatagcatatgtgtcattacatgtgatgctgtgcaaaactttgtataattctgtgttattaacagttaacaaaactggagcatctgaattacatccaacctgtgcatgtgatgttaggtagatgtgaatgcagggccttgggccataacttacatttctctcaatttgattagctttgagtcacaattaaggggaagcaaaaacatcttgaaaagactgctaggaaggaaattaatatcagtcatccagaagtacacgtttctgtattttaaaaaatactttgatgcatttatttttaggtgttttttttttccccttaaaaaacttgaagtgatatgcagcagtaatctatttgttttgcattgttcttggtgttttgtgtttcccagatccctcaagctttctcagctgttgtgaattatgtgtatctgtgtgtgtgctaagtacagtctctttaccaaagggcactgaaacacacaattgactggacaggtccacgcgccatgacaaaactataatcaagttattaaaactaaagaggagtgggaaaggaatgccttggtaagtaaaaaggcatctatatttaataacttttatccagatggcaacatatttgcaaaatttgcccagatcctattacaatactaaaaatagaaaatttcacctccatattcctgaggtgtaatttcattagactagttttagtttaaaaagaccttcttcagattggaccaaataatacttataagatcagcagaatgttgaatattagctcactggggtggggagaagccactaccattttttaggtgatggggatgccactgagttgcaacggctagaccttttcagggtggttgtgtccatgtttgcctgattggatgcttattcactttgtgttttcttttgttttattttgtccaattttgtctttagctgtgtttattaacttctccggtcttgttttgttttaatgctcttggcccagtgggtgtcaagaacactggcttaattcaagtcagttgattttttttctattaaaactgttgttaaaatattttttaaaacaaaaacattatttgtgccctcttttatatatgtcaaagggacactgtcaagtatttcatttttagatttttgttttataaaatttctgttgttcatatagtatcctttaacctctagttttccatacatcctttgtttgtttctcattttattttccttgacccatttatttcccaaggcacaatcactaaagactttgtactttcacagtctgttaatgtggtagcacctgtaactgtgttcttgttctgttaaaaggattgatttgcttttatagtccttgtgctggatgagtggctgcctcagtagcaaaactacctgacagtatttgacagtgtcctttccagcaccattatttgggtctttcagggtggccatctctgttagaagacagtagcatgttaacatcactgcattgagtttttgtctggtgtaaagtatgacttttaatgtaaacaaactgcaggtttttttcaaactaattttaagaatttagtcttatttcgttgtaaactgtgtatctaattatattacattactctgttcagatgggatggttactaccacttgtccatgattttcatttgaaaagcaagtatctatatcatttccccccagtcagcattatttaacactccccttaactgtctttgaactttctcttttaacaaaaatgtcaagtctttatagttgtaatatcaccatgtttcccatttctgttaatacttctatgaacccctaaagtattgaagggaactagctgtcagtttcaaggattacaagtttgagtctcctagtattcaacatcattctgaaccctgaaataatatttttctctgttaaacaatttttatctgtttgccacctctgttgttagaggtggttgtcaattgaccttactaagttagctgtctttgatgaggaattattgttattggttcctgaataaaacattaaccttttaagtcagaaggaacctcggtacttcttaaggtttgtttgtgttttctaaaaccagagaataaggaactgatttggctatgaggtttaacattataattttctgtaagctttcccacaaaaaaacattgttgatttgaggatataataatgttttaatctttttaaaatataagtggttattctctgacttggtaactatgttctgaaaacactgcatttaagaatttttaaaaattggttttctaaaattaaaatgtccaaattaggcatattgctgagctcaaattgatgtgaaatgccatggttccagttgaattttaagcatattttcatttagatataaaatatatgaagtatgctttgttgattatagtgagaacccatgacatagttaaccaaagaatatgtttggttcaaataaaaatagaagcttaatactgggcattcatactttttaaagagaatgaatgaagaaatcggtttcctgctgtagttctctatgggtaagtcttagtaaagacgagaatgctgaagtcggccgtggcgattccctcctaggaactgggaggtgtggcttgcccattacccgcttgaagctcacatctttaccctcctctcccactgtggtttgatcttcacctattcccaggccctcccagcaattggagaggtgtctttttttttggttttggttttttttctccccgtctgcattcttaggcctcttagctattaggaactgtcagatacatactagtagctaattttcctagcctgaaattatatactgcatctgcactatgtacctactagggatctgacctcaagtgttttctgagcccaggcttcctggtgtggtgtcttttaccacataaaattattacaaattgcaaatgttggtattgtgatttgattatctgtacaaagaaagaagctctatgcagtgagtttgtggtttaatggtcacaaaaatgttagcactgctaccactcagcacgtgtaaaattttttaaatttataaatattaaaattttaaacttacactaagacttttcagttttatttaaagacccagggatgagtgtactgtttaaatatttacctctattaacataactaatgaaggtataaaattgcatttagtttttcagaagatgctgcaatatgattttaggaaataaggctatgtattgagccagttataggctgaatatcaggttgataaaattttatttgtatttttaaaattcataaatgggagttaaaatgtgtcttttcactaaatatttttattacatttttgttttgaccatgtgtgatttgttcatgggtatttagctagactcttttatgaaatgcattgaaatggtgctagtttgtttaccattataggaagattgacactggggacattacacggtcctaaaataattttaaatttaaaaaaatgaagacatctgtacagataaaaatcaagatttgcatcaccttctgggagaacccgtggtactcacagaatatccagtattagaaatataaaaattttgtctatattttataatatttatctcagcccacagtcttagaaacagtttcacagttactagttaagtcattatctttggtgcatatttagtaaatacttttagcaagtcattctttttggcctttcagggaaagtggtgaattaccatattactgtgtgctagatagatccaccctttgcccagtgttaaatcttgtaaacatatgaagtgaaaagttaatttttaaagaaaatgcatctttaaaatgttcatttttaacctgaatttgctttgaatattctttgatttgtaatgttgttatttagcttatattgagatttattccactccaaaggtggataaagaaaagttgtttaagaaaaccaattagagtgtattttgaatttttgtttctttcattaccaagtgtggggccatacacacaggctaatcatctgtcatttgagacccacagatgatttcaaaggtcccaaataaatacacatctataactgttttttaaaagacatctttaatggtgctctccaaaaatacaattcggttgcttatgagtgatgcctttgacaggctgattagattataaaacagttttgtttttttaaacatagggtctcagattgagtcttgtgcattctatgtaatctcaaatggcagttcagtttgactttcttttaaaactaagtggaaatggtatatttggtgaaactaatgaaagaatcttttgctgggaaattccatacagcacccccagcagcatcctgtctcagtctggcgtataattcaacctcctactgagtgtccctgtaaattatttttaatatatagcatgagagtgaactgaggtaagtcattgatgtttcccagagatgatgaatgaacaaaagcaaataggatctgctaaacatttttattcccacagtagtgagcagttttgttcttgttttgataatgttcatttctgcctaatcttaggcttcaaatacacctttaagaaagcccaagatgtattgagtagtagaacttcttatttgtacacctgtttataactgcactgccctggatgttatggttatttctaaggactgacctggtaaagctacttgaactggtagactgcagggtagaggcagacctagattcaatgtctaactaagctgcttagggcttacattaatttccacaggtctgttatccatatcatgagtttataagtgttcctcccaaagaaaaaatttaaaagtgatggatgaaatataatagtagatgctcaataaattccattgtatttaaagatt

SEQ ID NO: 2568 - DNA, 2370 bp, Homo sapiens
gtcggtagaggcagaaggagaaggtcgggttgtagaagctggggtggccggcagctcgctcatcggtgttcgtgggctttgtcggtccgtgcctcgtctctccctggaaagggagggaggcttcgacgtcgagagggagccgctgccgcgttagttccgagcttgaagtcactaggacttctctcaaacttgtgtgctgaggagactcagatgttggcctcagctcctaggctgaactcagcagatcggcccatgaaaacttctgtattgagacaaaggaagggatctgtcagaaagcaacacttgttatcttgggcttggcagcaaggaagaggacaggtagtggagatcctgcaatctgaaaagcagactgaaaggtgacaaagaagctgaagatgggtggtggagagaggtataacattccagcccctcaatctagaaatgttagtaagaaccaacaacagcttaacagacagaagaccaaggaacagaattcccagatgaagattgttcataagaaaaaagaaagaggacatggttataactcatcagcagctgcctggcaggccatgcaaaatggggggaagaacaaaaattttccaaataatcaaagttggaattctagcttatcaggtcccaggttactttttaaatctcaagctaatcagaactatgctggtgccaaatttagtgagccgccatcaccaagtgttcttcccaaaccaccaagccactgggtccctgtttcctttaatccttcagataaggaaataatgacatttcaacttaaaaccttacttaaagtacaggtataaaataagacaaatgtttaaatttagttatgttcacgggtagttgtcaattggtctgaaacaaatttgctagggaatctatttgtgtagaactaattaatgtaaaaaaaatagaccatctcgtgttgtgtgcactgtgatataatggtagtatcagtgcaacttaaactaatgattgtacttgatattaagtgttctcaactgagtaacttttaagtggaaaccaagtttagatttggggagtggtaaaggaatcagctttttctattgttaggggaagacagtaatttatcattcatggaccagtagattgttgaaagttggtgaatcggattataagcttctagctaacacaaggattcagaattaggtaaacatctgaaggtttagtatattagaaacacccaaaccagtaatatgctaacctgatgcactgctgaaagaaaatgtgaatttttcgtaataattgcattttagtgaattgtacagtgggtggaaagggcatttggagctcattagaatgagacatagtacaccccaatggccctgtttattaaatgtagtggattaagtgtctgtcaacaaatacaccaaaaccattttttatagaaacagtatttaatggtcactcaatagctttcaaaatacatttttgtattacagcactgcacaagctattctaatagtgctctggcctcatcattcctgcaaagcttgctttggggagttggataatgtgaaaattttaagtacctaggggagaaagagccatgtaaatatctgtaataaacttgtagcatatgtaaagttttcttggcctttatcttacaaaaatggagtattttagtatgaatttgctgaatgtaagaccgtggactgttttttataatatggcctaattttaaaggtccaaaataacttgtttttaaagtttgcccttgtgctaaagtgccagtgtatgtatgttatacttgatttggttgtaaactatatttcaaagtaaaccctagtgtaataagttttataactaaaaaggtttaagctgctaaaactatttttaagagatgtgaaatgcagtatgggactatctttttttcctcctctaagcccaaagattaactagagtccctccaaccttatagattgttggctttcacaatcttataacctaggatacaggtagtttcgagtatggtgccagtgatgttttgtttttgtttggtcaaggggtaggtgcaacccaatggaccacttatgcaaaagatgtaaactcttgcataatacattgataacatgttttgccaactttaaatgcttaaacataagcgaaaccagtagcaagtatgtgggtcagcttaaaaattttgattgttaatgccctattttctaatttggcacctcttgatgcctaagcaggtaagcagatgcctaagctgtatttctccaaataaatcaagatgaagtactgcccaagttaaatattgatagcctaaagacaagtttatgtagtacttaatgtacatgatatgaagcataaaattaaataaaatttttcccc

SEQ ID NO: 2569 - DNA, 1295 bp, Homo sapiens
gcatcagcagctgtctgccagtgttgacggagggctcatgggtgccaggccgcttgctggggctttttatctgtcctcaggcattggcacagcagccctgggagatgaatactattgtgatcttcattctccacacaaggacagggaagtgacgtgccagggtcaaacaactacccaaggacagagccaggatttgaaccaggccatccagttccagaaccactgctcttcactgtcattgtggccattttacagtgctcctgcgggaagaagtgtcgcggctccaggaggaagttcaccttctccggcagatgaaggagatgttggcgaaggacctggaggagtcgcagggcggcaagtcctctgaggtcctctcggccaccgagctcagggtccagctggcccagaaggagcaggagctagccagagccaaagaagccttgcaggccatgaaagctgatcggaagcgcttaaagggcgagaagacagacctggtgagccagatgcagcagctgtatgccacactggagagccgcgaggagcagctccgagacttcatccgcaactatgagcagcaccgcaaggagagcgaggatgcggtcaaagcgctggccaaggagaaggacctgctggagcgtgagaagtgggagctgcggcgccaagccaaggaggccacagaccacgccacggcactgcgctcccagctggacctcaaggacaaccggatgaaggagctggaggccgagctggccatggccaaacagtccttagctacgctgaccaaggacgtccccaagcggcattccctcgccatgccgggcgagacggtgctcaatggcaaccaggagtgggtggtgcaggcggacctcccgctgaccgcagccatccggcagagtcaacagactctctaccactcacacccccctcaccctgcggaccggcaagcggtcagggtgagcccctgccactcccggcagccctctgtcatctccgacgcatctgccgccgaaggcgaccggtcgtccacaccgagcgacatcaactcccctcgacaccggacacactccctctgcaacggcgacagtcccggcccagttcagaagaacctgcacaaccctattgtacagtcactagaggatcttgaagaccaaaaacggaaaaagaagaaagagaagatgggattcggctccatctcccgcgtcttcgccagagggaagcagcggaagtccctcgaccccggcctctttgatggtaccgcccctgattattacatagaggaggacgcggactggtga
